US008426678B2

(12) United States Patent
Riechmann et al.

(10) Patent No.: US 8,426,678 B2
(45) Date of Patent: Apr. 23, 2013

(54) POLYNUCLEOTIDES AND POLYPEPTIDES IN PLANTS

(75) Inventors: Jose Luis Riechmann, Barcelona (ES); Cai-Zhong Jiang, Fremont, CA (US); Jacqueline E. Heard, Webster Groves, MO (US); Robert Creelman, Castro Valley, CA (US); Oliver Ratcliffe, Oakland, CA (US); T. Lynne Reuber, San Mateo, CA (US); Peter P. Repetti, Emeryville, CA (US); Roderick W. Kumimoto, Norman, OK (US); Neal I. Gutterson, Oakland, CA (US); Omaira Pineda, Vero Beach, FL (US); Gregory Nadzan, Thousand Oaks, CA (US)

(73) Assignee: Mendel Biotechnology, Inc., Hayward, CA (US)

( * ) Notice: Subject to any disclaimer, the term of this patent is extended or adjusted under 35 U.S.C. 154(b) by 347 days.

(21) Appl. No.: 12/702,109

(22) Filed: Feb. 8, 2010

(65) Prior Publication Data
US 2010/0162427 A1 Jun. 24, 2010

Related U.S. Application Data

(60) Continuation-in-part of application No. 10/546,266, filed as application No. PCT/US2004/005654 on Feb. 25, 2004, now Pat. No. 7,659,446, application No. 12/702,109, which is a continuation-in-part of application No. 11/642,814, filed on Dec. 20, 2006, now Pat. No. 7,825,296, which is a division of application No. 10/666,642, filed on Sep. 18, 2003, now Pat. No. 7,196, 245.

(60) Provisional application No. 60/465,809, filed on Apr. 24, 2003, provisional application No. 60/434,166, filed on Dec. 17, 2002, provisional application No. 60/411,837, filed on Sep. 18, 2002.

(51) Int. Cl.
*C12N 15/82* (2006.01)

(52) U.S. Cl.
USPC .......................... 800/278; 800/290; 800/260

(58) Field of Classification Search .................... None
See application file for complete search history.

(56) References Cited

U.S. PATENT DOCUMENTS

| 5,939,601 | A | 8/1999 | Klessig et al. | |
|---|---|---|---|---|
| 5,994,622 | A | 11/1999 | Jofuku et al. | |
| 7,193,129 | B2 | 3/2007 | Reuber et al. | |
| 7,196,245 | B2 | 3/2007 | Jiang et al. | |
| 7,238,860 | B2 | 7/2007 | Ratcliffe et al. | |
| 7,345,217 | B2 * | 3/2008 | Zhang et al. | 800/289 |
| 7,659,446 | B2 | 2/2010 | Sherman et al. | |
| 7,858,848 | B2 | 12/2010 | Reuber et al. | |
| 7,960,612 | B2 | 6/2011 | Zhang et al. | |
| 8,030,546 | B2 | 10/2011 | Reuber et al. | |
| 2002/0076775 | A1 | 6/2002 | Crane et al. | |
| 2004/0006797 | A1 * | 1/2004 | Shi et al. | 800/287 |
| 2006/0015972 | A1 | 1/2006 | Heard et al. | |
| 2008/0301836 | A1 | 12/2008 | Century et al. | |
| 2011/0010792 | A1 | 1/2011 | Zhang et al. | |
| 2011/0119789 | A1 | 5/2011 | Creelman et al. | |

FOREIGN PATENT DOCUMENTS

| DE | 19503359 C1 | 2/1996 |
|---|---|---|
| EP | 0803572 A2 | 10/1997 |
| WO | 9322342 A1 | 11/1993 |
| WO | 9742327 A2 | 11/1997 |
| WO | 9807842 A1 | 2/1998 |
| WO | 9837184 A1 | 8/1998 |
| WO | 9837755 A1 | 9/1998 |
| WO | 9848007 A1 | 10/1998 |
| WO | 9858069 A1 | 12/1998 |
| WO | 9924573 A2 | 5/1999 |
| WO | 9953016 A2 | 10/1999 |
| WO | 9955840 A1 | 11/1999 |
| WO | 0053724 A2 | 9/2000 |
| WO | 0135727 A1 | 5/2001 |
| WO | 0136598 A1 | 5/2001 |
| WO | WO 01/35727 A1 * | 5/2001 |
| WO | 0208410 A2 | 1/2002 |
| WO | 0208411 A2 | 1/2002 |
| WO | 0216655 A3 | 2/2002 |
| WO | 03012116 A2 | 2/2003 |
| WO | 03014327 A2 | 2/2003 |
| WO | 2004031349 A2 | 4/2004 |
| WO | 2004076638 A2 | 9/2004 |
| WO | 2005047516 A2 | 5/2005 |
| WO | 2006130156 A2 | 12/2006 |
| WO | 2007028165 A2 | 3/2007 |
| WO | 2007030001 A1 | 3/2007 |

OTHER PUBLICATIONS

Bowie et al, Science 247:1306-1310, 1990.*
McConnell et al, Nature 411 (6838):709-713, 2001.*
Payne et al (1999, Development 126:671-682).*
U.S. Appl. No. 09/713,994, filed Nov. 16, 2000, Keddie, et al.
U.S. Appl. No. 09/532,591, filed Mar. 22, 2000, Samaha et al.
U.S. Appl. No. 09/489,376, filed Jan. 21, 2000, Heard et al.
Berger. F. et al.; "Positional Information in Root Epidermis is Defined During Embryogenesis and Acts in Domains With Strict Boundaries"; Current Biology, vol. 8, pp. 421-430, 1998.
Costa, S. et al.; "Epidermal Patterning Genes are Active During Embryogenesis in *Arabidopsis*"; Development vol. 130, pp. 2893-2901, 2003.
Duckett, C. M. et al.; "Dye-Coupling in the Root Epidermis of *Arabidopsis* is Progressively Reduced During Development"; Development, vol. 120, pp. 3247-3255, 1994.
Frampton, J. et al.; "Proposed Structure for the DNA-Binding Domain of the Myb Oncoprotein Based on Model Building and Mutational Analysis"; Protein Engineering, vol. 4 No. 8 pp. 891-901, 1991.
Goff, S. A. et al.; "Functional Analysis of the Transcriptional Activator Encoded by the Maize B Gene: Evidence for a Direct Functional Interaction Between Two Classes of Regulatory Proteins"; Genes & Development ,vol. 6 , pp. 864-875, 1992.
Graf, T.; "Myb: A Transcriptional Activator Linking Proliferation and Differentiation in Hematopoietic Cells"; Genetics and Development, vol. 2 pp. 249-255, 1992.

(Continued)

*Primary Examiner* — Stuart F Baum
(74) *Attorney, Agent, or Firm* — Yifan Mao; Jeffrey M. Libby

(57) ABSTRACT

The invention relates to plant transcription factor polypeptides, polynucleotides that encode them, homologs from a variety of plant species, and methods of using the polynucleotides and polypeptides to produce transgenic plants having advantageous properties compared to a reference plant. Sequence information related to these polynucleotides and polypeptides can also be used in bioinformatic search methods and is also disclosed.

9 Claims, 34 Drawing Sheets

OTHER PUBLICATIONS

Hung, C. et al.; "A Common Position-Dependent Mechanism Controls Cell-Type Patterning and GLABRA2 Regulation in the Root and Hypocotyl Epidermis of *Arabidopsis*", Plant Physiology, vol. 117, pp. 73-84, 1998.

Jin, H. et al.; "Multifunctionality and Diversity Within the Plant MYB-Gene Family"; Plant Molecular Biology, vol. 41, pp. 577-585, 1999.

Kirik, V. et al.; "Two Novel MYB Homologues with Changed Expression in Late Embryogenesis-Defective *Arabidopsis* Mutants"; Plant Molecular Biology, vol. 37, pp. 819-827, 1998.

Kirik, V. et al.; "The Enhancer of TRY and CPC1 Gene Acts Redundantly with Triptychon and Caprice in Trichome and Root Hair Cell Patterning in *Arabidopsis*"; Developmental Biology, vol. 268, pp. 506-513, 2004.

Kirik, V. et al.; "Enhancer of TRY and CPC 2 (ETC2) Reveals Redundancy in the Region-Specific Control of Trichome Development of *Arabidopsis*"; Plant Molecular Biology, vol. 55, pp. 389-398, 2004.

Kwak, S. et al.; "Positional Signaling Mediated by a Receptor-Like Kinase in *Arabidopsis*"; Science, vol. 307, pp. 1111-1113, 2005.

Larkin, J.C. et al.: "How Do Cells Know What They Want to Be When They Grow Up? Lessons From Epidermal Patterning in *Arabidopsis*"; Annu. Rev. Plant Biol., vol. 54, pp. 403-430, 2003.

Lee, J. H. L. et al.; "Derepression of the Activity of Genetically Engineered Heat Shock Factor Causes Constitutive Synthesis of Heat Shock Proteins and Increased Thermotolerance in Transgenic *Arabidopsis*"; The Plant Journal, vol. 8(4), pp. 603-612, 1995.

Lee, M. M. et al.; "WEREWOLF, a MYB-Related Protein in *Arabidopsis* is a Position-Dependent Regulator of Epidermal Cell Patterning"; Cell, vol. 99, pp. 473-483, 1999.

Lee, M. M. et al.: "Cell Pattern in the *Arabidopsis* Root Epidermis Determined by Lateral Inhibition With Feedback"; The Plant Cell, vol. 14, pp. 611-618, 2002.

Levee, V. et al.; "Stable Genetic Transformation of White Pine (*Pinus strobus* L.) After Cocultivation of Embryogenic Tissues With *Agrobacterium tumefaciens*"; Molecular Breeding, vol. 5, pp. 429-440, 1999.

Li, S. F. et al.; "A Novel Myb-Related Gene From *Arabidopsis thaliana*"; FEBS Letter, vol. 379, pp. 117-121, 1996.

Loguercio, L.L.; et al.; "Differential Regulation of Six Novel MYB-Domain Genes Defines Two Distinct Expression Patterns in Allotetraploid Cotton (*Gossypium hirsutum* L.)"; Mol. Gen Genet. vol. 261, pp. 660-671, 1999.

Martin, C. et al.; "MYB Transcription Factors in Plants"; Trends in Genetics, vol. 13, No. 2, pp. 67-73, 1997.

Mayer, K. et al.; "Sequence and Analysis of Chromosome 4 of the Plant *Arabidopsis thaliana*"; Nature, vol. 402, pp. 769-777, 1999.

Payne, T. et al.; "Heterologous Myb Genes Distinct From GL1 Enhance Trichome Production When Overexpressed in *Nicotiana tabacum*"; Development, vol. 126, pp. 621-682, 1999.

Schaffer, R. et al.; "The Late Elongated Hypocotyl Mutation of *Arabidopsis* Disrupts Circadian Rhythms and the Photoperiodic Control of Flowering"; Cell, vol. 93, pp. 1219-1229, 1998.

Schellmann, S. et al.; "Triptychon and Caprice Mediate Lateral Inhibition During Trichome and Root Hair Patterning in *Arabidopsis*"; The EMBO Journal, vol. 21, No. 19, pp. 5036-5046, 2002.

Suzuki, A. et al.; "Cloning and Expression of Five Myb-Related Genes From Rice Seed"; Gene, vol. 198, pp. 393-398, 1997.

Wada, T. et al.; "Epidermal Cell Differentiation in *Arabidopsis* Determined by a Myb Homolog, CPC"; Science, vol. 277, pp. 1113-1116, 1997.

Wada, T. et al.; "Role of a Positive Regulator of Root Hair Development, Caprice, in *Arabidopsis* Root Epidermal Cell Differentiation"; Development, vol. 129, pp. 5409-5419, 2002.

Wang, Z. et al.; "A Myb-Related Transcription Factor is Involved in the Phytochrome Regulation of an *Arabidopsis* in Lhcb Gene"; The Plant Cell, vol. 9, pp. 491-507, 1997.

European Patent Application Serial No. 00980417.0 Official Advisory Action issued by the European Patent Office on Jun. 11, 2008.

European Patent Application Serial No. 00980417.0 Official Advisory Action issued by the European Patent Office on Apr. 27, 2009.

European Patent Application Serial No. 00980417.0 Official Advisory Action issued by the European Patent Office on Mar. 5, 2010.

European Patent Application Serial No. 00980417.0 Official Advisory Action issued by the European Patent Office on Dec. 16, 2010.

European Patent Application Serial No. 00980417.0 Official Advisory Action issued by the European Patent Office on Apr. 20, 2011.

Supplementary Partial European Search Report issued by the European Patent Office on Apr. 19, 2007 for European Patent Application Serial No. EP 04 71 4657.

NCBI Accession No. AC002338 (gi:2262124) (Jul. 16, 1997); Rounsley, S.D. et al.; *Arabidopsis thaliana* clone T09D09. 5 unordered pieces. *Arabidopsis thaliana*.

NCBI Accession No. ATU28422 (gi:1777442) (Jun. 6, 1995); Wang,Z. et al., *Arabidopsis thaliana* DNA-binding protein CCA1 (CCA1) mRNA, complete cds. *Arabidopsis thaliana*.

U.S. Appl. No. 10/302,267 Office Action issued by the United States Patent and Trademark Office on Mar. 17, 2005.

U.S. Appl. No. 10/225,068 Office Action issued by the United States Patent and Trademark Office on Jan. 12, 2006.

U.S. Appl. No. 10/225,068 Office Action issued by the United States Patent and Trademark Office on May 19, 2005.

U.S. Appl. No. 10/225,068 Final Office Action issued by the United States Patent and Trademark Office on Jul. 28, 2006.

U.S. Appl. No. 10/302,267 Final Office Action issued by the United States Patent and Trademark Office on Sep. 9, 2005.

U.S. Appl. No. 10/302,267 Office Action issued by the United States Patent and Trademark Office on Jul. 10, 2006.

U.S. Appl. No. 10/546,266 Office Action issued by the United States Patent and Trademark Office on Oct. 20, 2008.

U.S. Appl. No. 10/546,266, Advisory Action Before the Filing of an Appeal Brief, issued by the United States Patent and Trademark Office on Jul. 24, 2009.

U.S. Appl. No. 10/546,266 Final Office Action issued by the United States Patent and Trademark Office on Apr. 23, 2009.

U.S. Appl. No. 11/986,992 Office Action issued by the United States Patent and Trademark Office on Jan. 22, 2010.

U.S. Appl. No. 11/986,992, Advisory Action Before the Filing of an Appeal Brief, issued by the United States Patent and Trademark Office on Jul. 7, 2010.

U.S. Appl. No. 11/986,992 Office Action issued by the United States Patent and Trademark Office on Aug. 17, 2010.

\* cited by examiner

| | | 10 | 20 | 30 |
|---|---|---|---|---|
| SEQ ID NO: 148 | | M D N H R R T K Q P K | - - - - - - - T N S I V T S S | S E E |
| SEQ ID NO: 1972 | M F R S D K A E K M D K R | - - - R R R Q S K A K A S C | S E E |
| SEQ ID NO: 38 | | M D N T N R L R L R G P S L R Q T K F T R S R Y D | S E E |
| SEQ ID NO: 2142 | | M D N T D R R R R R K Q | - - - - - - - H K T A L H D S E |
| SEQ ID NO: 1084 | | M S T T - | - - - - - - - - - - A T T T | S E E |
| SEQ ID NO: 1085 | | M A D I D R S F D N N | - - - - - - - - - - V S A V | S T E |
| SEQ ID NO: 1086 | | M A D I D R S F D N N | - - - - - - - - - - V S A V | S T E |
| SEQ ID NO: 1083 | | M T D I D R S S D N - | - - - - - - - - - - V S S D | S I E |
| SEQ ID NO: 1087 | | M A D S D L S S S Q - | - - - - - - - - - - I S T H | S T D |
| SEQ ID NO: 1088 | | M A D S D R S S S E - | - - - - - - - - - - V S T H | S T D |
| SEQ ID NO: 559 | | M D S S S G S - Q G K N S K T | - - - - - S D G C E T K E |
| SEQ ID NO: 1082 | | M E S S G G S Q L G K N S K T | - - - - - S D G R E T K E |
| SEQ ID NO: 1081 | | M D S S S G S - Q G K N S K T | - - - - - S D G C E T K E |
| SEQ ID NO: 1089 | | M D S S S G S - Q D K F R D | - - - - - N D R P E A K E |
| SEQ ID NO: 1090 | | M - Q L Y P F T - | - - - - - - - - - - I I A E |
| | | M . S . | | . . S E |

| | 40 | 50 | 60 |
|---|---|---|---|
| SEQ ID NO: 148 | V S S L E W E V N M S Q E | E E D L V S R M H K L V G D R W |
| SEQ ID NO: 1972 | V S S I E W E A V K M S E E | E D L I S R M Y K L V G D R W |
| SEQ ID NO: 38 | V S S I E W E F I S M T E Q E | E D L I S R M Y R L V G N R W |
| SEQ ID NO: 2142 | V S S I E W E F I N M T E Q E | E D L I F R M Y R L V G D R W |
| SEQ ID NO: 1084 | V S S N E W K V I H M S E Q E | E D L I R M Y K L V G D K W |
| SEQ ID NO: 1085 | K S S Q - V S D V E F S E A E | E I L I A M V Y N L A G E R W |
| SEQ ID NO: 1086 | K S S Q - V S D V E F S E A E | E I L I A M V Y N L V G E R W |
| SEQ ID NO: 1083 | K S S Q - V S D V E F S E A E | E I L I A M V Y N L V G E R W |
| SEQ ID NO: 1087 | S G N R G S S K V E F S E D E | E T L I R M Y K L V G E R W |
| SEQ ID NO: 1088 | S G K R G S S K V E F S E D E | E T L I I R M Y K L V G E R W |
| SEQ ID NO: 559 | V N N T A Q N F V H F T E E | E D L V F R M H R L V G N R W |
| SEQ ID NO: 1082 | V N S T A Q N F V H F T E E | E D I V F R M H R L V G N R W |
| SEQ ID NO: 1081 | V N N T A Q N F V H F T E E | E D L V F R M H R L V G N R W |
| SEQ ID NO: 1089 | A N S T A Q H L V D F T E A | E D L V S R M H R L V G N R W |
| SEQ ID NO: 1090 | A N S T A Q H L V D F T E A | E D L V S R M H R L V G N R W |
| | V S S . . V . F S E | E E D L I R M Y . L V G . R W |

| | 70 | 80 | 90 |
|---|---|---|---|
| SEQ ID NO: 148 | E L I A G R I P G R T A G E I E R F W V M K N |
| SEQ ID NO: 1972 | E L I A G R I P G R T P E E I E R Y W L M K H G V V F A N R |
| SEQ ID NO: 38 | D L I A G R V V G R K A N E I E R Y W I M R N S D Y F S H K |
| SEQ ID NO: 2142 | D L I A G R V P G R Q P E E I E R Y W I M R N S E G F A D K |
| SEQ ID NO: 1084 | H L I A G R I P G R K A E E I E R F W I M R H G D A F S V K |
| SEQ ID NO: 1085 | S L I A G R I P G R T A E E I E K Y W T S R F S - T S Q |
| SEQ ID NO: 1086 | S L I A G R I P G R T A E E I E K Y W T S R F S - T S Q |
| SEQ ID NO: 1083 | S L I A G R I P G R T A E E I E K Y W T S R F S - T S Q |
| SEQ ID NO: 1087 | S I I A G R I P G R T A E E I E K Y W T S R F S G S S E |
| SEQ ID NO: 1088 | S L I A G R I P G R T A E E I E K Y W T S R F S G S S E |
| SEQ ID NO: 559 | E L I A G R I P G R T A K E V E M F W A V K H Q N T |
| SEQ ID NO: 1082 | E L I A G R I P G R T A E E V E K F W A I K H Q A T |
| SEQ ID NO: 1081 | E L I A G R I P G R T A K E Q Y T E G E I W C L E T F P R R |
| SEQ ID NO: 1089 | E I I A G R I P G R T A E E V E M F W S K K Y Q E R |
| SEQ ID NO: 1090 | E I I A G R I P G R T A E E V E M F W S K K Y Q E R |
| | . L I A G R I P G R T A E E I E . Y W . . R . . . . . . |

FIG. 3A

```
                                          100                     110
SEQ ID NO: 148
SEQ ID NO: 1972    R R D F F R K
SEQ ID NO: 38      R R R L H H S P F F S T S P L H L Q E H L K L
SEQ ID NO: 2142    R R Q L H S S S H K H T K P H R P R F S I Y P S
SEQ ID NO: 1084    R - - N - G S K T Q D S
SEQ ID NO: 1085
SEQ ID NO: 1086
SEQ ID NO: 1083
SEQ ID NO: 1087
SEQ ID NO: 1088
SEQ ID NO: 559
SEQ ID NO: 1082
SEQ ID NO: 1081    M
SEQ ID NO: 1089
SEQ ID NO: 1090
```

FIG. 3B

```
                                    10                  20                  30
SEQ ID NO 170            M E S S V D E S T T S T G S I C E T P A I T P A K K
SEQ ID NO 1950           M D S S C I D E I S S S T S E S F S A T T A K K L S P
SEQ ID NO 370      M D A M S S V D E S S T T T D S I P A R K S S S P A S -
SEQ ID NO 1184     M D G G - S V T D E T T T T S N S L S V P A N - - - - -
SEQ ID NO 1183     M D G G - C V T D E T T T S S D S L S V P - - - - - - -
SEQ ID NO 1182     M D A I S C M D E S T T T E S L S I S L S P T S S S E K
SEQ ID NO 1176           M G V V S F S S T S - S G A S T A T T E S G G A V R
SEQ ID NO 1177   M E Q E A A M V V F S C N S G S G G S S S T T D S K Q E E E
SEQ ID NO 1179     M D S T S C L L D D A S S G A S T G - - - - - - - K K
SEQ ID NO 1178     M D S S S C L V D D T N S G G S S - - - T D K L R A L A
SEQ ID NO 1186     M D S A S S L V D D T S S G G G G A C T D K L R A L A
SEQ ID NO 1185     M D S A S S L V D D T S G S G G G - A C T D K L R A L A
                   M D . S . . . . T . . . . S . . . . . . . . . . . .

40                  50                  60
SEQ ID NO 170      - - - - - - - - - - - - - - - - - - - S S V G N L Y R M G S G S
SEQ ID NO 1950     P - - - - - - - - - - - - - - - - - P A A A L R L Y R M G S G G
SEQ ID NO 370      - - - - - - - - - - - - - - - - - - - - - L L Y R M G S G T
SEQ ID NO 1184     - - - - - - - - - - - - - - L S P P P - - L S L D G S G A
SEQ ID NO 1183     - - - - - - - - - - - - - - - - P P - - - - - S R V G S V A
SEQ ID NO 1182     A K P S S M I T S S E K V S L S P P P S N R L C R V G S G A
SEQ ID NO 1176     M S P E P - - - - - - - - - - - V V A V A A A A Q L P V
SEQ ID NO 1177     E E E E - - - - - - - - - - - - - - - - L A A M E E D E L
SEQ ID NO 1179     A A A A - - - - - - - - - - - A S - K A L Q R V G S G A
SEQ ID NO 1178     A A A A E - - - - - - - - - - - T - - A P L E R M G S G A
SEQ ID NO 1186     V F A A A - - - - - - - - - - - S G - T P L E R M G S G A
SEQ ID NO 1185     A A A A S - - - - - - - - - - - A S G P P P E R M G S G A
                                                               L   R   G S G A 70                  80                  90
SEQ ID NO 170      S - V V L D S E N - - - - G V E A E S R - - - - - - - - -
SEQ ID NO 1950     S S V V L D P E N - - - - G L E T E S R R - - - - - - - -
SEQ ID NO 370      S - V V L D S E N G V E V E V E A E S R R - - - - - - - -
SEQ ID NO 1184     T A V V Y P D G C C V - - S G E A E S R R - - - - - - - -
SEQ ID NO 1183     S A V V D P D G C C V - - S G E A E S R R - - - - - - - -
SEQ ID NO 1182     S A V V D P D G G G S - - G A E V E S R R - - - - - - - -
SEQ ID NO 1176     V K G V D S A D E V V T S R P A A A A A Q - - - - - - - -
SEQ ID NO 1177     I H V V Q A A E L R L P S S T T A T R - - - - - - - - -
SEQ ID NO 1179     S A V M D A A E P G A E A D S G G E - - - - - - - R R G
SEQ ID NO 1178     S A V V D A A E P G A E A D S G S G G R V C G G G G G A G
SEQ ID NO 1186     S A V V D A A E P G A E A D S G S G - - - - - - - A A A V
SEQ ID NO 1185     S A V V D A A E P G A E A D S G S A P - - - A S V A A V A A
                   S A V V D . . E . . . . . . . . E . R 100                 110                 120
SEQ ID NO 170      - - - - K L P S S K Y K G V V P Q P N G R W G A Q I Y E K H
SEQ ID NO 1950     - - - - K L P S S K Y K G V V P Q P N G R W G A Q I Y E K H
SEQ ID NO 370      - - - - K L P S S R F K G V V P Q P N G R W G A Q I Y E K H
SEQ ID NO 1184     - - - - K L P S S K Y K G V V P Q P N G R W G A Q I Y E K H
SEQ ID NO 1183     - - - - K L P S S K Y K G V V P Q P N G R W G A Q I Y E K H
SEQ ID NO 1182     - - - - K L P S S K Y K G V V P Q P N G R W G A Q I Y E K H
SEQ ID NO 1176     - - - - - - Q S S R Y K G V V P Q P N G R W G A Q I Y E R H
SEQ ID NO 1177     - - - - - - P S S R Y K G V V P Q P N G R W G A Q I Y E R H
SEQ ID NO 1179     G G G G K L P S S K Y K G V V P Q P N G R W G A Q I Y E R H
SEQ ID NO 1178     G A G G K L P S S K F K G V V P Q P N G R W G A Q I Y E R H
SEQ ID NO 1186     S V G G K L P S S R Y K G V V P Q P N G R W G A Q I Y E R H
SEQ ID NO 1185     G V G G K L P S S R Y K G V V P Q P N G R W G A Q I Y E R H
                           K L P S S K Y K G V V P Q P N G R W G A Q I Y E . H
```

|            | 70                          | 80              | 90              |
|------------|-----------------------------|-----------------|-----------------|
| SEQ ID NO 186  | R E T R H P I Y R G V R Q R | N S - - - - G - | K W V C E V R E |
| SEQ ID NO 1958 | R E T R H P I Y R G V R Q R | N S - - - - G - | K W V S E V R E |
| SEQ ID NO 1960 | R E T R H P I Y R G V R Q R | N S - - - - G - | K W V C E L R E |
| SEQ ID NO 1962 | R E T R H P I Y R G V R R R | N S - - - - G - | K W V C E V R E |
| SEQ ID NO 1238 | K E T R H P V Y R G V R R R | N K - - - - N - | K W V C E M R V |
| SEQ ID NO 1242 | R E T R H P V Y R G V R R R | N S - - - - D - | K W V C E V R E |
| SEQ ID NO 1240 | K E T R H P V Y R G V R R R | N N - - - - N - | K W V C E V R V |
| SEQ ID NO 1241 | K E T R H P V Y R G V R R R | N N - - - - N - | K W V C E V R V |
| SEQ ID NO 1243 | R E T R H P V Y R G V R R R | N T - - - - D - | K W V S E V R E |
| SEQ ID NO 1222 | R E T R H P V Y R G V R A R | A G - - - - G S | R W V C E V R E |
| SEQ ID NO 1223 | K E T R H P V Y K G V R S R | N - - - - - P G | R W V C E V R E |
| SEQ ID NO 1232 | K E T R H P V F K G V R R R | N - - - - - P G | R W V C E V R E |
| SEQ ID NO 1221 | Q E T R H P V F R G V R R R | G R - - - - A G | R W V C E V R V |
| SEQ ID NO 1231 | Q E T R H L V F R G V R W R | G C - - - - A G | R W V C K V R V |
| SEQ ID NO 1227 | R E T R H P V Y R G V R R R | G R P G A A G | R W V C E V R V |
| SEQ ID NO 1235 | H E T R H P V F R G V R R R | G R - - - - A G | R W V C E V R V |
| SEQ ID NO 1230 | R E T R H P V F R G V R R R | G N - - - - A G | R W V C E V R V |
| SEQ ID NO 1229 | R E T R H P V Y R G V R R R | G P - - - - A G | R W V C E V R E |
| SEQ ID NO 1228 | R E T R H P V Y R G V R R R | G G - - - - A G | R W V C E V R V |
| SEQ ID NO 1246 | R E T R H P V F R G V R R R | G S - - - - A G | R W V C E V R V |
| SEQ ID NO 1247 | R E T R H P V F R G V R R R | G A - - - - A G | R W V C E V R V |
| SEQ ID NO 1244 | R E T R H P V F R G V R R R | G A - - - - A G | R W V C E V R V |
| SEQ ID NO 1245 | R E T R H P V Y R G V R R R | G P - - - - A G | R W V C E V R E |
|            | R E T R H P V Y R G V R R R | .               | . G R W V C E V R V |

|            | 100                   | 110                       | 120                 |
|------------|-----------------------|---------------------------|---------------------|
| SEQ ID NO 186  | P N K - K S R I W L G T F P | T V E M A A R A H D V A A L A L |
| SEQ ID NO 1958 | P N K - K T R I W L G T F Q | T A E M A A R A H D V A A L A L |
| SEQ ID NO 1960 | P N K - K T R I W L G T F Q | T A E M A A R A H D V A A I A L |
| SEQ ID NO 1962 | P N K - K T R I W L G T F Q | T A E M A A R A H D V A A L A L |
| SEQ ID NO 1238 | P N - N S R I W L G T Y P | T P E M A A R A H D V A A L A L |
| SEQ ID NO 1242 | P N K - K T R I W L G T F P | T P E M A A R A H D V A A M A L |
| SEQ ID NO 1240 | P N D K S T R I W L G T Y P | T P E M A A R A H D V A A L S L |
| SEQ ID NO 1241 | P N D K S T R I W L G T Y P | V P E M A A R A H D V A A L A L |
| SEQ ID NO 1243 | P N K - K T R I W L G T F P | T P E M A A R A H D V A A M A L |
| SEQ ID NO 1222 | P Q - A Q A R I W L G T Y P | T P E M A A R A H D V A A I A L |
| SEQ ID NO 1223 | P H G - K Q R I W L G T F E | T A E M A A R A H D V A A M A L |
| SEQ ID NO 1232 | P H G - K Q R I W L G T F E | T A E M A A R A H D V A A L A L |
| SEQ ID NO 1221 | P G S R G D R L W V G T F D | T A E E A A R A H D A A M L A L |
| SEQ ID NO 1231 | P G S R G D R F W I G T S D | T A E E T A R T H D A A M L A L |
| SEQ ID NO 1227 | P G A R G S R L W L G T F A | T A E A A A R A H D A A A L A L |
| SEQ ID NO 1235 | P G R R G C R L W L G T F D | A A D A A A R A H D A A M L A L |
| SEQ ID NO 1230 | P G R R G C R L W L G T F D | T A E G A A R A H D A A M L A I |
| SEQ ID NO 1229 | P N K - K S R I W L G T F A | T A E A A A R A H D A A A L A L |
| SEQ ID NO 1228 | P G K R G A R L W L G T Y V | T A E A A A R A H D A A M I A L |
| SEQ ID NO 1246 | P G R R G C R L W L G T F D | T A E A A A R A H D A A M L A L |
| SEQ ID NO 1247 | P G R R G A R L W L G T Y L | G A E A A A R A H D A A M L A L |
| SEQ ID NO 1244 | P G R R G A R L W L G T Y L | G A E A A A R A H D A A M L A L |
| SEQ ID NO 1245 | P N K - K S R I W L G T F A | T P E A A A R A H D V A A L A L |
|            | P . . . R I W L G T F | T A E M A A R A H D V A A L A L |

FIG. 5B

|  | | | | | | | | | 130 | | | | | | | | 140 | | | | | | | | | 150 | | | | |
|---|---|---|---|---|---|---|---|---|---|---|---|---|---|---|---|---|---|---|---|---|---|---|---|---|---|---|---|---|---|---|
| SEQ ID NO 186  | R | G | R | - | - | - | - | - | - | S | A | C | L | N | F | A | D | S | A | W | R | L | R | I | P | - | - | - | - | - |
| SEQ ID NO 1958 | R | G | R | - | - | - | - | - | - | S | A | C | L | N | F | A | D | S | A | W | R | L | R | I | P | - | - | - | - | - |
| SEQ ID NO 1960 | R | G | R | - | - | - | - | - | - | S | A | C | L | N | F | A | D | S | A | W | R | L | R | I | P | - | - | - | - | - |
| SEQ ID NO 1962 | R | G | R | - | - | - | - | - | - | S | A | C | L | N | F | A | D | S | A | W | R | L | R | I | P | - | - | - | - | - |
| SEQ ID NO 1238 | R | G | K | - | - | - | - | - | - | S | A | C | L | N | F | A | D | S | R | W | R | L | T | V | P | - | - | - | - | - |
| SEQ ID NO 1242 | R | G | R | - | - | - | - | - | - | Y | A | C | L | N | F | A | D | S | A | W | R | L | P | V | P | - | - | - | - | - |
| SEQ ID NO 1240 | R | G | K | - | - | - | - | - | - | S | A | C | L | N | F | A | D | S | A | W | R | L | P | L | P | - | - | - | - | - |
| SEQ ID NO 1241 | R | G | K | - | - | - | - | - | - | S | A | C | L | N | F | A | D | S | A | W | R | L | P | L | P | - | - | - | - | - |
| SEQ ID NO 1243 | R | G | R | - | - | - | - | - | - | Y | A | C | L | N | F | A | D | S | T | W | R | L | P | I | P | - | - | - | - | - |
| SEQ ID NO 1222 | R | G | E | R | - | - | - | - | - | G | A | E | L | N | F | P | D | S | P | S | T | L | P | R | - | - | - | - | - | - |
| SEQ ID NO 1223 | R | G | R | - | - | - | - | - | - | A | A | C | L | N | F | A | D | S | P | R | R | L | R | V | P | P | - | - | - | - |
| SEQ ID NO 1232 | R | G | R | - | - | - | - | - | - | A | A | C | L | N | F | A | D | S | P | R | R | L | R | V | P | P | - | - | - | - |
| SEQ ID NO 1221 | C | G | A | S | - | - | - | - | - | - | A | S | L | N | F | A | D | S | A | W | L | L | H | V | P | R | A | P | V | A |
| SEQ ID NO 1231 | C | G | A | S | - | - | - | - | - | - | A | S | L | N | F | A | D | S | A | W | L | L | H | V | P | R | A | P | V | V |
| SEQ ID NO 1227 | R | G | R | - | - | - | - | - | - | A | A | C | L | N | F | A | D | S | A | W | R | M | P | P | V | P | A | S | A | A |
| SEQ ID NO 1235 | R | G | R | A | A | - | - | - | - | - | A | C | L | N | F | A | D | S | A | W | L | L | A | V | P | P | - | P | A | T |
| SEQ ID NO 1230 | N | A | G | G | G | G | G | G | G | A | C | C | L | N | F | A | D | S | A | W | L | L | A | V | P | - | - | - | R | S |
| SEQ ID NO 1229 | R | G | R | - | - | - | - | - | - | G | A | C | L | N | F | A | D | S | A | R | L | L | R | V | D | P | - | - | - | - |
| SEQ ID NO 1228 | R | G | G | A | G | G | - | G | G | A | A | C | L | N | F | Q | D | S | A | W | L | L | A | V | P | - | - | P | A | A |
| SEQ ID NO 1246 | A | G | A | G | A | - | - | - | - | - | C | C | L | N | F | A | D | S | A | W | L | L | A | V | P | - | - | - | A | S |
| SEQ ID NO 1247 | G | - | - | - | - | - | - | - | - | R | G | A | C | L | N | F | P | D | S | A | W | L | L | A | V | P | P | P | P | A | L |
| SEQ ID NO 1244 | G | - | - | - | - | - | - | - | - | R | G | A | C | L | N | F | P | D | S | A | W | L | L | A | V | P | P | P | P | A | L |
| SEQ ID NO 1245 | R | G | R | - | - | - | - | - | - | A | A | C | L | N | F | A | D | S | A | R | L | L | Q | V | D | P | - | - | - | - |
|                | R | G | R | | | | | | | | A | C | L | N | F | A | D | S | A | W | R | L | | V | P | | | | | |

|  | | | | | | 160 | | | | | | | | 170 | | | | | | | | 180 | |
|---|---|---|---|---|---|---|---|---|---|---|---|---|---|---|---|---|---|---|---|---|---|---|---|
| SEQ ID NO 186  | - | E | T | T | C | P | K | E | I | Q | K | A | A | S | E | A | A | M | A | F | Q | N | E | T | T | T | E | - | - | - |
| SEQ ID NO 1958 | - | E | S | T | C | A | K | D | I | Q | K | A | A | A | E | A | A | L | A | F | Q | D | E | T | C | D | T | - | - | - |
| SEQ ID NO 1960 | - | E | S | T | C | A | K | E | I | Q | K | A | A | A | E | A | A | L | N | F | Q | D | E | M | C | H | M | - | - | - |
| SEQ ID NO 1962 | - | E | S | T | C | A | K | D | I | Q | K | A | A | A | E | A | A | L | A | F | Q | D | E | M | C | D | A | - | - | - |
| SEQ ID NO 1238 | - | A | T | T | N | A | E | E | I | R | R | A | A | G | E | A | A | E | A | F | A | V | A | D | G | - | - | - | - | - |
| SEQ ID NO 1242 | - | A | T | A | E | A | K | D | I | Q | K | A | A | A | E | A | A | Q | A | F | R | P | D | Q | T | L | K | - | - | - |
| SEQ ID NO 1240 | - | A | S | T | N | A | K | E | I | R | R | V | A | A | A | A | A | V | A | I | A | A | E | D | S | R | G | - | - | - |
| SEQ ID NO 1241 | - | A | S | T | N | A | K | E | I | R | R | V | A | A | A | A | A | V | A | I | A | A | E | D | S | C | G | - | - | - |
| SEQ ID NO 1243 | - | A | T | A | N | A | K | D | I | Q | K | A | A | A | E | A | A | E | A | F | R | P | S | Q | T | L | E | - | - | - |
| SEQ ID NO 1222 | A | R | T | A | S | P | E | D | I | R | L | A | A | A | Q | A | A | E | L | Y | R | R | P | P | P | P | L | - | - | - |
| SEQ ID NO 1223 | L | G | - | A | G | H | E | E | I | R | R | A | A | V | E | A | A | E | L | F | R | P | A | P | G | Q | H | - | - | - |
| SEQ ID NO 1232 | I | G | - | A | S | H | D | D | I | R | R | A | A | A | E | A | A | E | A | F | R | P | P | P | D | E | S | - | - | - |
| SEQ ID NO 1221 | S | G | H | D | Q | L | P | D | V | Q | R | A | A | S | E | A | V | A | E | F | Q | R | R | G | S | - | - | - | - | - |
| SEQ ID NO 1231 | S | G | - | - | L | R | P | P | A | A | R | C | A | T | R | C | L | Q | G | H | R | R | V | P | A | P | G | - | - | - |
| SEQ ID NO 1227 | L | A | G | - | - | A | R | G | V | R | D | A | V | A | V | A | V | E | A | F | Q | R | Q | S | - | - | - | - | - | - |
| SEQ ID NO 1235 | L | R | C | - | - | A | A | D | V | Q | R | A | V | A | R | A | L | E | D | F | E | Q | R | E | S | S | S | S | V | F |
| SEQ ID NO 1230 | Y | R | T | - | - | L | A | D | V | R | H | A | V | A | E | A | V | E | D | F | F | R | R | R | L | A | D | - | - | - |
| SEQ ID NO 1229 | A | T | L | A | T | P | D | D | I | R | R | A | A | I | E | L | A | E | S | C | P | - | H | D | A | A | A | - | - | - |
| SEQ ID NO 1228 | P | S | D | - | - | L | A | G | V | R | R | A | A | T | E | A | V | A | G | F | L | Q | R | N | K | T | T | N | - | - |
| SEQ ID NO 1246 | C | A | S | - | - | L | A | E | V | R | H | A | V | A | D | A | V | D | D | F | L | R | H | Q | L | V | P | - | - | - |
| SEQ ID NO 1247 | S | G | G | - | - | L | D | G | A | R | R | A | L | E | A | V | A | E | F | Q | R | R | R | - | - | - | - | - | - | - |
| SEQ ID NO 1244 | S | G | G | - | - | L | D | G | A | R | R | A | L | E | A | V | A | E | F | Q | R | R | R | - | - | - | - | - | - | - |
| SEQ ID NO 1245 | A | T | L | A | T | P | D | I | R | R | A | A | I | Q | L | A | D | A | S | Q | Q | D | E | T | A | - | - | - | - | - |
|                | . | . | | . | | | | | I | R | R | A | A | A | E | A | A | | . | F | | | | | | | | | | |

FIG. 5C

```
                               190              200              210
SEQ ID NO 186     . . . . G S . K T A A E A E E A A G E G V R E G E R . . . .
SEQ ID NO 1958    . . . . T T T N H G L D M E E T M V E A I Y T P E . . . . .
SEQ ID NO 1960    . . . . T T D A H G L D M E E T L V E A I Y T P E . . . . .
SEQ ID NO 1962    . . . . T T . D H G F D M E E T L V E A I Y T A E . . . . .
SEQ ID NO 1238    . . . . . . . . . . . . D D V N I . . . . . . . . . . . . .
SEQ ID NO 1242    . . . . N A . . . . . N T R Q E C V E A V A V A . . . . . .
SEQ ID NO 1240    . . . . K Q . . . . . L R T N A I . D A V A D . C E V S S S
SEQ ID NO 1241    . . . . E Q . . . . . L Q N S I V N D A V A D D C E V S R S
SEQ ID NO 1243    . . . . N T . . . . . N T K Q E C V K V V T T . . . . . . .
SEQ ID NO 1222    . . . . A L P E . . . D P Q E G T S G G . . . . . . . . . .
SEQ ID NO 1223    . . . . N A A A E A A A A V A A Q A T A A S A . . . . . . .
SEQ ID NO 1232    . . . . N A A T E V A A A S G . A T N S N A . . . . . . . .
SEQ ID NO 1221    . . . . T A A T A T A T S G D A A S T A P P S . . . . . . .
SEQ ID NO 1231    . . R G S T A T A T A T S G D A A S T A P P . . . . . . . .
SEQ ID NO 1227    . . . . A A P S S P A E T F A N D G D E E E D . . . . . . .
SEQ ID NO 1235    P L A I D V V A E D A M S A T S E P S A A S D . . . . . . .
SEQ ID NO 1230    . . D A L S A T S S S S T T P S T P R T D D D . . . . . . .
SEQ ID NO 1229    . . . . A A A S S S A A A V E A S A A A A P A . . . . . . .
SEQ ID NO 1228    G A S V A E A M D E A T S G V S A P P P L A N N A G S . . S
SEQ ID NO 1246    . . E D D A L A A T P S S P S S E D G N T S D . . . . . . .
SEQ ID NO 1247    . . F G A V A A D E A T S G T S P P S S S S S P S G T Y V S
SEQ ID NO 1244    . . F G A A A A D E A T S G T S P P S S S S . . . . . . . A
SEQ ID NO 1245    . . . . A V A A D V V A P S Q A D D V A A . . . . . . . . .
                                                      A .

220              230              240
SEQ ID NO 186     . . . . . . . . . . . . . . . . . . . . . . . . . . . . . .
SEQ ID NO 1958    . . . . . . . . . . . . . . . . . . . . . . . . . . . . . .
SEQ ID NO 1960    . . . . . . . . . . . . . . . . . . . . . . . . . . . . . .
SEQ ID NO 1962    . . . . . . . . . . . . . . . . . . . . . . . . . . . . . .
SEQ ID NO 1238    . . . . . . . E Q . . . . . . . . . . . . . . . . . Q Q S V
SEQ ID NO 1242    . . . . . . . . . . . . . . . . . . . . . . . . . . . . . V
SEQ ID NO 1240    D I G V D E N C N N . . . . . . . . . . . . . . . . N K A S
SEQ ID NO 1241    D V S F D E D S N S . . . . . . . . . . . . . . . . N K G L
SEQ ID NO 1243    . . . . . . . . . . . . . . . . . . . . . . . . . . . . . .
SEQ ID NO 1222    . . . . . . . . . . . . . . . . . . . . . . . . . . . . G A
SEQ ID NO 1223    . . . . . . . . . . . . . . . . . . . . . . . . . . . . . .
SEQ ID NO 1232    . . . . . . . . . . . . . . . . . . . . . . . . . . . . . .
SEQ ID NO 1221    S S P V L S P N D . . . . . . . . . . . . . . . D N A S S A
SEQ ID NO 1231    S A P V L S A K Q C E F I F L S S L D C W M L M S K L I S S
SEQ ID NO 1227    N K D V L P V A A A . . . . . . . . . . . . . . . . E V F D A
SEQ ID NO 1235    . . D D A V T S S S . . . . . . . . . . . . . . . . S T T D A
SEQ ID NO 1230    . . E E S A A T D G . . . . . . . . . . . . . . . . D E S S S
SEQ ID NO 1229    . . . . . . . . . . . . . . . . . . . . . . . . . . . . . .
SEQ ID NO 1228    E T P G P S S I D G . . . . . . . . . . . . . . . . T A D T A
SEQ ID NO 1246    . . G G E S S S D . . . . . . . . . . . . . . . . . . S S P
SEQ ID NO 1247    Q A P A P A I E R V . . . . . . . . . . . . . . . . P V E A S
SEQ ID NO 1244    T K P A P A I E R V . . . . . . . . . . . . . . . . P V E A S
SEQ ID NO 1245    . . . . . . . . . . . . . . . . . . . . . . . . . . . . . .
```

|               | 310         | 320         | 330 |
|---|---|---|---|
| SEQ ID NO 186  | - - - - - - - - - V S L W S F D E |  |  |
| SEQ ID NO 1958 | - - - - - - - - - V S L W S Y |  |  |
| SEQ ID NO 1960 | - - - - - - - - - V S L W S Y |  |  |
| SEQ ID NO 1962 | D - - - - - - - - V S L W S Y |  |  |
| SEQ ID NO 1238 | D D - - - - - D E I S L W N F S I |  |  |
| SEQ ID NO 1242 | D - - - - - - A E V S L W N F S I |  |  |
| SEQ ID NO 1240 | D D - - - - - A E V S L W S F T V |  |  |
| SEQ ID NO 1241 | D D - - - - - A E V S L W S F T I |  |  |
| SEQ ID NO 1243 | D - - - - - - A E V S L W S F S I |  |  |
| SEQ ID NO 1222 | D D H Y - - - H M D Y K L W M D |  |  |
| SEQ ID NO 1223 | C - - - - - - - E V N L W S Y |  |  |
| SEQ ID NO 1232 | G - - - - - - - E V Q L W S Y |  |  |
| SEQ ID NO 1221 | D E G - - C G G A E M E L W S |  |  |
| SEQ ID NO 1231 | Y Q V - - F L L L T M I T H H L F Q W R R |  |  |
| SEQ ID NO 1227 | E - - - L A G S D M P L W S Y |  |  |
| SEQ ID NO 1235 | A I V D S S D I A D V S L W S Y |  |  |
| SEQ ID NO 1230 | - - - - A I L A D V P L W S Y |  |  |
| SEQ ID NO 1229 | G G A G G Y G G G D V T L W S Y |  |  |
| SEQ ID NO 1228 | D E - - - - - G A D I A L W S Y |  |  |
| SEQ ID NO 1246 | - - - - E G F A D V P L W S Y |  |  |
| SEQ ID NO 1247 | D C S - - H S G A D V A L W S Y |  |  |
| SEQ ID NO 1244 | D C C - - D S G A D V A L W S Y |  |  |
| SEQ ID NO 1245 | G - - - - - - A G D M T L W S Y N A V E S V S S A G G W E R |  |  |
|                | . . V . L W S Y |  |  |

|                | 340 | 350 | 360 |
|---|---|---|---|
| SEQ ID NO 186 |  |  |  |
| SEQ ID NO 1958 |  |  |  |
| SEQ ID NO 1960 |  |  |  |
| SEQ ID NO 1962 |  |  |  |
| SEQ ID NO 1238 |  |  |  |
| SEQ ID NO 1242 |  |  |  |
| SEQ ID NO 1240 |  |  |  |
| SEQ ID NO 1241 |  |  |  |
| SEQ ID NO 1243 |  |  |  |
| SEQ ID NO 1222 |  |  |  |
| SEQ ID NO 1223 |  |  |  |
| SEQ ID NO 1232 |  |  |  |
| SEQ ID NO 1221 |  |  |  |
| SEQ ID NO 1231 |  |  |  |
| SEQ ID NO 1227 |  |  |  |
| SEQ ID NO 1235 |  |  |  |
| SEQ ID NO 1230 |  |  |  |
| SEQ ID NO 1229 |  |  |  |
| SEQ ID NO 1228 |  |  |  |
| SEQ ID NO 1246 |  |  |  |
| SEQ ID NO 1247 |  |  |  |
| SEQ ID NO 1244 |  |  |  |
| SEQ ID NO 1245 | R P R S G A T T G Q G R K W G S R E R V R I |  |  |

FIG. 5F

```
G3472     (801)  ----------------------------------MAES-------------------DNESGGHTGNASGSN------
G3473     (799)  ----------------------------------MADS-------------------DNDSGGAHNGGKGS------
G3474    (2951)  ----------------------------------MAES-------------------DNESGGHTGNASGSN------
G3435    (2952)  ----------------------------------MPDS-------------------DNDSGGPSN-AGG--------
G3397     (794)  ----------------------------------MPDS-------------------DNDSGGPSNYAGG--------
G3436     (805)  ----------------------------------MPDS-------------------DNESGGPSN--A---------
G3398     (796)  ----------------------------------MPDS-------------------DNESGGPSN--AG--------
G3475     (800)  ----------------------------------MADS-------------------DNDSGGAHNAGKG--------
G3478    (2953)  ----------------------------------MADS-------------------DNDSGGAHNGGKG--------
G3476     (798)  ----------------------------------MAES-------------------DNDSGGAQNAGNSGNL-----
G485     (2010)  ----------------------------------MADS-------------------DNDSGGHKDGGN---------
G482       (90)  ----------------------------------MGDS-------------------DRDSGGGQNGNNQNGQ-----
OSC30077 (2954)  MKSRKSYGHLLSPVGSPPL---------------------------------------DNESGEAAAAAGGGGCGSSAGYVVYGG
G3471    (2950)  ----------------------------------MSDAPPSP---------------THESGGEQSPRGSS----------
G3477    (2955)  ----------------------------------MSDAPASP---------------SHESGGEQSPRGSL----------
G3470    (2948)  ----------------------------------MSDAPASP---------------SHESGGEQSPRGSL----------
G481       (88)  ----------------------------------MADTPSSP---------------AGD-GGESG---------------
G1364    (2102)  ----------------------------------MAESQAKSP-------------GGCGSHESGGDQSPR----------
G2345    (2171)  ----------------------------------MAESQTGG--------------GGGGSHESGGDQSPR----------
AP004366 (2956)  ----------------------------------MADA------------------GHDESGSPPRSGGVR----------
G3434     (806)  ----------------------------------MADD------------------GGSHEGSG-GGGGVR----------
G3394    (2957)  ----------------------------------MADGPGSPG-------------GGGGSHESGSPRGGGGGGGGG-----
G1781    (2958)  --------------------------------MTEESPEEDHGSPGVAETNPGSPSSKTNNNNN-----------------
G1248    (2959)  --------------------------------MAGNYHSFQNPIPRYQNYNFGSSSNHQHEHDGLVV-----VVEDQ
G486     (2960)  ---------------------------------------------------------------------------------
G1821    (2961)  ----------------------------------MAEGSMRPP----------------EFNQPNKTSNGGEE--------
Consensus                                          M  D                                       GG
```

FIGURE 10A

| | | |
|---|---|---|
| G3472 | (801) | KCQKEKRKTINGDDLLWAMTTLGFEEYVEPLKVYLHKYRELEGEKTAMMG------------ |
| G3473 | (799) | ECQKEKRKTINGDDLLWAMTTLGFEEYVEPLKVYLHKYRELEGEKTAMMG------------ |
| G3474 | (2951) | KCQKEKRKTINGDDLLWAMTTLGFEDYVDPLKIYLHKYREMEGEKTAMMG------------ |
| G3435 | (2952) | KCQREKRKTINGDDLLWAMTTLGFEDYVDPLKHYLHKFREIEGERAAASAGASGSQQQ---- |
| G3397 | (794) | KCQREKRKTINGDDLLWAMTTLGFEDYVDPLKHYLHKFREIEGERAAASTTGAGTSAA---- |
| G3436 | (805) | KCQREKRKTINGDDLLWAMTTLGFEDYVEPLKIYLHKFRELEGEKAATTSASSGPQPPLH-- |
| G3398 | (796) | KCQREKRKTINGDDLLWAMTTLGFEDYIDPLKLYLHKFRELEGEKAIGAAGSGGGAASS--- |
| G3475 | (800) | KCQREKRKTINGDDLLWAMTTLGFEDYVEPLKGYLQRFREMEGEKTVAAR------------ |
| G3478 | (2953) | KCQREKRKTINGDDLLWAMTTLGFEDYVEPLKGYLQRFREMEGEKTVAAR------------ |
| G3476 | (798) | KCQREKRKTINGDDLLWAMTTLGFEDYVEPLKIYLQRFREMEGEKTVAAR------------ |
| G485 | (2010) | KCQREKRKTINGDDLLWAMTTLGFEDYVEPLKVYLQKYREVEGEKTTTAGR----------- |
| G482 | (90) | KCQREKRKTINGDDLLWAMTTLGFEAYVGPLKSYLNRYREAEGEKADVLGGAGGAAAARH-- |
| OSC30077 | (2954) | KCQREKRKTINGDDLLWAMATLGFEDYIEPLKVYLARYREAEGDTKGSARS----------- |
| G3471 | (2950) | KCQREKRKTINGDDLLWAMATLGFEDYIEPLKVYLARYREAEGDTKGSARS----------- |
| G3477 | (2955) | KCQREKRKTINGDDLLWAMATLGFEDYIEPLKVYLARYREAEGDTKGSARS----------- |
| G3470 | (2948) | KCQREKRKTVNGDDLLWAMATLGFEDYLEPLKIYLARYRELEGDNKGSGKS----------- |
| G481 | (88) | KCQKEKRKTVNGDDLLWAMATLGFEDYMEPLKVYLMRYRE--GDTKGSAKG----------- |
| G1364 | (2102) | KCQKEKRKTINGDDLLWAMATLGFEDYIDPLKVYLMRYREMEGDTKGSGKG----------- |
| G2345 | (2171) | KCQKEKRKTINGDDLLFAMGTLGFEEYVDPLKIYLHKYREMEGDSKLSSKA----------- |
| AP004366 | (2956) | KCQKEKRKTINGEDLLFAMGTLGFEEYVDPLKIYLHKYREMEGDSKLSSKA----------- |
| G3434 | (806) | KCQKEKRKTINGDDLLWAMATLGFEEYVEPLKIYLQKYKEMEGDSKLSTKA----------- |
| G3394 | (2957) | KCQREKRKTINGDDLLWAMATLGFEDYIEPLKVYLQKYREMEGDSKLTAKA----------- |
| G3395 | (2958) | KCQREKRKTINGDDIIWAITTLGFEDYVAPLKVYLCKYRDTEGEKVNSPKQ----------- |
| G1781 | (2959) | KCQREKRKTINGDDICWAMANLGFDDYAAQLKKYLHRYRVLEGEKPN--------------- |
| G1248 | (2960) | KCHKEKRKTVNGDDIWWALSTLGLDNYADAVGRHLHKYREAERERTEHNKG----------- |
| G486 | (2961) | RCQREQRKTITAEDVIWAMSKLGFDDYIEPLTLYLHRYRELEGERGVSCSAG---------- |
| G1821 | | |
| Consensus | | KCQREKRKTINGDDLLWAMTTLGFEDY EPLKVYL YRE EGE |

B domain

FIGURE 10C

```
G3472    (801)  ------------------RPHERDEGYGH--------------------------ATPMM-IMMGHQ--------
G3473    (799)  ------------------RPHERDEGYGH--------------------------ATPMM-IMMGHQ--------
G3474   (2951)  ------------------RPHERDEGYGHGHG-----------------HATPMMTMMGHQPQHQHQH--------
G3435   (2952)  ---QQQGELPRGAANAAG-YAGYGAPG-------------------------SG-GMMMMMGQPMYGGSQPQ-----
G3397    (794)  ---STTPPQQQHTANAAGGYAGYAAPG------------------------AGPGGMMMMGQPMYGSPPP-------
G3436    (805)  RETTPSSSTHN--GAGGPVGGYGMYGGA----------------------GGGSGMIMMGQPMYGGSPPA-------
G3398    (796)  GGSGSGSGSHHHQDASRNNGGYGMYG-------------------------GGGGMIMMGQPMYG-SPPA-------
G3475    (800)  ---DKDAPPPTNATNSAYESPSYAAA------------------------PGGIMMHQGHVYG--------------
G3478   (2953)  ---DKDAPPLTNATNSAYESANYAAAA-----------------------AVPGGIMMHQGHVYG--------------
G3476    (798)  ---DSSK---DSASASSY---------------------------------HQGHVYG-------------------
G485    (2010)  ---QGDKEGGGGGGGAGSGSGGAPMYG----------------------GGMVTTMGHQFS----------------
G482      (90)  ---QTGGEVGEHQRDAVGDGGGFYGGG----------------------GGMQYHQHHQFL----------------
OSC30077(2954)  GEGGCCGGGGGGGADGVVIDGHYPLAGGLSHSHHGHQQQDGGGDVGLMMGGGDAGVGYNAG
G3471   (2950)  ---GDGSATPD-QVGLAGQNSQLVHQG-----------------------SLNYIGLQVQP---------------
G3477   (2955)  ---GDGSATPD-QVGLAGQNSQLVHQG-----------------------SLNYIGLQVQP---------------
G3470   (2948)  ---GDGSARPD-QVGLAGQNAQVQPQX-----------------------SG--YAFNARP---------------
G481      (88)  ---GDGSNRDA-GGGVSGEEMPSW----------------------------------------------------
G1364   (2102)  ---GDPNAKKDGQSSQNGQFSQLAHQG----------------------------PYGNSQ---------------
G2345   (2171)  ---GESSAKRDGQPSQVSQFSQVPQQG--------------------SFSQGPYGNSQSLRFGNSIEH
AP004366(2956)  ---GDGSVKKDTIGPHSGASSSSAQG------------------------MVGAYTQGMGY---------------
G3434    (806)  ---GEGSVKKDAISPHGGTSSSSNQLV-----------------------QHGVYNQGMGY---------------
G3394   (2957)  ---GDGSVKKDVLGSHGGSSSSAQGMG-----------------------QQAAYNQGMGY---------------
G1781   (2958)  ---QQQRQQQQQIQQQNHHNYQFQEQDNNNN-------------------MSCTSYISHHHPSPFLPVDHQ------
G1248   (2959)  ---------------------------------------------------HHGKG-------------------
G486    (2960)  ---SNDSGNEKE------------------------------------------TNTRS-----------------
G1821   (2961)  ---SVSMTNGLVVKRPNGTMTEYGAYG------------------------PVPGIHMAQYHYR------------
```

FIGURE 10D

```
G3472    (801)  ------------------------------QQQHQG--HVYGSGTT-------TGSASSARTR-------
G3473    (799)  ------------------------------QQQHQG--HVYGSGTT-------TGSASSARTR-------
G3474   (2951)  ---------------------------QHQHQHQG--HVYGS----------GSASSARTR-------
G3435   (2952)  ---QQPPQPQPPQQQQQHQQHHMAMGGRGGFGQQ--GGGGGSSSSSGLGRQDRA-------
G3397    (794)  ----------PPQQQQQH--HHMAMGGRGGFGHHPGGGGGSSSSSSGHGRQNRGA-------
G3436    (805)  --ASSG------SYPHH--QMAMGGKGGAYGYGGGSSSPS--GLGR---------
G3398    (796)  --SSAGYAQPPPHHHHH----QMVMGGKG-AYGHGGGGGGPSPSSGYGRQDRL-------
G3475    (800)  ---------------SAGFH--QVAGGAIK-------GGPVYPGPGSNAGRPR-------
G3478   (2953)  ---------------SAGFH--QVAGGAIK-------GGPAYPGPGSNAGRPR-------
G3476    (798)  ---------------SPAYH--HQVP----------GPTYPAPG----RPR-------
G485    (2010)  ------------------HHFS----------------------------------
G482      (90)  -------------------HQQNHMYGATGGGSDS--------GGGAASGRTRT-------
OSC30077(2954)  AGSTTTAFYAPAATAASGNKAYCGGDGSRVMEFEGIGEEESGGGGGGERGFAGHLHGV
G3471   (2950)  ---------------QHLVMPSMQSHE-----------------------------
G3477   (2955)  ---------------QHLVMPSMQSHE-----------------------------
G3470   (2948)  --------------------------------------------------------
G481      (88)  -----------------VTFPLFSSHSSN-------------THH--SLLIC---------
G1364   (2102)  LEVLMSSTRTLFITIFRDSTMPVVSENLSDPLSIDMDCEAIYHHFIGLLILSCK-------
G2345   (2171)  ----------------MQPQSNFHILVVLQSFAFPYMYQVAQIYCKYPSIE---------
AP004366(2956)  ---------------MQPQ-----------------YHNGET--------------
G3434    (806)  ---------------MQPQ-----------------YHNGDVSN------------
G3394   (2957)  ---------------PFPNIAFSPKSLQKQ-------FPQQHDNNIDSIHW---------
G3398   (2958)  ---------------GPKSSP---------------DN------------------
G1781   (2959)  ---------------DVQNQSTK-------------------------------
G1248   (2960)  ---------------DVQNQSTK-------FIRVVEKGSSSSAR-------
G486    (2960)  ---------------------FIRVVEKGSSSSAR-------
G1821   (2961)  -------------HQNGFVFSGNEPNSKMSGSSSGASGARVEVFPTQQHKY-------
```

FIGURE 10E

| | | |
|---|---|---|
| G3472 | (801) | ---------- ---------- |
| G3473 | (799) | ---------- ---------- |
| G3474 | (2951) | ---------- ---------- |
| G3435 | (2952) | ---------- ---------- |
| G3397 | (794) | ---------- ---------- |
| G3436 | (805) | ---------- ---------- |
| G3398 | (796) | ---------- ---------- |
| G3475 | (800) | ---------- ---------- |
| G3478 | (2953) | ---------- ---------- |
| G3476 | (798) | ---------- ---------- |
| G485 | (2010) | ---------- ---------- |
| G482 | (90) | ---------- ---------- |
| OSC30077 | (2954) | QWFRLKRNTN ---------- |
| G3471 | (2950) | ---------- ---------- |
| G3477 | (2955) | ---------- ---------- |
| G3470 | (2948) | ---------- ---------- |
| G481 | (88) | ---------- ---------- |
| G1364 | (2102) | ---------- ---------- |
| G2345 | (2171) | ---------- ---------- |
| AP004366 | (2956) | ---------- ---------- |
| G3434 | (806) | ---------- ---------- |
| G3394 | (2957) | ---------- ---------- |
| G1781 | (2958) | ---------- ---------- |
| G1248 | (2959) | ---------- ---------- |
| G486 | (2960) | ---------- ---------- |
| G1821 | (2961) | ---------- ---------- |

FIGURE 10F

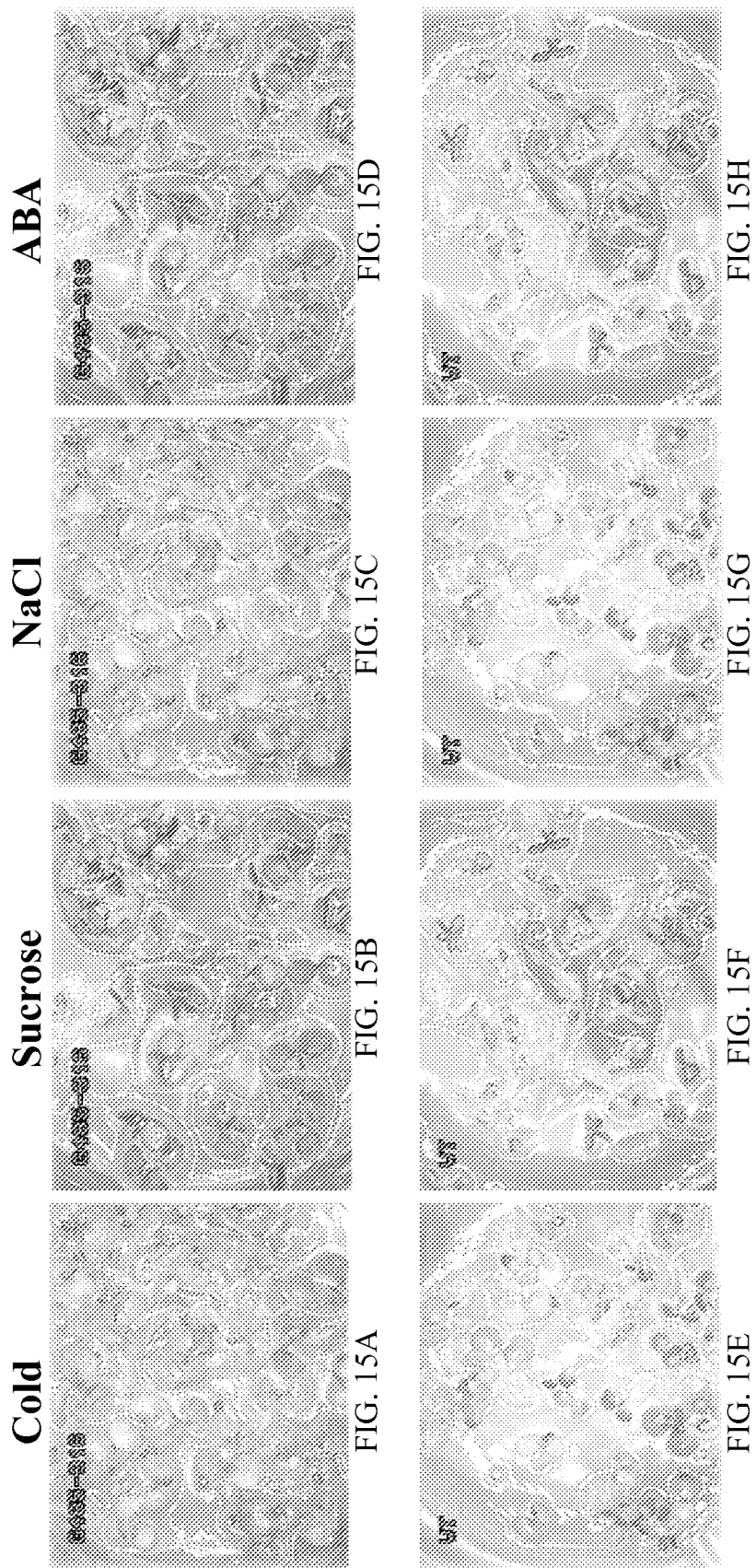

POLYNUCLEOTIDES AND POLYPEPTIDES IN PLANTS

RELATIONSHIP TO COPENDING APPLICATIONS

This application is a continuation-in-part of U.S. Non-provisional application Ser. No. 10/546,266, filed Aug. 19, 2005 now U.S. Pat. No. 7,659,446, which is a National Stage Entry of PCT application PCT/US04/05654, filed Feb. 25, 2004 (expired), which claims priority from U.S. Non-provisional application Ser. No. 10/374,780, filed Feb. 25, 2003 (issued as U.S. Pat. No. 7,511,190), and U.S. Non-provisional application Ser. No. 10/675,852, filed Sep. 30, 2003 (abandoned). This application is also a continuation-in-part of U.S. Non-provisional application Ser. No. 11/642,814, filed Dec. 20, 2006 (issued as U.S. Pat. No. 7,825,296), which is a divisional application of Non-provisional application Ser. No. 10/666,642, filed Sep. 18, 2003 (now issued as U.S. Pat. No. 7,196,245), which claims the benefit of U.S. provisional application No. 60/465,809, filed Apr. 24, 2003, U.S. provisional application No. 60/434,166, filed Dec. 17, 2002, and U.S. provisional application No. 60/411,837, filed Sep. 18, 2002. The entire contents of each of these applications are hereby incorporated by reference in their entirety.

JOINT RESEARCH AGREEMENT

The claimed invention, in the field of functional genomics and the characterization of plant genes for the improvement of plants, was made by or on behalf of Mendel Biotechnology, Inc. and Monsanto Company as a result of activities undertaken within the scope of a joint research agreement in effect on or before the date the claimed invention was made.

FIELD OF THE INVENTION

This invention relates to the field of plant biology. More particularly, the present invention pertains to compositions and methods for modifying a plant phenotypically.

BACKGROUND OF THE INVENTION

A plant's traits, such as its biochemical, developmental, or phenotypic characteristics, may be controlled through a number of cellular processes. One important way to manipulate that control is through transcription factors—proteins that influence the expression of a particular gene or sets of genes. Transformed and transgenic plants that comprise cells having altered levels of at least one selected transcription factor, for example, possess advantageous or desirable traits. Strategies for manipulating traits by altering a plant cell's transcription factor content can therefore result in plants and crops with new and/or improved commercially valuable properties.

Transcription factors can modulate gene expression, either increasing or decreasing (inducing or repressing) the rate of transcription. This modulation results in differential levels of gene expression at various developmental stages, in different tissues and cell types, and in response to different exogenous (e.g., environmental) and endogenous stimuli throughout the life cycle of the organism.

Because transcription factors are key controlling elements of biological pathways, altering the expression levels of one or more transcription factors can change entire biological pathways in an organism. For example, manipulation of the levels of selected transcription factors may result in increased expression of economically useful proteins or biomolecules in plants or improvement in other agriculturally relevant characteristics. Conversely, blocked or reduced expression of a transcription factor may reduce biosynthesis of unwanted compounds or remove an undesirable trait. Therefore, manipulating transcription factor levels in a plant offers tremendous potential in agricultural biotechnology for modifying a plant's traits. A number of the agriculturally relevant characteristics of plants, and desirable traits that may be imbued by gene expression are listed below.

We have identified polynucleotides encoding transcription factors, developed numerous transgenic plants using these polynucleotides, and have analyzed the plants for a variety of important traits. In so doing, we have identified important polynucleotide and polypeptide sequences for producing commercially valuable plants and crops as well as the methods for making them and using them. Other aspects and embodiments of the invention are described below and can be derived from the teachings of this disclosure as a whole.

SUMMARY OF THE INVENTION

The present invention pertains to transgenic plants that comprise a recombinant polynucleotide that includes a nucleotide sequence encoding a transcription factor with the ability to alter a trait in a plant, for example, by regulating abiotic stress tolerance in the plant.

Transgenic plants and methods for producing transgenic plants are provided. The transgenic plants comprise a recombinant polynucleotide having a polynucleotide sequence, or a sequence that is complementary to this polynucleotide sequence, that encodes a transcription factor.

The present invention is directed to transgenic plants with altered expression of a transcription factor polypeptide. When these plants are compared to non-transgenic plants or wild-type control plants of the same species (that is, those that do not have the expression of the transcription factor polypeptide altered), the transgenic plants are shown to have increased tolerance to a variety of abiotic stresses. These may include, for example, hyperosmotic stress, drought, salt stress, heat stress, or cold stress. A sizeable number of transcription factor sequences, which may be found in the Sequence Listing, have been used to confer these advantages. For example, the transgenic plant may comprise as part of its genome a transgene encoding a polypeptide member of the CCAAT box-binding transcription factor family or the MYB-related transcription factor family. By overexpressing these polypeptide members, the plant becomes more abiotic stress tolerant wild-type controls.

The transgenic plants of the invention may be either dicotyledonous or monocotyledonous, and the polynucleotide and polypeptide sequences of the invention may be derived from dicotyledonous or monocotyledonous plants, or be creations that are structurally and functionally similar. The transgenic plants that define the invention may be crossed with other plants or themselves to generate progeny plants, which may possess advantageous characteristics such as improved stress tolerance. Seed derived from the transgenic plants of the invention are also encompassed within the scope of the invention.

The invention is also directed to methods for producing a transgenic plant having increased tolerance to abiotic stress by introducing an expression vector that contains a polynucleotide sequence encoding a polypeptide of the invention into the plant.

Regardless of the nucleotide sequence used, the expression vector will also contain one or more regulatory elements operably linked to the nucleotide sequence. It is through the regulatory elements that expression of the nucleotide sequence is controlled in a target plant. By introducing the expression vector into a cell of the target plant, growing the plant cell into a plant and allowing the plant to overexpress the polypeptide, a plant with an altered trait, e.g., improved abiotic stress tolerance, relative to a control plant is generated. The improved plants may be identified by comparison to with one or more control plants.

BRIEF DESCRIPTION OF THE SEQUENCE LISTING AND DRAWINGS

The Sequence Listing provides exemplary polynucleotide and polypeptide sequences of the invention. The traits associated with the use of the sequences are included in the Examples.

Incorporation of the Sequence Listing.

The copy of the Sequence Listing, being submitted electronically with this patent application, provided under 37 CFR §1.821-1.825, is a read-only memory computer-readable file in ASCII text format. The Sequence Listing is named "MBI0047PCT_ST25.txt", the electronic file of the Sequence Listing was created on Feb. 25, 2004, and is 6,463, 383 bytes in size (or 6,312 kilobytes in size as measured in MS-WINDOWS). The Sequence Listing is herein incorporated by reference in its entirety.

FIG. 1 shows a conservative estimate of phylogenetic relationships among the orders of flowering plants (modified from Angiosperm Phylogeny Group (1998) *Ann. Missouri Bot. Gard.* 84: 1-49). Those plants with a single cotyledon (monocots) are a monophyletic clade nested within at least two major lineages of dicots; the eudicots are further divided into rosids and asterids. *Arabidopsis* is a rosid eudicot classified within the order Brassicales; rice is a member of the monocot order Poales. FIG. 1 was adapted from Daly et al. (2001) *Plant Physiol.* 127: 1328-1333.

FIG. 2 shows a phylogenic dendogram depicting phylogenetic relationships of higher plant taxa, including clades containing tomato and *Arabidopsis*; adapted from Ku et al. (2000) *Proc. Natl. Acad. Sci.* 97: 9121-9126; and Chase et al. (1993) *Ann. Missouri Bot. Gard.* 80: 528-580.

FIGS. 3A, and 3B show an alignment of G682 (SEQ ID NO: 148) and polynucleotide sequences that are paralogous and orthologous to G682. The alignment was produced using MACVECTOR software (Accelrys, Inc., San Diego, Calif.).

Figure 4B:
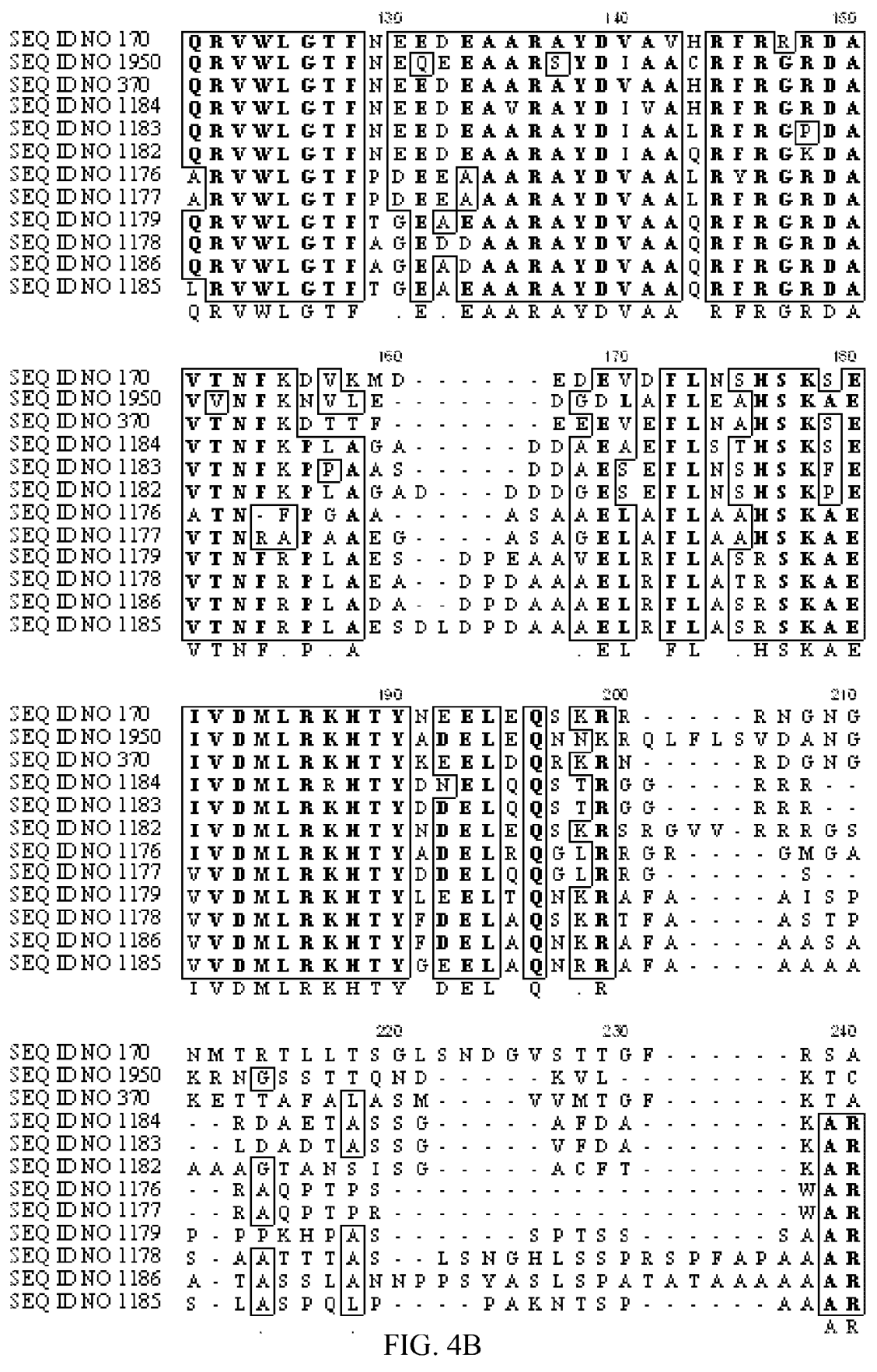
Figure 4C:
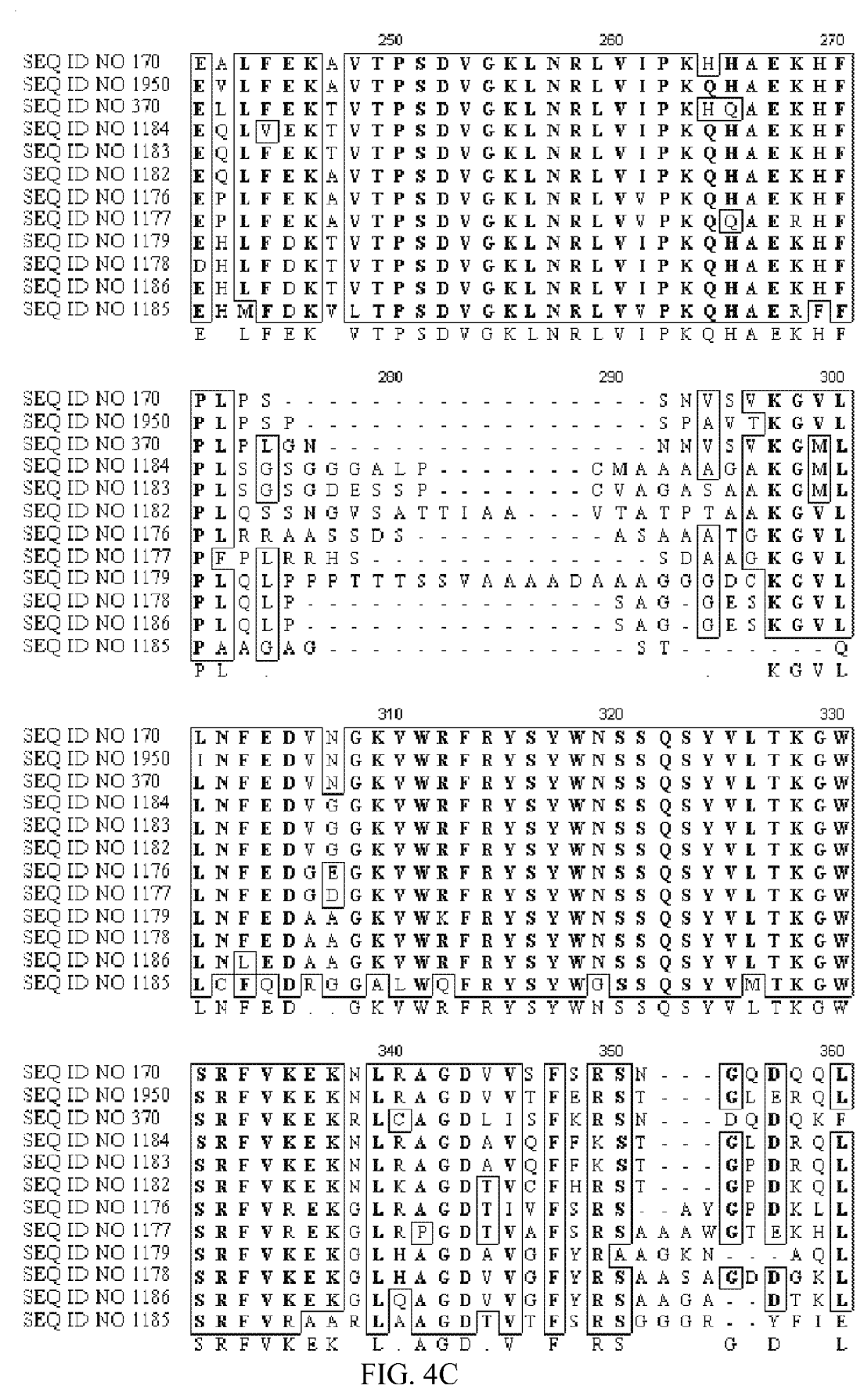

FIGS. 4A, 4B, 4C and 4D show an alignment of G867 (SEQ ID NO: 170) and polynucleotide sequences that are paralogous and orthologous to G867. The alignment was produced using MACVECTOR software (Accelrys, Inc.).

FIGS. 5A, 5B, 5C, 5D, 5E and 5F show an alignment of G912 (SEQ ID NO: 186) and polynucleotide sequences that are paralogous and orthologous to G912. The alignment was produced using MACVECTOR software (Accelrys, Inc.).

Figure 6:
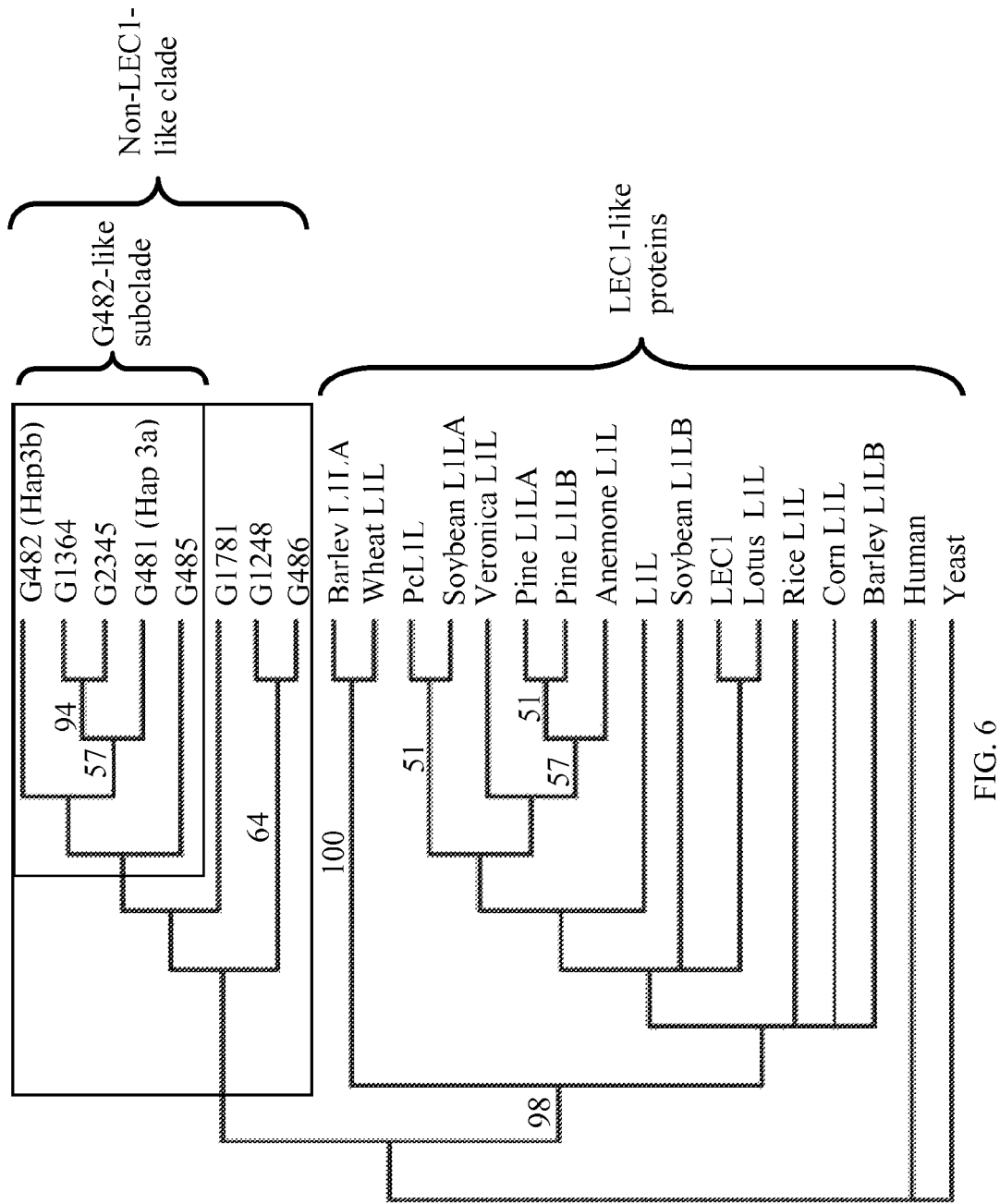

FIG. 6 is adapted from Kwong et al (2003) Plant Cell 15: 5-18, and shows crop sequences identified through BLAST analysis of various L1L-related sequences. A phylogeny tree was then generated using ClustalX based on whole protein sequences showing the non-LEC1-like HAP3 clade of transcription factors (large box). This clade contains *Arabidopsis* sequences as well as members from diverse species that are phylogenetically distinct from the LEC1-like proteins (seen in the next two figures). The smaller box delineates the G482-like subclade, containing transcription factors that are structurally most closely related to G481 and G482.

Figure 7:
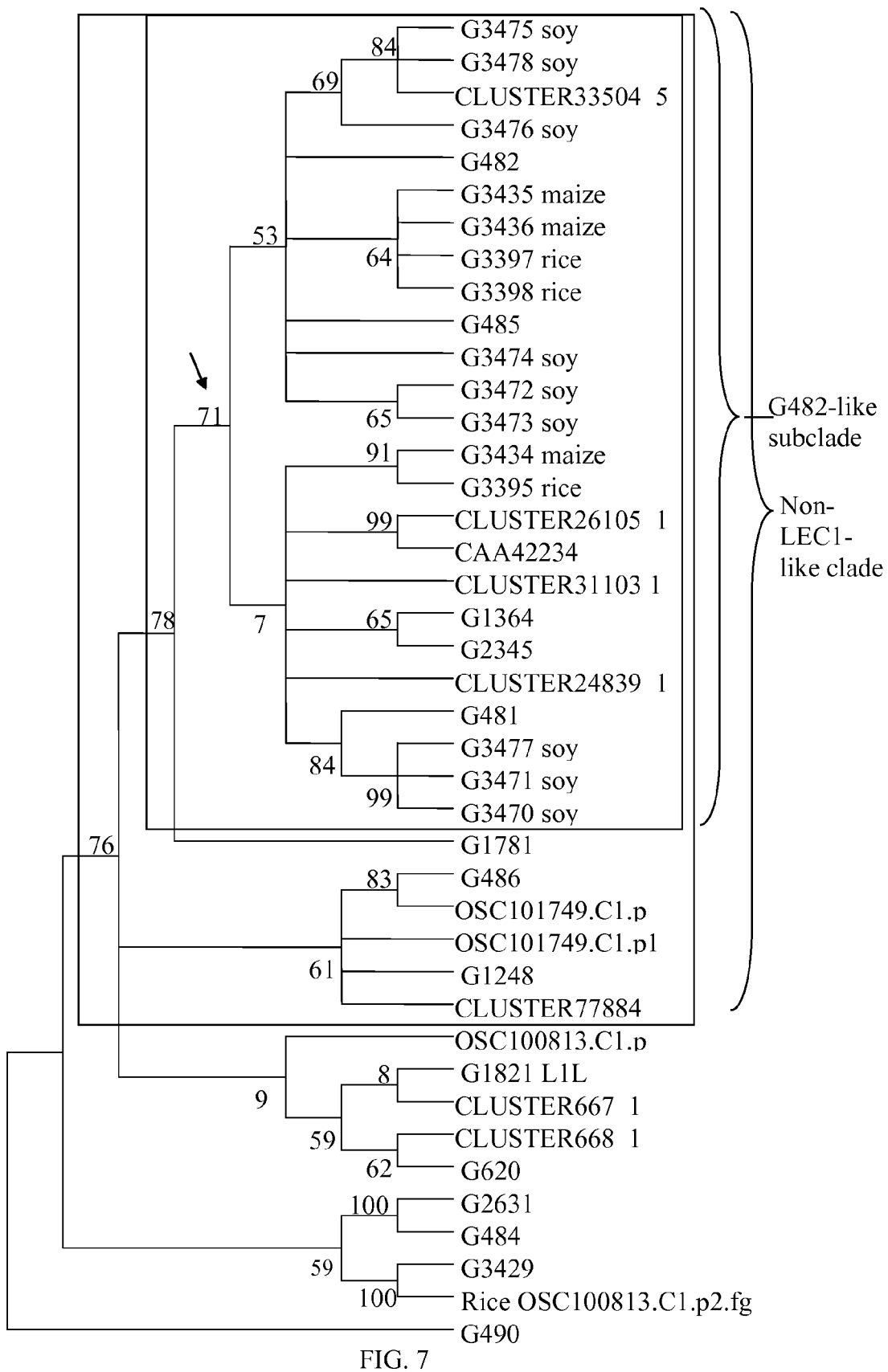

Similar to FIG. 6, FIG. 7 shows the phylogenic relationship of sequences within the G482-subclade (within the smaller box) and the non-LEC1-like clade (larger box). The G482-subclade contains members from diverse species, including *Arabidopsis*, soy, rice and corn sequences that are phylogenetically distinct from the LEC1-like proteins, some of which are also shown in FIG. 6. *Arabidopsis* plants carrying a mutation in the LEC1 gene display embryos that are intolerant to desiccation and that show defects in seed maturation (Lotan et al. (1998) *Cell* 93: 1195-1205). We have shown that the G482 subclade members confer abiotic stress tolerance. Given their phylogenetic divergence, it is possible that LEC1-like proteins seen below the G482 subclade have evolved to confer desiccation tolerance specifically within the embryo, whereas other G482 subclade evolved to confer abiotic stress tolerance in non-embryonic tissues.

Figure 8:
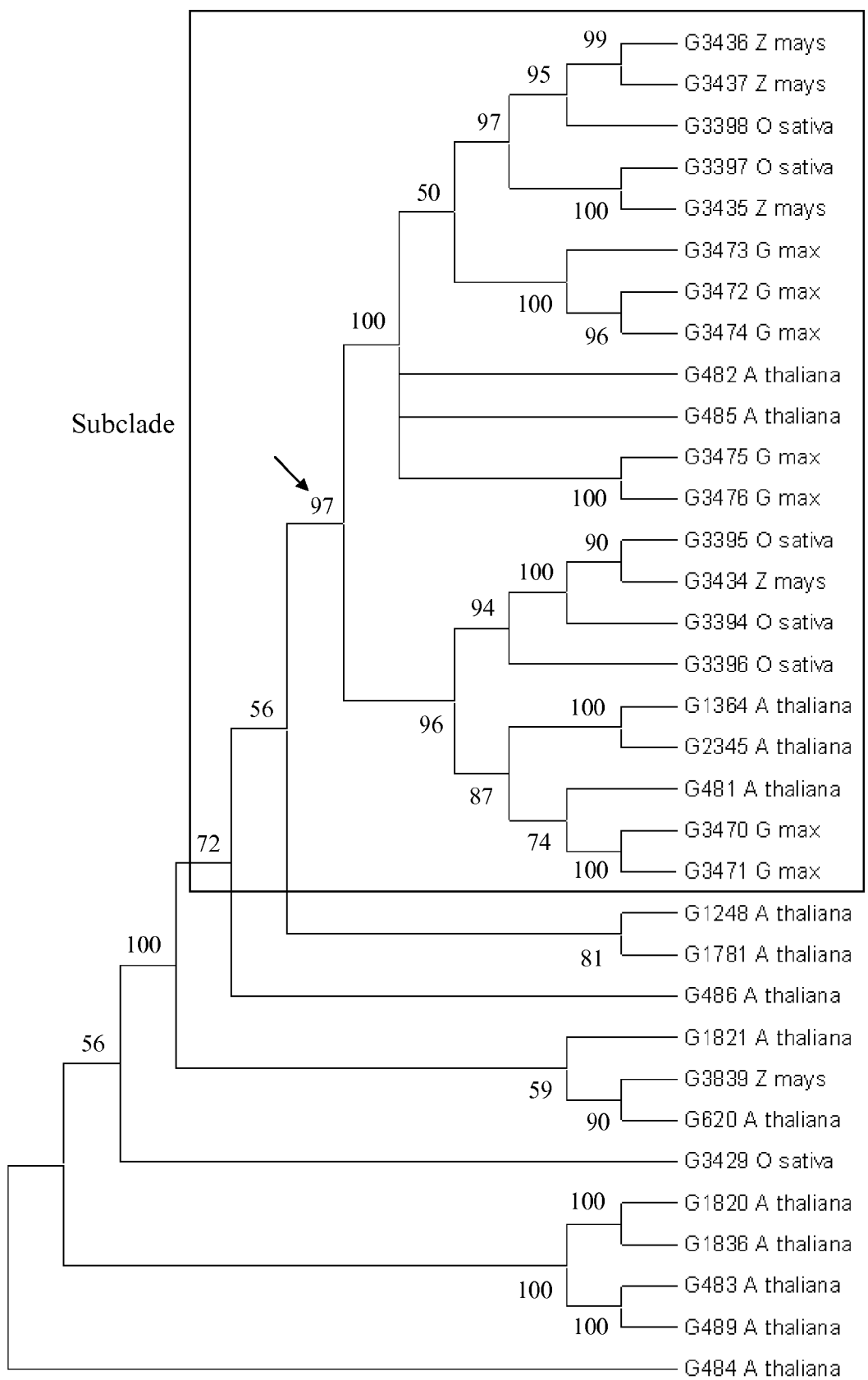

For FIG. 8, a phylogenic relationship of sequences within the G482-subclade was generated with different method than used to create FIG. 7. In this case, the phylogenetic tree and multiple sequence alignments of G481 and related full length proteins were constructed using ClustalW (CLUSTAL W Multiple Sequence Alignment Program version 1.83, 2003) and MEGA2 (http://www.megasoftware.net) software. The ClustalW multiple alignment parameters were:
Gap Opening Penalty: 10.00
Gap Extension Penalty: 0.20
Delay divergent sequences: 30%
DNA Transitions Weight: 0.50
Protein weight matrix: Gonnet series
DNA weight matrix: IUB
Use negative matrix: OFF.

A FastA formatted alignment was then used to generate a phylogenetic tree in MEGA2 using the neighbor joining algorithm and a p-distance model. A test of phylogeny was done via bootstrap with 100 replications and Random Speed set to default. Cut off values of the bootstrap tree were set to 50%. The G482 subclade of the non-LEC1-like clade of proteins of the L1L-related CCAAT transcription factor family (box), are derived from a common single node (arrow) and a representative number, including *Arabidopsis* sequences G481, G482, G485, G1364 and G2345, soy sequences G3470, G3471, G3472, G3475, G3476, rice sequences G3395, G3397, G3398, G3429, and corn sequences G3434, and G3436, have been shown to confer abiotic stress tolerance in plants (see Example XIII).

Figure 9:

FIG. 9 shows the domain structure of HAP3 proteins. HAP3 proteins contain an amino-terminal A domain, a central B domain, and a carboxy-terminal C domain. There may be relatively little sequence similarity between HAP3 proteins in the A and C domains. The A and C domains could thus provide a degree of specificity to each member of the HAP3 family. The B domain is the conserved region that specifies DNA binding and subunit association.

Figure 10B:
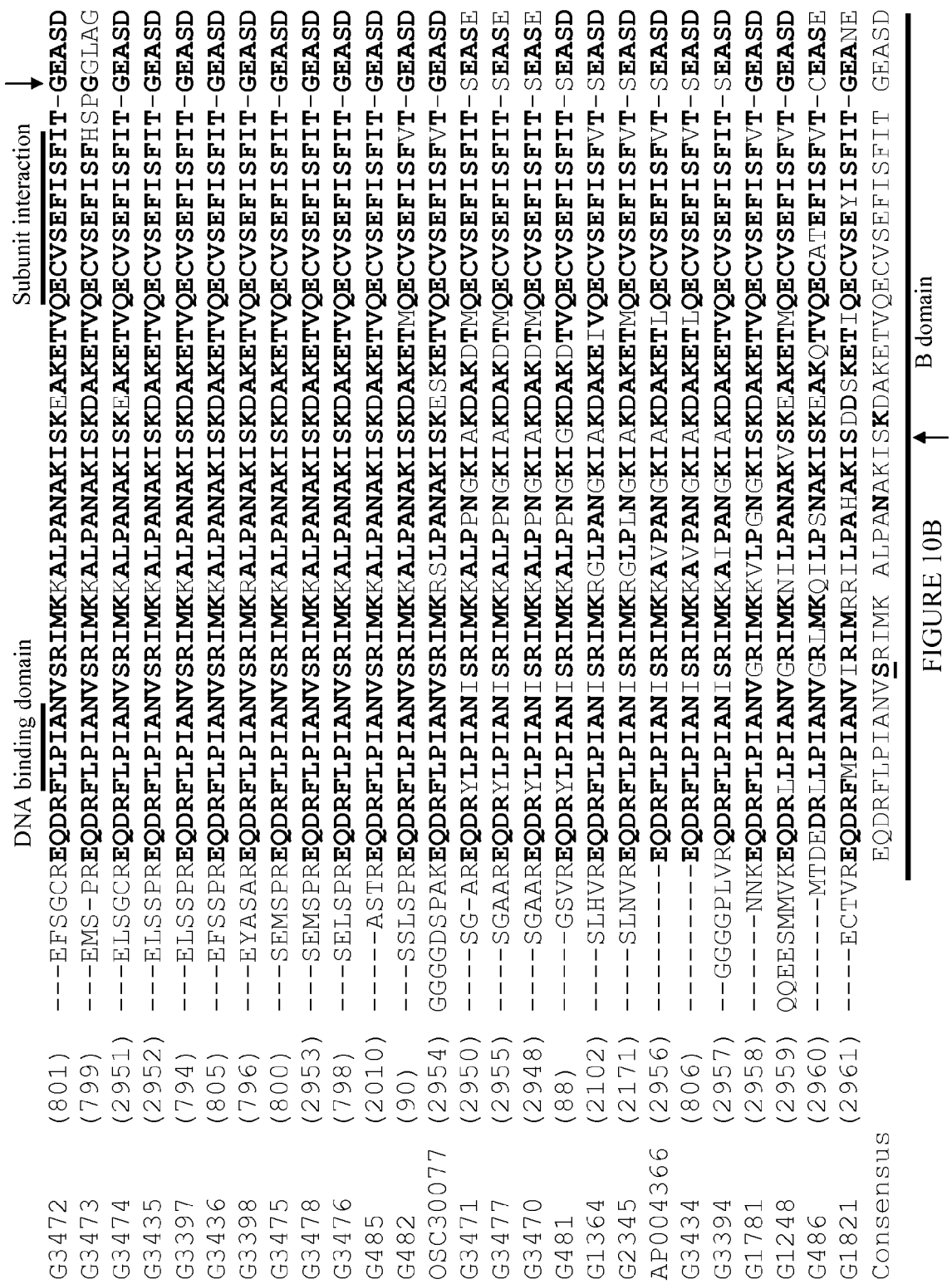

In FIGS. 10A-10F, the alignments of HAP3 polypeptides are presented, including G481, G482, G485, G1364, G2345, G1781 and related sequences from *Arabidopsis* aligned with soybean, rice and corn sequences, showing the B domains (indicated by the line that spans FIGS. 10B through 10D). Consensus residues within the listed sequences are indicated by boldface. The boldfaced residues in the consensus sequence that appears at the bottom of FIGS. 10A through 10C in their respective positions are uniquely found in the non-LEC1-like clade. The underlined serine residue appearing in the consensus sequence in its respective positions is uniquely found within the G482-like subclade. As discussed in greater detail below in Example III, the residue positions indicated by the arrows in FIG. 10B are associated with an alteration of flowering time when these polypeptides are overexpressed.

Figure 11:
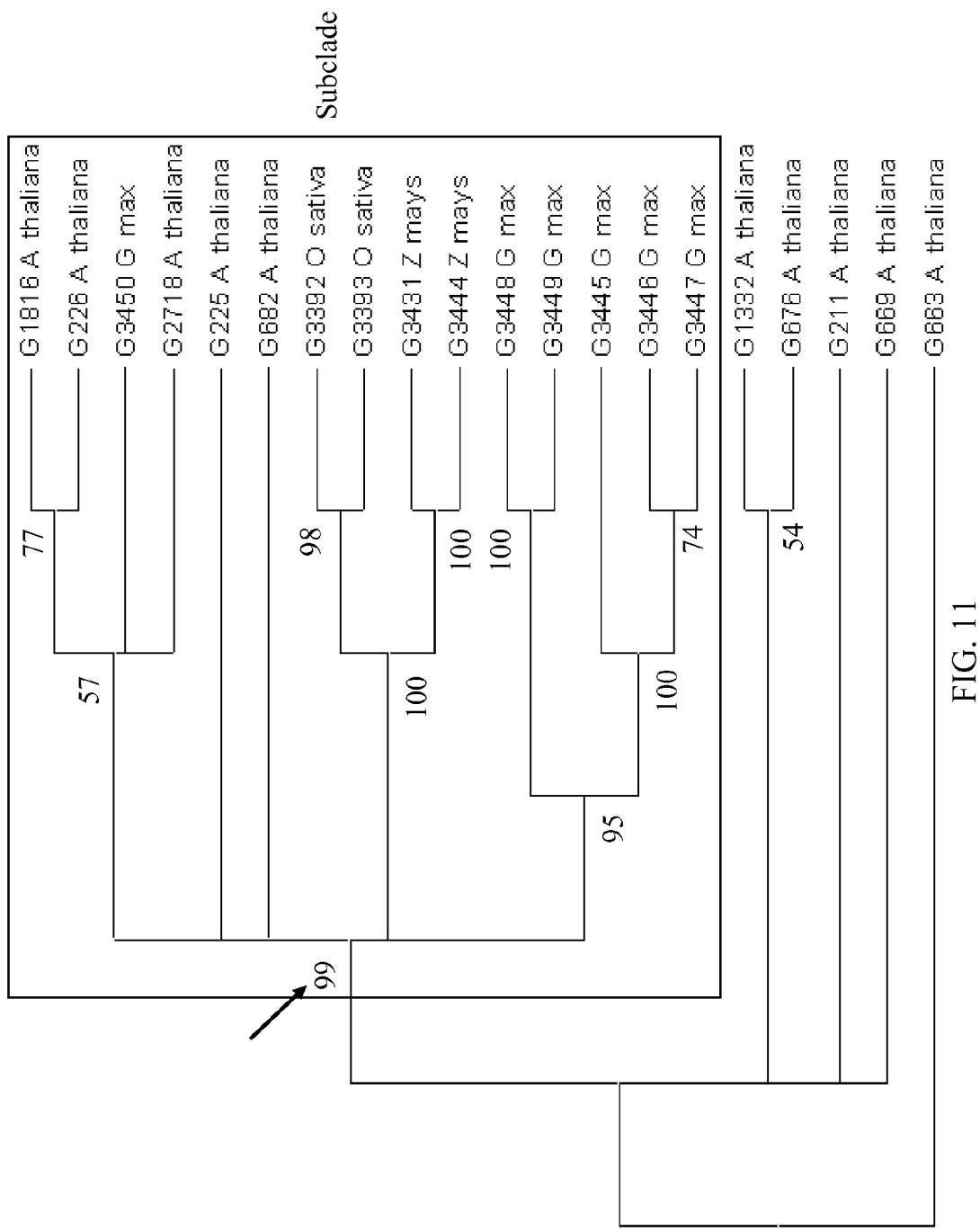

FIG. 11 is a phylogenetic tree of defined conserved domains of G682 and related polypeptides constructed with ClustalW (CLUSTAL W Multiple Sequence Alignment Program version 1.83, 2003) and MEGA2 (http://www.megasoftware.net) software. ClustalW multiple alignment parameters were as follows:

Gap Opening Penalty: 10.00
Gap Extension Penalty: 0.20
Delay divergent sequences: 30%
DNA Transitions Weight: 0.50
Protein weight matrix: Gonnet series
DNA weight matrix: IUB
Use negative matrix: OFF
A FastA formatted alignment was then used to generate a phylogenetic tree in MEGA2 using the neighbor joining algorithm and a p-distance model. A test of phylogeny was done via bootstrap with 100 replications and Random Speed set to default. Cut off values of the bootstrap tree were set to 50%. The G682 subclade of MYB-related transcription factors, a group of structurally and functionally related sequences that derive from a single ancestral node (arrow), appears within the box in FIG. 11.

Figure 12A:
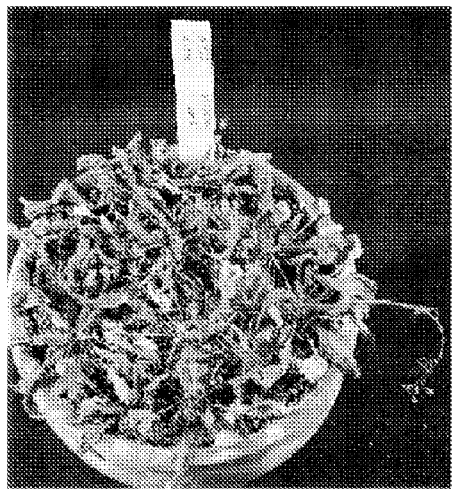
Figure 12B:
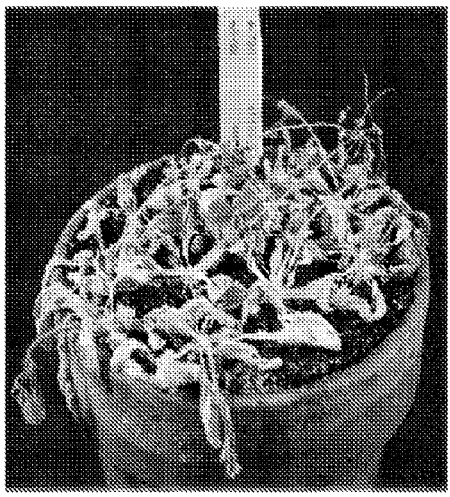
Figure 12C:
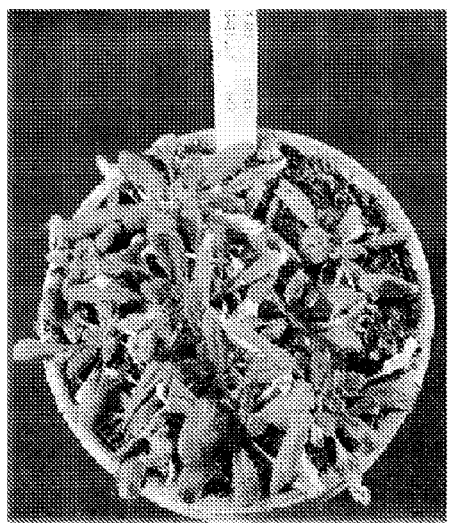
Figure 12D:
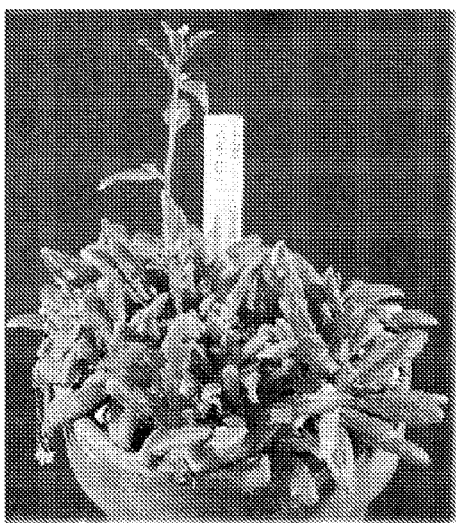

FIGS. 12A-12D show the effects of water deprivation and recovery from this treatment on *Arabidopsis* control and 35S::G481-overexpressing lines. After eight days of drought treatment overexpressing plants had a darker green and less withered appearance (FIG. 12C) than those in the control group (FIG. 12A). The differences in appearance between the control and G481-overexpressing plants after they were rewatered was even more striking. Most (11 of 12 plants; exemplified in FIG. 12B) of this set of control plants died after rewatering, indicating the inability to recover following severe water deprivation, whereas all nine of the overexpressor plants of the line shown recovered from this drought treatment (exemplified in FIG. 12D). The results shown in FIGS. 12A-12D were typical of a number of control and 35S::G481-overexpressing lines.

Figure 13A:
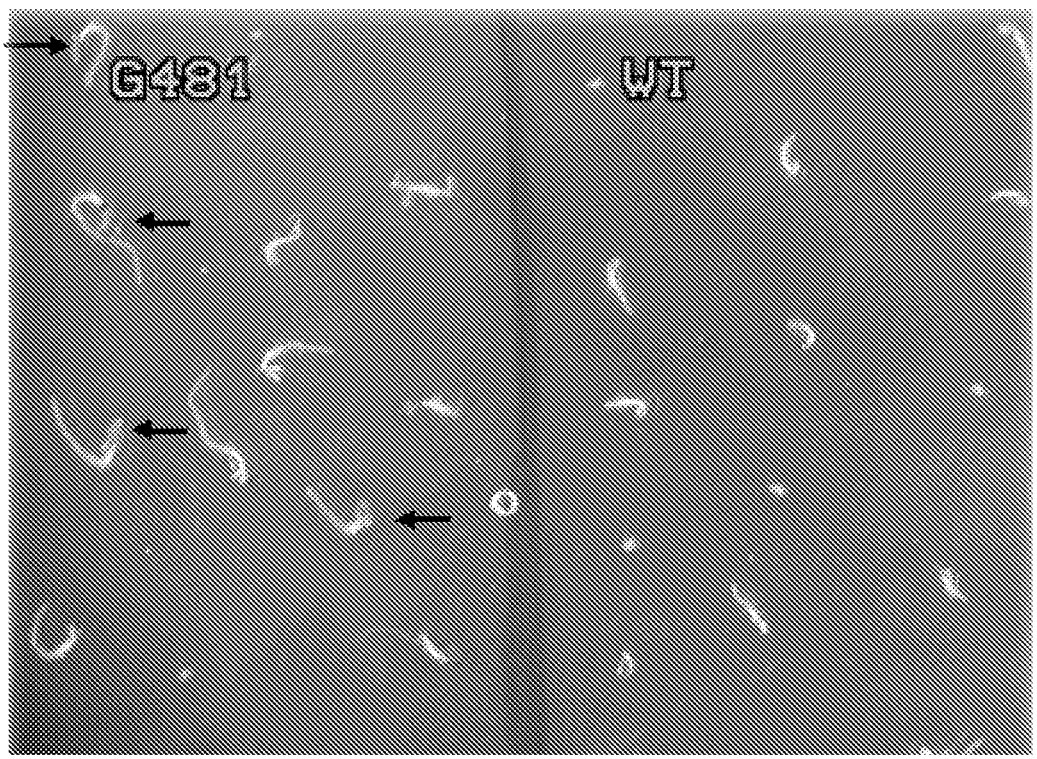
Figure 13B:
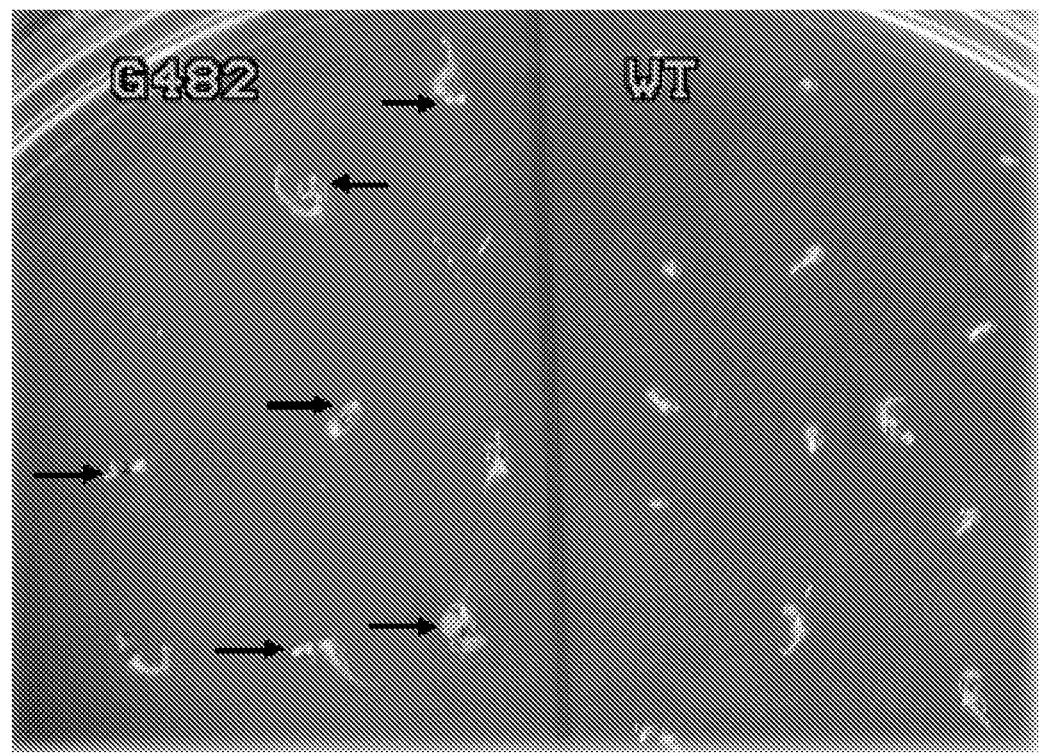

FIGS. 13A and 13B show the effects of salt stress on *Arabidopsis* seed germination. The three lines of G481- and G482 overexpressors on these two plate had longer roots and showed greater cotyledon expansion (arrows) after three days on 150 mM NaCl than the control seedlings on the right-hand sides of the plates.

Figure 14A:
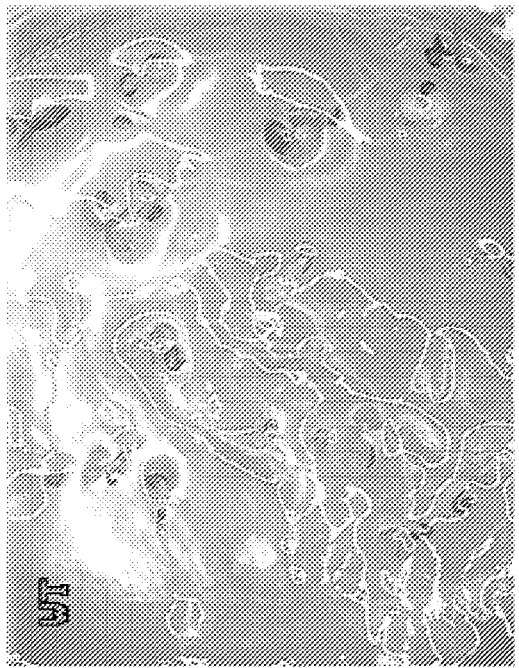
Figure 14B:
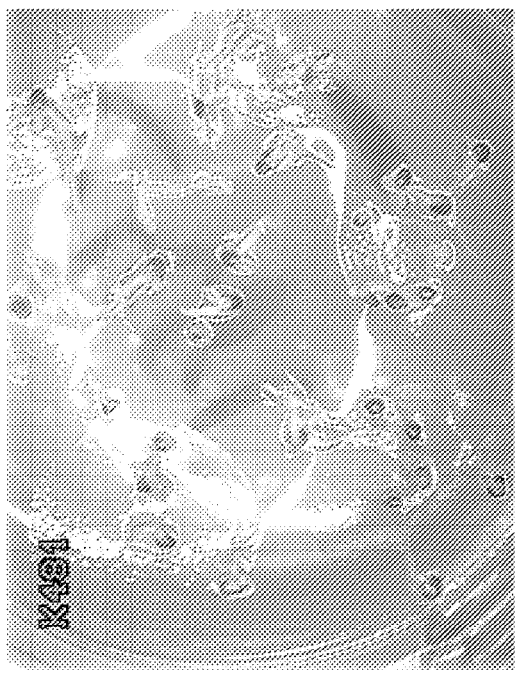
Figure 14C:
Figure 14D:

In FIG. 14A, G481 null mutant seedlings (labeled K481) show reduced tolerance to hyperosmotic stress, relative to the control seedlings in FIG. 14B, as evidenced by the reduced cotyledon expansion and root growth in the former group. Without salt stress tolerance on control media, (FIGS. 14C, G481 null mutants; and 14D, control seedlings), the knocked out and control plants appear the same.

FIGS. 15A-15D show the effects of stress-related treatments on G485 overexpressing seedlings (35S::G485 lines) in plate assays. In each treatment, including cold, high sucrose, high salt and ABA germination assays, the overexpressors fared much better than the wild-type controls exposed to the same treatments in FIGS. 15E-15H, respectively, as evidenced by the enhanced cotyledon expansion and root growth seen with the overexpressing seedlings.

Figure 16A:
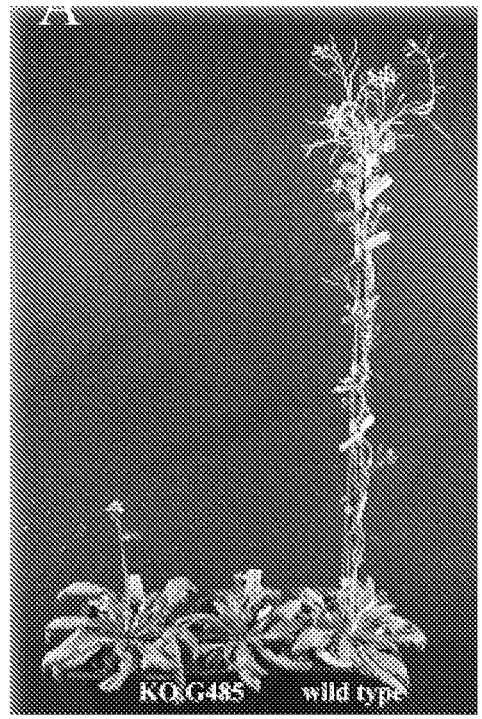
Figure 16B:
Figure 16C:
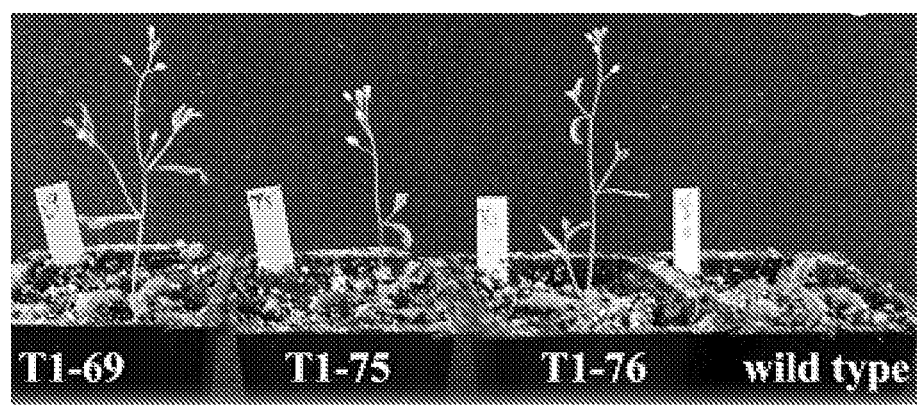

FIGS. 16A-16C depict the effects of G485 knockout and overexpression on flowering time and maturation. As seen in FIG. 16A, a T-DNA insertion knockout mutation containing a SALK_062245 insertion was shown to flower several days later than wild-type control plants. The plants in FIG. 16A are shown 44 days after germination. FIG. 16C shows that G485 primary transformants flowered distinctly earlier than wild-type controls. These plants are shown 24 days after germination. These effects were observed in each of two independent T1 plantings derived from separate transformation dates.

Additionally, accelerated flowering was also seen in plants that overexpressed G485 from a two component system (35S::LexA; op-LexA::G485). These studies indicated that G485 is both sufficient to act as a floral activator, and is also necessary in that role within the plant. G485 overexpressor plants also matured and set siliques much more rapidly than wild type controls, as shown in FIG. 16B with plants 39 days post-germination.

Figure 17A:
Figure 17B:

FIG. 17A shows the effects of a high salt medium on the germination of 35S::G3392 (a rice G682 ortholog) line 322. In this figure, the seedlings appeared larger and greener than the wild-type *Arabidopsis* seedlings similarly treated in FIG. 17B.

Figure 18A:
Figure 18B:
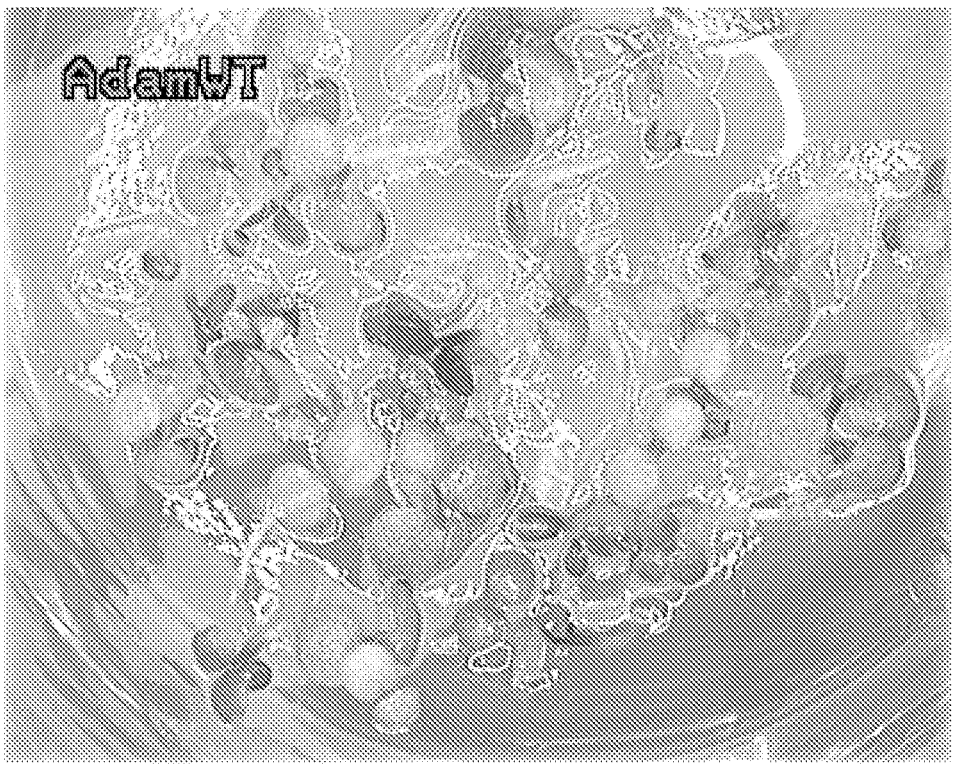

FIG. 18A shows the effects of cold treatment on the germination of 35S::G3450 (soy G682 ortholog) line 307. In this figure, the seedlings had less anthocyanin than the wild-type *Arabidopsis* seedlings similarly treated in FIG. 18B.

Figure 19A:
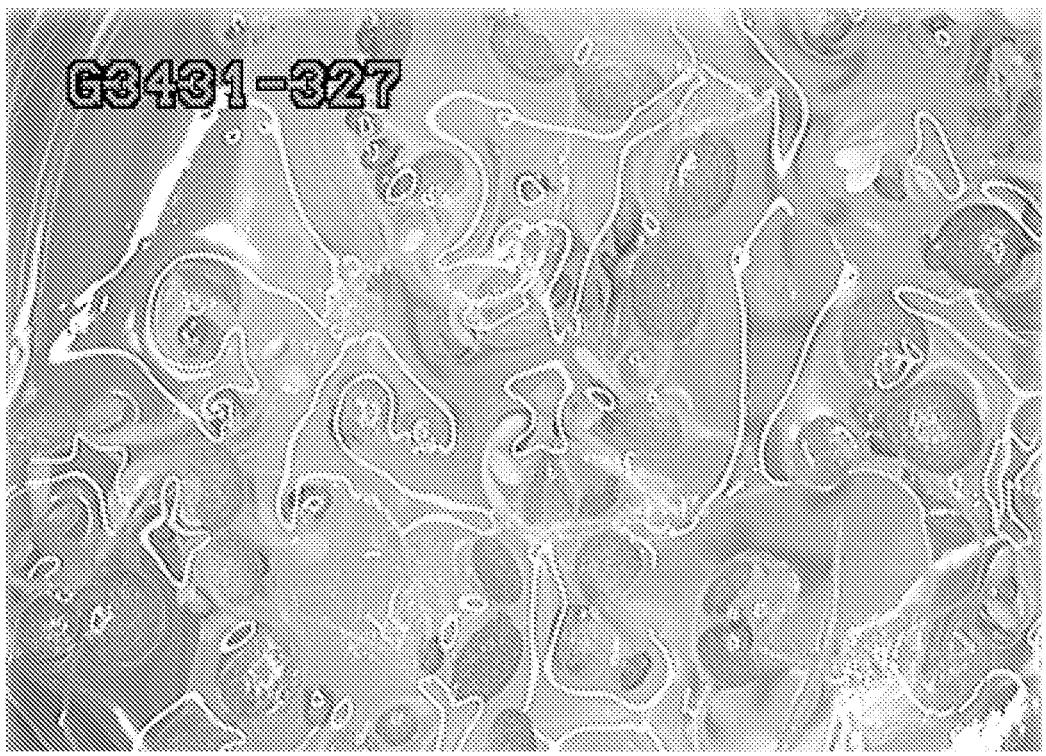
Figure 19B:
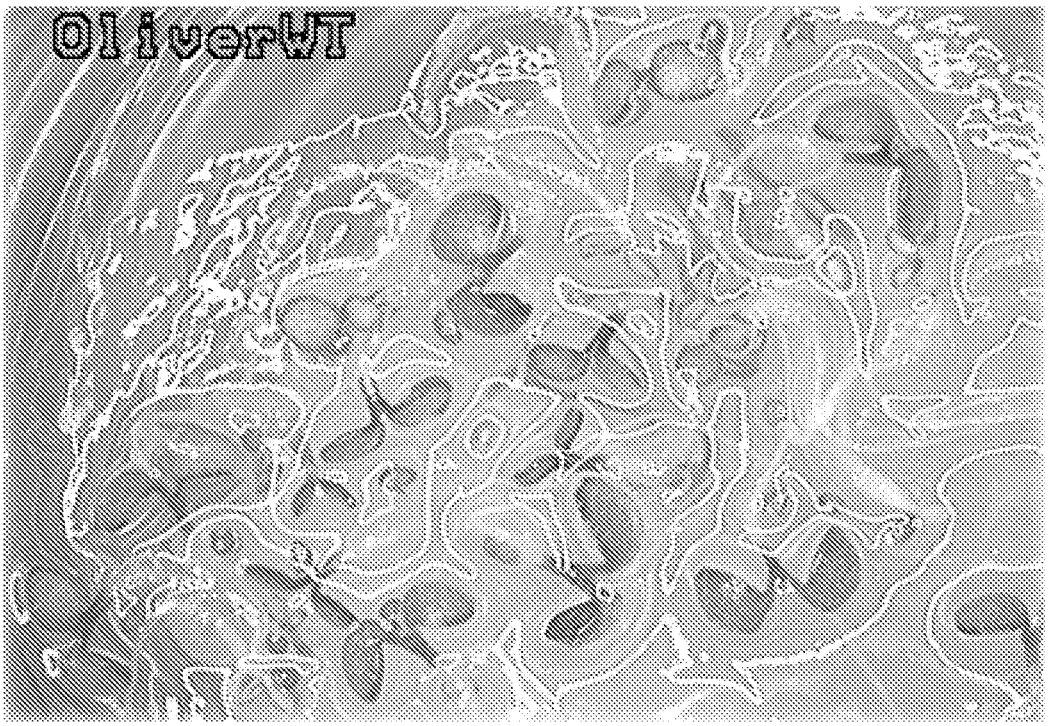

FIG. 19A compares the germination of 35S::G3431 (a corn G682 ortholog) line 327 *Arabidopsis* seedlings on a 9.4% sucrose germination plate with non-transgenic control seedlings of the same species similarly treated in FIG. 19B. The overexpressors were greener and had less anthocyanin than the non-transgenic control plants of the same species.

Figure 20:
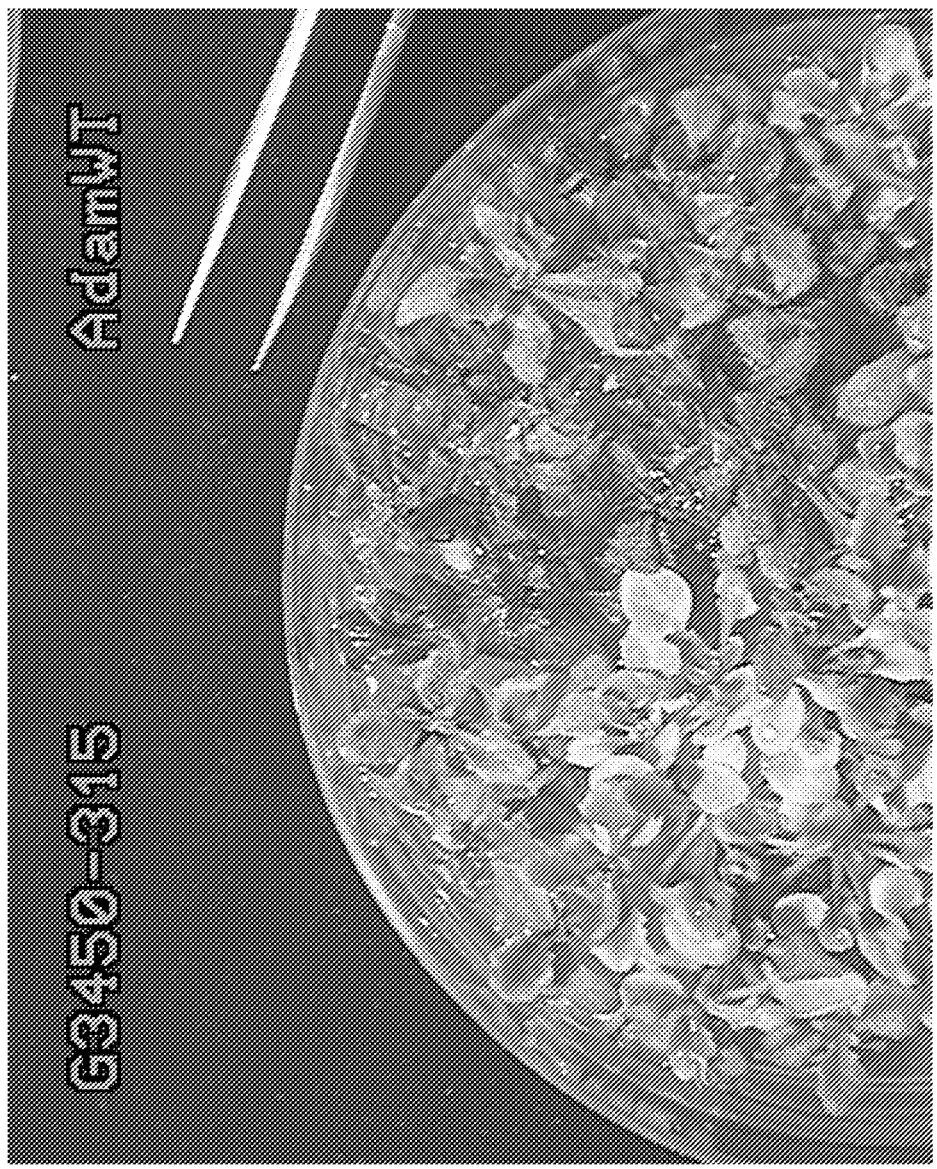

In FIG. 20, the deleterious effects of a heat treatment are seen in the wild-type plants on the right, and to a much lesser extent in the plants overexpressing the soy G3450 sequence on the left.

DETAILED DESCRIPTION OF EXEMPLARY EMBODIMENTS

In an important aspect, the present invention relates to polynucleotides and polypeptides, for example, for modifying phenotypes of plants. Throughout this disclosure, various information sources are referred to and/or are specifically incorporated. The information sources include scientific journal articles, patent documents, textbooks, and World Wide Web browser-inactive page addresses, for example. While the reference to these information sources clearly indicates that they can be used by one of skill in the art, each and every one of the information sources cited herein are specifically incorporated in their entirety, whether or not a specific mention of "incorporation by reference" is noted. The contents and teachings of each and every one of the information sources can be relied on and used to make and use embodiments of the invention.

As used herein and in the appended claims, the singular forms "a," "an," and "the" include plural reference unless the context clearly dictates otherwise. Thus, for example, a reference to "a plant" includes a plurality of such plants, and a reference to "a stress" is a reference to one or more stresses and equivalents thereof known to those skilled in the art, and so forth.

The polynucleotide sequences of the invention encode polypeptides that are members of well-known transcription factor families, including plant transcription factor families, as disclosed in Tables 7-11. Generally, the transcription factors encoded by the present sequences are involved in cellular metabolism, cell differentiation and proliferation and the regulation of growth. Accordingly, one skilled in the art would recognize that by expressing the present sequences in a plant, one may change the expression of autologous genes or induce the expression of introduced genes. By affecting the expression of similar autologous sequences in a plant that have the biological activity of the present sequences, or by introducing the present sequences into a plant, one may alter a plant's phenotype to one with improved traits. The sequences of the invention may also be used to transform a plant and introduce desirable traits not found in the wild-type cultivar or strain. Plants may then be selected for those that produce the most desirable degree of over- or under-expression of target genes of interest and coincident trait improvement.

The sequences of the present invention may be from any species, particularly plant species, in a naturally occurring form or from any source whether natural, synthetic, semi-synthetic or recombinant. The sequences of the invention may also include fragments of the present amino acid sequences. In this context, a "fragment" refers to a fragment of a polypeptide sequence which is at least 5 to about 15 amino acids in length, most preferably at least 14 amino acids, and which retain some biological activity of a transcription factor. Where "amino acid sequence" is recited to refer to an amino acid sequence of a naturally occurring protein molecule, "amino acid sequence" and like terms are not meant to limit the amino acid sequence to the complete native amino acid sequence associated with the recited protein molecule.

As one of ordinary skill in the art recognizes, transcription factors can be identified by the presence of a region or domain of structural similarity or identity to a specific consensus sequence or the presence of a specific consensus DNA-binding site or DNA-binding site motif (see, for example, Riechmann et al. (2000) *Science* 290: 2105-2110). The plant transcription factors may belong to one of the following transcription factor families: the AP2 (APETALA2) domain transcription factor family (Riechmann and Meyerowitz (1998) *Biol. Chem.* 379: 633-646); the MYB transcription factor family (ENBib; Martin and Paz-Ares (1997) *Trends Genet.* 13: 67-73); the MADS domain transcription factor family (Riechmann and Meyerowitz (1997) *Biol. Chem.* 378: 1079-1101); the WRKY protein family (Ishiguro and Nakamura (1994) *Mol. Gen. Genet.* 244: 563-571); the ankyrin-repeat protein family (Zhang et al. (1992) *Plant Cell* 4: 1575-1588); the zinc finger protein (Z) family (Klug and Schwabe (1995) *FASEB J.* 9: 597-604); Takatsuji (1998) *Cell. Mol. Life. Sci.* 54:582-596); the homeobox (HB) protein family (Buerglin (1994) in *Guidebook to the Homeobox Genes*, Duboule (ed.) Oxford University Press); the CAAT-element binding proteins (Forsburg and Guarente (1989) *Genes Dev.* 3: 1166-1178); the squamosa promoter binding proteins (SPB) (Klein et al. (1996) *Mol. Gen. Genet.* 1996 250: 7-16); the NAM protein family (Souer et al. (1996) *Cell* 85: 159-170); the IAA/AUX proteins (Abel et al. (1995) *J. Mol. Biol.* 251: 533-549); the HLH/MYC protein family (Littlewood et al. (1994) *Prot. Profile* 1: 639-709); the DNA-binding protein (DBP) family (Tucker et al. (1994) *EMBO J.* 13: 2994-3002); the bZIP family of transcription factors (Foster et al. (1994) *FASEB J.* 8: 192-200); the Box P-binding protein (the BPF-1) family (da Costa e Silva et al. (1993) *Plant J.* 4: 125-135); the high mobility group (HMG) family (Bustin and Reeves (1996) *Prog. Nucl. Acids Res. Mol. Biol.* 54: 35-100); the scarecrow (SCR) family (Di Laurenzio et al. (1996) *Cell* 86: 423-433); the GF14 family (Wu et al. (1997) *Plant Physiol.* 114: 1421-1431); the polycomb (PCOMB) family (Goodrich et al. (1997) *Nature* 386: 44-51); the teosinte branched (TEO) family (Luo et al. (1996) *Nature* 383: 794-799); the ABI3 family (Giraudat et al. (1992) *Plant Cell* 4: 1251-1261); the triple helix (TH) family (Dehesh et al. (1990) *Science* 250: 1397-1399); the EIL family (Chao et al. (1997) *Cell* 89: 1133-44); the AT-HOOK family (Reeves and Nissen (1990) *J. Biol. Chem.* 265: 8573-8582); the S1FA family (Zhou et al. (1995) *Nucleic Acids Res.* 23: 1165-1169); the bZIPT2 family (Lu and Ferl (1995) *Plant Physiol.* 109: 723); the YABBY family (Bowman et al. (1999) *Development* 126: 2387-96); the PAZ family (Bohmert et al. (1998) *EMBO J.* 17: 170-80); a family of miscellaneous (MISC) transcription factors including the DPBF family (Kim et al. (1997) *Plant J.* 11: 1237-1251) and the SPF1 family (Ishiguro and Nakamura (1994) *Mol. Gen. Genet.* 244: 563-571); the GARP family (Hall et al. (1998) *Plant Cell* 10: 925-936), the TUBBY family (Boggin et al (1999) *Science* 286: 2119-2125), the heat shock family (Wu (1995) *Annu. Rev. Cell Dev. Biol.* 11: 441-469), the ENBP family (Christiansen et al. (1996) *Plant Mol. Biol.* 32: 809-821), the RING-zinc family (Jensen et al. (1998) *FEBS Letters* 436: 283-287), the PDBP family (Janik et al. (1989) *Virology* 168: 320-329), the PCF family (Cubas et al. *Plant J.* (1999) 18: 215-22), the SRS(SHI-related) family (Fridborg et al. (1999) *Plant Cell* 11: 1019-1032), the CPP (cysteine-rich polycomb-like) family (Cvitanich et al. (2000) *Proc. Natl. Acad. Sci.* 97: 8163-8168), the ARF (auxin response factor) family (Ulmasov et al. (1999) *Proc. Natl. Acad. Sci.* 96: 5844-5849), the SWI/SNF family (Collingwood et al. (1999) *J. Mol. Endocrinol.* 23: 255-275), the ACBF family (Seguin et al. (1997) *Plant Mol. Biol.* 35: 281-291), PCGL (CG-1 like) family (da Costa e Silva et al. (1994) *Plant Mol. Biol.* 25: 921-924) the ARID family (Vazquez et al. (1999) *Development* 126: 733-742), the Jumonji family (Balciunas et al. (2000), *Trends Biochem. Sci.* 25: 274-276), the bZIP-NIN family (Schauser et al. (1999) *Nature* 402: 191-195), the E2F family (Kaelin et al. (1992) *Cell* 70: 351-364) and the GRF-like family (Knaap et al. (2000) *Plant Physiol.* 122: 695-704). As indicated by any part of the list above and as known in the art, transcription factors have been sometimes categorized by class, family, and sub-family according to their structural content and consensus DNA-binding site motif, for example. Many of the classes and many of the families and sub-families are listed here. However, the inclusion of one sub-family and not another, or the inclusion of one family and not another, does not mean that the invention does not encompass polynucleotides or polypeptides of a certain family or sub-family. The list provided here is merely an example of the types of transcription factors and the knowledge available concerning the consensus sequences and consensus DNA-binding site motifs that help define them as known to those of skill in the art (each of the references noted above are specifically incorporated herein by reference). A transcription factor may include, but is not limited to, any polypeptide that can activate or repress transcription of a single gene or a number of genes. This polypeptide group includes, but is not limited to, DNA-binding proteins, DNA-binding protein binding proteins, protein kinases, protein phosphatases, protein methyltransferases, GTP-binding proteins, and receptors, and the like.

In addition to methods for modifying a plant phenotype by employing one or more polynucleotides and polypeptides of the invention described herein, the polynucleotides and polypeptides of the invention have a variety of additional uses. These uses include their use in the recombinant production (i.e., expression) of proteins; as regulators of plant gene expression, as diagnostic probes for the presence of complementary or partially complementary nucleic acids (including for detection of natural coding nucleic acids); as substrates for further reactions, e.g., mutation reactions, PCR reactions, or the like; as substrates for cloning e.g., including digestion or ligation reactions; and for identifying exogenous or endogenous modulators of the transcription factors. A "polynucleotide" is a nucleic acid molecule comprising a plurality of polymerized nucleotides, e.g., at least about 15 consecutive polymerized nucleotides, optionally at least about 30 consecutive nucleotides, at least about 50 consecutive nucleotides. A polynucleotide may be a nucleic acid, oligonucleotide, nucleotide, or any fragment thereof. In many instances, a polynucleotide comprises a nucleotide sequence encoding a polypeptide (or protein) or a domain or fragment thereof. Additionally, the polynucleotide may comprise a promoter, an intron, an enhancer region, a polyadenylation site, a translation initiation site, 5' or 3' untranslated regions, a reporter gene, a selectable marker, or the like. The polynucleotide can be single stranded or double stranded DNA or RNA. The polynucleotide optionally comprises modified bases or a modified backbone. The polynucleotide can be, e.g., genomic DNA or RNA, a transcript (such as an mRNA), a cDNA, a PCR product, a cloned DNA, a synthetic DNA or RNA, or the like. The polynucleotide can be combined with carbohydrate, lipids, protein, or other materials to perform a particular activity such as transformation or form a useful composition such as a peptide nucleic acid (PNA). The polynucleotide can comprise a sequence in either sense or antisense orientations. "Oligonucleotide" is substantially equivalent to the terms amplimer, primer, oligomer, element, target, and probe and is preferably single stranded.

Definitions

A "recombinant polynucleotide" is a polynucleotide that is not in its native state, e.g., the polynucleotide comprises a nucleotide sequence not found in nature, or the polynucleotide is in a context other than that in which it is naturally found, e.g., separated from nucleotide sequences with which it typically is in proximity in nature, or adjacent (or contiguous with) nucleotide sequences with which it typically is not in proximity. For example, the sequence at issue can be cloned into a vector, or otherwise recombined with one or more additional nucleic acid.

An "isolated polynucleotide" is a polynucleotide whether naturally occurring or recombinant, that is present outside the cell in which it is typically found in nature, whether purified or not. Optionally, an isolated polynucleotide is subject to one or more enrichment or purification procedures, e.g., cell lysis, extraction, centrifugation, precipitation, or the like.

A "polypeptide" is an amino acid sequence comprising a plurality of consecutive polymerized amino acid residues e.g., at least about 15 consecutive polymerized amino acid residues, optionally at least about 30 consecutive polymerized amino acid residues, at least about 50 consecutive polymerized amino acid residues. In many instances, a polypeptide comprises a polymerized amino acid residue sequence that is a transcription factor or a domain or portion or fragment thereof. A transcription factor can regulate gene expression and may increase or decrease gene expression in a plant. Additionally, the polypeptide may comprise 1) a localization domain, 2) an activation domain, 3) a repression domain, 4) an oligomerization domain, or 5) a DNA-binding domain, or the like. The polypeptide optionally comprises modified amino acid residues, naturally occurring amino acid residues not encoded by a codon, non-naturally occurring amino acid residues.

A "recombinant polypeptide" is a polypeptide produced by translation of a recombinant polynucleotide. A "synthetic polypeptide" is a polypeptide created by consecutive polymerization of isolated amino acid residues using methods well known in the art. An "isolated polypeptide," whether a naturally occurring or a recombinant polypeptide, is more enriched in (or out of) a cell than the polypeptide in its natural state in a wild-type cell, e.g., more than about 5% enriched, more than about 10% enriched, or more than about 20%, or more than about 50%, or more, enriched, i.e., alternatively denoted: 105%, 110%, 120%, 150% or more, enriched relative to wild type standardized at 100%. Such an enrichment is not the result of a natural response of a wild-type plant. Alternatively, or additionally, the isolated polypeptide is separated from other cellular components with which it is typically associated, e.g., by any of the various protein purification methods herein.

"Identity" or "similarity" refers to sequence similarity between two polynucleotide sequences or between two polypeptide sequences, with identity being a more strict comparison. The phrases "percent identity" and "% identity" refer to the percentage of sequence similarity found in a comparison of two or more polynucleotide sequences or two or more polypeptide sequences. "Sequence similarity" refers to the percent similarity in base pair sequence (as determined by any suitable method) between two or more polynucleotide sequences. Two or more sequences can be anywhere from 0-100% similar, or any integer value therebetween. Identity or similarity can be determined by comparing a position in each sequence that may be aligned for purposes of comparison. When a position in the compared sequence is occupied by the same nucleotide base or amino acid, then the molecules are identical at that position. A degree of similarity or identity between polynucleotide sequences is a function of the number of identical or matching nucleotides at positions shared by the polynucleotide sequences. A degree of identity of polypeptide sequences is a function of the number of identical amino acids at positions shared by the polypeptide sequences. A degree of homology or similarity of polypeptide sequences is a function of the number of amino acids at positions shared by the polypeptide sequences.

"Alignment" refers to a number of DNA or amino acid sequences aligned by lengthwise comparison so that components in common (i.e., nucleotide bases or amino acid residues) may be visually and readily identified. The fraction or percentage of components in common is related to the homology or identity between the sequences. Alignments such as those of FIGS. 3A and B, 4A-D, 5A-F and 9A-F may be used to identify conserved domains and relatedness within these domains. An alignment may suitably be determined by means of computer programs known in the art, such as MACVECTOR software (1999) (Accelrys, Inc., San Diego, Calif.).

The terms "highly stringent" or "highly stringent condition" refer to conditions that permit hybridization of DNA strands whose sequences are highly complementary, wherein these same conditions exclude hybridization of significantly mismatched DNAs. Polynucleotide sequences capable of hybridizing under stringent conditions with the polynucleotides of the present invention may be, for example, variants of the disclosed polynucleotide sequences, including allelic or splice variants, or sequences that encode orthologs or paralogs of presently disclosed polypeptides. Nucleic acid hybridization methods are disclosed in detail by Kashima et al. (1985) *Nature* 313:402-404, and Sambrook et al. (1989) *Molecular Cloning: A Laboratory Manual,* 2nd Ed., Cold Spring Harbor Laboratory, Cold Spring Harbor, N.Y. ("Sambrook"); and by Haymes et al., "Nucleic Acid Hybridization: A Practical Approach", IRL Press, Washington, D.C. (1985), which references are incorporated herein by reference.

In general, stringency is determined by the temperature, ionic strength, and concentration of denaturing agents (e.g., formamide) used in a hybridization and washing procedure (for a more detailed description of establishing and determining stringency, see below). The degree to which two nucleic acids hybridize under various conditions of stringency is correlated with the extent of their similarity. Thus, similar nucleic acid sequences from a variety of sources, such as within a plant's genome (as in the case of paralogs) or from another plant (as in the case of orthologs) that may perform similar functions can be isolated on the basis of their ability to hybridize with known transcription factor sequences. Numerous variations are possible in the conditions and means by which nucleic acid hybridization can be performed to isolate transcription factor sequences having similarity to transcription factor sequences known in the art and are not limited to those explicitly disclosed herein. Such an approach may be used to isolate polynucleotide sequences having various degrees of similarity with disclosed transcription factor sequences, such as, for example, transcription factors having 60% identity, or more preferably greater than about 70% identity, most preferably 72% or greater identity with disclosed transcription factors.

The term "equivalog" describes members of a set of homologous proteins that are conserved with respect to function since their last common ancestor. Related proteins are grouped into equivalog families, and otherwise into protein families with other hierarchically defined homology types. This definition is provided at the Institute for Genomic Research (TIGR) website, www.tigr.org; "Terms associated with TIGRFAMs".

The term "variant", as used herein, may refer to polynucleotides or polypeptides that differ from the presently disclosed polynucleotides or polypeptides, respectively, in sequence from each other, and as set forth below.

With regard to polynucleotide variants, differences between presently disclosed polynucleotides and their variants are limited so that the nucleotide sequences of the former and the latter are closely similar overall and, in many regions, identical. The degeneracy of the genetic code dictates that many different variant polynucleotides can encode identical and/or substantially similar polypeptides in addition to those sequences illustrated in the Sequence Listing. Due to this degeneracy, differences between presently disclosed polynucleotides and variant nucleotide sequences may be silent in any given region or over the entire length of the polypeptide (i.e., the amino acids encoded by the polynucleotide are the same, and the variant polynucleotide sequence thus encodes the same amino acid sequence in that region or entire length of the presently disclosed polynucleotide. Variant nucleotide sequences may encode different amino acid sequences, in which case such nucleotide differences will result in amino acid substitutions, additions, deletions, insertions, truncations or fusions with respect to the similar disclosed polynucleotide sequences. These variations result in polynucleotide variants encoding polypeptides that share at least one functional characteristic (i.e., a presently disclosed transcription factor and a variant will confer at least one of the same functions to a plant).

Within the scope of the invention is a variant of a nucleic acid listed in the Sequence Listing, that is, one having a sequence that differs from the one of the polynucleotide sequences in the Sequence Listing, or a complementary sequence, that encodes a functionally equivalent polypeptide (i.e., a polypeptide having some degree of equivalent or similar biological activity) but differs in sequence from the sequence in the Sequence Listing, due to degeneracy in the genetic code.

"Splice variant" or "polynucleotide splice variant" as used herein refers to alternative forms of RNA transcribed from a gene. Splice variation naturally occurs as a result of alternative sites being spliced within a single transcribed RNA molecule or between separately transcribed RNA molecules, and may result in several different forms of mRNA transcribed from the same gene. Thus, splice variants may encode polypeptides having different amino acid sequences, which, in the present context, will have at least one similar function in the organism (splice variation may also give rise to distinct polypeptides having different functions). "Splice variant" or "polypeptide splice variant" may also refer to a polypeptide encoded by a splice variant of a transcribed mRNA.

As used herein, "polynucleotide variants" may also refer to polynucleotide sequences that encode paralogs and orthologs of the presently disclosed polypeptide sequences. "Polypeptide variants" may refer to polypeptide sequences that are paralogs and orthologs of the presently disclosed polypeptide sequences.

Differences between presently disclosed polypeptides and polypeptide variants are limited so that the sequences of the former and the latter are closely similar overall and, in many regions, identical. Presently disclosed polypeptide sequences and similar polypeptide variants may differ in amino acid sequence by one or more substitutions, additions, deletions, fusions and truncations, which may be present in any combination. These differences may produce silent changes and result in a functionally equivalent transcription factor. Thus, it will be readily appreciated by those of skill in the art, that any of a variety of polynucleotide sequences is capable of encoding the transcription factors and transcription factor homolog polypeptides of the invention. A polypeptide sequence variant may have "conservative" changes, wherein a substituted amino acid has similar structural or chemical properties. Deliberate amino acid substitutions may thus be made on the basis of similarity in polarity, charge, solubility, hydrophobicity, hydrophilicity, and/or the amphipathic nature of the residues, as long as the functional or biological activity of the transcription factor is retained. For example, negatively charged amino acids may include aspartic acid and glutamic acid, positively charged amino acids may include lysine and arginine, and amino acids with uncharged polar head groups having similar hydrophilicity values may include leucine, isoleucine, and valine; glycine and alanine; asparagine and glutamine; serine and threonine; and phenylalanine and tyrosine. For more detail on conservative substitutions, see Table 5. More rarely, a variant may have "non-conservative" changes, e.g., replacement of a glycine with a tryptophan. Similar minor variations may also include amino acid deletions or insertions, or both. Related polypeptides may comprise, for example, additions and/or deletions of one or more N-linked or O-linked glycosylation sites, or an addition and/or a deletion of one or more cysteine residues. Guidance in determining which and how many amino acid residues may be substituted, inserted or deleted without abolishing functional or biological activity may be found using computer programs well known in the art, for example, DNASTAR software (see U.S. Pat. No. 5,840,544).

Figure 1:
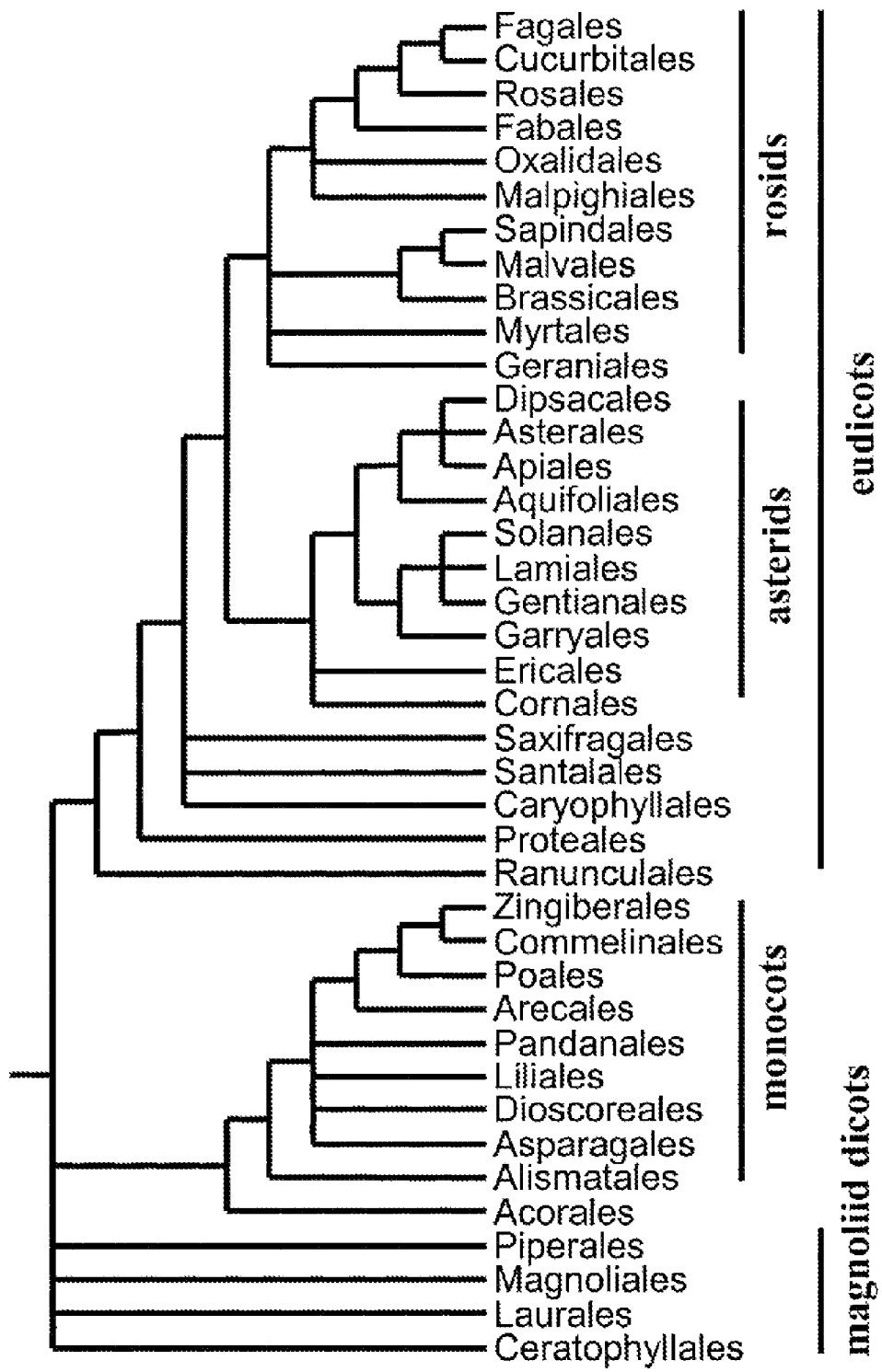
Figure 2:
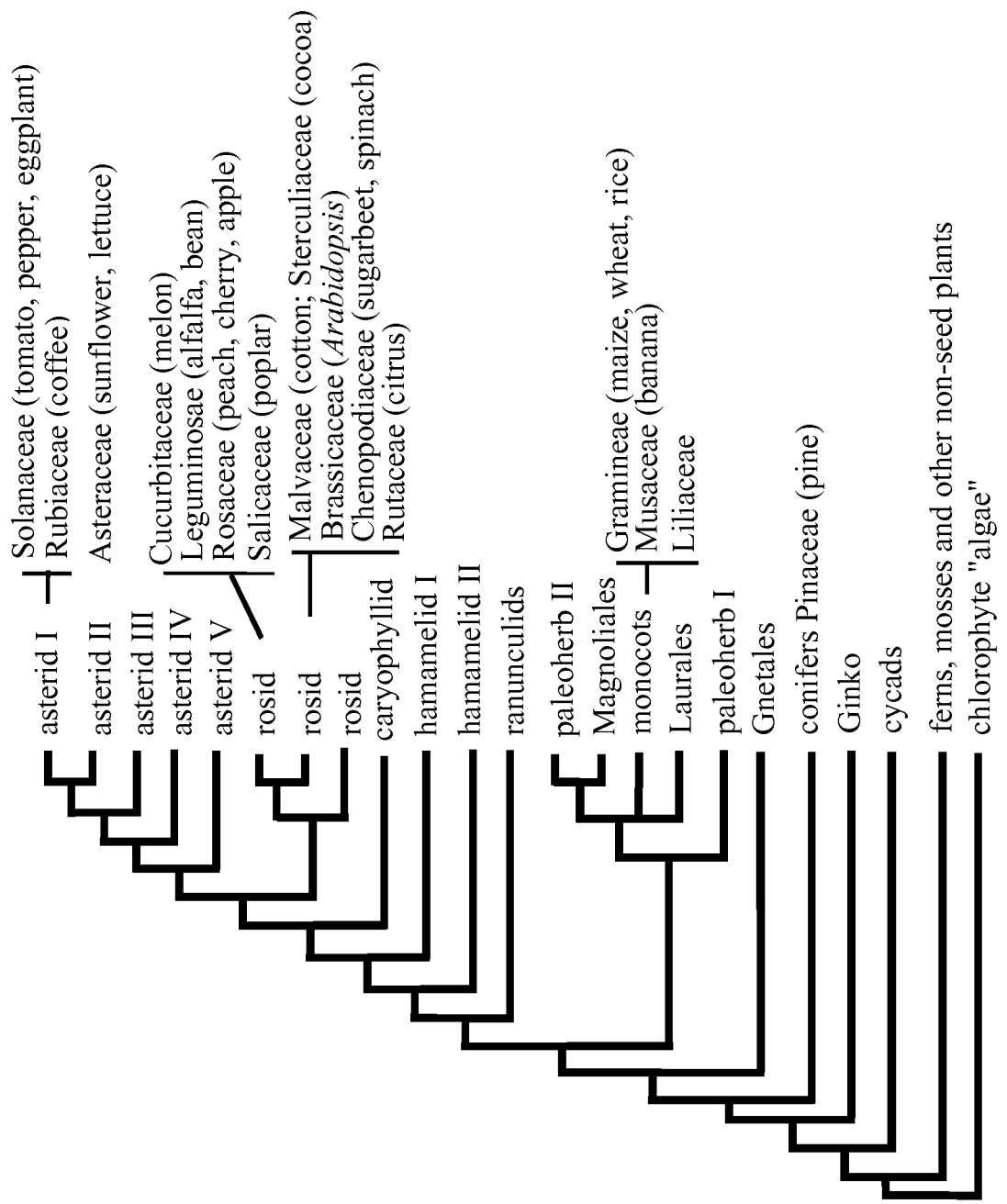

The term "plant" includes whole plants, shoot vegetative organs/structures (e.g., leaves, stems and tubers), roots, flowers and floral organs/structures (e.g., bracts, sepals, petals, stamens, carpels, anthers and ovules), seed (including embryo, endosperm, and seed coat) and fruit (the mature ovary), plant tissue (e.g., vascular tissue, ground tissue, and the like) and cells (e.g., guard cells, egg cells, and the like), and progeny of same. The class of plants that can be used in the method of the invention is generally as broad as the class of higher and lower plants amenable to transformation techniques, including angiosperms (monocotyledonous and dicotyledonous plants), gymnosperms, ferns, horsetails, psilophytes, lycophytes, bryophytes, and multicellular algae. (See for example, FIG. 1, adapted from Daly et al. (2001) *Plant Physiol.* 127: 1328-1333; FIG. 2, adapted from Ku et al. (2000) *Proc. Natl. Acad. Sci.* 97: 9121-9126; and see also Tudge, in *The Variety of Life*, Oxford University Press, New York, N.Y. (2000) pp. 547-606).

A "transgenic plant" refers to a plant that contains genetic material not found in a wild-type plant of the same species, variety or cultivar. The genetic material may include a transgene, an insertional mutagenesis event (such as by transposon or T-DNA insertional mutagenesis), an activation tagging sequence, a mutated sequence, a homologous recombination event or a sequence modified by chimeraplasty. Typically, the foreign genetic material has been introduced into the plant by human manipulation, but any method can be used as one of skill in the art recognizes.

A transgenic plant may contain an expression vector or cassette. The expression cassette typically comprises a polypeptide-encoding sequence operably linked (i.e., under regulatory control of) to appropriate inducible or constitutive regulatory sequences that allow for the expression of polypeptide. The expression cassette can be introduced into a plant by transformation or by breeding after transformation of a parent plant. A plant refers to a whole plant, including seedlings and mature plants, as well as to a plant part, such as seed, fruit, leaf, or root, plant tissue, plant cells or any other plant material, e.g., a plant explant, as well as to progeny thereof, and to in vitro systems that mimic biochemical or cellular components or processes in a cell.

Tissue-specific, tissue-enhanced (that is, tissue-preferred), cell type-specific, and inducible promoters constitute non-constitutive promoters. Promoters under developmental control include promoters that preferentially initiate transcription in certain tissues, such as xylem, leaves, roots, or seeds. Such promoters are examples of tissue-enhanced or tissue-preferred promoters (see U.S. Pat. No. 7,365,186). Tissue-enhanced promoters can be found upstream and operatively linked to DNA sequences normally transcribed in higher levels in certain plant tissues or specifically in certain plant tissues, respectively. "Cell-enhanced", "tissue-enhanced", or "tissue-specific" regulation thus refer to the control of gene or protein expression, for example, by a promoter, which drives expression that is not necessarily totally restricted to a single type of cell or tissue, but where expression is elevated in particular cells or tissues to a greater extent than in other cells or tissues within the organism, and in the case of tissue-specific regulation, in a manner that is primarily elevated in a specific tissue. Tissue-enhanced or preferred promoters have been described in, for example, U.S. Pat. No. 7,365,186, or U.S. Pat. No. 7,619,133.

A "condition-enhanced" promoter refers to a promoter that activates a gene in response to a particular environmental stimulus, for example, an abiotic stress, infection caused by a pathogen, light treatment, etc., and that drives expression in a unique pattern which may include expression in specific cell and/or tissue types within the organism (as opposed to a constitutive expression pattern in all cell types of an organism at all times).

A "control plant" as used in the present invention refers to a plant cell, seed, plant component, plant tissue, plant organ or whole plant used to compare against transformed, transgenic or genetically modified plant for the purpose of identifying an enhanced phenotype in the transformed, transgenic or genetically modified plant. A control plant may in some cases be a transformed or transgenic plant line that comprises an empty vector or marker gene, but does not contain the recombinant polynucleotide of the present invention that is expressed in the transformed, transgenic or genetically modified plant being evaluated. In general, a control plant is a plant of the same line or variety as the transformed, transgenic or genetically modified plant being tested. A suitable control plant would include a genetically unaltered or non-transgenic plant of the parental line used to generate a transformed or transgenic plant herein.

"Fragment", with respect to a polynucleotide, refers to a clone or any part of a polynucleotide molecule that retains a usable, functional characteristic. Useful fragments include oligonucleotides and polynucleotides that may be used in hybridization or amplification technologies or in the regulation of replication, transcription or translation. A polynucleotide fragment" refers to any subsequence of a polynucleotide, typically, of at least about 9 consecutive nucleotides, preferably at least about 30 nucleotides, more preferably at least about 50 nucleotides, of any of the sequences provided herein. Exemplary polynucleotide fragments are the first sixty consecutive nucleotides of the transcription factor polynucleotides listed in the Sequence Listing. Exemplary fragments also include fragments that comprise a region that encodes a conserved domain of a transcription factor.

Fragments may also include subsequences of polypeptides and protein molecules, or a subsequence of the polypeptide. Fragments may have uses in that they may have antigenic potential. In some cases, the fragment or domain is a subsequence of the polypeptide that performs at least one biological function of the intact polypeptide in substantially the same manner, or to a similar extent, as does the intact polypeptide. For example, a polypeptide fragment can comprise a recognizable structural motif or functional domain such as a DNA-binding site or domain that binds to a DNA promoter region, an activation domain, or a domain for protein-protein interactions, and may initiate transcription. Fragments can vary in size from as few as 3 amino acids to the full length of the intact polypeptide, but are preferably at least about 30 amino acids in length and more preferably at least about 60 amino acids in length. Exemplary polypeptide fragments are the first twenty consecutive amino acids of a mammalian protein encoded by are the first twenty consecutive amino acids of the transcription factor polypeptides listed in the Sequence Listing.

Exemplary fragments also include fragments that comprise a conserved domain of a transcription factor. An example of such an exemplary fragment would include amino acid residues 20-110 of G481 (SEQ ID NO: 88), as noted in Table 8.

The invention also encompasses production of DNA sequences that encode transcription factors and transcription factor derivatives, or fragments thereof, entirely by synthetic chemistry. After production, the synthetic sequence may be inserted into any of the many available expression vectors and cell systems using reagents well known in the art. Moreover, synthetic chemistry may be used to introduce mutations into a sequence encoding transcription factors or any fragment thereof.

A "conserved domain" or "conserved region" as used herein refers to a region in heterologous polynucleotide or polypeptide sequences where there is a relatively high degree of sequence identity between the distinct sequences.

With respect to polynucleotides encoding presently disclosed transcription factors, a conserved region is preferably at least 10 base pairs (bp) in length.

A "conserved domain", with respect to presently disclosed polypeptides refers to a domain within a transcription factor family that exhibits a higher degree of sequence homology, such as at least 16% sequence similarity, at least 26% sequence identity, or at least 40% sequence identity, preferably at least 50%, at least 51%, at least 52%, at least 53%, at least 54%, at least 55%, at least 56%, at least 57%, at least 58%, at least 59%, at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or about 100% amino acid sequence identity to a conserved domain of listed polypeptide (for example, including, but not limited to, conserved domains that are found in Table 8). A fragment or domain can be referred to as outside a conserved domain, outside a consensus sequence, or outside a consensus DNA-binding site that is known to exist or that exists for a particular transcription factor class, family, or sub-family. In this case, the fragment or domain will not include the exact amino acids of a consensus sequence or consensus DNA-binding site of a transcription factor class, family or sub-family, or the exact amino acids of a particular transcription factor consensus sequence or consensus DNA-binding site. Furthermore, a particular fragment, region, or domain of a polypeptide, or a polynucleotide encoding a polypeptide, can be "outside a conserved domain" if all the amino acids of the fragment, region, or domain fall outside of a defined conserved domain(s) for a polypeptide or protein. Sequences having lesser degrees of identity but comparable biological activity are considered to be equivalents.

As one of ordinary skill in the art recognizes, conserved domains of transcription factors may be identified as regions or domains of identity to a specific consensus sequence (see, for example, Riechmann et al. (2000) supra). Thus, by using alignment methods well known in the art, the conserved domains of the plant transcription factors for each of the following may be determined: the AP2 (APETALA2) domain transcription factor family (Riechmann and Meyerowitz (1998) supra; the MYB transcription factor family (ENBib; Martin and Paz-Ares (1997) supra); the MADS domain transcription factor family (Riechmann and Meyerowitz (1997) supra); the WRKY protein family (Ishiguro and Nakamura (1994) supra); the ankyrin-repeat protein family (Zhang et al. (1992) supra); the zinc finger protein (Z) family (Klug and Schwabe (1995) supra; Takatsuji (1998) supra); the homeobox (HB) protein family (Buerglin (1994) supra); the CAAT-element binding proteins (Forsburg and Guarente (1989) supra); the squamosa promoter binding proteins (SPB) (Klein et al. (1996) supra); the NAM protein family (Souer et al. (1996) supra); the IAA/AUX proteins (Abel et al. (1995) supra); the HLH/MYC protein family (Littlewood et al. (1994) supra); the DNA-binding protein (DBP) family (Tucker et al. (1994) supra); the bZIP family of transcription factors (Foster et al. (1994) supra); the Box P-binding protein (the BPF-1) family (da Costa e Silva et al. (1993) supra); the high mobility group (HMG) family (Bustin and Reeves (1996) supra); the scarecrow (SCR) family (Di Laurenzio et al. (1996) supra); the GF14 family (Wu et al. (1997) supra); the polycomb (PCOMB) family (Goodrich et al. (1997) supra); the teosinte branched (TEO) family (Luo et al. (1996) supra); the ABI3 family (Giraudat et al. (1992) supra); the triple helix (TH) family (Dehesh et al. (1990) supra); the EIL family (Chao et al. (1997) Cell supra); the AT-HOOK family (Reeves and Nissen (1990 supra); the S1FA family (Zhou et al. (1995) supra); the bZIPT2 family (Lu and Ferl (1995) supra); the YABBY family (Bowman et al. (1999) supra); the PAZ family (Bohmert et al. (1998) supra); a family of miscellaneous (MISC) transcription factors including the DPBF family (Kim et al. (1997) supra) and the SPF1 family (Ishiguro and Nakamura (1994) supra); the GARP family (Hall et al. (1998) supra), the TUBBY family (Boggin et al. (1999) supra), the heat shock family (Wu (1995 supra), the ENBP family (Christiansen et al. (1996) supra), the RING-zinc family (Jensen et al. (1998) supra), the PDBP family (Janik et al. (1989) supra), the PCF family (Cubas et al. (1999) supra), the SRS (SHI-related) family (Fridborg et al. (1999) supra), the CPP (cysteine-rich polycomb-like) family (Cvitanich et al. (2000) supra), the ARF (auxin response factor) family (Ulmasov et al. (1999) supra), the SWI/SNF family (Collingwood et al. (1999) supra), the ACBF family (Seguin et al. (1997) supra), PCGL (CG-1 like) family (da Costa e Silva et al. (1994) supra) the ARID family (Vazquez et al. (1999) supra), the Jumonji family, (Balciunas et al. (2000) supra), the bZIP-NIN family (Schauser et al. (1999) supra), the E2F family Kaelin et al. (1992) supra) and the GRF-like family (Knaap et al (2000) supra).

The conserved domains for each of polypeptides of SEQ ID NO: 2N, wherein N=1-229, are listed in Table 8 as described in Example VII. Also, many of the polypeptides of Table 8 have conserved domains specifically indicated by start and stop sites. A comparison of the regions of the polypeptides in SEQ ID NO: 2N, wherein N=1-229, or of those in Table 8, allows one of skill in the art to identify conserved domain(s) for any of the polypeptides listed or referred to in this disclosure, including those in Tables 7-11.

As used herein, a "gene" is a functional unit of inheritance, and in physical terms is a particular segment or sequence of nucleotides along a molecule of DNA (or RNA, in the case of RNA viruses) involved in producing a functional RNA molecule, such as one used for a structural or regulatory role, or a polypeptide chain, such as one used for a structural or regulatory role (an example of the latter would be transcription regulation, as by a transcription factor polypeptide). Polypeptides may then be subjected to subsequent processing such as splicing and/or folding to obtain a functional polypeptide. A gene may be isolated, partially isolated, or be found with an organism's genome. By way of example, a transcription factor gene encodes a transcription factor polypeptide, which may be functional with or without additional processing to function as an initiator of transcription.

Operationally, genes may be defined by the cis-trans test, a genetic test that determines whether two mutations occur in the same gene and which may be used to determine the limits of the genetically active unit (Rieger et al. (1976) *Glossary of Genetics and Cytogenetics: Classical and Molecular*, 4th ed., Springer Verlag. Berlin). A gene generally includes regions preceding ("leaders"; upstream) and following ("trailers"; downstream) of the coding region. A gene may also include intervening, non-coded sequences, referred to as "introns", which are located between individual coding segments, referred to as "exons". Most genes have an identifiable associated promoter region, a regulatory sequence 5' or upstream of the transcription initiation codon. The function of a gene may also be regulated by enhancers, operators, and other regulatory elements.

A "trait" refers to a physiological, morphological, biochemical, or physical characteristic of a plant or particular plant material or cell. In some instances, this characteristic is visible to the human eye, such as seed or plant size, or can be measured by biochemical techniques, such as detecting the protein, starch, or oil content of seed or leaves, or by observation of a metabolic or physiological process, e.g. by measuring uptake of carbon dioxide, or by the observation of the expression level of a gene or genes, e.g., by employing Northern analysis, RT-PCR, microarray gene expression assays, or reporter gene expression systems, or by agricultural observations such as stress tolerance, yield, or pathogen tolerance.

Any technique can be used to measure the amount of, comparative level of, or difference in any selected chemical compound or macromolecule in the transgenic plants, however.

"Trait modification" refers to a detectable difference in a characteristic in a plant ectopically expressing a polynucleotide or polypeptide of the present invention relative to a plant not doing so, such as a wild-type plant. In some cases, the trait modification can be evaluated quantitatively. For example, the trait modification can entail at least about a 2% increase or decrease in an observed trait (difference), at least a 5% difference, at least about a 10% difference, at least about a 20% difference, at least about a 30%, at least about a 50%, at least about a 70%, or at least about a 100%, or an even greater difference compared with a wild-type plant. It is known that there can be a natural variation in the modified trait. Therefore, the trait modification observed entails a change of the normal distribution of the trait in the plants compared with the distribution observed in wild-type plant.

The term "transcript profile" refers to the expression levels of a set of genes in a cell in a particular state, particularly by comparison with the expression levels of that same set of genes in a cell of the same type in a reference state. For example, the transcript profile of a particular transcription factor in a suspension cell is the expression levels of a set of genes in a cell overexpressing that transcription factor compared with the expression levels of that same set of genes in a suspension cell that has normal levels of that transcription factor. The transcript profile can be presented as a list of those genes whose expression level is significantly different between the two treatments, and the difference ratios. Differences and similarities between expression levels may also be evaluated and calculated using statistical and clustering methods.

"Wild type" or "wild-type", as used herein, refers to a plant cell, seed, plant component, plant tissue, plant organ or whole plant that has not been genetically modified or treated in an experimental sense. Wild-type cells, seed, components, tissue, organs or whole plants may be used as controls to compare levels of expression and the extent and nature of trait modification with cells, tissue or plants of the same species in which a polypeptide's expression is altered, e.g., in that it has been knocked out, overexpressed, or ectopically expressed.

"Ectopic expression" or "altered expression" in reference to a polynucleotide indicates that the pattern of expression in, e.g., a transgenic plant or plant tissue, is different from the expression pattern in a wild-type plant or a reference plant of the same species. The pattern of expression may also be compared with a reference expression pattern in a wild-type plant of the same species. For example, the polynucleotide or polypeptide is expressed in a cell or tissue type other than a cell or tissue type in which the sequence is expressed in the wild-type plant, or by expression at a time other than at the time the sequence is expressed in the wild-type plant, or by a response to different inducible agents, such as hormones or environmental signals, or at different expression levels (either higher or lower) compared with those found in a wild-type plant. Altered expression may be achieved by, for example, transformation of a plant with an expression cassette having a constitutive or inducible promoter element associated with a transcription factor gene. The resulting expression pattern can thus constitutive or inducible, and be stable or transient. Altered or ectopic expression may also refer to altered expression patterns that are produced by lowering the levels of expression to below the detection level or completely abolishing expression by, for example, knocking out a gene's expression by disrupting expression or regulation of the gene with an insertion element.

In reference to a polypeptide, the term "ectopic expression or altered expression" further may relate to altered activity levels resulting from the interactions of the polypeptides with exogenous or endogenous modulators or from interactions with factors or as a result of the chemical modification of the polypeptides.

The term "overexpression" as used herein refers to a greater expression level of a gene in a plant, plant cell or plant tissue, compared to expression in a wild-type plant, cell or tissue, at any developmental or temporal stage for the gene. Overexpression can occur when, for example, the genes encoding one or more transcription factors are under the control of a strong expression signal, such as one of the promoters described herein (e.g., the cauliflower mosaic virus 35S transcription initiation region). Overexpression may occur throughout a plant or in specific tissues of the plant, depending on the promoter used, as described below.

Overexpression may take place in plant cells normally lacking expression of polypeptides functionally equivalent or identical to the present transcription factors. Overexpression may also occur in plant cells where endogenous expression of the present transcription factors or functionally equivalent molecules normally occurs, but such normal expression is at a lower level than in the organism or tissues of the overexpressor. Overexpression thus results in a greater than normal production, or "overproduction" of the transcription factor in the plant, cell or tissue.

The term "phase change" refers to a plant's progression from embryo to adult, and, by some definitions, the transition wherein flowering plants gain reproductive competency. It is believed that phase change occurs either after a certain number of cell divisions in the shoot apex of a developing plant, or when the shoot apex achieves a particular distance from the roots. Thus, altering the timing of phase changes may affect a plant's size, which, in turn, may affect yield and biomass.

Traits that May be Modified in Overexpressing or Knock-Out Plants

Trait modifications of particular interest include those to seed (such as embryo or endosperm), fruit, root, flower, leaf, stem, shoot, seedling or the like, including: enhanced tolerance to environmental conditions including freezing, chilling, heat, drought, water saturation, radiation and ozone; improved tolerance to microbial, fungal or viral diseases; improved tolerance to pest infestations, including insects, nematodes, mollicutes, parasitic higher plants or the like; decreased herbicide sensitivity; improved tolerance of heavy metals or enhanced ability to take up heavy metals; improved growth under poor photoconditions (e.g., low light and/or short day length), or changes in expression levels of genes of interest. Other phenotype that can be modified relate to the production of plant metabolites, such as variations in the production of taxol, tocopherol, tocotrienol, sterols, phytosterols, vitamins, wax monomers, anti-oxidants, amino acids, lignins, cellulose, tannins, prenyllipids (such as chlorophylls and carotenoids), glucosinolates, and terpenoids, enhanced or compositionally altered protein or oil production (especially in seeds), or modified sugar (insoluble or soluble) and/or starch composition. Physical plant characteristics that can be modified include cell development (such as the number of trichomes), fruit and seed size and number, yields of plant parts such as stems, leaves, inflorescences, and roots, the stability of the seeds during storage, characteristics of the seed pod (e.g., susceptibility to shattering), root hair length and quantity, internode distances, or the quality of seed coat. Plant growth characteristics that can be modified include growth rate, germination rate of seeds, vigor of plants and seedlings, leaf and flower senescence, male sterility, apomixis, flowering time, flower abscission, rate of nitrogen uptake, osmotic sensitivity to soluble sugar concentrations, biomass or transpiration characteristics, as well as plant architecture characteristics such as apical dominance, branching patterns, number of organs, organ identity, organ shape or size.

Transcription Factors Modify Expression of Endogenous Genes

Expression of genes that encode transcription factors that modify expression of endogenous genes, polynucleotides, and proteins are well known in the art. In addition, transgenic plants comprising isolated polynucleotides encoding transcription factors may also modify expression of endogenous genes, polynucleotides, and proteins. Examples include Peng et al. (1997) *Genes and Development* 11: 3194-3205, and Peng et al. (1999) *Nature* 400: 256-261. In addition, many others have demonstrated that an *Arabidopsis* transcription factor expressed in an exogenous plant species elicits the same or very similar phenotypic response. See, for example, Fu et al. (2001) *Plant Cell* 13: 1791-1802; Nandi et al. (2000, *Curr. Biol.* 10: 215-218; Coupland (1995) *Nature* 377: 482-483; and Weigel and Nilsson (1995) *Nature* 377: 482-500.

In another example, Mandel et al. (1992) *Cell* 71-133-143 and Suzuki et al. (2001) *Plant J.* 28: 409-418, teach that a transcription factor expressed in another plant species elicits the same or very similar phenotypic response of the endogenous sequence, as often predicted in earlier studies of *Arabidopsis* transcription factors in *Arabidopsis* (see Mandel et al. (1992) supra; Suzuki et al. (2001) supra).

Other examples include Müller et al. (2001) *Plant J.* 28: 169-179; Kim et al. (2001) *Plant J.* 25: 247-259; Kyozuka and Shimamoto (2002) *Plant Cell Physiol.* 43: 130-135; Boss and Thomas (2002) *Nature* 416: 847-850; He et al. (2000) *Transgenic Res.* 9: 223-227; and Robson et al. (2001) *Plant J.* 28: 619-631.

In yet another example, Gilmour et al. (1998) *Plant J.* 16: 433-442, teach an *Arabidopsis* AP2 transcription factor, CBF 1 (SEQ ID NO: 1956), which, when overexpressed in transgenic plants, increases plant freezing tolerance. Jaglo et al. (2001) *Plant Physiol.* 127: 910-917, further identified sequences in *Brassica napus* which encode CBF-like genes and that transcripts for these genes accumulated rapidly in response to low temperature. Transcripts encoding CBF-like proteins were also found to accumulate rapidly in response to low temperature in wheat, as well as in tomato. An alignment of the CBF proteins from *Arabidopsis, B. napus*, wheat, rye, and tomato revealed the presence of conserved consecutive amino acid residues that bracket the AP2/EREBP DNA binding domains of the proteins and distinguish them from other members of the AP2/EREBP protein family. (See Jaglo et al. supra).

Gao et al. (2002) *Plant Molec. Biol.* 49: 459-471) have recently described four CBF transcription factors from *Brassica napus*: BNCBFs 5, 7, 16 and 17. They note that the first three CBFs (GenBank Accession Numbers AAM18958, AAM18959, and AAM18960, respectively) are very similar to *Arabidopsis* CBF1, whereas BNCBF17 (GenBank Accession Number AAM18961) is similar but contains two extra regions of 16 and 21 amino acids in its acidic activation domain. All four *B. napus* CBFs accumulate in leaves of the plants after cold-treatment, and BNCBFs 5, 7, 16 accumulated after salt stress treatment. The authors concluded that these BNCBFs likely function in low-temperature responses in *B. napus*.

In a functional study of CBF genes Hsieh et al. ((2002) *Plant Physiol.* 129: 1086-1094) found that heterologous expression of *Arabidopsis* CBF1 in tomato plants confers increased tolerance to chilling and considerable tolerance to oxidative stress, which suggested to the authors that ectopic *Arabidopsis* CBF1 expression may induce several tomato stress responsive genes to protect the plants.

Transcription factors mediate cellular responses and control traits through altered expression of genes containing cis-acting nucleotide sequences that are targets of the introduced transcription factor. It is well appreciated in the Art that the effect of a transcription factor on cellular responses or a cellular trait is determined by the particular genes whose expression is either directly or indirectly (e.g., by a cascade of transcription factor binding events and transcriptional changes) altered by transcription factor binding. In a global analysis of transcription comparing a standard condition with one in which a transcription factor is overexpressed, the resulting transcript profile associated with transcription factor overexpression is related to the trait or cellular process controlled by that transcription factor. For example, the PAP2 gene (and other genes in the MYB family) have been shown to control anthocyanin biosynthesis through regulation of the expression of genes known to be involved in the anthocyanin biosynthetic pathway (Bruce et al. (2000) *Plant Cell* 12: 65-79; and Borevitz et al. (2000) *Plant Cell* 12: 2383-2393). Further, global transcript profiles have been used successfully as diagnostic tools for specific cellular states (e.g., cancerous vs. non-cancerous; Bhattacharjee et al. (2001) *Proc. Natl. Acad. Sci. USA* 98: 13790-13795; and Xu et al. (2001) *Proc Natl Acad Sci*, USA 98: 15089-15094). Consequently, it is evident to one skilled in the art that similarity of transcript profile upon overexpression of different transcription factors would indicate similarity of transcription factor function.

Polypeptides and Polynucleotides of the Invention

The present invention provides, among other things, transcription factors (TFs), and transcription factor homolog polypeptides, and isolated or recombinant polynucleotides encoding the polypeptides, or novel sequence variant polypeptides or polynucleotides encoding novel variants of transcription factors derived from the specific sequences provided here. These polypeptides and polynucleotides may be employed to modify a plant's characteristics.

Exemplary polynucleotides encoding the polypeptides of the invention were identified in the *Arabidopsis thaliana* GenBank database using publicly available sequence analysis programs and parameters. Sequences initially identified were then further characterized to identify sequences comprising specified sequence strings corresponding to sequence motifs present in families of known transcription factors. In addition, further exemplary polynucleotides encoding the polypeptides of the invention were identified in the plant GenBank database using publicly available sequence analysis programs and parameters. Sequences initially identified were then further characterized to identify sequences comprising specified sequence strings corresponding to sequence motifs present in families of known transcription factors. Polynucleotide sequences meeting such criteria were confirmed as transcription factors.

Additional polynucleotides of the invention were identified by screening *Arabidopsis thaliana* and/or other plant cDNA libraries with probes corresponding to known transcription factors under low stringency hybridization conditions. Additional sequences, including full length coding sequences were subsequently recovered by the rapid amplification of cDNA ends (RACE) procedure, using a commercially available kit according to the manufacturer's instructions. Where necessary, multiple rounds of RACE are performed to isolate 5' and 3' ends. The full-length cDNA was then recovered by a routine end-to-end polymerase chain reaction (PCR) using primers specific to the isolated 5' and 3' ends. Exemplary sequences are provided in the Sequence Listing.

The polynucleotides of the invention can be or were ectopically expressed in overexpressor or knockout plants and the changes in the characteristic(s) or trait(s) of the plants observed. Therefore, the polynucleotides and polypeptides can be employed to improve the characteristics of plants.

The polynucleotides of the invention can be or were ectopically expressed in overexpressor plant cells and the changes in the expression levels of a number of genes, polynucleotides, and/or proteins of the plant cells observed. Therefore, the polynucleotides and polypeptides can be employed to change expression levels of a genes, polynucleotides, and/or proteins of plants.

Specific examples of the polypeptides and polynucleotides of the invention and experimental observations made after modifying their expression in plants may be found in the following text and tables.

CCAAT-Element Binding Protein Transcription Factor Family

G481 (AT2G38880) and G482 are members of the HAP3 sub-group of the CCAAT binding factor family (CAAT). G481, G481 and their related sequences were included a program to test the ability of these sequences to confer the same drought-related abiotic stress previously observed by us in 35S::G481 lines.

The CAAT family of transcription factors, also be referred to as the "CCAAT" or "CCAAT-box" family, are characterized by their ability to bind to the CCAAT-box element located 80 to 300 bp 5' from a transcription start site (Gelinas et al. (1985) *Nature* 313: 323-325). The CCAAT-box is a conserved cis-acting regulatory element with the consensus sequence CCAAT that is found in the promoters of genes from all eukaryotic species. The element can act in either orientation, alone or as multimeric regions with possible cooperation with other cis regulatory elements (Tasanen et al. (1992) (*J. Biol. Chem.* 267: 11513-11519). It has been estimated that 25% of eukaryotic promoters harbor this element (Bucher (1988) *J. Biomol. Struct. Dyn.* 5: 1231-1236). CCAAT-box elements have been shown to function in the regulation of gene expression in plants (Rieping and Schoffl (1992) *Mol. Gen. Genet.* 231: 226-232; Kehoe et al. (1994) *Plant Cell* 6: 1123-1134; Ito et al. (1995) *Plant Cell Physiol.* 36: 1281-1289). Several reports have described the importance of the CCAAT-binding element for regulated expression; including the regulation of genes that are responsive to light (Kusnetsov et al. (1999) *J. Biol. Chem.* 274: 36009-36014; Carre and Kay (1995) *Plant Cell* 7: 2039-2051) as well as stress (Rieping and Schoffl (1992) supra). Specifically, a CCAAT-box motif was shown to be important for the light regulated expression of the CAB2 promoter in *Arabidopsis*, however, the proteins that bind to the site were not identified (Carre and Kay (1995) supra). To date, no specific *Arabidopsis* CCAAT box-binding protein has been functionally associated with its corresponding target genes. In October of 2002 at an EPSO meeting on Plant Networks, a seminar was given by Detlef Weigel (Tuebingen) on the control of the AGAMOUS (a floral organ identity gene) gene in *Arabidopsis*. In order to find important cis-elements that regulate AGAMOUS activity, he aligned the promoter regions from 29 different Brassicaceae species and showed that there were two highly conserved regions; one well characterized site that binds LEAFY/WUS heterodimers and another putative CCAAT box-binding motif. We have discovered several CCAAT-box genes that regulate flowering time and are candidates for binding to the AGAMOUS promoter. One of these genes, G485, is a HAP3-like protein that is closely related to G481. Gain of function and loss of function studies on G485 reveal opposing effects on flowering time, indicating that the gene is both sufficient to act as a floral activator, and is also necessary in that role within the plant.

The first proteins identified that bind to the CCAAT-box element were identified in yeast. The CCAAT-box transcription factors bind as hetero-tetrameric complex called the HAP complex (heme activator protein complex) or the CCAAT binding factor (Forsburg and Guarente (1988) *Mol. Cell Biol.* 8: 647-654). The HAP complex in yeast is composed of at least four subunits, HAP2, HAP3, HAP4 and HAP5. In addition, the proteins that make up the HAP2,3,4,5 complex are represented by single genes. Their function is specific for the activation of genes involved in mitochondrial biogenesis and energy metabolism (Dang et al. (1996) *Mol. Microbiol.* 22:681-692). In mammals, the CCAAT binding factor is a trimeric complex consisting of NF-YA (HAP2-like), NF-YB (HAP3-like) and NF-YC (HAP5-like) subunits (Maity and de Crombrugghe (1998) *Trends Biochem. Sci.* 23: 174-178). In plants, analogous members of the CCAAT binding factor complex are represented by small gene families, and it is likely that these genes play a more complex role in regulating gene transcription. In *Arabidopsis*, there are ten members of the HAP2 subfamily, ten members of the HAP3 subfamily, and thirteen members of the HAP5 subfamily. Plants and mammals, however, do not appear to have a protein equivalent of HAP4 of yeast. HAP4 is not required for DNA binding in yeast although it provides the primary activation domain for the complex (McNabb et al. (1995) *Genes Dev.* 9: 47-58; Olesen and Guarente (1990) *Genes Dev.* 4, 1714-1729).

In mammals, the CCAAT-box element is found in the promoters of many genes and it is therefore been proposed that CCAAT binding factors serve as general transcriptional regulators that influence the frequency of transcriptional initiation (Maity and de Crombrugghe (1998) supra). CCAAT binding factors, however, can serve to regulate target promoters in response to environmental cues and it has been demonstrated that assembly of CCAAT binding factors on target promoters occurs in response to a variety signals (Myers et al. (1986) Myers et al. (1986) *Science* 232: 613-618; Maity and de Crombrugghe (1998) supra; Bezhani et al. (2001) *J. Biol. Chem.* 276: 23785-23789). Mammalian CP1 and NF-Y are both heterotrimeric CCAAT binding factor complexes (Johnson and McKnight (1989) *Ann. Rev. Biochem.* 58: 799-839. Plant CCAAT binding factors are assumed to be trimeric, as is the case in mammals, however, they could associate with other transcription factors on target promoters as part of a larger complex. The CCAAT box is generally found in close proximity of other promoter elements and it is generally accepted that the CCAAT binding factor functions synergistically with other transcription factors in the regulation of transcription. In addition, it has recently been shown that a HAP3-like protein from rice, OsNF-YB1, interacts with a MADS-box protein OsMADS18 in vitro (Masiero et al. (2002) *J. Biol. Chem.* 277: 26429-26435). It was also shown that the in vitro ternary complex between these two types of transcription factors requires that both; OsNF-YB1 form a dimer with a HAP5-like protein, and that OsMADS18 form a heterodimer with another MADS-box protein. Interestingly, the OsNF-YB1/HAP5 protein dimer is incapable of interacting with HAP2-like subunits and therefore cannot bind the CCAAT element. The authors therefore speculate that there is a select set of HAP3-like proteins in plants that act on non-CCAAT promoter elements by virtue of their interaction with other non-CCAAT transcription factors (Masiero et al. (2002) supra). In support of this, HAP3/HAP5 subunit dimers have been shown to be able to interact with TFIID in the absence of HAP2 subunits (Romier et al. (2003) *J. Biol. Chem.* 278: 1336-1345).

The CCAAT-box motif is found in the promoters of a variety of plant genes. In addition, the expression pattern of many of the HAP-like genes in *Arabidopsis* shows developmental regulation. We have used RT-PCR to analyze the endogenous expression of 31 of the 34 CCAAT-box proteins. Our findings suggest that while most of the CCAAT-box gene transcripts are found ubiquitously throughout the plant, in more than half of the cases, the genes are predominantly expressed in flower, embryo and/or silique tissues. Cell-type specific localization of the CCAAT genes in *Arabidopsis* would be very informative and could help determine the activity of various CCAAT genes in the plant.

Genetic analysis has determined the function of one *Arabidopsis* CCAAT gene, LEAFY COTYLEDON (LEC1). LEC1 is a HAP3 subunit gene that accumulates only during seed development. *Arabidopsis* plants carrying a mutation in the LEC1 gene display embryos that are intolerant to desiccation and that show defects in seed maturation (Lotan et al. (1998) *Cell* 93: 1195-1205). This phenotype can be rescued if the embryos are allowed to grow before the desiccation process occurs during normal seed maturation. This result suggests LEC1 has a role in allowing the embryo to survive desiccation during seed maturation. The mutant plants also possess trichomes, or epidermal hairs on their cotyledons, a characteristic that is normally restricted to adult tissues like leaves and stems. Such an effect suggests that LEC1 also plays a role in specifying embryonic organ identity. In addition to the mutant analysis, the ectopic expression (unregulated overexpression) of the wild type LEC1 gene induces embryonic programs and embryo development in vegetative cells consistent with its role in coordinating higher plant embryo development. The ortholog of LEC1 has been identified recently in maize. The expression pattern of ZmLEC1 in maize during somatic embryo development is similar to that of LEC1 in *Arabidopsis* during zygotic embryo development (Zhang et al. (2002) *Planta* 215:191-194).

Matching the CCAAT transcription factors with target promoters and the analysis of the knockout and overexpression mutant phenotypes will help sort out whether these proteins act specifically or non-specifically in the control of plant pathways. The fact that CCAAT-box elements are not present in most plant promoters suggests that plant CCAAT binding factors most likely do not function as general components of the transcriptional machinery. In addition, the very specific role of the LEC1 protein in plant developmental processes supports the idea that CCAAT box-binding complexes play very specific roles in plant growth and development.

The Domain Structure of CCAAT-Element Binding Transcription Factors and Novel Conserved Domains in *Arabidopsis* and Other Species Plant CCAAT binding factors potentially bind DNA as heterotrimers composed of HAP2-like, HAP3-like and HAP5-like subunits. All subunits contain regions that are required for DNA binding and subunit association. The subunit proteins appear to lack activation domains; therefore, that function must come from proteins with which they interact on target promoters. No proteins that provide the activation domain function for CCAAT binding factors have been identified in plants. In yeast, however, the HAP4 protein provides the primary activation domain (McNabb et al. (1995) *Genes Dev.* 9: 47-58; Olesen and Guarente (1990) *Genes Dev.* 4, 1714-1729).

HAP2-, HAP3- and HAP5-like proteins have two highly conserved sub-domains, one that functions in subunit interaction and the other that acts in a direct association with DNA. Outside these two regions, non-paralogous *Arabidopsis* HAP-like proteins are quite divergent in sequence and in overall length.

The general domain structure of HAP3 proteins is found in FIG. 9. HAP3 proteins contain an amino-terminal A domain, a central B domain and a carboxy-terminal C domain. There is very little sequence similarity between HAP3 proteins in the A and C domains; it is therefore reasonable to assume that the A and C domains could provide a degree of functional specificity to each member of the HAP3 subfamily. The B domain is the conserved region that specifies DNA binding and subunit association.

In FIGS. 10A-10F, HAP3 proteins from *Arabidopsis*, soybean, rice and corn are aligned with G481, with the A, B and C domains and the DNA binding and subunit interaction domains indicated. As can be seen in FIG. 10B-10C, the B domain of the non-LEC1-like clade (identified in FIGS. 6 and 7) may be distinguished by the amino acid residues:

<u>Ser</u>/Gly-Arg-Ile/Leu-Met-Lys-(Xaa)$_2$-Lys/Ile/Val-Pro-

Xaa-Asn-Ala/Gly-Lys-Ile/Val-Ser/Ala/Gly-Lys-Asp/

Glu-Ala/Ser-Lys-Glu/Asp/Gln-Thr/Ile-Xaa-Gln-Glu-

Cys-Val/Ala-Ser/Thr-Glu-Phe-Ile-Ser-Phe-Ile/Val/

His-Thr/Ser-[Pro]-Gly/Ser/Cys-Glu-Ala-/Leu-Ser/

Ala-Asp/Glu/Gly-Lys/Glu-Cys-Gln/His-Arg/Lys-Glu-

Lys/Asn-Arg-Lys-Thr-Ile/Val-Asn-Gly-Asp/Glu-Asp-

Leu/Ile-Xaa-Trp/Phe-Ala-Met/Ile/Leu-Xaa-Thr/Asn-

Leu-Gly-Phe/Leu-Glu/Asp-Xaa-Tyr-(Xaa)$_2$-Pro/Gln/

Ala-Leu/Val-Lys/Gly;

where Xaa can be any amino acid. The proline residue that appears in brackets is an additional residue that was found in only one sequence (not shown in FIG. 10B). The boldfaced residues that appear here and in the consensus sequences of FIGS. 10B-10C in their present positions are uniquely found in the non-LEC1-like clade, and may be used to identify members of this clade. The G482-like subclade may be delineated by the underlined serine residue in its present position here and in the consensus sequence of FIGS. 10B-10C. More generally, the non-LEC1-like clade is distinguished by a B domain comprising:

Asn-(Xaa)$_4$-Lys-(Xaa)$_{33-34}$-Asn-Gly;

and the G482 subclade is distinguished by a B-domain comprising:

Ser-(Xaa)$_9$-Asn-(Xaa)$_4$-Lys-(Xaa)$_{33-34}$-Asn-Gly.

Overexpression of these polypeptides confers increased abiotic stress tolerance in a transgenic plant, as compared to a non-transformed plant that does not overexpress the polypeptide.

The CCAAT Family Members Under Study

G481, G482 and G485 (polynucleotide SEQ ID NOs: 87, 89 and 2009) were chosen for study based on observations that *Arabidopsis* plants overexpressing these genes had resistance to abiotic stresses, such as hyperosmotic stress, and including drought-related stress (see Example XIII, below).

G481, G482 and G485 are members of the CCAAT family, proteins that act in a multi-subunit complex and are believed to bind CCAAT boxes in promoters of target genes as trimers or tetramers.

In *Arabidopsis*, three types of CCAAT binding proteins exist: HAP2, HAP3 and HAP5. The G481, G482 and G485 polypeptides, as well as a number of other proteins in the *Arabidopsis* proteome, belong to the HAP3 class. As reported in the scientific literature thus far, only two genes from the HAP3 class have been functionally analyzed to a substantial degree. These are LEAFY COTYLEDON1 (LEC1) and its most closely related subunit, LEC1-LIKE (L1L). LEC1 and L1L are expressed primarily during seed development. Both appear to be essential for embryo survival of desiccation during seed maturation (Kwong et al. (2003) *Plant Cell* 15: 5-18). LEC1 is a critical regulator required for normal development during the early and late phases of embryogenesis that is sufficient to induce embryonic development in vegetative cells. Kwong et al. showed that ten *Arabidopsis* HAP3 subunits can be divided into two classes based on sequence identity in their central, conserved B domain. LEC1 and L1L constitute LEC1-type HAP3 subunits, whereas the remaining HAP3 subunits were designated non-LEC1-type.

Phylogenetic trees based on sequential relatedness of the HAP3 genes are shown in FIGS. 6 and 7. As can be seen in these figures showing the L1L-related CCAAT transcription factor family, G1364 and G2345 are closely related to G481, and G482 and G485 are more related to G481 than either LEC1 or L1L, the latter two sequences being found on somewhat more distant nodes. The present invention encompasses the G482 subclade of these non-LEC1-like clade of proteins of the L1L-related CCAAT transcription factor family, for which a representative number of monocot and dicot species, including members from dicot and monocot species (for example, *Arabidopsis* sequences G481, G482, G485, G1364 and G2345, soy sequences G3472, G3475, G3476, rice sequences G3395, G3397, G3398, and corn sequences G3434, and G3436), have been shown to confer improved abiotic stress tolerance in plants when overexpressed.

Table 1 shows the polypeptides identified by SEQ ID NO; Gene ID (GID) No.; the transcription factor family to which the polypeptide belongs, and conserved B domains of the polypeptide. The first column shows the polypeptide SEQ ID NO; the second column the species (abbreviated) and identifier (GID or "Gene IDentifier); the third column shows the B domain; the fourth column shows the amino acid coordinates of the conserved domain which were used to determine percentage identity to G481; and the fifth column shows the percentage identity to G481. The sequences are arranged in descending order of percentage identity to G481.

For Tables 1 and 2, homology was determined after aligning the sequences using the methods of Smith and Waterman (1981) *Adv. Appl. Math.* 2: 482-489. After alignment, sequence comparisons between the polypeptides were performed by comparison over a comparison window to identify and compare local regions of sequence similarity. A description of the method is provided in Ausubel et al. (eds.) *Current Protocols in Molecular Biology*, John Wiley & Sons (1998, and supplements through 2001), Altschul et al. (1990). *J. Mol. Biol.* 215: 403-410; and Gish and States (1993) *Nature Genetics* 3: 266-72. The percentage identity reported in these tables is based on the comparison within these windows.

TABLE 1

Gene families and B domains

| Polypeptide SEQ ID NO: | Species/ GID No., Accession No., or identifier | B Domain | Amino Acid Coordinates for Percent Identity Determination | % ID to CCAAT box-binding conserved domain of G481 (SEQ ID NO: 88) |
|---|---|---|---|---|
| 88 | At/G481 | REQDRYLPIANISRIMKKALPPNGKIGK DAKDTVQECVSEFISFITSEASDKCQKE KRKTVNGDDLLWAMATLGFEDYLEPL KIYLARYRE | 20-110 | 100% |
| 806 | Zm/G3434 | REQDRFLPIANISRIMKKAVPANGKIAK DAKETLQECVSEFISFVTSEASDKCQKE KRKTINGDDLLWAMATLGFEEYVEPLK IYLQKYKE | 18-108 | 85% |
| 2102 | At/G1364 | REQDRFLPIANISRIMKRGLPANGKIAK DAKEIVQECVSEFISFVTSEASDKCQRE KRKTINGDDLLWAMATLGFEDYMEPL KVYLMRYRE | 29-119 | 85% |
| 800 | Gm/G3475 | REQDRFLPIANVSRIMKKALPANAKISK DAKETVQECVSEFISFITGEASDKCQRE KRKTINGDDLLWAMTTLGFEDYVEPLK GYLQRFRE | 23-113 | 84% |
| 2010 | At/G485 | REQDRFLPIANVSRIMKKALPANAKISK DAKETVQECVSEFISFITGEASDKCQRE KRKTINGDDLLWAMTTLGFEDYVEPLK VYLQKYRE | 20-110 | 84% |
| 798 | Gm/G3476 | REQDRFLPIANVSRIMKKALPANAKISK DAKETVQECVSEFISFITGEASDKCQRE KRKTINGDDLLWAMTTLGFEEYVEPLK IYLQRFRE | 26-116 | 84% |

TABLE 1-continued

Gene families and B domains

| Polypeptide SEQ ID NO: | Species/ GID No., Accession No., or identifier | B Domain | Amino Acid Coordinates for Percent Identity Determination | % ID to CCAAT box-binding conserved domain of G481 (SEQ ID NO: 88) |
|---|---|---|---|---|
| 2172 | At/G2345 | REQDRFLPIANISRIMKRGLPLNGKIAK DAKETMQECVSEFISFVTSEASDKCQRE KRKTINGDDLLWAMATLGFEDYIDPLK VYLMRYRE | 28-118 | 84% |
| 90 | At/G482 | REQDRFLPIANVSRIMKKALPANAKISK DAKETMQECVSEFISFVTGEASDKCQK EKRKTINGDDLLWAMTTLGFEDYVEPL KVYLQRFRE | 26-116 | 83% |
| 801 | Gm/G3472 | REQDRFLPIANVSRIMKKALPANAKISK EAKETVQECVSEFISFITGEASDKCQKE KRKTINGDDLLWAMTTLGFEEYVEPLK VYLHKYRE | 25-115 | 83% |
| 805 | Zm/G3436 | REQDRFLPIANVSRIMKKALPANAKISK DAKETVQECVSEFISFITGEASDKCQRE KRKTINGDDLLWAMTTLGFEDYVEPLK LYLHKFRE | 20-110 | 83% |
| 794 | Os/G3397 | REQDRFLPIANVSRIMKKALPANAKISK DAKETVQECVSEFISFITGEASDKCQRE KRKTINGDDLLWAMTTLGFEDYVDPL KHYLHKFRE | 23-113 | 82% |
| 790 | Os/G3395 | REQDRFLPIANISRIMKKAVPANGKIAK DAKETLQECVSEFISFVTSEASDKCQKE KRKTINGEDLLFAMGTLGFEEYVDPLKI YLHKYRE | 19-109 | 82% |
| 796 | Os/G3398 | REQDRFLPIANVSRIMKRALPANAKISK DAKETVQECVSEFISFITGEASDKCQRE KRKTINGDDLLWAMTTLGFEDYIDPLK LYLHKFRE | 21-111 | 81% |
|  | At/G1821 L1L NP_199578 | REQDRFMPIANVIRIMRRILPAHAKISD DSKETIQECVSEYISFITGEANERC QREQRKTITAEDVLWAMSKLGFDDYIE PLTLYLHRYRE | 28-118 | 62% |
|  | At/ AAC39488 LEC1 | REQDQYMPIANVIRIMRKTLPSHAKISD DAKETIQECVSEYISFVTGEANERCQRE QRKTITAEDILWAMSKLGFDNYVDPLT VFINRYRE | 28-118 | 62% |

Abbreviations: At *Arabidopsis thaliana*
Gm *Glycine max*
Os *Oryza sativa*
Zm *Zea mays*

G682 and the MYB-Related Transcription Factors

G682 is a member of the MYB-related group of transcription factors. G682 and its related sequences were included a program to test the ability of these sequences to confer the same drought-related abiotic stress previously observed by us in 35S::G682 lines.

We first identified G682 as a putative transcription factor from the *Arabidopsis* BAC, AF007269, based on sequence similarity to other members of the MYB-related family within the conserved domain. To date, no functional data are available for this gene in the literature. The gene corresponds to At4G01060, annotated by the *Arabidopsis* Genome initiative. G682 is one of a 5-member clade of related proteins that range in size from 75 to 112 amino acids. These proteins contain a single MYB repeat, which is not uncommon for plant MYB transcription factors. Information on gene function has been published for two of the genes in this clade, CAPRICE (CPC/G225) and TRIPTYCHON (TRY/G1816). Published information on gene function is not available for two additional members of the clade; G226 and G2718. Our initial genomics program, members of the G682 clade were found to promote epidermal cell type alterations when overexpressed in *Arabidopsis*. These changes include both increased numbers of root hairs compared to wild type plants, as well as a reduction in trichome number. In addition, overexpression lines for all members of the clade showed a reduction in anthocyanin accumulation in response to stress, and enhanced tolerance to hyperosmotic stress. In the case of 35S::G682 transgenic lines, an enhanced tolerance to high heat conditions was also observed. Given the phenotypic responses for G682 and its clade members, a sizeable number of clade members were included in the present drought-stress study. Table 2 summarizes the functional genomics data found in our investigation of G682 and its clade members.

TABLE 2

G682-clade experimental observations

| Observation | GID | | | |
|---|---|---|---|---|
| | G226 | G682 | TRY (G1816) | G2718 |
| Reduction in Trichome # | X | X | X | X |
| Increased Root Hair # | X | X | X | X |
| N Tolerance | X | | X | X |
| Heat Tolerance | | X | | |
| Salt Tolerance | X | | | |
| Sugar response | | | X | |

There are approximately 50 members of this family in *Arabidopsis*. The MYB-related DNA-binding domain contains approximately 50 amino acids with a series of highly conserved residues arranged with a characteristic spacing. The single-repeat MYB proteins do not contain a typical transcriptional activation domain and this suggests that they may function by interfering with the formation or activity of transcription factors or transcription factor complexes (Wada et al. (1997) *Science* 277: 1113-1116; Schellmann et al. (2002) *EMBO J.* 21: 5036-5046). In addition to the G682 clade, two well characterized transcription factors, CIRCADIAN CLOCK ASSOCIATED1 (CCA1/G214) and LATE ELONGATED HYPOCOTYL (LHY/G680) represent two additional well-characterized MYB-related proteins that contain single MYB repeats (Wang et al. (1997) *Plant Cell* 9: 491-507; Schaffer et al. (1998) *Cell* 93: 1219-1229).

The difference in the phenotypic responses of the G682-clade overexpression lines (Table 2), along with the differences in the CPC (G225) and TRY (G1816) mutant phenotypes (Schellmann et al. (2002) supra), suggest that each of the five *Arabidopsis* genes in the clade have distinct but overlapping functions in the plant. In the case of 35S::G682 transgenic lines, an enhanced tolerance to high heat conditions was observed. Heat can cause osmotic stress, and it is therefore consistent that these transgenic lines were also more tolerant to drought stress in a soil-based assay. Another common feature for four of five members of this clade is that they enhance performance under nitrogen-limiting conditions. 35S::G682 plants lacked this feature in the first round of screening, but given the high throughput nature of the genomics program, it is possible this phenotype would have been observed if a greater number of lines had been examined.

All of the genes in the *Arabidopsis* G682 clade reduced trichomes and increased root hairs when constitutively overexpressed (Table 2). It is unknown, however, whether the drought-tolerance phenotypes in these lines is related to the increase in root hairs on the root epidermis. Increasing root hair density may increase in absorptive surface area and increase in nitrate transporters that are normally found there. Alternatively, the wer, ttg1 and gl2 mutations, all of which increase root hair frequency, and have also been shown to cause ectopic stomate formation on the epidermis of hypocotyls. Thus, it is possible that CPC and TRY could be involved in the development, or regulation, of stomates as well (Hung et al. (1998) *Plant Physiol.* 117: 73-84, 1998; Berger et al. (1998) *Curr. Biol.* 8: 421-430; Lee and Schiefelbein (1999) *Cell* 99: 473-483). The CPC (G225) and TRY (G1816) proteins have not been reported to alter hypocotyl epidermal cell fate; however, ectopic expression may have resulted in an alteration in stomate production in this tissue. Since alterations in stomate production could alter plant water status, it should be examined in transgenics expressing the genes of the G682 clade, particularly in lines that show increased drought tolerance.

Interestingly, our data also suggest that G1816 (TRY) overexpression lines had a glucose sugar sensing phenotype. Several sugar sensing mutants have turned out to be allelic to ABA and ethylene mutants. This potentially implicates G1816 in hormone signaling.

As noted below, overexpression of a number of *Arabidopsis* and non-*Arabidopsis* the members of the G682 subclade of MYB-related transcription factors conferred increased abiotic stress tolerance in transgenic plants, as compared to non-transgenic plants of the same species a (i.e., non-transformed plant that did not overexpress these polypeptides).

Table 3 shows the polypeptides identified by SEQ ID NO; Gene ID (GID) No.; the transcription factor family to which the polypeptide belongs, and conserved MYB-related domains of the polypeptide. The first column shows the polypeptide SEQ ID NO; the second column the species and GID; the third column shows the MYB-related domain; the fourth column shows the amino acid coordinates of the conserved domain that were used to determine the percentage identity of that conserved domain to the MYB-related domain of G682; and the fifth column shows the percentage identity to G682. The sequences are arranged in descending order of percentage identity to G682.

TABLE 3

Gene families and MYB-related domains

| Polypeptide SEQ ID NO: | Species/ GID No., Accession Identifier | MYB-related Domain | Amino Acid Coordinates for Percent Identity Determination | % ID MYB-related conserved domain of G682 |
|---|---|---|---|---|
| 148 | At/G682 | EWEVVNMSQEEEDLVSRMHKLVG DRWELIAGRIPGRT | 27-63 | 100% |
| 559 | Os/G3393 | AQNFVHFTEEEEDLVFRMHRLVGN RWELIAGRIPGRT | 33-69 | 78% |
| 2192 | At/G2718 | EWEEIAMAQEEEDLICRMYKLVGE RWDLIAGRIPGRT | 28-64 | 75% |
| 1082 | Os/G3392 | AQNFVHFTEEEEDIVFRMHRLVGN RWELIAGRIPGRT | 28-64 | 75% |

TABLE 3-continued

Gene families and MYB-related domains

| SEQ ID NO: | Species/ GID No., Accession Polypeptide No., or Identifier | MYB-related Domain | Amino Acid Coordinates for Percent Identity Determination | % ID MYB-related conserved domain of G682 |
|---|---|---|---|---|
| 1089 | Zm/G3431 | AQHLVDFTEAEEDLVSRMHRLVGN RWEIIAGRIPGRT | 28-64 | 73% |
| 1084 | Gm/G3450 | EWKVIHMSEQEEDLIRRMYKLVGD KWNLIAGRIPGRK | 16-52 | 72% |
| 2142 | At/G1816 | EWEFINMTEQEEDLIFRMYRLVGD RWDLIAGRVPGRQ | 26-62 | 69% |
| 1088 | Gm/G3449 | GSSKVEFSEDEETLIIRMYKLVGER WSLIAGRIPGRT | 22-58 | 69% |
| 1087 | Gm/G3448 | GSSKVEFSEDEETLIIRMYKLVGER WSIIAGRIPGRT | 22-58 | 66% |
| 38 | At/G226 | EWEFISMTEQEEDLISRMYRLVGNR WDLIAGRVVGRK | 34-70 | 63% |
| 1086 | Gm/G3446 | QVSDVEFSEAEEILIAMVYNLVGER WSLIAGRIPGRT | 22-58 | 60% |
| 1083 | Gm/G3445 | QVSDVEFSEAEEILIAMVYNLVGER WSLIAGRIPGRT | 21-57 | 60% |

Abbreviations: At *Arabidopsis thaliana*
Gm *Glycine max*
Os *Oryza sativa*
Zm *Zea mays*

G682 and its paralogs and orthologs are composed (almost entirely) of a single MYB-repeat DNA binding domain that is highly conserved across plant species. An alignment of the G682-like proteins from *Arabidopsis*, soybean, rice and corn that are being analyzed in this trait module is shown in FIGS. 3A and 3B. No function has been assigned to any of these MYB-related genes outside of *Arabidopsis*.

Because the G682 clade members are short proteins that are comprised almost exclusively of a DNA binding motif, it is likely that they function as repressors. This is consistent with in expression analyses indicating that CPC represses its own transcription as well as that of WER and GL2 (Wada et al. (2002) supra; Lee and Schiefelbein (2002) supra). Repression may occur at the level of DNA binding through competition with other factors at target promoters, although repression via protein-protein interactions cannot be excluded.

The AP2 Family, Including the G47/G2133 and G1792 Clades.

AP2 (APETALA2) and EREBPs (Ethylene-Responsive Element Binding Proteins) are the prototypic members of a family of transcription factors unique to plants, whose distinguishing characteristic is that they contain the so-called AP2 DNA-binding domain (for a review, see Riechmann and Meyerowitz (1998) *Biol. Chem.* 379: 633-646). The AP2 domain was first recognized as a repeated motif within the *Arabidopsis thaliana* AP2 protein (Jofuku et al. (1994) *Plant Cell* 6: 1211-1225). Shortly afterwards, four DNA-binding proteins from tobacco were identified that interact with a sequence that is essential for the responsiveness of some promoters to the plant hormone ethylene, and were designated as ethylene-responsive element binding proteins (EREBPs; Ohme-Takagi et al. (1995) *Plant Cell* 7: 173-182). The DNA-binding domain of EREBP-2 was mapped to a region that was common to all four proteins (Ohme-Takagi et al (1995) supra), and that was found to be closely related to the AP2 domain (Weigel (1995) *Plant Cell* 7: 388-389) but that did not bear sequence similarity to previously known DNA-binding motifs.

AP2/EREBP genes form a large family, with many members known in several plant species (Okamuro et al. (1997) *Proc. Natl. Acad. Sci. USA* 94: 7076-7081; Riechmann and Meyerowitz (1998) supra). The number of AP2/EREBP genes in the *Arabidopsis thaliana* genome is approximately 145 (Riechmann et al. (2000) *Science* 290: 2105-2110). The APETALA2 class is characterized by the presence of two AP2 DNA binding domains, and contains 14 genes. The AP2/ERF is the largest subfamily, and includes 125 genes which are involved in abiotic (DREB subgroup) and biotic (ERF subgroup) stress responses and the RAV subgroup includes 6 genes which all have a B3 DNA binding domain in addition to the AP2 DNA binding domain (Kagaya et al. (1999) *Nucleic Acids Res.* 27: 470-478).

*Arabidopsis* AP2 is involved in the specification of sepal and petal identity through its activity as a homeotic gene that forms part of the combinatorial genetic mechanism of floral organ identity determination and it is also required for normal ovule and seed development (Bowman et al. (1991) *Development* 112: 1-20; Jofuku et al. (1994) supra). *Arabidopsis* ANT is required for ovule development and it also plays a role in floral organ growth (Elliott et al. (1996) *Plant Cell* 8: 155-168; Klucher et al. (1996) *Plant Cell* 8: 137-153). Finally, maize G115 regulates leaf epidermal cell identity (Moose et al. (1996) *Genes Dev.* 10: 3018-3027).

The attack of a plant by a pathogen may induce defense responses that lead to resistance to the invasion, and these responses are associated with transcriptional activation of defense-related genes, among them those encoding pathogenesis-related (PR) proteins. The involvement of EREBP-like genes in controlling the plant defense response is based on the observation that many PR gene promoters contain a short cis-acting element that mediates their responsiveness to ethylene (ethylene appears to be one of several signal molecules controlling the activation of defense responses). Tobacco EREBP-1, -2, -3, and -4, and tomato Pti4, Pti5 and Pti6 proteins have been shown to recognize such cis-acting elements (Ohme-Takagi (1995) supra; Zhou et al. (1997) *EMBO J.* 16: 3207-3218). In addition, Pti4, Pti5, and Pti6 proteins have been shown to interact directly with Pto, a protein kinase that confers resistance against *Pseudomonas syringae* pv tomato (Zhou et al. (1997) supra). Plants are also challenged by adverse environmental conditions like cold or drought, and EREBP-like proteins appear to be involved in the responses to these abiotic stresses as well. COR (for cold-regulated) gene expression is induced during cold acclimation, the process by which plants increase their resistance to freezing in response to low unfreezing temperatures. The *Arabidopsis* EREBP-like gene CBF1 (Stockinger et al. (1997) *Proc. Natl. Acad. Sci. USA* 94: 1035-1040) is a regulator of the cold acclimation response, because ectopic expression of CBF1 in *Arabidopsis* transgenic plants induced COR gene expression in the absence of a cold stimulus, and the plant freezing tolerance was increased (Jaglo-Ottosen et al. (1998) *Science* 280: 104-106). Finally, another *Arabidopsis* EREBP-like gene, ABI4, is involved in abscisic acid (ABA) signal transduction, because abi4 mutants are insensitive to ABA (ABA is a plant hormone that regulates many agronomically important aspects of plant development; Finkelstein et al. (1998) *Plant Cell* 10: 1043-1054).

The SCR Family, Including the G922 Clade.

The SCARECROW gene, which regulates an asymmetric cell division essential for proper radial organization of root cell layers, was isolated from *Arabidopsis thaliana* by screening a genomic library with sequences flanking a T-DNA insertion causing a "scarecrow" mutation (Di Laurenzio et al. (1996) *Cell* 86, 423-433). The gene product was tentatively described as a transcription factor based on the presence of homopolymeric stretches of several amino acids, the presence of a basic domain similar to that of the basic-leucine zipper family of transcription factors, and the presence of leucine heptad repeats. The presence of several *Arabidopsis* ESTs with gene products homologous to the SCARECROW gene were noted. The ability of the SCARECROW gene to complement the scarecrow mutation was also demonstrated (Malamy et al. (1997) *Plant J.* 12, 957-963).

More recently, the SCARECROW homologue RGA, which encodes a negative regulator of the gibberellin signal transduction pathway, was isolated from *Arabidopsis* by genomic subtraction (Silverstone et al. (1998) *Plant Cell* 10, 155-169). The RGA gene was shown to be expressed in many different tissues and the RGA protein was shown to be localized to the nucleus. The same gene was isolated by Truong (Truong et al. (1997) *FEBS Lett.* 410: 213-218) by identifying cDNA clones which complement a yeast nitrogen metabolism mutant, suggesting that RGA may be involved in regulating diverse metabolic processes. Another SCARECROW homologue designated GAI, which also is involved in gibberellin signaling processes, has been isolated by Peng (Peng et al. (1997) *Genes Dev.* 11, 3194-3205). Interestingly, GAI is the gene that initiated the Green Revolution. Peng et al. (Peng et al. (1999) Nature 6741, 256-261) have recently shown that maize GAI orthologs, when mutated, result in plants that are shorter, have increased seed yield, and are more resistant to damage by rain and wind than wild type plants. Based on the inclusion of the GAI, RGA and SCR genes in this family, it has also been referred to as the GRAS family (Pysh et al. (1999) *Plant J* 18, 111-19).

The scarecrow gene family has 32 members in the *Arabidopsis* genome.

The NAC Family, Including the G2053 Clade.

The NAC family is a group of transcription factors that share a highly conserved N-terminal domain of about 150 amino acids, designated the NAC domain (NAC stands for Petunia, NAM, and *Arabidopsis*, ATAF1, ATAF2 and CUC2). This is believed to be a novel domain that is present in both monocot and dicot plants but is absent from yeast and animal proteins. One hundred and twelve members of the NAC family have been identified in the *Arabidopsis* genome. The NAC class of proteins can be divided into at least two sub-families on the basis of amino acid sequence similarities within the NAC domain. One sub-family is built around the NAM and CUC2 (cup-shaped cotyledon) proteins whilst the other sub-family contains factors with a NAC domain similar to those of ATAF1 and ATAF2.

Thus far, little is known about the function of different NAC family members. This is surprising given that there are 113 members in *Arabidopsis*. However, NAM, CUC1 and CUC2 are thought to have vital roles in the regulation of embryo and flower development. In Petunia, nam mutant embryos fail to develop a shoot apical meristem (SAM) and have fused cotyledons. These mutants sometimes generate escape shoots that produce defective flowers with extra petals and fused organs. In *Arabidopsis*, the cuc1 and cuc2 mutations have somewhat similar effects, causing defects in SAM formation and the separation of cotyledons, sepals and stamens.

Although nam and cuc mutants exhibit comparable defects during embryogenesis, the penetrance of these phenotypes is much lower in cuc mutants. Functional redundancy of the CUC genes in *Arabidopsis* may explain this observation. In terms of the flower phenotype there are notable differences between nam and cuc mutants. Flowers of cuc mutants do not contain additional organs and the formation of sepals and stamens is most strongly affected. In nam mutants, by contrast, the flowers do carry additional organs and petal formation is more markedly affected than that of other floral organs. These apparent differences might be explained in two ways: the NAM and CUC proteins have been recruited into different roles in development of *Arabidopsis* and Petunia flowers. Alternatively, the proteins could share a common function between the two species, with the different mutant floral phenotypes arising from variations in the way other genes (that participate in the same developmental processes) are affected by defects in NAM or CUC.

A further gene from this family, NAP (NAC-like activated by AP3/PI) is also involved in flower development and is thought to influence the transition between cell division and cell expansion in stamens and petals. Overall, then, the NAC proteins mainly appear to regulate developmental processes.

Producing Polypeptides

The polynucleotides of the invention include sequences that encode transcription factors and transcription factor homolog polypeptides and sequences complementary thereto, as well as unique fragments of coding sequence, or sequence complementary thereto. Such polynucleotides can be, e.g., DNA or RNA, e.g., mRNA, cRNA, synthetic RNA, genomic DNA, cDNA synthetic DNA, oligonucleotides, etc. The polynucleotides are either double-stranded or single-stranded, and include either, or both sense (i.e., coding) sequences and antisense (i.e., non-coding, complementary) sequences. The polynucleotides include the coding sequence of a transcription factor, or transcription factor homolog polypeptide, in isolation, in combination with additional coding sequences (e.g., a purification tag, a localization signal, as a fusion-protein, as a pre-protein, or the like), in combination with non-coding sequences (e.g., introns or inteins, regulatory elements such as promoters, enhancers, terminators, and the like), and/or in a vector or host environment in which the polynucleotide encoding a transcription factor or transcription factor homolog polypeptide is an endogenous or exogenous gene.

A variety of methods exist for producing the polynucleotides of the invention. Procedures for identifying and isolating DNA clones are well known to those of skill in the art, and are described in, e.g., Berger and Kimmel, *Guide to Molecular Cloning Techniques, Methods in Enzymology*, vol. 152 Academic Press, Inc., San Diego, Calif. ("Berger"); Sambrook et al. (1989) *Molecular Cloning—A Laboratory Manual* (2nd Ed.), Vol. 1-3, Cold Spring Harbor Laboratory, Cold Spring Harbor, N.Y., and *Current Protocols in Molecular Biology*, Ausubel et al. eds., Current Protocols, a joint venture between Greene Publishing Associates, Inc. and John Wiley & Sons, Inc., (supplemented through 2000) ("Ausubel").

Alternatively, polynucleotides of the invention, can be produced by a variety of in vitro amplification methods adapted to the present invention by appropriate selection of specific or degenerate primers. Examples of protocols sufficient to direct persons of skill through in vitro amplification methods, including the polymerase chain reaction (PCR) the ligase chain reaction (LCR), Qbeta-replicase amplification and other RNA polymerase mediated techniques (e.g., NASBA), e.g., for the production of the homologous nucleic acids of the invention are found in Berger (supra), Sambrook (supra), and Ausubel (supra), as well as Mullis et al. (1987) *PCR Protocols A Guide to Methods and Applications* (Innis et al. eds) Academic Press Inc. San Diego, Calif. (1990) (Innis). Improved methods for cloning in vitro amplified nucleic acids are described in Wallace et al. U.S. Pat. No. 5,426,039. Improved methods for amplifying large nucleic acids by PCR are summarized in Cheng et al. (1994) *Nature* 369: 684-685 and the references cited therein, in which PCR amplicons of up to 40 kb are generated. One of skill will appreciate that essentially any RNA can be converted into a double stranded DNA suitable for restriction digestion, PCR expansion and sequencing using reverse transcriptase and a polymerase. See, e.g., Ausubel, Sambrook and Berger, all supra.

Alternatively, polynucleotides and oligonucleotides of the invention can be assembled from fragments produced by solid-phase synthesis methods. Typically, fragments of up to approximately 100 bases are individually synthesized and then enzymatically or chemically ligated to produce a desired sequence, e.g., a polynucleotide encoding all or part of a transcription factor. For example, chemical synthesis using the phosphoramidite method is described, e.g., by Beaucage et al. (1981) *Tetrahedron Letters* 22: 1859-1869; and Matthes et al. (1984) *EMBO J*. 3: 801-805. According to such methods, oligonucleotides are synthesized, purified, annealed to their complementary strand, ligated and then optionally cloned into suitable vectors. And if so desired, the polynucleotides and polypeptides of the invention can be custom ordered from any of a number of commercial suppliers.

Homologous Sequences

Sequences homologous, i.e., that share significant sequence identity or similarity, to those provided in the Sequence Listing, derived from *Arabidopsis thaliana* or from other plants of choice, are also an aspect of the invention.

Homologous sequences can be derived from any plant including monocots and dicots and in particular agriculturally important plant species, including but not limited to, crops such as soybean, wheat, corn (maize), potato, cotton, rice, rape, oilseed rape (including canola), sunflower, alfalfa, clover, sugarcane, and turf; or fruits and vegetables, such as banana, blackberry, blueberry, strawberry, and raspberry, cantaloupe, carrot, cauliflower, coffee, cucumber, eggplant, grapes, honeydew, lettuce, mango, melon, onion, papaya, peas, peppers, pineapple, pumpkin, spinach, squash, sweet corn, tobacco, tomato, tomatillo, watermelon, rosaceous fruits (such as apple, peach, pear, cherry and plum) and vegetable brassicas (such as broccoli, cabbage, cauliflower, Brussels sprouts, and kohlrabi). Other crops, including fruits and vegetables, whose phenotype can be changed and which comprise homologous sequences include barley; rye; millet; sorghum; currant; avocado; citrus fruits such as oranges, lemons, grapefruit and tangerines, artichoke, cherries; nuts such as the walnut and peanut; endive; leek; roots such as arrowroot, beet, cassava, turnip, radish, yam, and sweet potato; and beans. The homologous sequences may also be derived from woody species, such pine, poplar and eucalyptus, or mint or other labiates. In addition, homologous sequences may be derived from plants that are evolutionarily-related to crop plants, but which may not have yet been used as crop plants. Examples include deadly nightshade (*Atropa belladona*), related to tomato; jimson weed (*Datura strommium*), related to peyote; and teosinte (*Zea* species), related to corn (maize).

Orthologs and Paralogs

Homologous sequences as described above can comprise orthologous or paralogous sequences. Several different methods are known by those of skill in the art for identifying and defining these functionally homologous sequences. Three general methods for defining orthologs and paralogs are described; an ortholog or paralog, including equivalogs, may be identified by one or more of the methods described below.

Orthologs and paralogs are evolutionarily related genes that have similar sequence and similar functions. Orthologs are structurally related genes in different species that are derived by a speciation event. Paralogs are structurally related genes within a single species that are derived by a duplication event.

Within a single plant species, gene duplication may cause two copies of a particular gene, giving rise to two or more genes with similar sequence and often similar function known as paralogs. A paralog is therefore a similar gene formed by duplication within the same species. Paralogs typically cluster together or in the same clade (a group of similar genes) when a gene family phylogeny is analyzed using programs such as CLUSTAL (Thompson et al. (1994) *Nucleic Acids Res.* 22: 4673-4680; Higgins et al. (1996) *Methods Enzymol.* 266: 383-402). Groups of similar genes can also be identified with pair-wise BLAST analysis (Feng and Doolittle (1987) *J. Mol. Evol.* 25: 351-360). For example, a clade of very similar MADS domain transcription factors from *Arabidopsis* all share a common function in flowering time (Ratcliffe et al. (2001) *Plant Physiol.* 126: 122-132), and a group of very similar AP2 domain transcription factors from *Arabidopsis* are involved in tolerance of plants to freezing (Gilmour et al. (1998) *Plant J.* 16: 433-442). Analysis of groups of similar genes with similar function that fall within one clade can yield sub-sequences that are particular to the clade. These sub-sequences, known as consensus sequences, can not only be used to define the sequences within each clade, but define the functions of these genes; genes within a clade may contain paralogous sequences, or orthologous sequences that share the same function (see also, for example, Mount (2001), in

*Bioinformatics: Sequence and Genome Analysis*, Cold Spring Harbor Laboratory Press, Cold Spring Harbor, N.Y., page 543.)

Speciation, the production of new species from a parental species, can also give rise to two or more genes with similar sequence and similar function. These genes, termed orthologs, often have an identical function within their host plants and are often interchangeable between species without losing function. Because plants have common ancestors, many genes in any plant species will have a corresponding orthologous gene in another plant species. Once a phylogenic tree for a gene family of one species has been constructed using a program such as CLUSTAL (Thompson et al. (1994) Nucleic Acids Res. 22: 4673-4680; Higgins et al. (1996) supra) potential orthologous sequences can be placed into the phylogenetic tree and their relationship to genes from the species of interest can be determined. Orthologous sequences can also be identified by a reciprocal BLAST strategy. Once an orthologous sequence has been identified, the function of the ortholog can be deduced from the identified function of the reference sequence.

Transcription factor gene sequences are conserved across diverse eukaryotic species lines (Goodrich et al. (1993) *Cell* 75: 519-530; Lin et al. (1991) *Nature* 353: 569-571; Sadowski et al. (1988) *Nature* 335: 563-564). et al. Plants are no exception to this observation; diverse plant species possess transcription factors that have similar sequences and functions.

Orthologous genes from different organisms have highly conserved functions, and very often essentially identical functions (Lee et al. (2002) *Genome Res.* 12: 493-502; Remm et al. (2001) *J. Mol. Biol.* 314: 1041-1052). Paralogous genes, which have diverged through gene duplication, may retain similar functions of the encoded proteins. In such cases, paralogs can be used interchangeably with respect to certain embodiments of the instant invention (for example, transgenic expression of a coding sequence). An example of such highly related paralogs is the CBF family, with three well-defined members in *Arabidopsis* and at least one ortholog in *Brassica napus* (SEQ ID NOs: 1956, 1958, 1960, or 2204, respectively), all of which control pathways involved in both freezing and drought stress (Gilmour et al. (1998) *Plant J.* 16: 433-442; Jaglo et al. (1998) *Plant Physiol.* 127: 910-917).

The following references represent a small sampling of the many studies that demonstrate that conserved transcription factor genes from diverse species are likely to function similarly (i.e., regulate similar target sequences and control the same traits), and that transcription factors may be transformed into diverse species to confer or improve traits.

(1) The *Arabidopsis* NPR1 gene regulates systemic acquired resistance (SAR); over-expression of NPR1 leads to enhanced resistance in *Arabidopsis*. When either *Arabidopsis* NPR1 or the rice NPR1 ortholog was overexpressed in rice (which, as a monocot, is diverse from *Arabidopsis*), challenge with the rice bacterial blight pathogen *Xanthomonas oryzae* pv. *Oryzae*, the transgenic plants displayed enhanced resistance (Chern et al. (2001) *Plant J.* 27: 101-113). NPR1 acts through activation of expression of transcription factor genes, such as TGA2 (Fan and Dong (2002) *Plant Cell* 14: 1377-1389).

(2) E2F genes are involved in transcription of plant genes for proliferating cell nuclear antigen (PCNA). Plant E2Fs share a high degree of similarity in amino acid sequence between monocots and dicots, and are even similar to the conserved domains of the animal E2Fs. Such conservation indicates a functional similarity between plant and animal E2Fs. E2F transcription factors that regulate meristem development act through common cis-elements, and regulate related (PCNA) genes (Kosugi and Ohashi, (2002) *Plant J.* 29: 45-59).

(3) The ABI5 gene (abscisic acid (ABA) insensitive 5) encodes a basic leucine zipper factor required for ABA response in the seed and vegetative tissues. Co-transformation experiments with ABI5 cDNA constructs in rice protoplasts resulted in specific transactivation of the ABA-inducible wheat, *Arabidopsis*, bean, and barley promoters. These results demonstrate that sequentially similar ABI5 transcription factors are key targets of a conserved ABA signaling pathway in diverse plants. (Gampala et al. (2001) *J. Biol. Chem.* 277: 1689-1694).

(4) Sequences of three *Arabidopsis* GAMYB-like genes were obtained on the basis of sequence similarity to GAMYB genes from barley, rice, and *L. temulentum*. These three *Arabidopsis* genes were determined to encode transcription factors (AtMYB33, AtMYB65, and AtMYB101) and could substitute for a barley GAMYB and control alpha-amylase expression (Gocal et al. (2001) *Plant Physiol.* 127: 1682-1693).

(5) The floral control gene LEAFY from *Arabidopsis* can dramatically accelerate flowering in numerous dictoyledonous plants. Constitutive expression of *Arabidopsis* LEAFY also caused early flowering in transgenic rice (a monocot), with a heading date that was 26-34 days earlier than that of wild-type plants. These observations indicate that floral regulatory genes from *Arabidopsis* are useful tools for heading date improvement in cereal crops (He et al. (2000) *Transgenic Res.* 9: 223-227).

(6) Bioactive gibberellins (GAs) are essential endogenous regulators of plant growth. GA signaling tends to be conserved across the plant kingdom. GA signaling is mediated via GAI, a nuclear member of the GRAS family of plant transcription factors. *Arabidopsis* GAI has been shown to function in rice to inhibit gibberellin response pathways (Fu et al. (2001) *Plant Cell* 13: 1791-1802).

(7) The *Arabidopsis* gene SUPERMAN (SUP), encodes a putative transcription factor that maintains the boundary between stamens and carpels. By over-expressing *Arabidopsis* SUP in rice, the effect of the gene's presence on whorl boundaries was shown to be conserved. This demonstrated that SUP is a conserved regulator of floral whorl boundaries and affects cell proliferation (Nandi et al. (2000) *Curr. Biol.* 10: 215-218).

(8) Maize, petunia and *Arabidopsis* myb transcription factors that regulate flavonoid biosynthesis are very genetically similar and affect the same trait in their native species, therefore sequence and function of these myb transcription factors correlate with each other in these diverse species (Borevitz et al. (2000) *Plant Cell* 12: 2383-2394).

(9) Wheat reduced height-1 (Rht-B1/Rht-D1) and maize dwarf-8 (d8) genes are orthologs of the *Arabidopsis* gibberellin insensitive (GAI) gene. Both of these genes have been used to produce dwarf grain varieties that have improved grain yield. These genes encode proteins that resemble nuclear transcription factors and contain an SH2-like domain, indicating that phosphotyrosine may participate in gibberellin signaling. Transgenic rice plants containing a mutant GAI allele from *Arabidopsis* have been shown to produce reduced responses to gibberellin and are dwarfed, indicating that mutant GAI orthologs could be used to increase yield in a wide range of crop species (Peng et al. (1999) *Nature* 400: 256-261).

Transcription factors that are homologous to the listed sequences will typically share, in at least one conserved domain, at least about 70% amino acid sequence identity, and with regard to zinc finger transcription factors, at least about 50% amino acid sequence identity. More closely related transcription factors can share at least about 70%, or about 75% or about 80% or about 90% or about 95% or about 98% or more sequence identity with the listed sequences, or with the listed sequences but excluding or outside a known consensus sequence or consensus DNA-binding site, or with the listed sequences excluding one or all conserved domain. Factors that are most closely related to the listed sequences share, e.g., at least about 85%, about 90% or about 95% or more % sequence identity to the listed sequences, or to the listed sequences but excluding or outside a known consensus sequence or consensus DNA-binding site or outside one or all conserved domain. At the nucleotide level, the sequences will typically share at least about 40% nucleotide sequence identity, preferably at least about 50%, about 60%, about 70% or about 80% sequence identity, and more preferably about 85%, about 90%, about 95% or about 97% or more sequence identity to one or more of the listed sequences, or to a listed sequence but excluding or outside a known consensus sequence or consensus DNA-binding site, or outside one or all conserved domain. The degeneracy of the genetic code enables major variations in the nucleotide sequence of a polynucleotide while maintaining the amino acid sequence of the encoded protein. Conserved domains within a transcription factor family may exhibit a higher degree of sequence homology, such as at least 65% amino acid sequence identity including conservative substitutions, and preferably at least 80% sequence identity, and more preferably at least 85%, or at least about 86%, or at least about 87%, or at least about 88%, or at least about 90%, or at least about 95%, or at least about 98% sequence identity. Transcription factors that are homologous to the listed sequences should share at least 30%, or at least about 60%, or at least about 75%, or at least about 80%, or at least about 90%, or at least about 95% amino acid sequence identity over the entire length of the polypeptide or the homolog.

Percent identity can be determined electronically, e.g., by using the MEGALIGN program (DNASTAR, Inc. Madison, Wis.). The MEGALIGN program can create alignments between two or more sequences according to different methods, for example, the clustal method. (See, for example, Higgins and Sharp (1988) *Gene* 73: 237-244.) The clustal algorithm groups sequences into clusters by examining the distances between all pairs. The clusters are aligned pairwise and then in groups. Other alignment algorithms or programs may be used, including FASTA, BLAST, or ENTREZ, FASTA and BLAST, and which may be used to calculate percent similarity. These are available as a part of the GCG sequence analysis package (University of Wisconsin, Madison, Wis.), and can be used with or without default settings. ENTREZ is available through the National Center for Biotechnology Information. In one embodiment, the percent identity of two sequences can be determined by the GCG program with a gap weight of 1, e.g., each amino acid gap is weighted as if it were a single amino acid or nucleotide mismatch between the two sequences (see U.S. Pat. No. 6,262,333).

Other techniques for alignment are described in Doolittle, R. F. (1996) *Methods in Enzymology: Computer Methods for Macromolecular Sequence Analysis*, vol. 266, Academic Press, Orlando, Fla., USA. Preferably, an alignment program that permits gaps in the sequence is utilized to align the sequences. The Smith-Waterman is one type of algorithm that permits gaps in sequence alignments (see Shpaer (1997) *Methods Mol. Biol.* 70: 173-187). Also, the GAP program using the Needleman and Wunsch alignment method can be utilized to align sequences. An alternative search strategy uses MPSRCH software, which runs on a MASPAR computer. MPSRCH uses a Smith-Waterman algorithm to score sequences on a massively parallel computer. This approach improves ability to pick up distantly related matches, and is especially tolerant of small gaps and nucleotide sequence errors. Nucleic acid-encoded amino acid sequences can be used to search both protein and DNA databases.

The percentage similarity between two polypeptide sequences, e.g., sequence A and sequence B, is calculated by dividing the length of sequence A, minus the number of gap residues in sequence A, minus the number of gap residues in sequence B, into the sum of the residue matches between sequence A and sequence B, times one hundred. Gaps of low or of no similarity between the two amino acid sequences are not included in determining percentage similarity. Percent identity between polynucleotide sequences can also be counted or calculated by other methods known in the art, e.g., the Jotun Hein method. (See, e.g., Hein (1990) *Methods Enzymol.* 183: 626-645.) Identity between sequences can also be determined by other methods known in the art, e.g., by varying hybridization conditions (see US Patent Application No. 20010010913).

The percent identity between two conserved domains of a transcription factor DNA-binding domain consensus polypeptide sequence can be as low as 16%, as exemplified in the case of GATA1 family of eukaryotic $Cys_2/Cys_2$-type zinc finger transcription factors. The DNA-binding domain consensus polypeptide sequence of the GATA1 family is $CX_2CX_{17}CX_2C$, where X is any amino acid residue. (See, for example, Takatsuji, supra.) Other examples of such conserved consensus polypeptide sequences with low overall percent sequence identity are well known to those of skill in the art.

Thus, the invention provides methods for identifying a sequence similar or paralogous or orthologous or homologous to one or more polynucleotides as noted herein, or one or more target polypeptides encoded by the polynucleotides, or otherwise noted herein and may include linking or associating a given plant phenotype or gene function with a sequence. In the methods, a sequence database is provided (locally or across an internet or intranet) and a query is made against the sequence database using the relevant sequences herein and associated plant phenotypes or gene functions.

In addition, one or more polynucleotide sequences or one or more polypeptides encoded by the polynucleotide sequences may be used to search against a BLOCKS (Bairoch et al. (1997) *Nucleic Acids Res.* 25: 217-221), PFAM, and other databases which contain previously identified and annotated motifs, sequences and gene functions. Methods that search for primary sequence patterns with secondary structure gap penalties (Smith et al. (1992) *Protein Engineering* 5: 35-51) as well as algorithms such as Basic Local Alignment Search Tool (BLAST; Altschul (1993) *J. Mol. Evol.* 36: 290-300; Altschul et al. (1990) supra), BLOCKS (Henikoff and Henikoff (1991) *Nucleic Acids Res.* 19: 6565-6572), Hidden Markov Models (HMM; Eddy (1996) *Curr. Opin. Str. Biol.* 6: 361-365; Sonnhammer et al. (1997) *Proteins* 28: 405-420), and the like, can be used to manipulate and analyze polynucleotide and polypeptide sequences encoded by polynucleotides. These databases, algorithms and other methods are well known in the art and are described in Ausubel et al. (1997; *Short Protocols in Molecular Biology*, John Wiley & Sons, New York, N.Y., unit 7.7) and in Meyers (1995; *Molecular Biology and Biotechnology*, Wiley VCH, New York, N.Y., p 856-853).

Furthermore, methods using manual alignment of sequences similar or homologous to one or more polynucleotide sequences or one or more polypeptides encoded by the polynucleotide sequences may be used to identify regions of similarity and conserved domains. Such manual methods are well-known of those of skill in the art and can include, for example, comparisons of tertiary structure between a polypeptide sequence encoded by a polynucleotide which comprises a known function with a polypeptide sequence encoded by a polynucleotide sequence which has a function not yet determined. Such examples of tertiary structure may comprise predicted alpha helices, beta-sheets, amphipathic helices, leucine zipper motifs, zinc finger motifs, proline-rich regions, cysteine repeat motifs, and the like.

Orthologs and paralogs of presently disclosed transcription factors may be cloned using compositions provided by the present invention according to methods well known in the art. cDNAs can be cloned using mRNA from a plant cell or tissue that expresses one of the present transcription factors. Appropriate mRNA sources may be identified by interrogating Northern blots with probes designed from the present transcription factor sequences, after which a library is prepared from the mRNA obtained from a positive cell or tissue. Transcription factor-encoding cDNA is then isolated using, for example, PCR, using primers designed from a presently disclosed transcription factor gene sequence, or by probing with a partial or complete cDNA or with one or more sets of degenerate probes based on the disclosed sequences. The cDNA library may be used to transform plant cells. Expression of the cDNAs of interest is detected using, for example, methods disclosed herein such as microarrays, Northern blots, quantitative PCR, or any other technique for monitoring changes in expression. Genomic clones may be isolated using similar techniques to those.

In addition to the Sequences listed in the Sequence Listing, the invention encompasses isolated nucleotide sequences that are sequentially and structurally similar to G481, G482, G485, and G682, SEQ ID NO: 87, 89, 2009, and 147, respectively, and function in a plant in a manner similar to G481, G482, G485 and G867 by regulating abiotic stress tolerance.

The nucleotide sequences of the G482 subclade of the non-LEC1-like clade of proteins of the L1L-related CCAAT transcription factor family, including G481, share at least 81% identity in their B domains with the B domain of G481 (Table 1). Sequences outside of this subclade, including L1L (NP_199578) and LEC1 (AAC39488) share significantly less identity with G481 (Table 1), are phylogenetically distinct from the members of this subclade (FIGS. 6 and 7), and appear to function in embryonic development rather than in abiotic stress tolerance, as noted above.

Since the members of this subclade are phylogenetically related, sequentially similar and a representative number from diverse plant species have been shown to regulate abiotic stress tolerance, one skilled in the art would predict that other similar, phylogenetically related sequences would also regulate abiotic stress tolerance.

Similar to the G481 subclade, G682 and similar sequences in the G682 subclade of MYB-related transcription factors are phylogenetically related, sequentially similar and a representative number from diverse plant species have been shown to regulate abiotic stress tolerance. This would prompt one skilled in the art to draw similar conclusions regarding the regulation of these sequences of abiotic stress tolerance. A representative number of the members of this clade, including sequences derived from diverse non-Arabidopsis species, have been shown to confer abiotic stress tolerance when overexpressed. These sequences have been shown to share 60% identity in their MYB-related domains (Table 3).

Identifying Polynucleotides or Nucleic Acids by Hybridization

Polynucleotides homologous to the sequences illustrated in the Sequence Listing and tables can be identified, e.g., by hybridization to each other under stringent or under highly stringent conditions. Single stranded polynucleotides hybridize when they associate based on a variety of well characterized physical-chemical forces, such as hydrogen bonding, solvent exclusion, base stacking and the like. The stringency of a hybridization reflects the degree of sequence identity of the nucleic acids involved, such that the higher the stringency, the more similar are the two polynucleotide strands. Stringency is influenced by a variety of factors, including temperature, salt concentration and composition, organic and non-organic additives, solvents, etc. present in both the hybridization and wash solutions and incubations (and number thereof), as described in more detail in the references cited above.

Encompassed by the invention are polynucleotide sequences that are capable of hybridizing to the claimed polynucleotide sequences, including any of the transcription factor polynucleotides within the Sequence Listing, and fragments thereof under various conditions of stringency (See, for example, Wahl and Berger (1987) *Methods Enzymol.* 152: 399-407; and Kimmel (1987) *Methods Enzymol.* 152: 507-511). In addition to the nucleotide sequences listed in Tables 7 and 8, full length cDNA, orthologs, and paralogs of the present nucleotide sequences may be identified and isolated using well-known methods. The cDNA libraries orthologs, and paralogs of the present nucleotide sequences may be screened using hybridization methods to determine their utility as hybridization target or amplification probes.

With regard to hybridization, conditions that are highly stringent, and means for achieving them, are well known in the art. See, for example, Sambrook et al. (1989) "*Molecular Cloning: A Laboratory Manual*" (2nd ed., Cold Spring Harbor Laboratory); Berger and Kimmel, eds., (1987) "Guide to Molecular Cloning Techniques", In *Methods in Enzymology* 152: 467-469; and Anderson and Young (1985) "Quantitative Filter Hybridisation." In: Hames and Higgins, ed., *Nucleic Acid Hybridisation, A Practical Approach*. Oxford, IRL Press, 73-111.

Stability of DNA duplexes is affected by such factors as base composition, length, and degree of base pair mismatch. Hybridization conditions may be adjusted to allow DNAs of different sequence relatedness to hybridize. The melting temperature ($T_m$) is defined as the temperature when 50% of the duplex molecules have dissociated into their constituent single strands. The melting temperature of a perfectly matched duplex, where the hybridization buffer contains formamide as a denaturing agent, may be estimated by the following equation:

$$\text{DNA-DNA: } T_m(°\text{C.})=81.5+16.6(\log[\text{Na+}])+0.41(\% \ G+C)-0.62(\% \text{ formamide})-500/L \tag{1}$$

$$\text{DNA-RNA: } T_m(°\text{C.})=79.8+18.5(\log[\text{Na+}])+0.58(\% \ G+C)+0.12(\% \ G+C)^2-0.5(\% \text{ formamide})-820/L \tag{2}$$

$$\text{RNA-RNA: } T_m(°\text{C.})=79.8+18.5(\log[\text{Na+}])+0.58(\% \ G+C)+0.12(\% \ G+C)^2-0.35(\% \text{ formamide})-820/L \tag{3}$$

where L is the length of the duplex formed, [Na+] is the molar concentration of the sodium ion in the hybridization or washing solution, and % G+C is the percentage of (guanine+cytosine) bases in the hybrid. For imperfectly matched hybrids, approximately 1° C. is required to reduce the melting temperature for each 1-% mismatch.

Hybridization experiments are generally conducted in a buffer of pH between 6.8 to 7.4, although the rate of hybridization is nearly independent of pH at ionic strengths likely to be used in the hybridization buffer (Anderson et al. (1985) supra). In addition, one or more of the following may be used to reduce non-specific hybridization: sonicated salmon sperm DNA or another non-complementary DNA, bovine serum albumin, sodium pyrophosphate, sodium dodecylsulfate (SDS), polyvinyl-pyrrolidone, ficoll and Denhardt's solution. Dextran sulfate and polyethylene glycol 6000 act to exclude DNA from solution, thus raising the effective probe DNA concentration and the hybridization signal within a given unit of time. In some instances, conditions of even greater stringency may be desirable or required to reduce non-specific and/or background hybridization. These conditions may be created with the use of higher temperature, lower ionic strength and higher concentration of a denaturing agent such as formamide.

Stringency conditions can be adjusted to screen for moderately similar fragments such as homologous sequences from distantly related organisms, or to highly similar fragments such as genes that duplicate functional enzymes from closely related organisms. The stringency can be adjusted either during the hybridization step or in the post-hybridization washes. Salt concentration, formamide concentration, hybridization temperature and probe lengths are variables that can be used to alter stringency (as described by the formula above). As a general guidelines high stringency is typically performed at $T_m$-5° C. to $T_m$-20° C., moderate stringency at $T_m$-20° C. to $T_m$-35° C. and low stringency at $T_m$-35° C. to $T_m$-50° C. for duplex >150 base pairs. Hybridization may be performed at low to moderate stringency (25°-50° C. below $T_m$), followed by post-hybridization washes at increasing stringencies. Maximum rates of hybridization in solution are determined empirically to occur at $T_m$-25° C. for DNA-DNA duplex and $T_m$-15° C. for RNA-DNA duplex. Optionally, the degree of dissociation may be assessed after each wash step to determine the need for subsequent, higher stringency wash steps.

High stringency conditions may be used to select for nucleic acid sequences with high degrees of identity to the disclosed sequences. An example of stringent hybridization conditions obtained in a filter-based method such as a Southern or northern blot for hybridization of complementary nucleic acids that have more than 100 complementary residues is about 5° C. to 20° C. lower than the thermal melting point ($T_m$) for the specific sequence at a defined ionic strength and pH. Conditions used for hybridization may include about 0.02 M to about 0.15 M sodium chloride, about 0.5% to about 5% casein, about 0.02% SDS or about 0.1% N-laurylsarcosine, about 0.001 M to about 0.03 M sodium citrate, at hybridization temperatures between about 50° C. and about 70° C. More preferably, high stringency conditions are about 0.02 M sodium chloride, about 0.5% casein, about 0.02% SDS, about 0.001 M sodium citrate, at a temperature of about 50° C. Nucleic acid molecules that hybridize under stringent conditions will typically hybridize to a probe based on either the entire DNA molecule or selected portions, e.g., to a unique subsequence, of the DNA.

Stringent salt concentration will ordinarily be less than about 750 mM NaCl and 75 mM trisodium citrate. Increasingly stringent conditions may be obtained with less than about 500 mM NaCl and 50 mM trisodium citrate, to even greater stringency with less than about 250 mM NaCl and 25 mM trisodium citrate. Low stringency hybridization can be obtained in the absence of organic solvent, e.g., formamide, whereas high stringency hybridization may be obtained in the presence of at least about 35% formamide, and more preferably at least about 50% formamide. Stringent temperature conditions will ordinarily include temperatures of at least about 30° C., more preferably of at least about 37° C., and most preferably of at least about 42° C. with formamide present. Varying additional parameters, such as hybridization time, the concentration of detergent, e.g., sodium dodecyl sulfate (SDS) and ionic strength, are well known to those skilled in the art. Various levels of stringency are accomplished by combining these various conditions as needed. In a preferred embodiment, hybridization will occur at 30° C. in 750 mM NaCl, 75 mM trisodium citrate, and 1% SDS. In a more preferred embodiment, hybridization will occur at 37° C. in 500 mM NaCl, 50 mM trisodium citrate, 1% SDS, 35% formamide. In a most preferred embodiment, hybridization will occur at 42° C. in 250 mM NaCl, 25 mM trisodium citrate, 1% SDS, 50% formamide. Useful variations on these conditions will be readily apparent to those skilled in the art.

The washing steps that follow hybridization may also vary in stringency; the post-hybridization wash steps primarily determine hybridization specificity, with the most critical factors being temperature and the ionic strength of the final wash solution. Wash stringency can be increased by decreasing salt concentration or by increasing temperature. Stringent salt concentration for the wash steps will preferably be less than about 30 mM NaCl and 3 mM trisodium citrate, and most preferably less than about 15 mM NaCl and 1.5 mM trisodium citrate. For example, the wash conditions may be under conditions of 0.1×SSC to 2.0×SSC and 0.1% SDS at 50-65° C., with, for example, two steps of 10-30 min. One example of stringent wash conditions includes about 2.0×SSC, 0.1% SDS at 65° C. and washing twice, each wash step being about 30 min. A higher stringency wash is about 0.2×SSC, 0.1% SDS at 65° C. and washing twice for 30 min. A still higher stringency wash is about 0.1×SSC, 0.1% SDS at 65° C. and washing twice for 30 min. The temperature for the wash solutions will ordinarily be at least about 25° C., and for greater stringency at least about 42° C. Hybridization stringency may be increased further by using the same conditions as in the hybridization steps, with the wash temperature raised about 3° C. to about 5° C., and stringency may be increased even further by using the same conditions except the wash temperature is raised about 6° C. to about 9° C. For identification of less closely related homolog, wash steps may be performed at a lower temperature, e.g., 50° C.

An example of a low stringency wash step employs a solution and conditions of at least 25° C. in 30 mM NaCl, 3 mM trisodium citrate, and 0.1% SDS over 30 min. Greater stringency may be obtained at 42° C. in 15 mM NaCl, with 1.5 mM trisodium citrate, and 0.1% SDS over 30 min. Even higher stringency wash conditions are obtained at 65° C.-68° C. in a solution of 15 mM NaCl, 1.5 mM trisodium citrate, and 0.1% SDS. Wash procedures will generally employ at least two final wash steps. Additional variations on these conditions will be readily apparent to those skilled in the art (see, for example, U.S. Patent Application No. 20010010913).

Stringency conditions can be selected such that an oligonucleotide that is perfectly complementary to the coding oligonucleotide hybridizes to the coding oligonucleotide with at least about a 5-10× higher signal to noise ratio than the ratio for hybridization of the perfectly complementary oligonucleotide to a nucleic acid encoding a transcription factor known as of the filing date of the application. It may be desirable to select conditions for a particular assay such that a higher signal to noise ratio, that is, about 15× or more, is obtained.

Accordingly, a subject nucleic acid will hybridize to a unique coding oligonucleotide with at least a 2× or greater signal to noise ratio as compared to hybridization of the coding oligonucleotide to a nucleic acid encoding known polypeptide. The particular signal will depend on the label used in the relevant assay, e.g., a fluorescent label, a colorimetric label, a radioactive label, or the like. Labeled hybridization or PCR probes for detecting related polynucleotide sequences may be produced by oligolabeling, nick translation, end-labeling, or PCR amplification using a labeled nucleotide.

Identifying Polynucleotides or Nucleic Acids with Expression Libraries

In addition to hybridization methods, transcription factor homolog polypeptides can be obtained by screening an expression library using antibodies specific for one or more transcription factors. With the provision herein of the disclosed transcription factor, and transcription factor homolog nucleic acid sequences, the encoded polypeptide(s) can be expressed and purified in a heterologous expression system (e.g., *E. coli*) and used to raise antibodies (monoclonal or polyclonal) specific for the polypeptide(s) in question. Antibodies can also be raised against synthetic peptides derived from transcription factor, or transcription factor homolog, amino acid sequences. Methods of raising antibodies are well known in the art and are described in Harlow and Lane (1988), *Antibodies: A Laboratory Manual*, Cold Spring Harbor Laboratory, New York. Such antibodies can then be used to screen an expression library produced from the plant from which it is desired to clone additional transcription factor homologs, using the methods described above. The selected cDNAs can be confirmed by sequencing and enzymatic activity.

Sequence Variations

It will readily be appreciated by those of skill in the art, that any of a variety of polynucleotide sequences are capable of encoding the transcription factors and transcription factor homolog polypeptides of the invention. Due to the degeneracy of the genetic code, many different polynucleotides can encode identical and/or substantially similar polypeptides in addition to those sequences illustrated in the Sequence Listing. Nucleic acids having a sequence that differs from the sequences shown in the Sequence Listing, or complementary sequences, that encode functionally equivalent peptides (i.e., peptides having some degree of equivalent or similar biological activity) but differ in sequence from the sequence shown in the Sequence Listing due to degeneracy in the genetic code, are also within the scope of the invention.

Altered polynucleotide sequences encoding polypeptides include those sequences with deletions, insertions, or substitutions of different nucleotides, resulting in a polynucleotide encoding a polypeptide with at least one functional characteristic of the instant polypeptides. Included within this definition are polymorphisms which may or may not be readily detectable using a particular oligonucleotide probe of the polynucleotide encoding the instant polypeptides, and improper or unexpected hybridization to allelic variants, with a locus other than the normal chromosomal locus for the polynucleotide sequence encoding the instant polypeptides.

Allelic variant refers to any of two or more alternative forms of a gene occupying the same chromosomal locus. Allelic variation arises naturally through mutation, and may result in phenotypic polymorphism within populations. Gene mutations can be silent (i.e., no change in the encoded polypeptide) or may encode polypeptides having altered amino acid sequence. The term allelic variant is also used herein to denote a protein encoded by an allelic variant of a gene. Splice variant refers to alternative forms of RNA transcribed from a gene. Splice variation arises naturally through use of alternative splicing sites within a transcribed RNA molecule, or less commonly between separately transcribed RNA molecules, and may result in several mRNAs transcribed from the same gene. Splice variants may encode polypeptides having altered amino acid sequence. The term splice variant is also used herein to denote a protein encoded by a splice variant of an mRNA transcribed from a gene.

Those skilled in the art would recognize that, for example, G481, SEQ ID NO: 88, represents a single transcription factor; allelic variation and alternative splicing may be expected to occur. Allelic variants of SEQ ID NO: 87 can be cloned by probing cDNA or genomic libraries from different individual organisms according to standard procedures. Allelic variants of the DNA sequence shown in SEQ ID NO: 87, including those containing silent mutations and those in which mutations result in amino acid sequence changes, are within the scope of the present invention, as are proteins which are allelic variants of SEQ ID NO: 88. cDNAs generated from alternatively spliced mRNAs, which retain the properties of the transcription factor are included within the scope of the present invention, as are polypeptides encoded by such cDNAs and mRNAs. Allelic variants and splice variants of these sequences can be cloned by probing cDNA or genomic libraries from different individual organisms or tissues according to standard procedures known in the art (see U.S. Pat. No. 6,388,064).

Thus, in addition to the sequences set forth in the Sequence Listing, the invention also encompasses related nucleic acid molecules that include allelic or splice variants of SEQ ID NO: 2N-1, wherein N=1-229, SEQ ID NO: 459-466; 468-487; 491-500; 504; 506-511; 516-520; 523-524; 527; 529; 531-533; 538-539; 541-557; 560-568; 570-586; 595-596; 598-606; 610-620; 627-634; 640-664; 670-707; 714-719; 722-735; 740-741; 743-779; 808-823; 825-834; 838-850; 855-864; 868-889; 892-902; 908-909; 914-921; 924-925; 927-932; 935-942; 944-952; 961-965; 968-986; 989-993; 995-1010; 1012-1034; 1043-1063; 1074-1080; 1091-1104; 1111-1121; 1123-1128; 1134-1138; 1142-1156; 1159-1175; 1187-1190; 1192-1199; 1202-1220; 1249-1253; 1258-1262; 1264-1269; 1271-1287; 1292-1301; 1303-1309; 1315-1323; 1328-1337; 1340-1341; 1344-1361; 1365-1377; 1379-1390; 1393-1394; 1396-1398; 1419-1432; 1434-1452; 1455-1456; 1460-1465; 1468-1491; 1499; 1502; 1505-1521; 1523-1527; 1529-1532; 1536-1539; 1542-1562; 1567-1571; 1573-1582; 1587-1592; 1595-1620; 1625-1644; 1647-1654; 1659-1669; 1671-1673; 1675-1680; 1682-1686; 1688-1700; 1706-1709; 1714-1726; 1728-1734; 1738-1742; 1744-1753; 1757-1760; 1763-1764; 1766-1768; 1770-1780; 1782-1784; 1786-1789; 1791-1804; 1806-1812; 1814-1837; 1847-1856; 1858-1862; 1864-1873; 1876-1882; 1885-1896; 1902-1910; 1913-1916; 1921-1928; 1931-1936; 1940-1941; 1944-1946, 2907-2941, 2944, 2945, 2947, 2949, or SEQ ID NO: 2N-1, wherein N=974-1101, and include sequences which are complementary to any of the above nucleotide sequences. Related nucleic acid molecules also include nucleotide sequences encoding a polypeptide comprising or consisting essentially of a substitution, modification, addition and/or deletion of one or more amino acid residues compared to the polypeptide as set forth in any of SEQ ID NO: 2N, wherein N=1-229, SEQ ID NO: 467; 488-490; 501-503; 505; 512-515; 521-522; 525-526; 528; 530; 534-537; 540; 558-559; 569; 587-594; 597; 607-609; 621-626; 635-639; 665-669; 708-713; 720-721; 736-739; 742; 780-807; 824; 835-837; 851-854; 865-867; 890-891; 903-907; 910-913; 922-923; 926; 933-934; 943; 953-960; 966-967; 987-988; 994; 1011; 1035-1042; 1064-1073; 1081-1090; 1105-1110; 1122; 1129-1133; 1139-1141; 1157-

1158; 1176-1186; 1191; 1200-1201; 1221-1248; 1254-1257; 1263; 1270; 1288-1291; 1302; 1310-1314; 1324-1327; 1338-1339; 1342-1343; 1362-1364; 1378; 1391-1392; 1395; 1399-1418; 1433; 1453-1454; 1457-1459; 1466-1467; 1492-1498; 1500-1501; 1503-1504; 1522; 1528; 1533-1535; 1540-1541; 1563-1566; 1572; 1583-1586; 1593-1594; 1621-1624; 1645-1646; 1655-1658; 1670; 1674; 1681; 1687; 1701-1705; 1710-1713; 1727; 1735-1737; 1743; 1754-1756; 1761-1762; 1765; 1769; 1781; 1785; 1790; 1805; 1813; 1838-1846; 1857; 1863; 1874-1875; 1883-1884; 1897-1901; 1911-1912; 1917-1920; 1929-1930; 1937-1939; 1942-1943; 2942 or 2943, 2945, 2947, 2949, or SEQ ID NO: 2N, wherein N=974-1101. Such related polypeptides may comprise, for example, additions and/or deletions of one or more N-linked or O-linked glycosylation sites, or an addition and/or a deletion of one or more cysteine residues.

For example, Table 4 illustrates, e.g., that the codons AGC, AGT, TCA, TCC, TCG, and TCT all encode the same amino acid: serine. Accordingly, at each position in the sequence where there is a codon encoding serine, any of the above trinucleotide sequences can be used without altering the encoded polypeptide.

TABLE 4

| Amino acid | | | Possible Codons |
|---|---|---|---|
| Alanine | Ala | A | GCA GCC GCG GCU |
| Cysteine | Cys | C | TGC TGT |
| Aspartic acid | Asp | D | GAC GAT |
| Glutamic acid | Glu | E | GAA GAG |
| Phenylalanine | Phe | F | TTC TTT |
| Glycine | Gly | G | GGA GGC GGG GGT |
| Histidine | His | H | CAC CAT |
| Isoleucine | Ile | I | ATA ATC ATT |
| Lysine | Lys | K | AAA AAG |
| Leucine | Leu | L | TTA TTG CTA CTC CTG CTT |
| Methionine | Met | M | ATG |
| Asparagine | Asn | N | AAC AAT |
| Proline | Pro | P | CCA CCC CCG CCT |
| Glutamine | Gln | Q | CAA CAG |
| Arginine | Arg | R | AGA AGG CGA CGC CGG CGT |
| Serine | Ser | S | AGC AGT TCA TCC TCG TCT |
| Threonine | Thr | T | ACA ACC ACG ACT |
| Valine | Val | V | GTA GTC GTG GTT |
| Tryptophan | Trp | W | TGG |
| Tyrosine | Tyr | Y | TAC TAT |

Sequence alterations that do not change the amino acid sequence encoded by the polynucleotide are termed "silent" variations. With the exception of the codons ATG and TGG, encoding methionine and tryptophan, respectively, any of the possible codons for the same amino acid can be substituted by a variety of techniques, e.g., site-directed mutagenesis, available in the art. Accordingly, any and all such variations of a sequence selected from the above table are a feature of the invention.

In addition to silent variations, other conservative variations that alter one, or a few amino acids in the encoded polypeptide, can be made without altering the function of the polypeptide, these conservative variants are, likewise, a feature of the invention.

For example, substitutions, deletions and insertions introduced into the sequences provided in the Sequence Listing, are also envisioned by the invention. Such sequence modifications can be engineered into a sequence by site-directed mutagenesis (Wu (ed.) *Methods Enzymol.* (1993) vol. 217, Academic Press) or the other methods noted below Amino acid substitutions are typically of single residues; insertions usually will be on the order of about from 1 to 10 amino acid residues; and deletions will range about from 1 to 30 residues. In preferred embodiments, deletions or insertions are made in adjacent pairs, e.g., a deletion of two residues or insertion of two residues. Substitutions, deletions, insertions or any combination thereof can be combined to arrive at a sequence. The mutations that are made in the polynucleotide encoding the transcription factor should not place the sequence out of reading frame and should not create complementary regions that could produce secondary mRNA structure. Preferably, the polypeptide encoded by the DNA performs the desired function.

Conservative substitutions are those in which at least one residue in the amino acid sequence has been removed and a different residue inserted in its place. Such substitutions generally are made in accordance with the Table 5 when it is desired to maintain the activity of the protein. Table 5 shows amino acids which can be substituted for an amino acid in a protein and which are typically regarded as conservative substitutions.

TABLE 5

| Residue | Conservative Substitutions |
|---|---|
| Ala | Ser |
| Arg | Lys |
| Asn | Gln; His |
| Asp | Glu |
| Gln | Asn |
| Cys | Ser |
| Glu | Asp |
| Gly | Pro |
| His | Asn; Gln |
| Ile | Leu, Val |
| Leu | Ile; Val |
| Lys | Arg; Gln |
| Met | Leu; Ile |
| Phe | Met; Leu; Tyr |
| Ser | Thr; Gly |
| Thr | Ser; Val |
| Trp | Tyr |
| Tyr | Trp; Phe |
| Val | Ile; Leu |

The polypeptides provided in the Sequence Listing have a novel activity, such as, for example, regulatory activity. Although all conservative amino acid substitutions (for example, one basic amino acid substituted for another basic amino acid) in a polypeptide will not necessarily result in the polypeptide retaining its activity, it is expected that many of these conservative mutations would result in the polypeptide retaining its activity. Most mutations, conservative or non-conservative, made to a protein but outside of a conserved domain required for function and protein activity will not affect the activity of the protein to any great extent.

Similar substitutions are those in which at least one residue in the amino acid sequence has been removed and a different residue inserted in its place. Such substitutions generally are made in accordance with the Table 6 when it is desired to maintain the activity of the protein. Table 6 shows amino acids which can be substituted for an amino acid in a protein and which are typically regarded as structural and functional substitutions. For example, a residue in column 1 of Table 6 may be substituted with a residue in column 2; in addition, a residue in column 2 of Table 6 may be substituted with the residue of column 1.

TABLE 6

| Residue | Similar Substitutions |
|---------|-----------------------|
| Ala | Ser; Thr; Gly; Val; Leu; Ile |
| Arg | Lys; His; Gly |
| Asn | Gln; His; Gly; Ser; Thr |
| Asp | Glu, Ser; Thr |
| Gln | Asn; Ala |
| Cys | Ser; Gly |
| Glu | Asp |
| Gly | Pro; Arg |
| His | Asn; Gln; Tyr; Phe; Lys; Arg |
| Ile | Ala; Leu; Val; Gly; Met |
| Leu | Ala; Ile; Val; Gly; Met |
| Lys | Arg; His; Gln; Gly; Pro |
| Met | Leu; Ile; Phe |
| Phe | Met; Leu; Tyr; Trp; His; Val; Ala |
| Ser | Thr; Gly; Asp; Ala; Val; Ile; His |
| Thr | Ser; Val; Ala; Gly |
| Trp | Tyr; Phe; His |
| Tyr | Trp; Phe; His |
| Val | Ala; Ile; Leu; Gly; Thr; Ser; Glu |

Substitutions that are less conservative than those in Table 5 can be selected by picking residues that differ more significantly in their effect on maintaining (a) the structure of the polypeptide backbone in the area of the substitution, for example, as a sheet or helical conformation, (b) the charge or hydrophobicity of the molecule at the target site, or (c) the bulk of the side chain. The substitutions which in general are expected to produce the greatest changes in protein properties will be those in which (a) a hydrophilic residue, e.g., seryl or threonyl, is substituted for (or by) a hydrophobic residue, e.g., leucyl, isoleucyl, phenylalanyl, valyl or alanyl; (b) a cysteine or proline is substituted for (or by) any other residue; (c) a residue having an electropositive side chain, e.g., lysyl, arginyl, or histidyl, is substituted for (or by) an electronegative residue, e.g., glutamyl or aspartyl; or (d) a residue having a bulky side chain, e.g., phenylalanine, is substituted for (or by) one not having a side chain, e.g., glycine.

Further Modifying Sequences of the Invention—Mutation/Forced Evolution

In addition to generating silent or conservative substitutions as noted, above, the present invention optionally includes methods of modifying the sequences of the Sequence Listing. In the methods, nucleic acid or protein modification methods are used to alter the given sequences to produce new sequences and/or to modify chemically or enzymatically given sequences to change the properties of the nucleic acids or proteins.

Thus, in one embodiment, given nucleic acid sequences are modified, e.g., according to standard mutagenesis or artificial evolution methods to produce modified sequences. The modified sequences may be created using purified natural polynucleotides isolated from any organism or may be synthesized from purified compositions and chemicals using chemical means well know to those of skill in the art. For example, Ausubel, supra, provides additional details on mutagenesis methods. Artificial forced evolution methods are described, for example, by Stemmer (1994) *Nature* 370: 389-391, Stemmer (1994) *Proc. Natl. Acad. Sci.* 91: 10747-10751, and U.S. Pat. Nos. 5,811,238, 5,837,500, and 6,242,568. Methods for engineering synthetic transcription factors and other polypeptides are described, for example, by Zhang et al. (2000) *J. Biol. Chem.* 275: 33850-33860, Liu et al. (2001) *J. Biol. Chem.* 276: 11323-11334, and Isalan et al. (2001) *Nature Biotechnol.* 19: 656-660. Many other mutation and evolution methods are also available and expected to be within the skill of the practitioner.

Similarly, chemical or enzymatic alteration of expressed nucleic acids and polypeptides can be performed by standard methods. For example, sequence can be modified by addition of lipids, sugars, peptides, organic or inorganic compounds, by the inclusion of modified nucleotides or amino acids, or the like. For example, protein modification techniques are illustrated in Ausubel, supra. Further details on chemical and enzymatic modifications can be found herein. These modification methods can be used to modify any given sequence, or to modify any sequence produced by the various mutation and artificial evolution modification methods noted herein.

Accordingly, the invention provides for modification of any given nucleic acid by mutation, evolution, chemical or enzymatic modification, or other available methods, as well as for the products produced by practicing such methods, e.g., using the sequences herein as a starting substrate for the various modification approaches.

For example, optimized coding sequence containing codons preferred by a particular prokaryotic or eukaryotic host can be used e.g., to increase the rate of translation or to produce recombinant RNA transcripts having desirable properties, such as a longer half-life, as compared with transcripts produced using a non-optimized sequence. Translation stop codons can also be modified to reflect host preference. For example, preferred stop codons for *Saccharomyces cerevisiae* and mammals are TAA and TGA, respectively. The preferred stop codon for monocotyledonous plants is TGA, whereas insects and *E. coli* prefer to use TAA as the stop codon.

The polynucleotide sequences of the present invention can also be engineered in order to alter a coding sequence for a variety of reasons, including but not limited to, alterations which modify the sequence to facilitate cloning, processing and/or expression of the gene product. For example, alterations are optionally introduced using techniques which are well known in the art, e.g., site-directed mutagenesis, to insert new restriction sites, to alter glycosylation patterns, to change codon preference, to introduce splice sites, etc.

Furthermore, a fragment or domain derived from any of the polypeptides of the invention can be combined with domains derived from other transcription factors or synthetic domains to modify the biological activity of a transcription factor. For instance, a DNA-binding domain derived from a transcription factor of the invention can be combined with the activation domain of another transcription factor or with a synthetic activation domain. A transcription activation domain assists in initiating transcription from a DNA-binding site. Examples include the transcription activation region of VP16 or GAL4 (Moore et al. (1998) *Proc. Natl. Acad. Sci.* 95: 376-381; Aoyama et al. (1995) *Plant Cell* 7: 1773-1785), peptides derived from bacterial sequences (Ma and Ptashne (1987) *Cell* 51: 113-119) and synthetic peptides (Giniger and Ptashne (1987) *Nature* 330: 670-672).

Expression and Modification of Polypeptides

Typically, polynucleotide sequences of the invention are incorporated into recombinant DNA (or RNA) molecules that direct expression of polypeptides of the invention in appropriate host cells, transgenic plants, in vitro translation systems, or the like. Due to the inherent degeneracy of the genetic code, nucleic acid sequences which encode substantially the same or a functionally equivalent amino acid sequence can be substituted for any listed sequence to provide for cloning and expressing the relevant homolog.

The transgenic plants of the present invention comprising recombinant polynucleotide sequences are generally derived from parental plants, which may themselves be non-transformed (or non-transgenic) plants. These transgenic plants may either have a transcription factor gene "knocked out" (for example, with a genomic insertion by homologous recombination, an antisense or ribozyme construct) or expressed to a normal or wild-type extent. However, overexpressing transgenic "progeny" plants will exhibit greater mRNA levels, wherein the mRNA encodes a transcription factor, that is, a DNA-binding protein that is capable of binding to a DNA regulatory sequence and inducing transcription, and preferably, expression of a plant trait gene. Preferably, the mRNA expression level will be at least three-fold greater than that of the parental plant, or more preferably at least ten-fold greater mRNA levels compared to said parental plant, and most preferably at least fifty-fold greater compared to said parental plant.

Vectors, Promoters, and Expression Systems

The present invention includes recombinant constructs comprising one or more of the nucleic acid sequences herein. The constructs typically comprise a vector, such as a plasmid, a cosmid, a phage, a virus (e.g., a plant virus), a bacterial artificial chromosome (BAC), a yeast artificial chromosome (YAC), or the like, into which a nucleic acid sequence of the invention has been inserted, in a forward or reverse orientation. In a preferred aspect of this embodiment, the construct further comprises regulatory sequences, including, for example, a promoter, operably linked to the sequence. Large numbers of suitable vectors and promoters are known to those of skill in the art, and are commercially available.

General texts that describe molecular biological techniques useful herein, including the use and production of vectors, promoters and many other relevant topics, include Berger, Sambrook, supra and Ausubel, supra. Any of the identified sequences can be incorporated into a cassette or vector, e.g., for expression in plants. A number of expression vectors suitable for stable transformation of plant cells or for the establishment of transgenic plants have been described including those described in Weissbach and Weissbach (1989) *Methods for Plant Molecular Biology*, Academic Press, and Gelvin et al. (1990) *Plant Molecular Biology Manual*, Kluwer Academic Publishers. Specific examples include those derived from a Ti plasmid of *Agrobacterium tumefaciens*, as well as those disclosed by Herrera-Estrella et al. (1983) *Nature* 303: 209, Bevan (1984) *Nucleic Acids Res.* 12: 8711-8721, Klee (1985) *Bio/Technology* 3: 637-642, for dicotyledonous plants.

Alternatively, non-Ti vectors can be used to transfer the DNA into monocotyledonous plants and cells by using free DNA delivery techniques. Such methods can involve, for example, the use of liposomes, electroporation, microprojectile bombardment, silicon carbide whiskers, and viruses. By using these methods transgenic plants such as wheat, rice (Christou (1991) *Bio/Technology* 9: 957-962) and corn (Gordon-Kamm (1990) *Plant Cell* 2: 603-618) can be produced. An immature embryo can also be a good target tissue for monocots for direct DNA delivery techniques by using the particle gun (Weeks et al. (1993) *Plant Physiol.* 102: 1077-1084; Vasil (1993) *Bio/Technology* 10: 667-674; Wan and Lemeaux (1994) *Plant Physiol.* 104: 37-48, and for *Agrobacterium*-mediated DNA transfer (Ishida et al. (1996) *Nature Biotechnol.* 14: 745-750).

Typically, plant transformation vectors include one or more cloned plant coding sequence (genomic or cDNA) under the transcriptional control of 5' and 3' regulatory sequences and a dominant selectable marker. Such plant transformation vectors typically also contain a promoter (e.g., a regulatory region controlling inducible or constitutive, environmentally- or developmentally-regulated, or cell-, tissue-enhanced, or tissue-specific expression), a transcription initiation start site, an RNA processing signal (such as intron splice sites), a transcription termination site, and/or a polyadenylation signal.

A potential utility for the transcription factor polynucleotides disclosed herein is the isolation of promoter elements from these genes that can be used to program expression in plants of any genes. Each transcription factor gene disclosed herein is expressed in a unique fashion, as determined by promoter elements located upstream of the start of translation, and additionally within an intron of the transcription factor gene or downstream of the termination codon of the gene. As is well known in the art, for a significant portion of genes, the promoter sequences are located entirely in the region directly upstream of the start of translation. In such cases, typically the promoter sequences are located within 2.0 kb of the start of translation, or within 1.5 kb of the start of translation, frequently within 1.0 kb of the start of translation, and sometimes within 0.5 kb of the start of translation.

The promoter sequences can be isolated according to methods known to one skilled in the art.

Examples of constitutive plant promoters which can be useful for expressing the TF sequence include: the cauliflower mosaic virus (CaMV) 35S promoter, which confers constitutive, high-level expression in most plant tissues (see, e.g., Odell et al. (1985) *Nature* 313: 810-812); the nopaline synthase promoter (An et al. (1988) *Plant Physiol.* 88: 547-552); and the octopine synthase promoter (Fromm et al. (1989) *Plant Cell* 1: 977-984).

A variety of plant gene promoters that regulate gene expression in response to environmental, hormonal, chemical, developmental signals, and in a tissue-active manner can be used for expression of a TF sequence in plants. Choice of a promoter is based largely on the phenotype of interest and is determined by such factors as tissue (e.g., seed, fruit, root, pollen, vascular tissue, flower, carpel, etc.), inducibility (e.g., in response to wounding, heat, cold, drought, light, pathogens, etc.), timing, developmental stage, and the like. Numerous known promoters have been characterized and can favorably be employed to promote expression of a polynucleotide of the invention in a transgenic plant or cell of interest. For example, tissue specific promoters include: seed-specific promoters (such as the napin, phaseolin or DC3 promoter described in U.S. Pat. No. 5,773,697), fruit-specific promoters that are active during fruit ripening (such as the dm 1 promoter (U.S. Pat. No. 5,783,393), or the 2A11 promoter (U.S. Pat. No. 4,943,674) and the tomato polygalacturonase promoter (Bird et al. (1988) *Plant Mol. Biol.* 11: 651-662), root-specific promoters, such as those disclosed in U.S. Pat. Nos. 5,618,988, 5,837,848 and 5,905,186, pollen-active promoters such as PTA29, PTA26 and PTA13 (U.S. Pat. No. 5,792,929), promoters active in vascular tissue (Ringli and Keller (1998) *Plant Mol. Biol.* 37: 977-988), flower-specific (Kaiser et al. (1995) *Plant Mol. Biol.* 28: 231-243), pollen (Baerson et al. (1994) *Plant Mol. Biol.* 26: 1947-1959), carpels (Ohl et al. (1990) *Plant Cell* 2: 837-848), pollen and ovules (Baerson et al. (1993) *Plant Mol. Biol.* 22: 255-267), auxin-inducible promoters (such as that described in van der Kop et al. (1999) *Plant Mol. Biol.* 39: 979-990 or Baumann et al. (1999) *Plant Cell* 11: 323-334), cytokinin-inducible promoter (Guevara-Garcia (1998) *Plant Mol. Biol.* 38: 743-753), promoters responsive to gibberellin (Shi et al. (1998) *Plant Mol. Biol.* 38: 1053-1060, Willmott et al. (1998) 38: 817-825) and the like. Additional promoters are those that elicit expression in response to heat (Ainley et al. (1993) *Plant Mol. Biol.* 22: 13-23), light (e.g., the pea rbcS-3A promoter, Kuhlemeier et al. (1989) *Plant Cell* 1: 471-478, and the maize rbcS promoter, Schaffner and Sheen (1991) *Plant Cell* 3: 997-1012); wounding (e.g., wunI, Siebertz et al. (1989) *Plant Cell* 1: 961-968); pathogens (such as the PR-1 promoter described in Buchel et al. (1999) *Plant Mol. Biol.* 40: 387-396, and the PDF1.2 promoter described in Manners et al. (1998) *Plant Mol. Biol.* 38: 1071-1080), and chemicals such as methyl jasmonate or salicylic acid (Gatz (1997) *Annu. Rev. Plant Physiol. Plant Mol. Biol.* 48: 89-108). In addition, the timing of the expression can be controlled by using promoters such as those acting at senescence (Gan and Amasino (1995) *Science* 270: 1986-1988); or late seed development (Odell et al. (1994) *Plant Physiol.* 106: 447-458).

Plant expression vectors can also include RNA processing signals that can be positioned within, upstream or downstream of the coding sequence. In addition, the expression vectors can include additional regulatory sequences from the 3'-untranslated region of plant genes, e.g., a 3' terminator region to increase mRNA stability of the mRNA, such as the PI-II terminator region of potato or the octopine or nopaline synthase 3' terminator regions.

Additional Expression Elements

Specific initiation signals can aid in efficient translation of coding sequences. These signals can include, e.g., the ATG initiation codon and adjacent sequences. In cases where a coding sequence, its initiation codon and upstream sequences are inserted into the appropriate expression vector, no additional translational control signals may be needed. However, in cases where only coding sequence (e.g., a mature protein coding sequence), or a portion thereof, is inserted, exogenous transcriptional control signals including the ATG initiation codon can be separately provided. The initiation codon is provided in the correct reading frame to facilitate transcription. Exogenous transcriptional elements and initiation codons can be of various origins, both natural and synthetic. The efficiency of expression can be enhanced by the inclusion of enhancers appropriate to the cell system in use.

Expression Hosts

The present invention also relates to host cells which are transduced with vectors of the invention, and the production of polypeptides of the invention (including fragments thereof) by recombinant techniques. Host cells are genetically engineered (i.e., nucleic acids are introduced, e.g., transduced, transformed or transfected) with the vectors of this invention, which may be, for example, a cloning vector or an expression vector comprising the relevant nucleic acids herein. The vector is optionally a plasmid, a viral particle, a phage, a naked nucleic acid, etc. The engineered host cells can be cultured in conventional nutrient media modified as appropriate for activating promoters, selecting transformants, or amplifying the relevant gene. The culture conditions, such as temperature, pH and the like, are those previously used with the host cell selected for expression, and will be apparent to those skilled in the art and in the references cited herein, including, Sambrook, supra and Ausubel, supra.

The host cell can be a eukaryotic cell, such as a yeast cell, or a plant cell, or the host cell can be a prokaryotic cell, such as a bacterial cell. Plant protoplasts are also suitable for some applications. For example, the DNA fragments are introduced into plant tissues, cultured plant cells or plant protoplasts by standard methods including electroporation (Fromm et al. (1985) *Proc. Natl. Acad. Sci.* 82: 5824-5828, infection by viral vectors such as cauliflower mosaic virus (CaMV) (Hohn et al. (1982) *Molecular Biology of Plant Tumors* Academic Press, New York, N.Y., pp. 549-560; U.S. Pat. No. 4,407,956), high velocity ballistic penetration by small particles with the nucleic acid either within the matrix of small beads or particles, or on the surface (Klein et al. (1987) *Nature* 327: 70-73), use of pollen as vector (WO 85/01856), or use of *Agrobacterium tumefaciens* or *A. rhizogenes* carrying a T-DNA plasmid in which DNA fragments are cloned. The T-DNA plasmid is transmitted to plant cells upon infection by *Agrobacterium tumefaciens*, and a portion is stably integrated into the plant genome (Horsch et al. (1984) *Science* 233: 496-498; Fraley et al. (1983) *Proc. Natl. Acad. Sci.* 80: 4803-4807).

The cell can include a nucleic acid of the invention that encodes a polypeptide, wherein the cell expresses a polypeptide of the invention. The cell can also include vector sequences, or the like. Furthermore, cells and transgenic plants that include any polypeptide or nucleic acid above or throughout this specification, e.g., produced by transduction of a vector of the invention, are an additional feature of the invention.

For long-term, high-yield production of recombinant proteins, stable expression can be used. Host cells transformed with a nucleotide sequence encoding a polypeptide of the invention are optionally cultured under conditions suitable for the expression and recovery of the encoded protein from cell culture. The protein or fragment thereof produced by a recombinant cell may be secreted, membrane-bound, or contained intracellularly, depending on the sequence and/or the vector used. As will be understood by those of skill in the art, expression vectors containing polynucleotides encoding mature proteins of the invention can be designed with signal sequences which direct secretion of the mature polypeptides through a prokaryotic or eukaryotic cell membrane.

Modified Amino Acid Residues

Polypeptides of the invention may contain one or more modified amino acid residues. The presence of modified amino acids may be advantageous in, for example, increasing polypeptide half-life, reducing polypeptide antigenicity or toxicity, increasing polypeptide storage stability, or the like. Amino acid residue(s) are modified, for example, co-translationally or post-translationally during recombinant production or modified by synthetic or chemical means.

Non-limiting examples of a modified amino acid residue include incorporation or other use of acetylated amino acids, glycosylated amino acids, sulfated amino acids, prenylated (e.g., farnesylated, geranylgeranylated) amino acids, PEG modified (e.g., "PEGylated") amino acids, biotinylated amino acids, carboxylated amino acids, phosphorylated amino acids, etc. References adequate to guide one of skill in the modification of amino acid residues are replete throughout the literature.

The modified amino acid residues may prevent or increase affinity of the polypeptide for another molecule, including, but not limited to, polynucleotide, proteins, carbohydrates, lipids and lipid derivatives, and other organic or synthetic compounds.

Identification of Additional Factors

A transcription factor provided by the present invention can also be used to identify additional endogenous or exogenous molecules that can affect a phenotype or trait of interest. On the one hand, such molecules include organic (small or large molecules) and/or inorganic compounds that affect expression of (i.e., regulate) a particular transcription factor. Alternatively, such molecules include endogenous molecules that are acted upon either at a transcriptional level by a transcription factor of the invention to modify a phenotype as desired. For example, the transcription factors can be employed to identify one or more downstream genes that are subject to a regulatory effect of the transcription factor. In one approach, a transcription factor or transcription factor homolog of the invention is expressed in a host cell, e.g., a transgenic plant cell, tissue or explant, and expression products, either RNA or protein, of likely or random targets are monitored, e.g., by hybridization to a microarray of nucleic acid probes corresponding to genes expressed in a tissue or cell type of interest, by two-dimensional gel electrophoresis of protein products, or by any other method known in the art for assessing expression of gene products at the level of RNA or protein. Alternatively, a transcription factor of the invention can be used to identify promoter sequences (such as binding sites on DNA sequences) involved in the regulation of a downstream target. After identifying a promoter sequence, interactions between the transcription factor and the promoter sequence can be modified by changing specific nucleotides in the promoter sequence or specific amino acids in the transcription factor that interact with the promoter sequence to alter a plant trait. Typically, transcription factor DNA-binding sites are identified by gel shift assays. After identifying the promoter regions, the promoter region sequences can be employed in double-stranded DNA arrays to identify molecules that affect the interactions of the transcription factors with their promoters (Bulyk et al. (1999) *Nature Biotechnol.* 17: 573-577).

The identified transcription factors are also useful to identify proteins that modify the activity of the transcription factor. Such modification can occur by covalent modification, such as by phosphorylation, or by protein-protein (homo or -heteropolymer) interactions. Any method suitable for detecting protein-protein interactions can be employed. Among the methods that can be employed are co-immunoprecipitation, cross-linking and co-purification through gradients or chromatographic columns, and the two-hybrid yeast system.

The two-hybrid system detects protein interactions in vivo and is described in Chien et al. (1991) *Proc. Natl. Acad. Sci.* 88: 9578-9582, and is commercially available from Clontech (Palo Alto, Calif.). In such a system, plasmids are constructed that encode two hybrid proteins: one consists of the DNA-binding domain of a transcription activator protein fused to the TF polypeptide and the other consists of the transcription activator protein's activation domain fused to an unknown protein that is encoded by a cDNA that has been recombined into the plasmid as part of a cDNA library. The DNA-binding domain fusion plasmid and the cDNA library are transformed into a strain of the yeast *Saccharomyces cerevisiae* that contains a reporter gene (e.g., lacZ) whose regulatory region contains the transcription activator's binding site. Either hybrid protein alone cannot activate transcription of the reporter gene. Interaction of the two hybrid proteins reconstitutes the functional activator protein and results in expression of the reporter gene, which is detected by an assay for the reporter gene product. Then, the library plasmids responsible for reporter gene expression are isolated and sequenced to identify the proteins encoded by the library plasmids. After identifying proteins that interact with the transcription factors, assays for compounds that interfere with the TF protein-protein interactions can be preformed.

Identification of Modulators

In addition to the intracellular molecules described above, extracellular molecules that alter activity or expression of a transcription factor, either directly or indirectly, can be identified. For example, the methods can entail first placing a candidate molecule in contact with a plant or plant cell. The molecule can be introduced by topical administration, such as spraying or soaking of a plant, or incubating a plant in a solution containing the molecule, and then the molecule's effect on the expression or activity of the TF polypeptide or the expression of the polynucleotide monitored. Changes in the expression of the TF polypeptide can be monitored by use of polyclonal or monoclonal antibodies, gel electrophoresis or the like. Changes in the expression of the corresponding polynucleotide sequence can be detected by use of microarrays, Northern blots, quantitative PCR, or any other technique for monitoring changes in mRNA expression. These techniques are exemplified in Ausubel et al. (eds.) *Current Protocols in Molecular Biology*, John Wiley & Sons (1998, and supplements through 2001). Changes in the activity of the transcription factor can be monitored, directly or indirectly, by assaying the function of the transcription factor, for example, by measuring the expression of promoters known to be controlled by the transcription factor (using promoter-reporter constructs), measuring the levels of transcripts using microarrays, Northern blots, quantitative PCR, etc. Such changes in the expression levels can be correlated with modified plant traits and thus identified molecules can be useful for soaking or spraying on fruit, vegetable and grain crops to modify traits in plants.

Essentially any available composition can be tested for modulatory activity of expression or activity of any nucleic acid or polypeptide herein. Thus, available libraries of compounds such as chemicals, polypeptides, nucleic acids and the like can be tested for modulatory activity. Often, potential modulator compounds can be dissolved in aqueous or organic (e.g., DMSO-based) solutions for easy delivery to the cell or plant of interest in which the activity of the modulator is to be tested. Optionally, the assays are designed to screen large modulator composition libraries by automating the assay steps and providing compounds from any convenient source to assays, which are typically run in parallel (e.g., in microtiter formats on microplates in robotic assays).

In one embodiment, high throughput screening methods involve providing a combinatorial library containing a large number of potential compounds (potential modulator compounds). Such "combinatorial chemical libraries" are then screened in one or more assays, as described herein, to identify those library members (particular chemical species or subclasses) that display a desired characteristic activity. The compounds thus identified can serve as target compounds.

A combinatorial chemical library can be, e.g., a collection of diverse chemical compounds generated by chemical synthesis or biological synthesis. For example, a combinatorial chemical library such as a polypeptide library is formed by combining a set of chemical building blocks (e.g., in one example, amino acids) in every possible way for a given compound length (i.e., the number of amino acids in a polypeptide compound of a set length). Exemplary libraries include peptide libraries, nucleic acid libraries, antibody libraries (see, e.g., Vaughn et al. (1996) *Nature Biotechnol.* 14: 309-314 and PCT/US96/10287), carbohydrate libraries (see, e.g., Liang et al. *Science* (1996) 274: 1520-1522 and U.S. Pat. No. 5,593,853), peptide nucleic acid libraries (see, e.g., U.S. Pat. No. 5,539,083), and small organic molecule libraries (see, e.g., benzodiazepines, in Baum *Chem. & Engineering News* Jan. 18, 1993, page 33; isoprenoids, U.S. Pat. No. 5,569,588; thiazolidinones and metathiazanones, U.S.

Pat. No. 5,549,974; pyrrolidines, U.S. Pat. Nos. 5,525,735 and 5,519,134; morpholino compounds, U.S. Pat. No. 5,506,337) and the like.

Preparation and screening of combinatorial or other libraries is well known to those of skill in the art. Such combinatorial chemical libraries include, but are not limited to, peptide libraries (see, e.g., U.S. Pat. No. 5,010,175; Furka, (1991) *Int. J. Pept. Prot. Res.* 37: 487-493; and Houghton et al. (1991) *Nature* 354: 84-88). Other chemistries for generating chemical diversity libraries can also be used.

In addition, as noted, compound screening equipment for high-throughput screening is generally available, e.g., using any of a number of well known robotic systems that have also been developed for solution phase chemistries useful in assay systems. These systems include automated workstations including an automated synthesis apparatus and robotic systems utilizing robotic arms. Any of the above devices are suitable for use with the present invention, e.g., for high-throughput screening of potential modulators. The nature and implementation of modifications to these devices (if any) so that they can operate as discussed herein will be apparent to persons skilled in the relevant art.

Indeed, entire high-throughput screening systems are commercially available. These systems typically automate entire procedures including all sample and reagent pipetting, liquid dispensing, timed incubations, and final readings of the microplate in detector(s) appropriate for the assay. These configurable systems provide high throughput and rapid start up as well as a high degree of flexibility and customization. Similarly, microfluidic implementations of screening are also commercially available.

The manufacturers of such systems provide detailed protocols the various high throughput. Thus, for example, Zymark Corp. provides technical bulletins describing screening systems for detecting the modulation of gene transcription, ligand binding, and the like. The integrated systems herein, in addition to providing for sequence alignment and, optionally, synthesis of relevant nucleic acids, can include such screening apparatus to identify modulators that have an effect on one or more polynucleotides or polypeptides according to the present invention.

In some assays it is desirable to have positive controls to ensure that the components of the assays are working properly. At least two types of positive controls are appropriate. That is, known transcriptional activators or inhibitors can be incubated with cells or plants, for example, in one sample of the assay, and the resulting increase/decrease in transcription can be detected by measuring the resulting increase in RNA levels and/or protein expression, for example, according to the methods herein. It will be appreciated that modulators can also be combined with transcriptional activators or inhibitors to find modulators that inhibit transcriptional activation or transcriptional repression. Either expression of the nucleic acids and proteins herein or any additional nucleic acids or proteins activated by the nucleic acids or proteins herein, or both, can be monitored.

In an embodiment, the invention provides a method for identifying compositions that modulate the activity or expression of a polynucleotide or polypeptide of the invention. For example, a test compound, whether a small or large molecule, is placed in contact with a cell, plant (or plant tissue or explant), or composition comprising the polynucleotide or polypeptide of interest and a resulting effect on the cell, plant, (or tissue or explant) or composition is evaluated by monitoring, either directly or indirectly, one or more of: expression level of the polynucleotide or polypeptide, activity (or modulation of the activity) of the polynucleotide or polypeptide. In some cases, an alteration in a plant phenotype can be detected following contact of a plant (or plant cell, or tissue or explant) with the putative modulator, e.g., by modulation of expression or activity of a polynucleotide or polypeptide of the invention. Modulation of expression or activity of a polynucleotide or polypeptide of the invention may also be caused by molecular elements in a signal transduction second messenger pathway and such modulation can affect similar elements in the same or another signal transduction second messenger pathway.

Subsequences

Also contemplated are uses of polynucleotides, also referred to herein as oligonucleotides, typically having at least 12 bases, preferably at least 15, more preferably at least 20, 30, or 50 bases, which hybridize under at least highly stringent (or ultra-high stringent or ultra-ultra-high stringent conditions) conditions to a polynucleotide sequence described above. The polynucleotides may be used as probes, primers, sense and antisense agents, and the like, according to methods as noted supra.

Subsequences of the polynucleotides of the invention, including polynucleotide fragments and oligonucleotides are useful as nucleic acid probes and primers. An oligonucleotide suitable for use as a probe or primer is at least about 15 nucleotides in length, more often at least about 18 nucleotides, often at least about 21 nucleotides, frequently at least about 30 nucleotides, or about 40 nucleotides, or more in length. A nucleic acid probe is useful in hybridization protocols, e.g., to identify additional polypeptide homologs of the invention, including protocols for microarray experiments. Primers can be annealed to a complementary target DNA strand by nucleic acid hybridization to form a hybrid between the primer and the target DNA strand, and then extended along the target DNA strand by a DNA polymerase enzyme. Primer pairs can be used for amplification of a nucleic acid sequence, e.g., by the polymerase chain reaction (PCR) or other nucleic-acid amplification methods. See Sambrook, supra, and Ausubel, supra.

In addition, the invention includes an isolated or recombinant polypeptide including a subsequence of at least about 15 contiguous amino acids encoded by the recombinant or isolated polynucleotides of the invention. For example, such polypeptides, or domains or fragments thereof, can be used as immunogens, e.g., to produce antibodies specific for the polypeptide sequence, or as probes for detecting a sequence of interest. A subsequence can range in size from about 15 amino acids in length up to and including the full length of the polypeptide.

To be encompassed by the present invention, an expressed polypeptide which comprises such a polypeptide subsequence performs at least one biological function of the intact polypeptide in substantially the same manner, or to a similar extent, as does the intact polypeptide. For example, a polypeptide fragment can comprise a recognizable structural motif or functional domain such as a DNA binding domain that activates transcription, e.g., by binding to a specific DNA promoter region an activation domain, or a domain for protein-protein interactions.

Production of Transgenic Plants

Modification of Traits

The polynucleotides of the invention are favorably employed to produce transgenic plants with various traits, or characteristics, that have been modified in a desirable manner, e.g., to improve the seed characteristics of a plant. For example, alteration of expression levels or patterns (e.g., spatial or temporal expression patterns) of one or more of the transcription factors (or transcription factor homologs) of the invention, as compared with the levels of the same protein found in a wild-type plant, can be used to modify a plant's traits. An illustrative example of trait modification, improved characteristics, by altering expression levels of a particular transcription factor is described further in the Examples and the Sequence Listing.

Arabidopsis as a Model System

Arabidopsis thaliana is the object of rapidly growing attention as a model for genetics and metabolism in plants. Arabidopsis has a small genome, and well-documented studies are available. It is easy to grow in large numbers and mutants defining important genetically controlled mechanisms are either available, or can readily be obtained. Various methods to introduce and express isolated homologous genes are available (see Koncz et al. eds., et al. Methods in Arabidopsis Research (1992) et al. World Scientific, New Jersey, N.J., in "Preface"). Because of its small size, short life cycle, obligate autogamy and high fertility, Arabidopsis is also a choice organism for the isolation of mutants and studies in morphogenetic and development pathways, and control of these pathways by transcription factors (Koncz supra, p. 72). A number of studies introducing transcription factors into A. thaliana have demonstrated the utility of this plant for understanding the mechanisms of gene regulation and trait alteration in plants. (See, for example, Koncz supra, and U.S. Pat. No. 6,417,428).

Arabidopsis Genes in Transgenic Plants.

Expression of genes which encode transcription factors modify expression of endogenous genes, polynucleotides, and proteins are well known in the art. In addition, transgenic plants comprising isolated polynucleotides encoding transcription factors may also modify expression of endogenous genes, polynucleotides, and proteins. Examples include Peng et al. (1997) et al. Genes and Development 11: 3194-3205, and Peng et al. (1999) Nature 400: 256-261. In addition, many others have demonstrated that an Arabidopsis transcription factor expressed in an exogenous plant species elicits the same or very similar phenotypic response. See, for example, Fu et al. (2001) Plant Cell 13: 1791-1802; Nandi et al. (2000) Curr. Biol. 10: 215-218; Coupland (1995) Nature 377: 482-483; and Weigel and Nilsson (1995) Nature 377: 482-500.

Homologous Genes Introduced into Transgenic Plants.

Homologous genes that may be derived from any plant, or from any source whether natural, synthetic, semi-synthetic or recombinant, and that share significant sequence identity or similarity to those provided by the present invention, may be introduced into plants, for example, crop plants, to confer desirable or improved traits. Consequently, transgenic plants may be produced that comprise a recombinant expression vector or cassette with a promoter operably linked to one or more sequences homologous to presently disclosed sequences. The promoter may be, for example, a plant or viral promoter.

The invention thus provides for methods for preparing transgenic plants, and for modifying plant traits. These methods include introducing into a plant a recombinant expression vector or cassette comprising a functional promoter operably linked to one or more sequences homologous to presently disclosed sequences. Plants and kits for producing these plants that result from the application of these methods are also encompassed by the present invention.

Transcription Factors of Interest for the Modification of Plant Traits

Currently, the existence of a series of maturity groups for different latitudes represents a major barrier to the introduction of new valuable traits. Any trait (e.g. disease resistance) has to be bred into each of the different maturity groups separately, a laborious and costly exercise. The availability of single strain, which could be grown at any latitude, would therefore greatly increase the potential for introducing new traits to crop species such as soybean and cotton.

For many of the specific effects, traits and utilities listed in Table 7 and Table 9 that may be conferred to plants, one or more transcription factor genes may be used to increase or decrease, advance or delay, or improve or prove deleterious to a given trait. Overexpressing or suppressing one or more genes can impart significant differences in production of plant products, such as different fatty acid ratios. For example, overexpression of G720 caused a plant to become more freezing tolerant, but knocking out the same transcription factor imparted greater susceptibility to freezing. Thus, suppressing a gene that causes a plant to be more sensitive to cold may improve a plant's tolerance of cold.

More than one transcription factor gene may be introduced into a plant, either by transforming the plant with one or more vectors comprising two or more transcription factors, or by selective breeding of plants to yield hybrid crosses that comprise more than one introduced transcription factor. Transgenic plants may be crossed with another plant or selfed or to produce seed; which may be used to generate progeny plants having increased tolerance to abiotic stress ("selfing" refers to self-pollinating, or using pollen from one plant to fertilize the same plant or another plant in the same line, whereas "crossing" generally refers to cross pollination with plant from a different line, such as a non-transformed or wild-type plant, or another transformed plant from a different transgenic line of plants). Crossing provides the advantage of being able to produce new varieties. The resulting seed may then be used to grow a progeny plant that is transgenic and has increased tolerance to abiotic stress. Generally, the progeny plants will express mRNA that encodes a DNA-binding protein having a conserved domain (e.g., an AP2, MYB-related or CCAAT box-binding domain) that binds to a DNA molecule, regulates its expression, and induces the expression of genes and polypeptides that confer to the plant the desirable trait (e.g., abiotic stress tolerance). In these progeny plants, the mRNA may be expressed at a level greater than in a non-transformed plant that does not overexpress the DNA-binding protein.

A listing of specific effects and utilities that the presently disclosed transcription factor genes have on plants, as determined by direct observation and assay analysis, is provided in Table 7. Table 7 shows the polynucleotides identified by SEQ ID NO; GID; and whether the polynucleotide was tested in a transgenic assay. The first column shows the polynucleotide SEQ ID NO; the second column shows the GID; the third column shows whether the gene was overexpressed (OE) or knocked out (KO) in plant studies; the fourth column shows the trait(s) resulting from the knock out or overexpression of the polynucleotide in the transgenic plant; and the fifth column ("Observations"), includes specific experimental observations made when expression of the polynucleotide of the first column was altered.

TABLE 7

Traits categories and effects of transcription factor genes that are overexpressed (OE) or knocked out (KO)

| Polynucleotide SEQ ID NO: | GID. | OE/KO | Trait Alterations | Observations |
|---|---|---|---|---|
| 1 | G8 | OE | Altered flowering time<br>Growth regulation; nutrient uptake | Late flowering<br>Altered C/N sensing |
| 3 | G19 | OE | Increased tolerance to disease | Increased tolerance to *Erysiphe*; repressed by methyl jasmonate and induced by 1-aminocyclopropane 1-carboxylic acid (ACC) |
| 5 | G22 | OE | Increased tolerance to abiotic stress | Increased tolerance to high salt |
| 7 | G24 | OE | Altered necrosis<br>Growth regulation; nutrient uptake | Reduced size and necrotic patches<br>Altered C/N sensing |
| 2217 | G27 | OE | Growth regulation; nutrient uptake | Altered C/N sensing |
| 9 | G28 | OE | Increased tolerance to disease | Increased tolerance to *Botrytis*<br>Increased tolerance to *Sclerotinia*<br>Increased resistance to *Erysiphe* |
| 11 | G47 | OE | Altered stem morphology<br>Increased tolerance to abiotic stress<br>Altered flowering time<br>Altered architecture<br>Increased tolerance to abiotic and hyperosmotic stress | Altered structure of vascular tissues<br>Better root growth under hyperosmotic stress<br>Late flowering<br>Altered architecture and inflorescence development<br>Reduced apical dominance<br>Increased tolerance to drought |
| 13 | G156 | KO | Altered seed<br>Growth regulation; nutrient uptake | Seed color alteration<br>Altered C/N sensing |
| 15 | G157 | OE | Altered flowering time | Altered flowering time (modest level of overexpression triggers early flowering, whereas a larger increase delays flowering) |
| 17 | G162 | OE | Altered seed oil<br>Altered seed protein | Increased seed oil content<br>Increased seed protein content |
| 19 | G175 | OE | Increased tolerance to abiotic stress | Increased tolerance to hyperosmotic stress<br>Increased tolerance to drought |
| 21 | G180 | OE | Altered seed oil<br>Altered flowering time | Decreased seed oil<br>Early flowering |
| 23 | G183 | OE | Altered flowering time<br>Altered light response and/or shade tolerance<br>Growth regulation; nutrient uptake | Early flowering<br>Constitutive photomorphogenesis<br>Altered C/N sensing |
| 25 | G188 | KO | Increased susceptibility to disease<br>Increased tolerance to abiotic stress | Increased susceptibility to *Fusarium*<br>Better germination under hyperosmotic stress<br>Increased tolerance to drought |
| 27 | G189 | OE | Altered size<br>Growth regulation; nutrient uptake | Increased leaf size<br>Altered C/N sensing |
| 29 | G192 | OE | Altered flowering time<br>Altered seed oil | Late flowering<br>Decreased seed oil content |
| 31 | G196 | OE | Increased tolerance to abiotic stress | Increased tolerance to high salt |
| 33 | G211 | OE | Altered leaf biochemistry<br>Altered architecture<br>Altered leaf | Increase in leaf xylose<br>Reduced apical dominance<br>Altered leaf shape |
| 35 | G214 | OE | Altered flowering time<br>Altered leaf biochemistry<br>Altered seed prenyl lipids<br>Altered leaf prenyl lipids | Late flowering<br>Increased leaf fatty acids<br>Increased seed lutein<br>Increased leaf chlorophyll and carotenoids |
| 37 | G226 | OE | Altered seed protein<br>Altered trichomes<br>Altered root<br>Increased tolerance to abiotic stress<br>Growth regulation; nutrient uptake | Increased seed protein<br>Glabrous, lack of trichomes<br>Increased root hairs<br>Increased tolerance to high salt<br>Increased tolerance to nitrogen-limited medium<br>Altered C/N sensing |
| 2267 | G234 | OE | Growth regulation; nutrient uptake | Altered C/N sensing |
| 2269 | G237 | OE | Growth regulation; nutrient uptake | Altered C/N sensing |

TABLE 7-continued

Traits categories and effects of transcription factor genes that are overexpressed (OE) or knocked out (KO)

| Polynucleotide SEQ ID NO: | GID. | OE/KO | Trait Alterations | Observations |
|---|---|---|---|---|
| 39 | G241 | KO | Altered seed protein | Increased seed protein content |
|  |  |  | Altered seed oil | Decreased seed oil |
|  |  |  | Altered sugar sensing | Decreased germination and growth on glucose medium |
| 41 | G248 | OE | Increased susceptibility to disease | Increased susceptibility to *Botrytis* |
| 43 | G254 | OE | Altered sugar sensing | Decreased germination and growth on glucose medium |
| 45 | G256 | OE | Increased tolerance to abiotic stress | Better germination and growth in cold |
| 47 | G278 | OE | Increased susceptibility to disease | Increased susceptibility to *Sclerotinia* |
| 49 | G291 | OE | Altered seed oil | Increased seed oil content |
| 51 | G303 | OE | Increased tolerance to abiotic and hyperosmotic stress | Better germination on high sucrose and high NaCl |
|  |  |  |  | Increased tolerance to drought |
| 53 | G312 | OE | Increased tolerance to abiotic stress | Better germination on high NaCl |
| 55 | G325 | OE | Increased tolerance to abiotic and hyperosmotic stress | Better germination on high sucrose and NaCl |
|  |  |  |  | Increased tolerance to drought |
| 57 | G343 | OE | Altered glyphosate sensitivity | Increased resistance to glyphosate |
|  |  |  | Altered size | Small plant |
| G2295 | G347 | OE | Growth regulation; nutrient uptake | Altered C/N sensing |
| 59 | G353 | OE | Increased tolerance to abiotic and hyperosmotic stress | Increased seedling vigor on polyethylene glycol (PEG) |
|  |  |  | Altered size | Increased tolerance to drought |
|  |  |  | Altered leaf | Reduced size |
|  |  |  | Altered flower | Altered leaf development |
|  |  |  |  | Short pedicels, downward pointing siliques |
| 61 | G354 | OE | Altered size | Reduced size |
|  |  |  | Altered light response and/or shade tolerance | Constitutive photomorphogenesis |
|  |  |  | Flower | Short pedicels, downward pointing siliques |
| 63 | G361 | OE | Altered flowering time | Late flowering |
| 65 | G362 | OE | Altered flowering time | Late flowering |
|  |  |  | Altered size | Reduced size |
|  |  |  | Altered trichomes | Ectopic trichome formation, increased trichome number |
|  |  |  | Morphology: other | Increased pigmentation in seed and embryos, and in other organs |
| 67 | G371 | OE | Increased susceptibility to disease | Increased susceptibility to *Botrytis* |
| 69 | G390 | OE | Altered architecture | Altered shoot development |
| 71 | G391 | OE | Altered architecture | Altered shoot development |
| 73 | G409 | OE | Increased tolerance to disease | Increased tolerance to *Erysiphe* |
| 75 | G427 | OE | Altered seed oil | Increased oil content |
|  |  |  | Altered seed protein | Decreased protein content |
|  |  |  | Growth regulation; nutrient uptake | Altered C/N sensing |
| 77 | G438 | KO | Altered stem morphology | Reduced lignin |
|  |  |  | Altered architecture | Reduced branching |
| 79 | G450 | OE | Altered seed | Increased seed size |
| 81 | G464 | OE | Increased tolerance to abiotic stress | Better germination and growth in heat |
| 83 | G470 | OE | Altered fertility | Short stamen filaments |
| 85 | G477 | OE | Increased susceptibility to disease | Increased susceptibility to *Sclerotinia* |
|  |  |  | Increased tolerance to abiotic stress | Increased sensitivity to oxidative stress |
| 87 | G481 | OE | Increased tolerance to abiotic and hyperosmotic stress | Altered sugar sensing: better germination on sucrose media |
|  |  |  |  | Increased tolerance to drought |
| 89 | G482 | OE | Increased tolerance to abiotic and hyperosmotic stress | Increased tolerance to high salt |
| 91 | G484 | KO | Altered seed glucosinolates | Altered glucosinolate profile |
| 93 | G489 | OE | Increased tolerance to abiotic and hyperosmotic stress | Increased tolerance to hyperosmotic stress |
|  |  |  |  | Increased tolerance to drought |
| 95 | G490 | OE | Altered flowering time | Early flowering |
| 97 | G504 | OE | Altered seed oil composition | Decreased seed oil composition and content; increase in 18:2 fatty acid and decrease in 20:1 fatty acid |
| 99 | G509 | KO | Altered seed oil | Increased total seed oil and protein content |
|  |  |  | Altered seed protein |  |
| 101 | G519 | OE | Altered seed oil | Increased seed oil content |
| 103 | G545 | OE | Increased tolerance to abiotic and hyperosmotic stress | Susceptible to high salt |
|  |  |  |  | Increased susceptibility to *Erysiphe* |
|  |  |  | Increased susceptibility to disease | Increased susceptibility to *Pseudomonas* |

TABLE 7-continued

Traits categories and effects of transcription factor genes that are overexpressed (OE) or knocked out (KO)

| Polynucleotide SEQ ID NO: | GID. | OE/KO | Trait Alterations | Observations |
|---|---|---|---|---|
| | | | Growth regulation; nutrient uptake | Increased susceptibility to *Fusarium* |
| | | | | Increased tolerance to phosphate-free medium |
| | | | | Altered C/N sensing |
| 105 | G546 | OE | Altered hormone sensitivity | Decreased sensitivity to abscisic acid (ABA) |
| 107 | G561 | OE | Altered seed oil | Increased seed oil content |
| | | | Tolerance to abiotic stress | Increased tolerance to potassium-free medium |
| 109 | G562 | OE | Altered flowering time | Late flowering |
| 111 | G567 | OE | Altered seed oil | Increased total seed oil/protein content |
| | | | Altered seed protein | Increased total seed oil/protein content |
| | | | Altered sugar sensing | Decreased seedling vigor on high glucose |
| 113 | G568 | OE | Altered architecture | Altered branching |
| 115 | G584 | OE | Altered seed | Large seeds |
| 117 | G585 | OE | Altered trichomes | Reduced trichome density |
| 119 | G590 | KO | Altered seed oil | Increased seed oil content |
| | | OE | Altered flowering time | Early flowering |
| | | OE | Growth regulation; nutrient uptake | Altered C/N sensing |
| 121 | G594 | OE | Increased susceptibility to disease | Increased susceptibility to *Sclerotinia* |
| 123 | G597 | OE | Altered seed protein | Altered seed protein content |
| 125 | G598 | OE | Altered seed oil | Increased seed oil |
| 127 | G634 | OE | Altered trichomes | Increased trichome density and size |
| | | | Altered light response and/or shade tolerance | Increased shade tolerance; lack of shade avoidance phenotype |
| | | | Increased tolerance to abiotic stress | Increased drought tolerance |
| 129 | G635 | OE | Variegation | Altered coloration |
| | | | Growth regulation; nutrient uptake | Altered C/N sensing |
| 131 | G636 | OE | Altered senescence | Premature senescence |
| 133 | G638 | OE | Altered flower | Altered flower development |
| 135 | G652 | KO | Altered seed prenyl lipids | Increase in alpha-tocopherol |
| 2391 | G657 | OE | Growth regulation; nutrient uptake | Altered C/N sensing |
| 137 | G663 | OE | Altered pigment | Increased anthocyanins in leaf, root, seed |
| 139 | G664 | OE | Increased tolerance to abiotic stress | Better germination and growth in cold |
| 141 | G674 | OE | Altered leaf | Dark green, upwardly oriented leaves |
| 143 | G676 | OE | Altered trichomes | Reduced trichome number, ectopic trichome formation |
| 145 | G680 | OE | Altered sugar sensing | Reduced germination on glucose medium |
| 147 | G682 | OE | Altered trichomes | Glabrous, lack of trichomes |
| | | | Increased tolerance to abiotic and hyperosmotic stress | Better germination and growth in heat |
| | | | | Increased root hairs |
| | | | Altered root | Increased tolerance to drought |
| | | | Growth regulation; nutrient uptake | Altered C/N sensing |
| 149 | G715 | OE | Altered seed oil | Increased seed oil content |
| 151 | G720 | OE | Increased tolerance to abiotic and hyperosmotic stress | More freezing tolerant |
| | | KO | | Increased susceptibility to freezing |
| | | | Increased susceptibility to abiotic and hyperosmotic stress | |
| 153 | G736 | OE | Altered flowering time | Late flowering |
| | | | Altered leaf | Altered leaf shape |
| 155 | G748 | OE | Altered seed prenyl lipids | Increased lutein content |
| | | | Altered stem morphology | More vascular bundles in stem |
| | | | Altered flowering time | Late flowering |
| 2413 | G760 | OE | Growth regulation; nutrient uptake | Altered C/N sensing |
| 157 | G779 | OE | Altered fertility | Reduced fertility |
| | | | Altered flower | Homeotic transformations |
| 159 | G789 | OE | Altered flowering time | Early flowering |
| 161 | G801 | OE | Increased tolerance to abiotic stress | Better germination on high NaCl |
| 163 | G849 | KO | Altered seed oil | Increased seed oil content |
| | | | Altered seed protein | Altered seed protein content |
| 165 | G859 | OE | Altered flowering time | Late flowering |
| 167 | G864 | OE | Increased tolerance to abiotic stress | Better germination in heat |
| | | | | Increased tolerance to drought |
| 169 | G867 | OE | Increased tolerance to abiotic and hyperosmotic stress | Better seedling vigor on high salt |
| | | | | Better seedling vigor on high sucrose |
| | | | Altered sugar sensing | |
| 171 | G869 | OE | Altered seed oil composition | Altered seed fatty acid composition |
| 2437 | G872 | OE | Growth regulation; nutrient uptake | Altered C/N sensing |
| 173 | G877 | KO | Embryo lethal | Embryo lethal phenotype: potential herbicide target |

TABLE 7-continued

Traits categories and effects of transcription factor genes that are overexpressed (OE) or knocked out (KO)

| Polynucleotide SEQ ID NO: | GID. | OE/KO | Trait Alterations | Observations |
|---|---|---|---|---|
| 175 | G881 | OE | Increased susceptibility to disease | Increased susceptibility to *Erysiphe* |
| 177 | G892 | KO | Altered seed protein<br>Altered seed oil | Altered seed protein content<br>Altered seed oil content |
| 179 | G896 | KO | Increased susceptibility to disease | Increased susceptibility to *Fusarium* |
| 2451 | G904 | OE | Growth regulation; nutrient uptake | Altered C/N sensing |
| 181 | G910 | OE | Altered flowering time | Late flowering |
| 183 | G911 | OE | Tolerance to abiotic stress | Increased growth on potassium-free medium |
| 185 | G912 | OE | Increased tolerance to abiotic stress<br>Altered pigment<br>Altered sugar sensing | Freezing tolerant<br>Increased survival in drought conditions<br>Dark green color<br>Reduced cotyledon expansion in glucose |
| 187 | G913 | OE | Increased tolerance to abiotic stress<br>Altered flowering time | Increased tolerance to freezing<br>Late flowering<br>Increased tolerance to drought |
| 189 | G922 | OE | Increased tolerance to abiotic and hyperosmotic stress | Better germination on high sucrose<br>Better germination, increased root growth on high salt<br>Increased tolerance to drought |
| 191 | G926 | KO | Altered hormone sensitivity<br>Increased tolerance to abiotic and hyperosmotic stress | Reduced sensitivity to ABA<br>Increased tolerance to high salt and sucrose |
| 2065 | G932 | OE | Growth regulation; nutrient uptake | C/N sensing: increased tolerance to low nitrogen |
| 2461 | G937 | OE | Growth regulation; nutrient uptake | Altered C/N sensing |
| 2471 | G958 | OE | Growth regulation; nutrient uptake | Altered C/N sensing |
| 193 | G961 | KO | Altered seed oil | Increased seed oil content |
| 2479 | G964 | KO | Growth regulation; nutrient uptake | Altered C/N sensing |
| 195 | G971 | OE | Altered flowering time | Late flowering |
| 197 | G974 | OE | Altered seed oil | Altered seed oil content |
| 199 | G975 | OE | Altered leaf biochemistry<br>Increased tolerance to abiotic and hyperosmotic stress<br>Growth regulation; nutrient uptake | Increased fatty acids and wax in leaves<br>Increased tolerance to drought<br>Altered C/N sensing |
| 201 | G979 | KO | Altered seed<br>Growth regulation; nutrient uptake | Altered seed development, ripening, and germination<br>Altered C/N sensing |
| 203 | G987 | KO | Altered leaf fatty acids<br>Altered leaf biochemistry | Reduction in 16:3 fatty acids<br>Altered prenyl lipids: chlorophyll, tocopherol, carotenoid |
| 205 | G988 | OE | Altered seed protein<br>Altered flower<br>Altered architecture<br>Altered stem morphology<br>Growth regulation; nutrient uptake | Increased seed protein content<br>Enlarged floral organs, short pedicels<br>Reduced lateral branching<br>Thicker stem, altered distribution of vascular bundles<br>Altered C/N sensing |
| 207 | G1040 | OE | Altered seed | Smaller and more rounded seeds |
| 209 | G1047 | OE | Increased tolerance to disease | Increased tolerance to *Fusarium* |
| 2515 | G1048 | OE | Altered light response and/or shade tolerance | Increased shade tolerance; lack of shade avoidance phenotype |
| 2517 | G1049 | OE | Growth regulation; nutrient uptake | Altered C/N sensing |
| 211 | G1051 | OE | Altered flowering time | Late flowering |
| 213 | G1052 | OE | Altered flowering time | Late flowering |
| 215 | G1062 | KO | Altered seed | Altered seed shape |
| 217 | G1063 | OE | Altered leaf<br>Altered inflorescence<br>Altered flower | Altered leaf shape, dark green color<br>Altered inflorescence development<br>Altered flower development, ectopic carpel tissue |
| 219 | G1064 | OE | Increased susceptibility to disease | Increased sensitivity to *Botrytis* |
| 221 | G1069 | OE | Altered hormone sensitivity<br>Increased tolerance to abiotic and hyperosmotic stress<br>Growth regulation; nutrient uptake | Reduced ABA sensitivity<br>Better germination under hyperosmotic stress<br>Increased tolerance to drought<br>Altered C/N sensing |
| 223 | G1073 | OE | Altered size<br>Altered seed<br>Increased tolerance to abiotic stress | Substantially increased plant size<br>Increased seed yield<br>Increased tolerance to drought |
| 225 | G1075 | OE | Altered flower | Reduced or absent petals, sepals and stamens |
| 227 | G1084 | OE | Increased susceptibility to disease | Increased susceptibility to *Botrytis* |
| 229 | G1089 | KO | Increased tolerance to hyperosmotic stress | Better germination under hyperosmotic stress |

TABLE 7-continued

Traits categories and effects of transcription factor genes that are overexpressed (OE) or knocked out (KO)

| Polynucleotide SEQ ID NO: | GID. | OE/ KO | Trait Alterations | Observations |
|---|---|---|---|---|
| 231 | G1134 | OE | Altered hormone sensitivity | Altered response to ethylene: longer hypocotyls and lack of apical hook |
| 233 | G1140 | OE | Altered flower | Altered flower development |
| 235 | G1143 | OE | Altered seed oil | Altered seed oil content |
| 237 | G1146 | OE | Altered leaf | Altered leaf development |
| 239 | G1196 | KO | Increased susceptibility to disease | Increased susceptibility to *Botrytis* |
| 241 | G1198 | OE | Altered seed oil | Increased seed oil content |
| 243 | G1225 | OE | Altered flowering time | Early flowering |
|  |  |  | Altered sugar sensing | Better germination on sucrose and glucose media |
| 245 | G1226 | OE | Altered seed oil | Increased seed oil content |
| 247 | G1229 | OE | Altered seed oil | Decreased seed oil content |
| 2555 | G1246 | OE | Growth regulation; nutrient uptake | Altered C/N sensing |
| 249 | G1255 | OE | Increased susceptibility to disease | Increased susceptibility to *Botrytis* |
|  |  |  | Altered seed | Increased seed size |
|  |  |  | Altered architecture | Reduced apical dominance |
|  |  |  | Growth regulation; nutrient uptake | Altered C/N sensing |
| 251 | G1266 | OE | Increased tolerance to disease | Increased tolerance to *Erysiphe* |
|  |  |  | Growth regulation; nutrient uptake | Altered C/N sensing |
| 253 | G1275 | OE | Altered architecture | Reduced apical dominance |
| 255 | G1305 | OE | Increased tolerance to abiotic stress | Reduced chlorosis in heat |
| 257 | G1322 | OE | Increased tolerance to abiotic stress | Increased seedling vigor in cold |
|  |  |  |  | Reduced size |
|  |  |  | Altered size | Increase in M39480 |
|  |  |  | Leaf glucosinolates | Constitutive photomorphogenesis |
|  |  |  | Altered light response and/or shade tolerance | Altered C/N sensing: increased tolerance to low nitrogen |
|  |  |  | Growth regulation; nutrient uptake |  |
| 259 | G1323 | OE | Altered seed oil | Decreased seed oil |
|  |  |  | Altered seed protein | Increased seed protein |
| 261 | G1330 | OE | Altered hormone sensitivity | Ethylene insensitive when germinated in the dark on ACC |
| 263 | G1331 | OE | Altered light response and/or shade tolerance | Constitutive photomorphogenesis |
|  |  |  | Growth regulation; nutrient uptake | Altered C/N sensing |
| 265 | G1332 | OE | Altered trichomes | Reduced trichome density |
|  |  |  | Growth regulation; nutrient uptake | Altered C/N sensing |
| 267 | G1363 | OE | Increased tolerance to disease | Increased tolerance to *Fusarium* |
| 269 | G1411 | OE | Altered architecture | Loss of apical dominance |
| 2607 | G1412 | KO | Altered light response and/or shade tolerance | Increased shade tolerance; lack of shade avoidance phenotype |
| 271 | G1417 | KO | Altered seed oil | Increase in 18:2, decrease in 18:3 fatty acids |
| 273 | G1419 | OE | Altered seed protein | Increased seed protein |
| 275 | G1449 | OE | Altered flower | Altered flower structure |
| 277 | G1451 | OE | Altered size | Increased plant size |
|  |  | OE | Altered leaf | Large leaf size |
|  |  | KO | Altered seed oil | Altered seed oil content |
| 279 | G1452 | OE | Altered trichomes | Reduced trichome density |
|  |  |  | Altered leaf | Altered leaf shape, dark green color |
|  |  |  | Altered hormone sensitivity | Reduced sensitivity to ABA |
|  |  |  | Altered flowering time | Better germination on sucrose, salt |
|  |  |  | Increased tolerance to abiotic and hyperosmotic stress | Late flowering |
|  |  |  |  | Increased tolerance to drought |
| 281 | G1463 | OE | Altered senescence | Premature senescence |
| 283 | G1471 | OE | Altered seed oil | Increased seed oil content |
| 285 | G1478 | OE | Altered seed protein | Decreased seed protein content |
|  |  |  | Altered flowering time | Late flowering |
|  |  |  | Altered seed oil | Increased seed oil content |
| 287 | G1482 | KO | Altered pigment | Increased anthocyanins |
|  |  | OE | Altered root | Increased root growth |
| 289 | G1488 | OE | Altered seed protein | Altered seed protein content |
|  |  |  | Altered light response and/or shade tolerance | Constitutive photomorphogenesis |
|  |  |  | Altered architecture | Reduced apical dominance, shorter stems |
| 291 | G1494 | OE | Altered flowering time | Early flowering |
|  |  |  | Altered light response and/or shade tolerance | Long hypocotyls, altered leaf shape |
|  |  |  | Altered leaf | Pale green leaves, altered leaf shape |
|  |  |  | Growth regulation; nutrient uptake | Altered C/N sensing |
| 293 | G1496 | OE | Altered seed oil | Altered seed oil content |
| 295 | G1499 | OE | Altered pigment | Dark green color |
|  |  |  | Altered architecture | Altered plant architecture |

TABLE 7-continued

Traits categories and effects of transcription factor genes that are overexpressed (OE) or knocked out (KO)

| Polynucleotide SEQ ID NO: | GID. | OE/ KO | Trait Alterations | Observations |
|---|---|---|---|---|
| | | | Altered flower | Altered floral organ identity and development |
| 297 | G1519 | KO | Embryo lethal | Embryo lethal phenotype: potential herbicide target |
| 299 | G1526 | KO | Altered seed oil | Increased seed oil content |
| 301 | G1540 | OE | Altered cell differentiation | Reduced cell differentiation in meristem |
| 303 | G1543 | OE | Altered architecture | Altered architecture, compact plant |
| | | | Morphology: other | Dark green color |
| | | | Altered seed oil | Decreased seed oil |
| | | | Altered leaf prenyl lipids | Increase in chlorophyll a and b |
| 2667 | G1587 | OE | Growth regulation; nutrient uptake | Altered C/N sensing |
| 305 | G1634 | OE | Altered seed oil | Increased seed oil content |
| | | | Altered seed protein | Decreased seed protein content |
| 307 | G1637 | OE | Altered seed protein | Altered seed protein content |
| 309 | G1640 | OE | Altered seed oil | Increased seed oil |
| 311 | G1645 | OE | Altered inflorescence | Altered inflorescence structure |
| 313 | G1646 | OE | Altered seed oil | Increased seed oil content |
| 2685 | G1649 | OE | Growth regulation; nutrient uptake | Altered C/N sensing |
| 315 | G1652 | OE | Altered seed protein | Increased seed protein content |
| | G1666 | KO | Growth regulation; nutrient uptake | Altered C/N sensing |
| 317 | G1672 | OE | Altered seed oil | Altered seed oil content |
| 319 | G1677 | OE | Altered seed protein | Altered seed protein content |
| | | | Altered seed oil | Altered seed oil content |
| 321 | G1749 | OE | Altered necrosis | Formation of necrotic lesions |
| 323 | G1750 | OE | Altered seed oil | Increased seed oil content |
| | | | Growth regulation; nutrient uptake | Altered C/N sensing |
| 325 | G1756 | OE | Increased susceptibility to disease | Increased susceptibility to *Botrytis* |
| 327 | G1765 | OE | Altered seed oil | Increased seed oil content |
| 329 | G1777 | OE | Altered seed oil | Increased seed oil content |
| | | | Altered seed protein | Decreased seed protein content |
| 331 | G1792 | OE | Altered leaf | Dark green, shiny leaves |
| | | | Increased tolerance to disease | Increased resistance to *Erysiphe* |
| | | | Increased tolerance to abiotic and hyperosmotic stress | Increased resistance to *Botrytis* |
| | | | | Increased resistance to *Fusarium* |
| | | | | Increased tolerance to nitrogen-limited medium |
| | | | | Increased tolerance to drought |
| 333 | G1793 | OE | Altered seed oil | Increased seed oil content |
| 335 | G1794 | OE | Altered architecture | Altered architecture, bushier plant |
| | | | Altered light response and/or shade tolerance | Reduced apical dominance |
| | | | | Constitutive photomorphogenesis |
| | | | Increased tolerance to hyperosmotic and abiotic stress | Increased sensitivity to high PEG |
| | | | | Reduced root growth |
| 337 | G1804 | OE | Altered flowering time | Late flowering |
| | | | Altered sugar sensing | Altered sugar sensing: more sensitive to glucose in germination assays |
| 339 | G1818 | OE | Altered seed protein | Increased protein content |
| 341 | G1820 | OE | Altered flowering time | Early flowering |
| | | | Altered hormone sensitivity | Reduced ABA sensitivity |
| | | | Altered seed protein | Increased seed protein content |
| | | | Increased tolerance to abiotic and hyperosmotic stress | Better germination in high NaCl |
| | | | | Increased tolerance to drought |
| 2733 | G1835 | OE | Growth regulation; nutrient uptake | Altered C/N sensing |
| 343 | G1836 | OE | Increased tolerance to abiotic and hyperosmotic stress | Better germination in high salt |
| | | | | Increased tolerance to drought |
| 345 | G1838 | OE | Altered seed oil | Increased seed oil content |
| 347 | G1841 | OE | Increased tolerance to abiotic and hyperosmotic stress | Better germination under heat stress |
| | | | Altered flowering time | Early flowering |
| 349 | G1842 | OE | Altered flowering time | Early flowering |
| 351 | G1843 | OE | Altered flowering time | Early flowering |
| 353 | G1852 | OE | Increased tolerance to abiotic and hyperosmotic stress | Better root growth under hyperosmotic stress |
| 355 | G1863 | OE | Altered leaf | Altered leaf shape and coloration |
| 357 | G1880 | KO | Increased tolerance to disease | Increased resistance to *Botrytis* |
| 359 | G1895 | OE | Altered flowering time | Late flowering |
| 361 | G1902 | OE | Altered seed oil | Increased seed oil content |
| 363 | G1903 | OE | Altered seed protein | Decreased seed protein content |
| 365 | G1919 | OE | Increased tolerance to disease | Increased tolerance to *Botrytis* |
| 367 | G1927 | OE | Increased tolerance to disease | Increased tolerance to *Sclerotinia* |
| 369 | G1930 | OE | Increased tolerance to hyperosmotic stress | Better germination under hyperosmotic stress |
| | | | Growth regulation; nutrient uptake | Altered C/N sensing |

TABLE 7-continued

Traits categories and effects of transcription factor genes that are overexpressed (OE) or knocked out (KO)

| Polynucleotide SEQ ID NO: | GID. | OE/KO | Trait Alterations | Observations |
|---|---|---|---|---|
| 371 | G1936 | KO | Increased susceptibility to disease | Increased susceptibility to *Sclerotinia* |
|  |  |  |  | Increased susceptibility to *Botrytis* |
| 373 | G1944 | OE | Altered senescence | Early senescence |
| 375 | G1946 | OE | Altered seed oil | Increased seed oil content |
|  |  |  | Altered seed protein | Decreased seed protein content |
|  |  |  | Altered flowering time | Early flowering |
|  |  |  | Growth regulation; nutrient uptake | Increased root growth on phosphate-free media |
| 377 | G1947 | KO | Altered fertility | Reduced fertility |
| 379 | G1948 | OE | Altered seed oil | Increased seed oil content |
| 381 | G1950 | OE | Increased tolerance to disease | Increased tolerance to *Botrytis* |
| 383 | G1958 | KO | Altered size | Reduced size and root mass |
|  |  |  | Altered seed oil | Increased seed oil content |
|  |  |  | Altered seed protein | Increased seed protein content. |
| 2157 | G1995 | OE | Altered light response and/or shade tolerance | Increased shade tolerance; lack of shade avoidance phenotype |
| 385 | G2007 | OE | Altered flowering time | Late flowering |
| 387 | G2010 | OE | Altered flowering time | Early flowering |
| 389 | G2053 | OE | Increased tolerance to abiotic and hyperosmotic stress | Increased root growth under hyperosmotic stress |
|  |  |  | Growth regulation; nutrient uptake | Increased tolerance to drought |
|  |  |  |  | Altered C/N sensing |
| 2797 | G2057 | OE | Growth regulation; nutrient uptake | Altered C/N sensing |
| 391 | G2059 | OE | Altered seed oil | Altered seed oil content |
|  |  |  | Altered seed protein | Altered seed protein content |
| 393 | G2085 | OE | Altered seed | Increased seed size and altered seed color |
| 395 | G2105 | OE | Altered seed | Large, pale seeds |
| 397 | G2110 | OE | Increased tolerance to abiotic and hyperosmotic stress | Increased tolerance to high salt |
|  |  |  |  | Increased tolerance to drought |
| 399 | G2114 | OE | Altered seed | Increased seed size |
| 401 | G2117 | OE | Altered seed protein | Increased seed protein content |
|  |  |  |  | Altered C/N sensing |
| 403 | G2123 | OE | Altered seed oil | Increased seed oil content |
| 405 | G2130 | OE | Increased tolerance to abiotic stress | Better germination in heat |
| 2163 | G2131 | OE | Growth regulation; nutrient uptake | Altered C/N sensing |
| 407 | G2133 | OE | Altered herbicide sensitivity | Increased tolerance to glyphosate |
|  |  |  | Altered flowering time | Late flowering |
|  |  |  | Increased tolerance to abiotic and hyperosmotic stress | Increased drought tolerance |
|  |  |  | Growth regulation; nutrient uptake | Altered C/N sensing |
| 409 | G2138 | OE | Altered seed oil | Increased seed oil content |
| 411 | G2140 | OE | Altered hormone sensitivity | Decreased sensitivity to ABA |
|  |  |  | Increased tolerance to abiotic and hyperosmotic stress | Better germination on high NaCl and sucrose |
|  |  |  |  | Increased tolerance to drought |
| 413 | G2143 | OE | Altered inflorescence | Altered inflorescence development |
|  |  |  | Altered leaf | Altered leaf shape, dark green color |
|  |  |  | Altered flower | Altered flower development, ectopic camel tissue |
| 415 | G2144 | OE | Altered flowering time | Early flowering |
|  |  |  | Altered leaf | Pale green leaves, altered leaf shape |
|  |  |  | Light response | Long hypocotyls, altered leaf shape |
|  |  |  | Growth regulation; nutrient uptake | Altered C/N sensing |
| 2827 | G2145 | OE | Growth regulation; nutrient uptake | Altered C/N sensing |
| 417 | G2153 | OE | Increased tolerance to hyperosmotic stress | Better germination under hyperosmotic stress |
| 419 | G2155 | OE | Altered flowering time | Late flowering |
| 421 | G2192 | OE | Altered seed oil | Altered seed fatty acid composition |
| 423 | G2295 | OE | Altered flowering time | Early flowering |
| 425 | G2340 | OE | Altered seed glucosinolates | Altered glucosinolate profile |
| 427 | G2343 | OE | Altered seed oil | Increased seed oil content |
| 429 | G2346 | OE | Altered size | Enlarged seedlings |
| 431 | G2347 | OE | Altered flowering time | Early flowering |
| 433 | G2379 | OE | Increased tolerance to hyperosmotic stress | Increased seedling vigor on high sucrose media |
| 435 | G2430 | OE | Increased tolerance to abiotic and hyperosmotic stress | Increased tolerance to heat |
|  |  |  | Altered size | Increased leaf size, faster development |
| 437 | G2505 | OE | Increased tolerance to abiotic and hyperosmotic stress | Increased tolerance to drought |
|  |  |  | Altered light response and/or shade tolerance | Increased shade tolerance; lack of shade avoidance phenotype |

TABLE 7-continued

Traits categories and effects of transcription factor genes that are overexpressed (OE) or knocked out (KO)

| Polynucleotide SEQ ID NO: | GID. | OE/KO | Trait Alterations | Observations |
|---|---|---|---|---|
| 439 | G2509 | OE | Altered seed oil | Decreased seed oil content |
| | | | Altered seed protein | Increased seed protein content |
| | | | Altered seed prenyl lipids | Increase in alpha-tocopherol |
| | | | Altered architecture | Reduced apical dominance |
| | | | Altered flowering time Early flowering | |
| 2875 | G2512 | OE | Growth regulation; nutrient uptake | Altered C/N sensing |
| 441 | G2517 | OE | Altered herbicide sensitivity | Increased tolerance to glyphosate |
| 443 | G2520 | OE | Altered seed prenyl lipids | Altered tocopherol composition |
| | | | Growth regulation; nutrient uptake | Altered C/N sensing |
| 2185 | G2535 | OE | Growth regulation; nutrient uptake | Altered C/N sensing |
| 445 | G2555 | OE | Altered light response and/or shade tolerance | Constitutive photomorphogenesis |
| | | | Increased susceptibility to disease | Increased susceptibility to *Botrytis* |
| 447 | G2557 | OE | Altered leaf | Altered leaf shape, dark green color |
| | | | Altered flower | Altered flower development, ectopic carpel tissue |
| 449 | G2583 | OE | Altered leaf | Glossy, shiny leaves |
| 451 | G2701 | OE | Increased tolerance to abiotic and hyperosmotic stress | Better germination on high NaCl and sucrose |
| | | | | Increased tolerance to drought |
| 2191 | G2718 | OE | Growth regulation; nutrient uptake | Altered C/N sensing |
| 453 | G2719 | OE | Increased tolerance to hyperosmotic stress | Increased seedling vigor on high sucrose |
| | | | Growth regulation; nutrient uptake | Altered C/N sensing |
| 2193 | G2776 | OE | Increased tolerance to abiotic and hyperosmotic stress | Increased tolerance to drought |
| 455 | G2789 | OE | Altered hormone sensitivity | Better germination on high sucrose |
| | | | Increased tolerance to abiotic and hyperosmotic stress | Reduced ABA sensitivity |
| | | | | Increased tolerance to drought |
| | | | Altered light response and/or shade tolerance | Increased shade tolerance; lack of shade avoidance phenotype |
| | | | Growth regulation; nutrient uptake | Altered C/N sensing |
| 457 | G2830 | KO | Altered seed oil | Increased seed oil content |
| 1951 | G12 | KO | Altered hormone sensitivity | Increased sensitivity to ACC |
| | | OE | Altered necrosis | Leaf and hypocotyl necrosis |
| 1953 | G30 | OE | Altered leaf | Glossy green leaves |
| | | | Altered light response and/or shade tolerance | Increased shade tolerance; lack of shade avoidance phenotype |
| 1975 | G231 | OE | Altered leaf biochemistry | Increased leaf unsaturated fatty acids |
| | | | Altered seed oil | Increased seed oil content |
| | | | Altered seed protein | Decreased seed protein content |
| 1979 | G247 | OE | Altered trichomes | Altered trichome distribution, reduced trichome density |
| 1991 | G370 | KO | Altered size | Reduced size, shiny leaves |
| | | OE | Altered trichome | ectopic trichome formation |
| 2009 | G485 | OE | Altered flowering time | Early flowering |
| | | KO | Altered flowering time | Late flowering |
| 2061 | G839 | OE | Growth regulation; nutrient uptake | Increased tolerance to nitrogen-limited medium |
| 2099 | G1357 | OE | Altered leaf | Altered leaf shape, dark green leaves |
| | | | Increased tolerance to abiotic and hyperosmotic stress | Increased tolerance to cold |
| | | | | Insensitive to ABA |
| | | | Altered hormone sensitivity | Late flowering |
| | | | Altered flowering time | |
| 2126 | G1646 | OE | Altered seed oil | Increased seed oil content |
| 2142 | G1816 | OE | Altered sugar sensing | Increased tolerance to glucose |
| | | | Growth regulation; nutrient uptake | Altered C/N sensing; less anthocyanin on nitrogen-limited medium |
| | | | Increased tolerance to abiotic and hyperosmotic stress | Increased tolerance to hyperosmotic stress |
| | | | Altered root | Increased root hairs |
| | | | Altered trichomes | Glabrous leaves |
| | | | | Increased tolerance to nitrogen-limited medium |
| 2147 | G1888 | OE | Altered size | Reduced size, dark green leaves |
| 2153 | G1945 | OE | Altered flowering time | Late flowering |
| | | | Altered leaf | Altered leaf shape |
| 2195 | G2826 | OE | Altered flower | Aerial rosettes |
| | | | Altered trichomes | Ectopic trichome formation |
| 2197 | G2838 | OE | Altered trichomes | Increased trichome density |
| | | | Altered flowering time | Late flowering |
| | | | Altered flower | Flower: multiple alterations |
| | | | Leaves | Aerial rosettes |
| | | | Altered size | Dark green leaves |
| | | | | Increased seedling size |

TABLE 7-continued

Traits categories and effects of transcription factor genes that are overexpressed (OE) or knocked out (KO)

| Polynucleotide SEQ ID NO: | GID. | OE/KO | Trait Alterations | Observations |
|---|---|---|---|---|
| 2199 | G2839 | OE | Increased tolerance to abiotic and hyperosmotic stress<br>Altered inflorescence<br>Altered size | Better germination on high sucrose<br>Increased tolerance to drought<br>Downward pedicels<br>Reduced size |

Table 8 shows the polypeptides identified by SEQ ID NO; Gene ID (GID) No.; the transcription factor family to which the polypeptide belongs, and conserved domains of the polypeptide. The first column shows the polypeptide SEQ ID NO; the third column shows the transcription factor family to which the polynucleotide belongs; and the fourth column shows the amino acid residue positions of the conserved domain in amino acid (AA) co-ordinates.

TABLE 8

Gene families and conserved domains

| Polypeptide SEQ ID NO: | GID No. | Family | Conserved Domains in Amino Acid Coordinates |
|---|---|---|---|
| 4 | G19 | AP2 | 76-145 |
| 6 | G22 | AP2 | 89-157 |
| 10 | G28 | AP2 | 145-213 |
| 12 | G47 | AP2 | 11-80 |
| 38 | G226 | MYB-related | 34-69 |
| 60 | G353 | Z-C2H2 | 41-61, 84-104 |
| 62 | G354 | Z-C2H2 | 42-62, 88-109 |
| 88 | G481 | CAAT | 20-110 |
| 90 | G482 | CAAT | 26-116 |
| 2010 | G485 | CAAT | 20-110 |
| 94 | G489 | CAAT | 57-156 |
| 128 | G634 | TH | 62-147, 189-245 |
| 148 | G682 | MYB-related | 27-63 |
| 168 | G864 | AP2 | 119-186 |
| 170 | G867 | AP2 | 59-124 |
| 186 | G912 | AP2 | 51-118 |
| 188 | G913 | AP2 | 62-128 |
| 190 | G922 | SCR | 134-199, 332-401, 405-478 |
| 192 | G926 | CAAT | 131-225 |
| 200 | G975 | AP2 | 4-71 |
| 2516 | G1048 | bZIP | 138-190 |
| 222 | G1069 | AT-hook | 67-74 |
| 224 | G1073 | AT-hook | 33-42, 78-175 |
| 226 | G1075 | AT-hook | 78-85 |
| 2102 | G1364 | CAAT | 29-119 |
| 270 | G1411 | AP2 | 87-154 |
| 278 | G1451 | ARF | 22-357 |

TABLE 8-continued

Gene families and conserved domains

| Polypeptide SEQ ID NO: | GID No. | Family | Conserved Domains in Amino Acid Coordinates |
|---|---|---|---|
| 304 | G1543 | HB | 135-195 |
| 332 | G1792 | AP2 | 17-85 |
| 2142 | G1816 | MYB-related | 26-61 |
| 342 | G1820 | CAAT | 70-133 |
| 344 | G1836 | CAAT | 30-164 |
| 370 | G1930 | AP2 | 59-124 |
| 2608 | G1995 | Z-C2H2 | 93-113 |
| 408 | G2133 | AP2 | 11-83 |
| 418 | G2153 | AT-hook | 75-94, 162-206 |
| 420 | G2155 | AT-hook | 18-38 |
| 2172 | G2345 | CAAT | 28-118 |
| 440 | G2509 | AP2 | 89-156 |
| 450 | G2583 | AP2 | 4-71 |
| | G2718 | MYB-related | 28-64 |

Examples of some of the utilities that may be desirable in plants, and that may be provided by transforming the plants with the presently disclosed sequences, are listed in Table 9. Many of the transcription factors listed in Table 9 may be operably linked with a specific promoter that causes the transcription factor to be expressed in response to environmental, tissue-enhanced, tissue-specific or temporal signals. For example, G362 induces ectopic trichomes on flowers but also produces small plants. The former may be desirable to produce insect or herbivore resistance, or increased cotton yield, but the latter may be undesirable in that it may reduce biomass. However, by operably linking G362 with a flower-specific promoter, one may achieve the desirable benefits of the gene without affecting overall biomass to a significant degree. For examples of flower specific promoters, see Kaiser et al. (supra). For examples of other tissue-enhanced, tissue-specific, temporal-specific or inducible promoters, see the above discussion under the heading "Vectors, Promoters, and Expression Systems".

TABLE 9

Genes, traits and utilities that affect plant characteristics

| Trait Category | Phenotype(s) | Transcription factor genes that impact traits | Utility |
|---|---|---|---|
| Abiotic stress | Effect of chilling on plants<br>Increased tolerance: | G256; G664; G1322 | Improved germination, growth rate, earlier planting, yield |
| | Germination in cold<br>Increased tolerance: | G256; G664 | Earlier planting; improved survival, yield |
| | Freezing tolerance | G720 (G720 KO is more susceptible); G912; G913 | Earlier planting; improved quality, survival, yield |

TABLE 9-continued

Genes, traits and utilities that affect plant characteristics

| Trait Category | Phenotype(s) | Transcription factor genes that impact traits | Utility |
|---|---|---|---|
| | Drought | | |
| | Increased tolerance: | G47; G175; G188; G303; G325; G353; G481; G489; G634; G682; G864; G912; G913; G922; G975; G1069; G1452; G1792; G1820; G1836; G2053; G2110; G2133; G2140; G2505; G2701; G2776; G2789; G2839 | Improved survival, vigor, appearance, yield |
| | Heat | | |
| | Increased tolerance: | G464; G682; G864; G1305; G1841; G2130; G2430 | Improved germination, growth rate, later planting, yield |
| | Hyperosmotic stress | | |
| | Increased sensitivity: | G1794 | Abiotic stress response manipulation |
| | Increased tolerance: | G47; G175; G188; G303; G325; G353; G489; G922; G926; G1069; G1089; G1452; G1816; G1820; G1852; G1930; G2053; G2140; G2153; G2379; G2701; G2719; G2789; G2839 | Improved germination rate, seedling vigor, survival, yield |
| | Salt tolerance | | |
| | More susceptible: | G545 | Manipulation of response to high salt conditions |
| | Increased tolerance: | G22; G196; G226; G312; G482; G801; G867; G922; G1836; G2110 | Improved germination rate, survival, yield; extended growth range |
| | Nitrogen stress | | |
| | Sensitivity to N limitation: | G1794 | Manipulation of response to low nutrient conditions |
| | Tolerance to N limitation: | G225; G226; G839; G1792; G1816 | Improved yield and nutrient stress tolerance, decreased fertilizer usage |
| | Phosphate stress | | |
| | Tolerance to P limitation: | G545; G561; G911; G1946 | Improved yield and nutrient stress tolerance, decreased fertilizer usage |
| | Oxidative stress | G477 | Improved yield, quality, ultraviolet and chemical stress tolerance |
| Herbicide | Glyphosate | G343; G2133; G2517 | Generation of glyphosate-resistant plants to improve weed control |
| Hormone sensitivity | Abscisic acid (ABA) sensitivity | | |
| | Reduced sensitivity to ABA: | G546; G926; G1069; G1357; G1452; G1820; G2140; G2789 | Modification of seed development, improved seed dormancy, cold and dehydration tolerance |
| | Sensitivity to ethylene | | |
| | Altered response: | G1134 | Manipulation of fruit ripening |
| | Insensitive to ethylene: | G1330 | |
| Disease | *Botrytis* | | |
| | Increased susceptibility: | G248; G371; G1064; G1084; G1196; G1255; G1756; G1936; G2555 | Manipulation of response to disease organism |
| | Increased resistance or tolerance: | G28; G1792; G1880; G1919; G1950 | Improved yield, appearance, survival, extended range |
| | *Fusarium* | | |
| | Increased susceptibility: | G188; G545; G896 | Manipulation of response to disease organism |

TABLE 9-continued

Genes, traits and utilities that affect plant characteristics

| Trait Category | Phenotype(s) | Transcription factor genes that impact traits | Utility |
|---|---|---|---|
| | Increased resistance or tolerance: | G1047; G1792 | Improved yield, appearance, survival, extended range |
| | *Erysiphe* | | |
| | Increased susceptibility: | G545; G881 | Manipulation of response to disease organism |
| | Increased resistance or tolerance: | G19; G28; G409; G1266; G1363; G1792 | Improved yield, appearance, survival, extended range |
| | *Pseudomonas* | | |
| | Increased susceptibility: | G545 | Manipulation of response to disease organism |
| | *Sclerotinia* | | |
| | Increased susceptibility: | G278; G477; G594; G1936 | Manipulation of response to disease organism |
| | Increased resistance or tolerance: | G28; G1927 | Improved yield, appearance, survival, extended range |
| Growth regulator | Altered sugar sensing | | |
| | Decreased tolerance to sugars: | G241; G254; G567; G680; G912; G1804 | Alteration of energy balance, photosynthetic rate, carbohydrate accumulation, biomass production, source-sink relationships, senescence; alteration of storage compound accumulation in seeds |
| | Increased tolerance to sugars: | G481; G867; G1225; G1816 | |
| | Altered C/N sensing | G682; G226; G1816; G2718; G24; G545; G760; G937; G971; G988; G1069; G1322; G1587; G1666; G2117; G2131; G2520; G2789; G8; G27; G156; G183; G189; G234; G237; G347; G427; G590; G635; G657; G872; G904; G912; G932; G958; G964; G975; G979; G1049; G1246; G1255; G1266; G1331; G1332; G1494; G1649; G1750; G1816; G1835; G1930; G2053; G2057; G2133; G2144; G2145; G2295; G2512; G2535; G2719 | |
| Flowering time | Early flowering | G157; G180; G183; G485 (OE); G490; G590; G789; G1225; G1494; G1820; G1841; G1842; G1843; G1946; G2010; G2144; G2295; G2347; G2509 | Faster generation time; synchrony of flowering; additional harvests within a growing season, shortening of breeding programs |
| | Late flowering | G8; G47; G157; G192; G214; G231; G361; G362; G485 (KO); G562; G736; G748; G859; G910; G913; G971; G1051; G1052; G1357; G1452; G1478; G1804; G1895; G1945; G2007; G2133; G2155; G2838 | Increased yield or biomass, alleviate risk of transgenic pollen escape, synchrony of flowering |
| General development and morphology | Altered flower structure Stamen: | G988; G1075; G1140; G1499; G2557 | Ornamental modification of plant architecture, improved or reduced fertility to mitigate escape of transgenic pollen, improved fruit size, shape, number or yield |
| | Sepal: | G1075; G1140; G2557 | |
| | Petal: | G638; G1075; G1140; G1449; G1499; G2557 | |
| | Pedicel: | G353; G354; G988 | |
| | Carpel: | G1063; G1140; G2143; G2143; G2557 | |
| | Multiple alterations: | G638; G988; G1063; G1140; G1449; G1499; G2143; G2557 G988; G1449; G2838 | |
| | Enlarged floral organs: | G353; G354 | |
| | Siliques: | G470; G779; G988; G1075; G1140; G1499; G1947; G2143; G2557 | |

TABLE 9-continued

Genes, traits and utilities that affect plant characteristics

| Trait Category | Phenotype(s) | Transcription factor genes that impact traits | Utility |
|---|---|---|---|
| | Reduced fertility: Aerial rosettes Inflorescence architectural change | G638; G779; G1140; G1499 G1995; G2826; G2838 | |
| | Altered branching pattern: Short internodes/bushy inflorescences: Internode elongation: Lack of inflorescence: | G47; G1063; G1645; G2143 G47 G1063 G1499; G2143 | Ornamental modification of flower architecture; timing of flowering; altered plant habit for yield or harvestability benefit; reduction in pollen production of genetically modified plants; manipulation of seasonality and annual or perennial habit; manipulation of determinate vs. indeterminate growth |
| | Altered shoot meristem development Stem bifurcations: | G390; G391 | Ornamental modification of plant architecture, manipulation of growth and development, increase in leaf numbers, modulation of branching patterns to provide improved yield or biomass |
| | Altered branching pattern | G427; G568; G988; G1543; G1794 | Ornamental modification of plant architecture, improved lodging resistance |
| | Apical dominance Reduced apical dominance: | G47; G211; G1255; G1275; G1411; G1488; G1794; G2509 | Ornamental modification of plant architecture |
| | Altered trichome density; development, or structure Reduced or no trichomes: Ectopic trichomes/altered trichome development/cell fate: Increase in trichome number, size or density: | G225; G226; G247; G585; G676; G682; G1332; G1452; G1816 G247; G362; G370; G676; G2826 G362; G634; G838; G2838 | Ornamental modification of plant architecture, increased plant product (e.g., diterpenes, cotton) productivity, insect and herbivore resistance |
| | Stem morphology and altered vascular tissue structure | G47; G438; G748; G988; G1488 | Modulation of lignin content; improvement of wood, palatability of fruits and vegetables |
| | Root development Increased root growth and proliferation: Increased root hairs: Altered seed development, ripening and germination Cell differentiation and cell proliferation | G1482 G225; G226; G1816 G979 G1540 | Improved yield, stress tolerance; anchorage Increase in carpel or fruit development; improve regeneration of shoots from callus in transformation or micro-propagation systems |
| | Rapid development | G2430 | Promote faster development and reproduction in plants |
| | Senescence Premature senescence: | G636; G1463; G1944 | Improvement in response to disease, fruit ripening |

TABLE 9-continued

Genes, traits and utilities that affect plant characteristics

| Trait Category | Phenotype(s) | Transcription factor genes that impact traits | Utility |
|---|---|---|---|
| | Lethality when overexpressed | G877; G1519 | Herbicide target; ablation of specific tissues or organs such as stamen to prevent pollen escape |
| | Necrosis | G12, G24 | Disease resistance |
| Plant size | Increased plant size | G1073; G1451 | Improved yield, biomass, appearance |
| | Larger seedlings | G2346; G2838 | Increased survival and vigor of seedlings, yield |
| | Dwarfed or more compact plants | G24; G343; G353; G354; G362; G370; G1008; G1277; G1543; G1794; G1958 | Dwarfism, lodging resistance, manipulation of gibberellin responses |
| Leaf morphology | Dark green leaves | G674; G912; G1063; G1357; G1452; G1482; G1499; G1792; G1863; G1888; G2143; G2557; G2838 | Increased photosynthesis, biomass, appearance, yield |
| | Change in leaf shape | G211; G353; G674; G736; G1063; G1146; G1357; G1452; G1494; G1543; G1863; G2143; G2144 | Ornamental applications |
| | Altered leaf size: Increased leaf size, number or mass: | G189; G214; G1451; G2430 | Increased yield, ornamental applications |
| | Light green leaves | G1494; G2144 | Ornamental applications |
| | Variegation | G635 | Ornamental applications |
| | Glossy leaves | G30; G1792; G2583 | Ornamental applications, manipulation of wax composition, amount, or distribution |
| Seed morphology | Altered seed coloration | G156; G2105; G2085 | Appearance |
| | Seed size and shape Increased seed size: | G450; G584; G1255; G2085; G2105; G2114 | Yield, appearance |
| | Decreased seed size: | G1040 | Appearance |
| | Altered seed shape: | G1040; G1062 | Appearance |
| Leaf biochemistry | Increased leaf wax | G975; G1792; G2583 | Insect, pathogen resistance |
| | Leaf prenyl lipids Reduced chlorophyll: | G987 | |
| | Increase in tocopherols | G652; G987; G2509 | |
| | Increased lutein content | G748 | |
| | Increase in chlorophyll or carotenoids: | G214; G1543 | |
| | Leaf insoluble sugars Increase in leaf xylose | G211 | |
| | Increased leaf anthocyanins | G663; G1482; G1888 | |
| | Leaf fatty acids Reduction in leaf fatty acids: | G987 | |
| | Increase in leaf fatty acids: | G214 | |
| Seed biochemistry | Seed oil content Increased oil content: | G162; G291; G427; G509; G519; G561; G590; G598; G629; G715; G849; G961; G1198; G1226; G1471; G1478; G1526; G1640; G1646; G1750; G1765; G1777; G1793; G1838; G1902; G1946; G1948; G1958, G2123; G2138; G2343; G2830 | Improved oil yield Reduced caloric content |
| | Decreased oil content: | G180; G192; G241; G504; G1143; G1229; G1323; G1543; G2509 | |
| | Altered oil content: | G567; G892; G974; G1451; G1496; G1646; G1672; G1677 | |
| | Altered fatty acid content: Seed protein content | G869; G1417; G2192 | |
| | Increased protein content: | G162; G226; G241; G509; G988; G1323; G1419; G1652; G1818; G1820; G1958; G2117; G2509 | Improved protein yield, nutritional value Reduced caloric content |
| | Decreased protein content: | G427; G1478; G1777; G1903; G1946 | |

TABLE 9-continued

Genes, traits and utilities that affect plant characteristics

| Trait Category | Phenotype(s) | Transcription factor genes that impact traits | Utility |
|---|---|---|---|
| | Altered protein content: | G162; G567; G597; G849; G892; G1634; G1637; G1677 | |
| | Altered seed prenyl lipid content or composition | G652; G2509; G2520 | Improved antioxidant and vitamin E content |
| | Seed glucosinolate Altered profile: | G484; G2340 | |
| | Increased seed anthocyanins | G362; G663 | |
| Root Biochemistry | Increased root anthocyanins | G663 | |
| Light response/shade tolerance | Altered cotyledon, hypocotyl, petiole development; altered leaf orientation; constitutive photomorphogenesis; photomorphogenesis in low light | G183; G354; G634; G1048; G1322; G1331; G1412; G1488; G1494; G1794; G1995, G2144; G2505; G2555; G2789; | Improved shade tolerance: potential for increased planting densities and yield enhancement |
| Pigment | Increased anthocyanin level | G362; G663; G1482 | Enhanced health benefits, improved ornamental appearance, increased stress resistance, attraction of pollinating and seed-dispersing animals |

Abbreviations:
N = nitrogen
P = phosphate
ABA = abscisic acid
C/N = carbon/nitrogen balance Detailed Description of Genes, Traits and Utilities that Affect Plant Characteristics The following descriptions of traits and utilities associated with the present transcription factors offer a more comprehensive description than that provided in Table 9.

Abiotic Stress, General Considerations

Plant transcription factors can modulate gene expression, and, in turn, be modulated by the environmental experience of a plant. Significant alterations in a plant's environment invariably result in a change in the plant's transcription factor gene expression pattern. Altered transcription factor expression patterns generally result in phenotypic changes in the plant. Transcription factor gene product(s) in transgenic plants then differ(s) in amounts or proportions from that found in wild-type or non-transformed plants, and those transcription factors likely represent polypeptides that are used to alter the response to the environmental change. By way of example, it is well accepted in the art that analytical methods based on altered expression patterns may be used to screen for phenotypic changes in a plant far more effectively than can be achieved using traditional methods.

Abiotic Stress: Adult Stage Chilling.

Enhanced chilling tolerance may extend the effective growth range of chilling sensitive crop species by allowing earlier planting or later harvest. Improved chilling tolerance may be conferred by increased expression of glycerol-3-phosphate acetyltransferase in chloroplasts (see, for example, Wolter et al. (1992) et al. *EMBO J.* 4685-4692, and Murata et al. (1992) *Nature* 356: 710-713).

Chilling tolerance could also serve as a model for understanding how plants adapt to water deficit. Both chilling and water stress share similar signal transduction pathways and tolerance/adaptation mechanisms. For example, acclimation to chilling temperatures can be induced by water stress or treatment with abscisic acid. Genes induced by low temperature include dehydrins (or LEA proteins). Dehydrins are also induced by salinity, abscisic acid, water stress, and during the late stages of embryogenesis.

Another large impact of chilling occurs during post-harvest storage. For example, some fruits and vegetables do not store well at low temperatures (for example, bananas, avocados, melons, and tomatoes). The normal ripening process of the tomato is impaired if it is exposed to cool temperatures. Transcription factor genes conferring resistance to chilling temperatures, including G256, G664, and G1322 may thus enhance tolerance during post-harvest storage.

Abiotic Stress: Cold Germination.

Several of the presently disclosed transcription factor genes confer better germination and growth in cold conditions. For example, the improved germination in cold conditions seen with G256 and G664 indicates a role in regulation of cold responses by these genes and their equivalogs. These genes might be engineered to manipulate the response to low temperature stress. Genes that would allow germination and seedling vigor in the cold would have highly significant utility in allowing seeds to be planted earlier in the season with a high rate of survival. Transcription factor genes that confer better survival in cooler climates allow a grower to move up planting time in the spring and extend the growing season further into autumn for higher crop yields. Germination of seeds and survival at temperatures significantly below that of the mean temperature required for germination of seeds and survival of non-transformed plants would increase the potential range of a crop plant into regions in which it would otherwise fail to thrive.

Abiotic Stress: Freezing Tolerance and Hyperosmotic Stress.

Presently disclosed transcription factor genes, including G47, G175, G188, G303, G325, G353, G489, G922, G926, G1069, G1089, G1452, G1820, G1852, G1930, G2053, G2140, G2153, G2379, G2701, G2719, G2789, G2839 and their equivalogs, that increase germination rate and/or growth under adverse hyperosmotic conditions, could impact survival and yield of seeds and plants. Osmotic stresses may be regulated by specific molecular control mechanisms that include genes controlling water and ion movements, functional and structural stress-induced proteins, signal perception and transduction, and free radical scavenging, and many others (Wang et al. (2001) *Acta Hort.* (ISHS) 560: 285-292). Instigators of hyperosmotic stress include freezing, drought and high salinity, each of which are discussed in more detail below.

In many ways, freezing, high salt and drought have similar effects on plants, not the least of which is the induction of common polypeptides that respond to these different stresses. For example, freezing is similar to water deficit in that freezing reduces the amount of water available to a plant. Exposure to freezing temperatures may lead to cellular dehydration as water leaves cells and forms ice crystals in intercellular spaces (Buchanan, supra). As with high salt concentration and freezing, the problems for plants caused by low water availability include mechanical stresses caused by the withdrawal of cellular water. Thus, the incorporation of transcription factors that modify a plant's response to hyperosmotic stress or improve tolerance to (e.g., by G720, G912, G913 or their equivalogs) into, for example, a crop or ornamental plant, may be useful in reducing damage or loss. Specific effects caused by freezing, high salt and drought are addressed below.

Abiotic Stress: Drought and Low Humidity Tolerance.

Exposure to dehydration invokes similar survival strategies in plants as does freezing stress (see, for example, Yelenosky (1989) *Plant Physiol* 89: 444-451) and drought stress induces freezing tolerance (see, for example, Siminovitch et al. (1982) *Plant Physiol* 69: 250-255; and Guy et al. (1992) *Planta* 188: 265-270). In addition to the induction of cold-acclimation proteins, strategies that allow plants to survive in low water conditions may include, for example, reduced surface area, or surface oil or wax production. A number of presently disclosed transcription factor genes, e.g., G912, G913, G1820, G1836 and G2505 increase a plant's tolerance to low water conditions and, along with their functional equivalogs, would provide the benefits of improved survival, increased yield and an extended geographic and temporal planting range.

Abiotic Stress: Heat Stress Tolerance.

The germination of many crops is also sensitive to high temperatures. Presently disclosed transcription factor genes that provide increased heat tolerance, including G464, G682, G864, G1305, G1841, G2130, G2430 and their equivalogs, would be generally useful in producing plants that germinate and grow in hot conditions, may find particular use for crops that are planted late in the season, or extend the range of a plant by allowing growth in relatively hot climates.

Abiotic Stress: Salt.

The genes in Table 9 that provide tolerance to salt may be used to engineer salt tolerant crops and trees that can flourish in soils with high saline content or under drought conditions. In particular, increased salt tolerance during the germination stage of a plant enhances survival and yield. Presently disclosed transcription factor genes, including G22, G196, G226, G312, G482, G801, G867, G922, G1836, G2110, and their equivalogs that provide increased salt tolerance during germination, the seedling stage, and throughout a plant's life cycle, would find particular value for imparting survival and yield in areas where a particular crop would not normally prosper.

Nutrient Uptake and Utilization: Nitrogen and Phosphorus.

Presently disclosed transcription factor genes introduced into plants provide a means to improve uptake of essential nutrients, including nitrogenous compounds, phosphates, potassium, and trace minerals. The enhanced performance of, for example, G225, G226, G839, G1792, and other overexpressing lines under low nitrogen, and G545, G561, G911, G1946 under low phosphorous conditions indicate that these genes and their equivalogs can be used to engineer crops that could thrive under conditions of reduced nutrient availability. Phosphorus, in particular, tends to be a limiting nutrient in soils and is generally added as a component in fertilizers. Young plants have a rapid intake of phosphate and sufficient phosphate is important for yield of root crops such as carrot, potato and parsnip.

The effect of these modifications is to increase the seedling germination and range of ornamental and crop plants. The utilities of presently disclosed transcription factor genes conferring tolerance to conditions of low nutrients also include cost savings to the grower by reducing the amounts of fertilizer needed, environmental benefits of reduced fertilizer runoff into watersheds; and improved yield and stress tolerance. In addition, by providing improved nitrogen uptake capability, these genes can be used to alter seed protein amounts and/or composition in such a way that could impact yield as well as the nutritional value and production of various food products.

A number of the transcription factor-overexpressing lines make less anthocyanin on high sucrose plus glutamine indicates that these genes can be used to modify carbon and nitrogen status, and hence assimilate partitioning (assimilate partitioning refers to the manner in which an essential element, such as nitrogen, is distributed among different pools inside a plant, generally in a reduced form, for the purpose of transport to various tissues).

Increased Tolerance of Plants to Oxidative Stress.

In plants, as in all living things, abiotic and biotic stresses induce the formation of oxygen radicals, including superoxide and peroxide radicals. This has the effect of accelerating senescence, particularly in leaves, with the resulting loss of yield and adverse effect on appearance. Generally, plants that have the highest level of defense mechanisms, such as, for example, polyunsaturated moieties of membrane lipids, are most likely to thrive under conditions that introduce oxidative stress (e.g., high light, ozone, water deficit, particularly in combination). Introduction of the presently disclosed transcription factor genes, including G477 and its equivalogs, that increase the level of oxidative stress defense mechanisms would provide beneficial effects on the yield and appearance of plants. One specific oxidizing agent, ozone, has been shown to cause significant foliar injury, which impacts yield and appearance of crop and ornamental plants. In addition to reduced foliar injury that would be found in ozone resistant plant created by transforming plants with some of the presently disclosed transcription factor genes, the latter have also been shown to have increased chlorophyll fluorescence (Yu-Sen Chang et al. (2001) *Bot. Bull. Acad. Sin.* 42: 265-272).

Decreased Herbicide Sensitivity.

Presently disclosed transcription factor genes, including G343, G2133, G2517 and their equivalogs, that confer resistance or tolerance to herbicides (e.g., glyphosate) will find use in providing means to increase herbicide applications without detriment to desirable plants. This would allow for the increased use of a particular herbicide in a local environment, with the effect of increased detriment to undesirable species and less harm to transgenic, desirable cultivars.

Knockouts of a number of the presently disclosed transcription factor genes have been shown to be lethal to developing embryos. Thus, these genes are potentially useful as herbicide targets.

Hormone Sensitivity.

ABA plays regulatory roles in a host of physiological processes in all higher as well as in lower plants (Davies et al. (1991) Abscisic Acid: Physiology and Biochemistry. Bios Scientific Publishers, Oxford, UK; Zeevaart et al. (1988) *Ann Rev Plant Physiol. Plant Mol. Biol.* 49: 439-473; Shimizu-Sato et al. (2001) *Plant Physiol* 127: 1405-1413). ABA mediates stress tolerance responses in higher plants, is a key signal compound that regulates stomatal aperture and, in concert with other plant signaling compounds, is implicated in mediating responses to pathogens and wounding or oxidative damage (for example, see Larkindale et al. (2002) *Plant Physiol.* 128: 682-695). In seeds, ABA promotes seed development, embryo maturation, synthesis of storage products (proteins and lipids), desiccation tolerance, and is involved in maintenance of dormancy (inhibition of germination), and apoptosis (Zeevaart et al. (1988) *Ann Rev Plant Physiol. Plant Mol. Biol.* 49: 439-473; Davies (1991), supra; Thomas (1993) *Plant Cell* 5: 1401-1410; and Bethke et al. (1999) *Plant Cell* 11: 1033-1046). ABA also affects plant architecture, including root growth and morphology and root-to-shoot ratios. ABA action and metabolism is modulated not only by environmental signals but also by endogenous signals generated by metabolic feedback, transport, hormonal cross-talk and developmental stage. Manipulation of ABA levels, and hence by extension the sensitivity to ABA, has been described as a very promising means to improve productivity, performance and architecture in plants Zeevaart (1999) in: Biochemistry and Molecular Biology of Plant Hormones, Hooykaas et al. eds, Elsevier Science pp 189-207; and Cutler et al. (1999) *Trends Plant Sci.* 4: 472-478).

A number of the presently disclosed transcription factor genes affect plant abscisic acid (ABA) sensitivity, including G546, G926, 1069, G1357, G1452, G1820, G2140, G2789. Thus, by affecting ABA sensitivity, these introduced transcription factor genes and their equivalogs would affect cold, drought, oxidative and other stress sensitivities, plant architecture, and yield.

Several other of the present transcription factor genes have been used to manipulate ethylene signal transduction and response pathways. These genes can thus be used to manipulate the processes influenced by ethylene, such as seed germination or fruit ripening, and to improve seed or fruit quality.

Diseases, Pathogens and Pests.

A number of the presently disclosed transcription factor genes have been shown to or are likely to affect a plants response to various plant diseases, pathogens and pests. The offending organisms include fungal pathogens *Fusarium oxysporum, Botrytis cinerea, Sclerotinia sclerotiorum,* and *Erysiphe orontii*. Bacterial pathogens to which resistance may be conferred include *Pseudomonas syringae*. Other problem organisms may potentially include nematodes, mollicutes, parasites, or herbivorous arthropods. In each case, one or more transformed transcription factor genes may provide some benefit to the plant to help prevent or overcome infestation, or be used to manipulate any of the various plant responses to disease. These mechanisms by which the transcription factors work could include increasing surface waxes or oils, surface thickness, or the activation of signal transduction pathways that regulate plant defense in response to attacks by herbivorous pests (including, for example, protease inhibitors). Another means to combat fungal and other pathogens is by accelerating local cell death or senescence, mechanisms used to impair the spread of pathogenic microorganisms throughout a plant. For instance, the best known example of accelerated cell death is the resistance gene-mediated hypersensitive response, which causes localized cell death at an infection site and initiates a systemic defense response. Because many defenses, signaling molecules, and signal transduction pathways are common to defense against different pathogens and pests, such as fungal, bacterial, oomycete, nematode, and insect, transcription factors that are implicated in defense responses against the fungal pathogens tested may also function in defense against other pathogens and pests. These transcription factors include, for example, G28, G1792, G1880, G1919, G1950 (improved resistance or tolerance to *Botrytis*), G1047, G1792 (improved resistance or tolerance to *Fusarium*), G19, G28, G409, G1266, G1363, G1792 (improved resistance or tolerance to *Erysiphe*), G545 (improved resistance or tolerance to *Pseudomonas*), G28, G1927 (improved resistance or tolerance to *Sclerotinia*), and their equivalogs.

Growth Regulator: Sugar Sensing.

In addition to their important role as an energy source and structural component of the plant cell, sugars are central regulatory molecules that control several aspects of plant physiology, metabolism and development (Hsieh et al. (1998) *Proc. Natl. Acad. Sci.* 95: 13965-13970). It is thought that this control is achieved by regulating gene expression and, in higher plants, sugars have been shown to repress or activate plant genes involved in many essential processes such as photosynthesis, glyoxylate metabolism, respiration, starch and sucrose synthesis and degradation, pathogen response, wounding response, cell cycle regulation, pigmentation, flowering and senescence. The mechanisms by which sugars control gene expression are not understood.

Because sugars are important signaling molecules, the ability to control either the concentration of a signaling sugar or how the plant perceives or responds to a signaling sugar could be used to control plant development, physiology or metabolism. For example, the flux of sucrose (a disaccharide sugar used for systemically transporting carbon and energy in most plants) has been shown to affect gene expression and alter storage compound accumulation in seeds. Manipulation of the sucrose signaling pathway in seeds may therefore cause seeds to have more protein, oil or carbohydrate, depending on the type of manipulation. Similarly, in tubers, sucrose is converted to starch which is used as an energy store. It is thought that sugar signaling pathways may partially determine the levels of starch synthesized in the tubers. The manipulation of sugar signaling in tubers could lead to tubers with a higher starch content.

Thus, the presently disclosed transcription factor genes that manipulate the sugar signal transduction pathway, including G241, G254, G567, G680, G912, G1804, G481, G867, G1225, along with their equivalogs, may lead to altered gene expression to produce plants with desirable traits. In particular, manipulation of sugar signal transduction pathways could be used to alter source-sink relationships in seeds, tubers, roots and other storage organs leading to increase in yield.

Growth Regulator: C/N Sensing.

Nitrogen and carbon metabolism are tightly linked in almost every biochemical pathway in the plant. Carbon metabolites regulate genes involved in N acquisition and metabolism, and are known to affect germination and the expression of photosynthetic genes (Coruzzi et al. (2001) *Plant Physiol.* 125: 61-64) and hence growth. Early studies on nitrate reductase (NR) in 1976 showed that NR activity could be affected by Glc/Suc (Crawford (1995) *Plant Cell* 7: 859-886; Daniel-Vedele et al. (1996) *CR Acad Sci Paris* 319: 961-968). Those observations were supported by later experiments that showed sugars induce NR mRNA in dark-adapted, green seedlings (Cheng C L, et al. (1992) *Proc Natl Acad Sci USA* 89: 1861-1864). C and N may have antagonistic relationships as signaling molecules; light induction of NR activity and mRNA levels can be mimicked by C metabolites and N-metabolites cause repression of NR induction in tobacco (Vincentz et al. (1992) *Plant J* 3: 315-324). Gene regulation by C/N status has been demonstrated for a number of N-metabolic genes (Stitt (1999) *Curr. Opin. Plant. Biol.* 2: 178-186); Coruzzi et al. (2001) supra). Thus, transcription factor genes that affect C/N sensing, such as G1816, can be used to alter or improve germination and growth under nitrogen-limiting conditions.

Flowering Time: Early and Late Flowering.

Presently disclosed transcription factor genes that accelerate flowering, which include G157, G180, G183, G485, G490, G590, G789, G1225, G1494, G1820, G1841, G1842, G1843, G1946, G2010, G2144, G2295, G2347, G2509, and their functional equivalogs, could have valuable applications in such programs, since they allow much faster generation times. In a number of species, for example, broccoli, cauliflower, where the reproductive parts of the plants constitute the crop and the vegetative tissues are discarded, it would be advantageous to accelerate time to flowering. Accelerating flowering could shorten crop and tree breeding programs. Additionally, in some instances, a faster generation time would allow additional harvests of a crop to be made within a given growing season. A number of *Arabidopsis* genes have already been shown to accelerate flowering when constitutively expressed. These include LEAFY, APETALA1 and CONSTANS (Mandel et al. (1995) *Nature* 377: 522-524; Weigel and Nilsson (1995) *Nature* 377: 495-500; Simon et al. (1996) *Nature* 384: 59-62).

By regulating the expression of potential flowering using inducible promoters, flowering could be triggered by application of an inducer chemical. This would allow flowering to be synchronized across a crop and facilitate more efficient harvesting. Such inducible systems could also be used to tune the flowering of crop varieties to different latitudes. At present, species such as soybean and cotton are available as a series of maturity groups that are suitable for different latitudes on the basis of their flowering time (which is governed by day-length). A system in which flowering could be chemically controlled would allow a single high-yielding northern maturity group to be grown at any latitude. In southern regions such plants could be grown for longer periods before flowering was induced, thereby increasing yields. In more northern areas, the induction would be used to ensure that the crop flowers prior to the first winter frosts.

In a sizeable number of species, for example, root crops, where the vegetative parts of the plants constitute the crop and the reproductive tissues are discarded, it is advantageous to identify and incorporate transcription factor genes that delay or prevent flowering in order to prevent resources being diverted into reproductive development. For example, G8, G47, G157, G192, G214, G231; G361, G362, G562, G736, G748, G859, G910, G913, G971, G1051, G1052, G1357, G1452, G1478, G1804, G1895, G1945, G2007, G2133, G2155, G2838 and equivalogs, delay flowering time in transgenic plants. Extending vegetative development with presently disclosed transcription factor genes could thus bring about large increases in yields. Prevention of flowering can help maximize vegetative yields and prevent escape of genetically modified organism (GMO) pollen.

Presently disclosed transcription factors that extend flowering time have utility in engineering plants with longer-lasting flowers for the horticulture industry, and for extending the time in which the plant is fertile.

A number of the presently disclosed transcription factors may extend flowering time, and delay flower abscission, which would have utility in engineering plants with longer-lasting flowers for the horticulture industry. This would provide a significant benefit to the ornamental industry, for both cut flowers and woody plant varieties (of, for example, maize), as well as have the potential to lengthen the fertile period of a plant, which could positively impact yield and breeding programs.

General Development and Morphology: Flower Structure and Inflorescence: Architecture, Altered Flower Organs, Reduced Fertility, Multiple Alterations, Aerial Rosettes, Branching, Internode Distance, Terminal Flowers and Phase Change.

Presently disclosed transgenic transcription factors such as G353; G354, G638; G779; G988; G1063; G1075; G1140; G1449; G1499; G2143; G2557, G2838, G2839 and their equivalogs, may be used to create plants with larger flowers or arrangements of flowers that are distinct from wild-type or non-transformed cultivars. This would likely have the most value for the ornamental horticulture industry, where larger flowers or interesting floral configurations are generally preferred and command the highest prices.

Flower structure may have advantageous or deleterious effects on fertility, and could be used, for example, to decrease fertility by the absence, reduction or screening of reproductive components. In fact, plants that overexpress a sizable number of the presently disclosed transcription factor genes e.g., G470, G779, G988, G1075, G1140, G1499, G1947, G2143, G2557 and their functional equivalogs, possess reduced fertility; flowers are infertile and fail to yield seed. These could be desirable traits, as low fertility could be exploited to prevent or minimize the escape of the pollen of genetically modified organisms (GMOs) into the environment.

The alterations in shoot architecture seen in the lines transformed with G47, G1063, G1645, G2143, and their functional equivalogs indicates that these genes and their equivalogs can be used to manipulate inflorescence branching patterns. This could influence yield and offer the potential for more effective harvesting techniques. For example, a "self pruning" mutation of tomato results in a determinate growth pattern and facilitates mechanical harvesting (Pnueli et al. (2001) *Plant Cell* 13(12): 2687-702).

One interesting application for manipulation of flower structure, for example, by introduced transcription factors could be in the increased production of edible flowers or flower parts, including saffron, which is derived from the stigmas of *Crocus sativus*.

Genes that later silique conformation in brassicates may be used to modify fruit ripening processes in brassicates and other plants, which may positively affect seed or fruit quality.

A number of the presently disclosed transcription factors may affect the timing of phase changes in plants. Since the timing or phase changes generally affects a plant's eventual size, these genes may prove beneficial by providing means for improving yield and biomass.

General Development and Morphology: Shoot Meristem and Branching Patterns.

Several of the presently disclosed transcription factor genes, including G390 and G391, and G1794, when introduced into plants, have been shown to cause stem bifurcations in developing shoots in which the shoot meristems split to form two or three separate shoots. These transcription factors and their functional equivalogs may thus be used to manipulate branching. This would provide a unique appearance, which may be desirable in ornamental applications, and may be used to modify lateral branching for use in the forestry industry. A reduction in the formation of lateral branches could reduce knot formation. Conversely, increasing the number of lateral branches could provide utility when a plant is used as a view- or windscreen.

General Development and Morphology: Apical Dominance:

The modified expression of presently disclosed transcription factors (e.g., G47, G211, G1255, G1275, G1411, G1488, G1794, G2509 and their equivalogs) that reduce apical dominance could be used in ornamental horticulture, for example, to modify plant architecture, for example, to produce a shorter, more bushy stature than wild type. The latter form would have ornamental utility as well as provide increased resistance to lodging.

General Development and Morphology: Trichome Density, Development or Structure.

Several of the presently disclosed transcription factor genes have been used to modify trichome number, density, trichome cell fate, amount of trichome products produced by plants, or produce ectopic trichome formation. These include G225; G226, G247; G362, G370; G585, G634, G676, G682, G1332, G1452, G1995, G2826, and G2838. In most cases where the metabolic pathways are impossible to engineer, increasing trichome density or size on leaves may be the only way to increase plant productivity. Thus, by increasing trichome density, size or type, these trichome-affecting genes and their functional equivalogs would have profound utilities in molecular farming practices by making use of trichomes as a manufacturing system for complex secondary metabolites.

Trichome glands on the surface of many higher plants produce and secrete exudates that give protection from the elements and pests such as insects, microbes and herbivores. These exudates may physically immobilize insects and spores, may be insecticidal or ant-microbial or they may act as allergens or irritants to protect against herbivores. By modifying trichome location, density or activity with presently disclosed transcription factors that modify these plant characteristics, plants that are better protected and higher yielding may be the result.

A potential application for these trichome-affecting genes and their equivalogs also exists in cotton: cotton fibers are modified unicellular trichomes that develop from the outer ovule epidermis. In fact, only about 30% of these epidermal cells develop into trichomes, but all have the potential to develop a trichome fate. Trichome-affecting genes can trigger an increased number of these cells to develop as trichomes and thereby increase the yield of cotton fibers. Since the mallow family is closely related to the Brassica family, genes involved in trichome formation will likely have homologs in cotton or function in cotton.

If the effects on trichome patterning reflect a general change in heterochronic processes, trichome-affecting transcription factors or their equivalogs can be used to modify the way meristems and/or cells develop during different phases of the plant life cycle. In particular, altering the timing of phase changes could afford positive effects on yield and biomass production.

General Development and Morphology: Stem Morphology and Altered Vascular Tissue Structure.

Plants transformed with transcription factor genes that modify stem morphology or lignin content may be used to affect overall plant architecture and the distribution of lignified fiber cells within the stem.

Modulating lignin content might allow the quality of wood used for furniture or construction to be improved. Lignin is energy rich; increasing lignin composition could therefore be valuable in raising the energy content of wood used for fuel. Conversely, the pulp and paper industries seek wood with a reduced lignin content. Currently, lignin must be removed in a costly process that involves the use of many polluting chemicals. Consequently, lignin is a serious barrier to efficient pulp and paper production (Tzfira et al. (1998) TIBTECH 16: 439-446; Robinson (1999) Nature Biotechnology 17: 27-30). In addition to forest biotechnology applications, changing lignin content by selectively expressing or repressing transcription factors in fruits and vegetables might increase their palatability.

Transcription factors that modify stem structure, including G47, G438, G748, G988, G1488 and their equivalogs, may also be used to achieve reduction of higher-order shoot development, resulting in significant plant architecture modification. Overexpression of the genes that encode these transcription factors in woody plants might result in trees that lack side branches, and have fewer knots in the wood. Altering branching patterns could also have applications amongst ornamental and agricultural crops. For example, applications might exist in any species where secondary shoots currently have to be removed manually, or where changes in branching pattern could increase yield or facilitate more efficient harvesting.

General Development and Morphology: Altered Root Development.

By modifying the structure or development of roots by transforming into a plant one or more of the presently disclosed transcription factor genes, including G225, G226, G1482, and their equivalogs, plants may be produced that have the capacity to thrive in otherwise unproductive soils. For example, grape roots extending further into rocky soils would provide greater anchorage, greater coverage with increased branching, or would remain viable in waterlogged soils, thus increasing the effective planting range of the crop and/or increasing yield and survival. It may be advantageous to manipulate a plant to produce short roots, as when a soil in which the plant will be growing is occasionally flooded, or when pathogenic fungi or disease-causing nematodes are prevalent.

General Development and Morphology: Seed Development, Ripening and Germination Rate.

A number of the presently disclosed transcription factor genes (e.g., G979) have been shown to modify seed development and germination rate, including when the seeds are in conditions normally unfavorable for germination (e.g., cold, heat or salt stress, or in the presence of ABA), and may, along with functional equivalogs, thus be used to modify and improve germination rates under adverse conditions.

General Development and Morphology: Cell Differentiation and Cell Proliferation.

Several of the disclosed transcription factors regulate cell proliferation and/or differentiation, including G1540 and its functional equivalogs. Control of these processes could have valuable applications in plant transformation, cell culture or micro-propagation systems, as well as in control of the proliferation of particular useful tissues or cell types. Transcription factors that induce the proliferation of undifferentiated cells can be operably linked with an inducible promoter to promote the formation of callus that can be used for transformation or production of cell suspension cultures. Transcription factors that prevent cells from differentiating, such as G1540 or its equivalogs, could be used to confer stem cell identity to cultured cells. Transcription factors that promote differentiation of shoots could be used in transformation or micro-propagation systems, where regeneration of shoots from callus is currently problematic. In addition, transcription factors that regulate the differentiation of specific tissues could be used to increase the proportion of these tissues in a plant. Genes that promote the differentiation of carpel tissue could be introduced into commercial species to induce formation of increased numbers of carpels or fruits. A particular application might exist in saffron, one of the world's most expensive spices. Saffron filaments, or threads, are actually the dried stigmas of the saffron flower, *Crocus sativus* Linneaus. Each flower contains only three stigmas, and more than 75,000 of these flowers are needed to produce just one pound of saffron filaments. An increase in carpel number would increase the quantity of stigmatic tissue and improve yield.

General Development and Morphology: Cell Expansion.

Plant growth results from a combination of cell division and cell expansion. Transcription factors may be useful in regulation of cell expansion. Altered regulation of cell expansion could affect stem length, an important agronomic characteristic. For instance, short cultivars of wheat contributed to the Green Revolution, because plants that put fewer resources into stem elongation allocate more resources into developing seed and produce higher yield. These plants are also less vulnerable to wind and rain damage. These cultivars were found to be altered in their sensitivity to gibberellins, hormones that regulate stem elongation through control of both cell expansion and cell division. Altered cell expansion in leaves could also produce novel and ornamental plant forms.

General Development and Morphology: Phase Change and Floral Reversion.

Transcription factors that regulate phase change can modulate the developmental programs of plants and regulate developmental plasticity of the shoot meristem. In particular, these genes might be used to manipulate seasonality and influence whether plants display an annual or perennial habit.

General Development and Morphology: Rapid Development.

A number of the presently disclosed transcription factor genes, including G2430, have been shown to have significant effects on plant growth rate and development. These observations have included, for example, more rapid or delayed growth and development of reproductive organs. Thus, by causing more rapid development, G2430 and its functional equivalogs would prove useful for regions with short growing seasons; other transcription factors that delay development may be useful for regions with longer growing seasons. Accelerating plant growth would also improve early yield or increase biomass at an earlier stage, when such is desirable (for example, in producing forestry products or vegetable sprouts for consumption). Transcription factors that promote faster development such as G2430 and its functional equivalogs may also be used to modify the reproductive cycle of plants.

General Development and Morphology: Slow Growth Rate.

A number of the presently disclosed transcription factor genes, including G652 and G1335, have been shown to have significant effects on retarding plant growth rate and development. These observations have included, for example, delayed growth and development of reproductive organs. Slow growing plants may be highly desirable to ornamental horticulturists, both for providing house plants that display little change in their appearance over time, or outdoor plants for which wild-type or rapid growth is undesirable (e.g., ornamental palm trees). Slow growth may also provide for a prolonged fruiting period, thus extending the harvesting season, particularly in regions with long growing seasons. Slow growth could also provide a prolonged period in which pollen is available for improved self- or cross-fertilization, or cross-fertilization of cultivars that normally flower over non-overlapping time periods. The latter aspect may be particularly useful to plants comprising two or more distinct grafted cultivars (e.g., fruit trees) with normally non-overlapping flowering periods.

General Development and Morphology: Senescence.

Presently disclosed transcription factor genes may be used to alter senescence responses in plants. Although leaf senescence is thought to be an evolutionary adaptation to recycle nutrients, the ability to control senescence in an agricultural setting has significant value. For example, a delay in leaf senescence in some maize hybrids is associated with a significant increase in yields and a delay of a few days in the senescence of soybean plants can have a large impact on yield. In an experimental setting, tobacco plants engineered to inhibit leaf senescence had a longer photosynthetic lifespan, and produced a 50% increase in dry weight and seed yield (Gan and Amasino (1995) *Science* 270: 1986-1988). Delayed flower senescence caused by overexpression of transcription factors may generate plants that retain their blossoms longer and this may be of potential interest to the ornamental horticulture industry, and delayed foliar and fruit senescence could improve post-harvest shelf-life of produce.

Premature senescence caused by, for example, G636, G1463, G1944 and their equivalogs may be used to improve a plant's response to disease and hasten fruit ripening.

Growth Rate and Development: Lethality and Necrosis.

Overexpression of transcription factors, for example, G12, G24, G877, G1519 and their equivalogs that have a role in regulating cell death may be used to induce lethality in specific tissues or necrosis in response to pathogen attack. For example, if a transcription factor gene inducing lethality or necrosis was specifically active in gametes or reproductive organs, its expression in these tissues would lead to ablation and subsequent male or female sterility. Alternatively, under pathogen-regulated expression, a necrosis-inducing transcription factor can restrict the spread of a pathogen infection through a plant.

Plant Size: Large Plants.

Plants overexpressing G1073 and G1451, for example, have been shown to be larger than controls. For some ornamental plants, the ability to provide larger varieties with these genes or their equivalogs may be highly desirable. For many plants, including fruit-bearing trees, trees that are used for lumber production, or trees and shrubs that serve as view or wind screens, increased stature provides improved benefits in the forms of greater yield or improved screening. Crop species may also produce higher yields on larger cultivars, particularly those in which the vegetative portion of the plant is edible.

Plant Size: Large Seedlings.

Presently disclosed transcription factor genes that produce large seedlings can be used to produce crops that become established faster. Large seedlings are generally hardier, less vulnerable to stress, and better able to out-compete weed species. Seedlings transformed with presently disclosed transcription factors, including G2346 and G2838, for example, have been shown to possess larger cotyledons and were more developmentally advanced than control plants. Rapid seedling development made possible by manipulating expression of these genes or their equivalogs is likely to reduce loss due to diseases particularly prevalent at the seedling stage (e.g., damping off) and is thus important for survivability of plants germinating in the field or in controlled environments.

Plant Size: Dwarfed Plants.

Presently disclosed transcription factor genes, including G24; G343, G353, G354, G362, G370; G1008, G1277, G1543, G1794, G1958 and their equivalogs, for example, that can be used to decrease plant stature are likely to produce plants that are more resistant to damage by wind and rain, have improved lodging resistance, or more resistant to heat or low humidity or water deficit. Dwarf plants are also of significant interest to the ornamental horticulture industry, and particularly for home garden applications for which space availability may be limited.

Plant Size: Fruit Size and Number.

Introduction of presently disclosed transcription factor genes that affect fruit size will have desirable impacts on fruit size and number, which may comprise increases in yield for fruit crops, or reduced fruit yield, such as when vegetative growth is preferred (e.g., with bushy ornamentals, or where fruit is undesirable, as with ornamental olive trees).

Leaf Morphology: Dark Leaves.

Color-affecting components in leaves include chlorophylls (generally green), anthocyanins (generally red to blue) and carotenoids (generally yellow to red). Transcription factor genes that increase these pigments in leaves, including G674, G912, G1063, G1357, G1452, G1482, G1499, G1792, G1863, G1888, G2143, G2557, G2838 and their equivalogs, may positively affect a plant's value to the ornamental horticulture industry. Variegated varieties, in particular, would show improved contrast. Other uses that result from overexpression of transcription factor genes include improvements in the nutritional value of foodstuffs. For example, lutein is an important nutraceutical; lutein-rich diets have been shown to help prevent age-related macular degeneration (AMD), the leading cause of blindness in elderly people. Consumption of dark green leafy vegetables has been shown in clinical studies to reduce the risk of AMD.

Enhanced chlorophyll and carotenoid levels could also improve yield in crop plants. Lutein, like other xanthophylls such as zeaxanthin and violaxanthin, is an essential component in the protection of the plant against the damaging effects of excessive light. Specifically, lutein contributes, directly or indirectly, to the rapid rise of non-photochemical quenching in plants exposed to high light. Crop plants engineered to contain higher levels of lutein could therefore have improved photo-protection, leading to less oxidative damage and better growth under high light (e.g., during long summer days, or at higher altitudes or lower latitudes than those at which a non-transformed plant would survive). Additionally, elevated chlorophyll levels increases photosynthetic capacity.

Leaf Morphology: Changes in Leaf Shape.

Presently disclosed transcription factors produce marked and diverse effects on leaf development and shape. The transcription factors include G211, G353, G674, G736, G1063, G1146, G1357, G1452, G1494, G1543, G1863, G2143, G2144, and their equivalogs. At early stages of growth, transgenic seedlings have developed narrow, upward pointing leaves with long petioles, possibly indicating a disruption in circadian-clock controlled processes or nyctinastic movements. Other transcription factor genes can be used to alter leaf shape in a significant manner from wild type, some of which may find use in ornamental applications.

Leaf Morphology: Altered Leaf Size.

Large leaves, such as those produced in plants overexpressing G189, G1451, G2430 and their functional equivalogs, generally increase plant biomass. This provides benefit for crops where the vegetative portion of the plant is the marketable portion.

Leaf Morphology: Light Green and Variegated Leaves.

Transcription factor genes such as G635, G1494, G2144 and their equivalogs that provide an altered appearance may positively affect a plant's value to the ornamental horticulture industry.

Leaf Morphology: Glossy Leaves.

Transcription factor genes such as G30, G1792, G2583 and their equivalogs that induce the formation of glossy leaves generally do so by elevating levels of epidermal wax. Thus, the genes could be used to engineer changes in the composition and amount of leaf surface components, including waxes. The ability to manipulate wax composition, amount, or distribution could modify plant tolerance to drought and low humidity, or resistance to insects or pathogens. Additionally, wax may be a valuable commodity in some species, and altering its accumulation and/or composition could enhance yield.

Seed Morphology: Altered Seed Coloration.

Presently disclosed transcription factor genes, including G156, G2105, G2085 have also been used to modify seed color, which, along with the equivalogs of these genes, could provide added appeal to seeds or seed products.

Seed Morphology: Altered Seed Size and Shape.

The introduction of presently disclosed transcription factor genes into plants that increase (e.g., G450; G584; G1255; G2085; G2105; G2114) or decrease (e.g., G1040). The size of seeds may have a significant impact on yield and appearance, particularly when the product is the seed itself (e.g., in the case of grains, legumes, nuts, etc.). Seed size, in addition to seed coat integrity, thickness and permeability, seed water content and a number of other components including antioxidants and oligosaccharides, also affects affect seed longevity in storage, with larger seeds often being more desirable for prolonged storage.

Transcription factor genes that alter seed shape, including G1040, G1062, G1255 and their equivalogs may have both ornamental applications and improve or broaden the appeal of seed products.

Leaf Biochemistry: Increased Leaf Wax.

Overexpression of transcription factors genes, including G975, G1792 and G2085 and their equivalogs, which results in increased leaf wax could be used to manipulate wax composition, amount, or distribution. These transcription factors can improve yield in those plants and crops from which wax is a valuable product. The genes may also be used to modify plant tolerance to drought and/or low humidity or resistance to insects, as well as plant appearance (glossy leaves). The effect of increased wax deposition on leaves of a plant like may improve water use efficiency. Manipulation of these genes may reduce the wax coating on sunflower seeds; this wax fouls the oil extraction system during sunflower seed processing for oil. For the latter purpose or any other where wax reduction is valuable, antisense or co-suppression of the transcription factor genes in a tissue-enhanced or tissue-specific manner would be valuable.

Leaf Biochemistry: Leaf Prenyl Lipids Including Tocopherol.

Prenyl lipids play a role in anchoring proteins in membranes or membranous organelles. Thus modifying the prenyl lipid content of seeds and leaves could affect membrane integrity and function. One important group of prenyl lipids, the tocopherols, have both anti-oxidant and vitamin E activity. A number of presently disclosed transcription factor genes, including G214, G652, G748, G987, G1543, and G2509, have been shown to modify the tocopherol composition of leaves in plants, and these genes and their equivalogs may thus be used to alter prenyl lipid content of leaves.

Leaf Biochemistry: Increased Leaf Insoluble Sugars.

Overexpression of a number of presently disclosed transcription factors, including G211, resulted in plants with altered leaf insoluble sugar content. This transcription factor and its equivalogs that alter plant cell wall composition have several potential applications including altering food digestibility, plant tensile strength, wood quality, pathogen resistance and in pulp production. In particular, hemicellulose is not desirable in paper pulps because of its lack of strength compared with cellulose. Thus modulating the amounts of cellulose vs. hemicellulose in the plant cell wall is desirable for the paper/lumber industry. Increasing the insoluble carbohydrate content in various fruits, vegetables, and other edible consumer products will result in enhanced fiber content. Increased fiber content would not only provide health benefits in food products, but might also increase digestibility of forage crops. In addition, the hemicellulose and pectin content of fruits and berries affects the quality of jam and catsup made from them. Changes in hemicellulose and pectin content could result in a superior consumer product.

Leaf Biochemistry: Increased Leaf Anthocyanin.

Several presently disclosed transcription factor genes may be used to alter anthocyanin production in numerous plant species. Expression of presently disclosed transcription factor genes that increase flavonoid production in plants, including anthocyanins and condensed tannins, may be used to alter in pigment production for horticultural purposes, and possibly increasing stress resistance. G362, G663, G1482 and G1888 or their equivalogs, for example, could be used to alter anthocyanin production or accumulation. A number of flavonoids have been shown to have antimicrobial activity and could be used to engineer pathogen resistance. Several flavonoid compounds have health promoting effects such as inhibition of tumor growth, prevention of bone loss and prevention of the oxidation of lipids. Increased levels of condensed tannins, in forage legumes would be an important agronomic trait because they prevent pasture bloat by collapsing protein foams within the rumen. For a review on the utilities of flavonoids and their derivatives, refer to Dixon et al. (1999) Trends Plant Sci. 4: 394-400.

Leaf and Seed Biochemistry: Altered Fatty Acid Content.

A number of the presently disclosed transcription factor genes have been shown to alter the fatty acid composition in plants, and seeds and leaves in particular. This modification suggests several utilities, including improving the nutritional value of seeds or whole plants. Dietary fatty acids ratios have been shown to have an effect on, for example, bone integrity and remodeling (see, for example, Weiler (2000) Pediatr. Res. 47:5 692-697). The ratio of dietary fatty acids may alter the precursor pools of long-chain polyunsaturated fatty acids that serve as precursors for prostaglandin synthesis. In mammalian connective tissue, prostaglandins serve as important signals regulating the balance between resorption and formation in bone and cartilage. Thus, dietary fatty acid ratios altered in seeds may affect the etiology and outcome of bone loss.

Transcription factors that reduce leaf fatty acids, for example, 16:3 fatty acids, may be used to control thylakoid membrane development, including proplastid to chloroplast development. The genes that encode these transcription factors might thus be useful for controlling the transition from proplastid to chromoplast in fruits and vegetables. It may also be desirable to change the expression of these genes to prevent cotyledon greening in Brassica napus or B. campestris to avoid green oil due to early frost.

A number of transcription factor genes are involved in mediating an aspect of the regulatory response to temperature. These genes may be used to alter the expression of desaturases that lead to production of 18:3 and 16:3 fatty acids, the balance of which affects membrane fluidity and mitigates damage to cell membranes and photosynthetic structures at high and low temperatures.

Seed Biochemistry: Modified Seed Oil and Fatty Acid Content.

The composition of seeds, particularly with respect to seed oil amounts and/or composition, is very important for the nutritional and caloric value and production of various food and feed products. Several of the presently disclosed transcription factor genes in seed lipid saturation that alter seed oil content could be used to improve the heat stability of oils or to improve the nutritional quality of seed oil, by, for example, reducing the number of calories in seed by decreasing oil or fatty acid content (e.g., G180; G192; G241; G1229; G1323; G1543), increasing the number of calories in animal feeds by increasing oil or fatty acid content (e.g. G162; G291; G427; G590; G598; G629, G715; G849; G1198, G1471; G1526; G1640; G1646, G1750; G1777; G1793; G1838; G1902; G1946; G1948; G2123; G2138; G2830), altering seed oil content (G504; G509; G519; G561; G567; G892; G961; G974; G1143; G1226; G1451; G1478; G1496; G1672; G1677; G1765; G2509; G2343), or altering the ratio of saturated to unsaturated lipids comprising the oils (e.g. G869; G1417; G2192).

Seed Biochemistry: Modified Seed Protein Content.

As with seed oils, the composition of seeds, particularly with respect to protein amounts and/or composition, is very important for the nutritional value and production of various food and feed products. A number of the presently disclosed transcription factor genes modify the protein concentrations in seeds, including G162; G226; G1323; G1419; G1818, which increase seed protein, G427; G1777; G1903; G1946, which decrease seed protein, and G162; G241; G509; G567; G597; G849; G892; G988; G1478; G1634; G1637; G1652; G1677; G1820; G1958; G2509; G2117; G2509, which alter seed protein content, would provide nutritional benefits, and may be used to prolong storage, increase seed pest or disease resistance, or modify germination rates.

Seed Biochemistry: Seed Prenyl Lipids.

Prenyl lipids play a role in anchoring proteins in membranes or membranous organelles. Thus, modifying the prenyl lipid content of seeds and leaves could affect membrane integrity and function. A number of presently disclosed transcription factor genes have been shown to modify the tocopherol composition of plants. α-Tocopherol is better known as vitamin E. Tocopherols such as α- and γ-tocopherol both have anti-oxidant activity.

Seed Biochemistry: Seed Glucosinolates.

A number of glucosinolates have been shown to have anti-cancer activity; thus, increasing the levels or composition of these compounds by introducing several of the presently disclosed transcription factors, including G484 and G2340, can have a beneficial effect on human diet.

Glucosinolates are undesirable components of the oilseeds used in animal feed since they produce toxic effects. Low-glucosinolate varieties of canola, for example, have been developed to combat this problem. Glucosinolates form part of a plant's natural defense against insects. Modification of glucosinolate composition or quantity by introducing transcription factors that affect these characteristics can therefore afford increased protection from herbivores. Furthermore, in edible crops, tissue specific promoters can be used to ensure that these compounds accumulate specifically in tissues, such as the epidermis, which are not taken for consumption.

Seed Biochemistry: Increased Seed Anthocyanin.

Several presently disclosed transcription factor genes may be used to alter anthocyanin production in the seeds of plants. As with leaf anthocyanins, expression of presently disclosed transcription factor genes that increase flavonoid (anthocyanins and condensed tannins) production in seeds, including G663 and its equivalogs, may be used to alter in pigment production for horticultural purposes, and possibly increasing stress resistance, antimicrobial activity and health promoting effects such as inhibition of tumor growth, prevention of bone loss and prevention of the oxidation of lipids.

Leaf and Seed Biochemistry: Production of Seed and Leaf Phytosterols:

Presently disclosed transcription factor genes that modify levels of phytosterols in plants may have at least two utilities. First, phytosterols are an important source of precursors for the manufacture of human steroid hormones. Thus, regulation of transcription factor expression or activity could lead to elevated levels of important human steroid precursors for steroid semi-synthesis. For example, transcription factors that cause elevated levels of campesterol in leaves, or sitosterols and stigmasterols in seed crops, would be useful for this purpose. Phytosterols and their hydrogenated derivatives phytostanols also have proven cholesterol-lowering properties, and transcription factor genes that modify the expression of these compounds in plants would thus provide health benefits.

Root Biochemistry: Increased Root Anthocyanin.

Presently disclosed transcription factor genes, including G663, may be used to alter anthocyanin production in the root of plants. As described above for seed anthocyanins, expression of presently disclosed transcription factor genes that increase flavonoid (anthocyanins and condensed tannins) production in seeds, including G663 and its equivalogs, may be used to alter in pigment production for horticultural purposes, and possibly increasing stress resistance, antimicrobial activity and health promoting effects such as inhibition of tumor growth, prevention of bone loss and prevention of the oxidation of lipids.

Light Response/Shade Avoidance:

Altered cotyledon, hypocotyl, petiole development, altered leaf orientation, constitutive photomorphogenesis, photomorphogenesis in low light. Presently disclosed transcription factor genes, including G183; G354; G1322; G1331; G1488; G1494; G1794; G2144; and G2555, that modify a plant's response to light may be useful for modifying plant growth or development, for example, photomorphogenesis in poor light, or accelerating flowering time in response to various light intensities, quality or duration to which a non-transformed plant would not similarly respond. Examples of such responses that have been demonstrated include leaf number and arrangement, and early flower bud appearances. Elimination of shading responses may lead to increased planting densities with subsequent yield enhancement. As these genes may also alter plant architecture, they may find use in the ornamental horticulture industry.

Pigment: Increased Anthocyanin Level in Various Plant Organs and Tissues.

In addition to seed, leaves and roots, as mentioned above, several presently disclosed transcription factor genes can be used to alter anthocyanin levels in one or more tissues. The potential utilities of these genes include alterations in pigment production for horticultural purposes, and possibly increasing stress resistance, antimicrobial activity and health promoting effects such as inhibition of tumor growth, prevention of bone loss and prevention of the oxidation of lipids.

Miscellaneous Biochemistry: Diterpenes in Leaves and Other Plant Parts.

Depending on the plant species, varying amounts of diverse secondary biochemicals (often lipophilic terpenes) are produced and exuded or volatilized by trichomes. These exotic secondary biochemicals, which are relatively easy to extract because they are on the surface of the leaf, have been widely used in such products as flavors and aromas, drugs, pesticides and cosmetics. Thus, the overexpression of genes that are used to produce diterpenes in plants may be accomplished by introducing transcription factor genes that induce said overexpression. One class of secondary metabolites, the diterpenes, can effect several biological systems such as tumor progression, prostaglandin synthesis and tissue inflammation. In addition, diterpenes can act as insect pheromones, termite allomones, and can exhibit neurotoxic, cytotoxic and antimitotic activities. As a result of this functional diversity, diterpenes have been the target of research several pharmaceutical ventures. In most cases where the metabolic pathways are impossible to engineer, increasing trichome density or size on leaves may be the only way to increase plant productivity.

Miscellaneous Biochemistry: Production of Miscellaneous Secondary Metabolites.

Microarray data suggests that flux through the aromatic amino acid biosynthetic pathways and primary and secondary metabolite biosynthetic pathways are up-regulated. Presently disclosed transcription factors have been shown to be involved in regulating alkaloid biosynthesis, in part by up-regulating the enzymes indole-3-glycerol phosphatase and strictosidine synthase. Phenylalanine ammonia lyase, chalcone synthase and trans-cinnamate mono-oxygenase are also induced, and are involved in phenylpropenoid biosynthesis.

Antisense and Co-Suppression

In addition to expression of the nucleic acids of the invention as gene replacement or plant phenotype modification nucleic acids, the nucleic acids are also useful for sense and anti-sense suppression of expression, e.g., to down-regulate expression of a nucleic acid of the invention, e.g., as a further mechanism for modulating plant phenotype. That is, the nucleic acids of the invention, or subsequences or anti-sense sequences thereof, can be used to block expression of naturally occurring homologous nucleic acids. A variety of sense and anti-sense technologies are known in the art, e.g., as set forth in Lichtenstein and Nellen (1997) *Antisense Technology: A Practical Approach* IRL Press at Oxford University Press, Oxford, U.K. Antisense regulation is also described in Crowley et al. (1985) *Cell* 43: 633-641; Rosenberg et al. (1985) *Nature* 313: 703-706; Preiss et al. (1985) *Nature* 313: 27-32; Melton (1985) *Proc. Natl. Acad. Sci.* 82: 144-148; Izant and Weintraub (1985) *Science* 229: 345-352; and Kim and Wold (1985) *Cell* 42: 129-138. Additional methods for antisense regulation are known in the art. Antisense regulation has been used to reduce or inhibit expression of plant genes in, for example in European Patent Publication No. 271988. Antisense RNA may be used to reduce gene expression to produce a visible or biochemical phenotypic change in a plant (Smith et al. (1988) *Nature,* 334: 724-726; Smith et al. (1990) *Plant Mol. Biol.* 14: 369-379). In general, sense or anti-sense sequences are introduced into a cell, where they are optionally amplified, e.g., by transcription. Such sequences include both simple oligonucleotide sequences and catalytic sequences such as ribozymes.

For example, a reduction or elimination of expression (i.e., a "knock-out") of a transcription factor or transcription factor homolog polypeptide in a transgenic plant, e.g., to modify a plant trait, can be obtained by introducing an antisense construct corresponding to the polypeptide of interest as a cDNA.

For antisense suppression, the transcription factor or homolog cDNA is arranged in reverse orientation (with respect to the coding sequence) relative to the promoter sequence in the expression vector. The introduced sequence need not be the full length cDNA or gene, and need not be identical to the cDNA or gene found in the plant type to be transformed. Typically, the antisense sequence need only be capable of hybridizing to the target gene or RNA of interest. Thus, where the introduced sequence is of shorter length, a higher degree of homology to the endogenous transcription factor sequence will be needed for effective antisense suppression. While antisense sequences of various lengths can be utilized, preferably, the introduced antisense sequence in the vector will be at least 30 nucleotides in length, and improved antisense suppression will typically be observed as the length of the antisense sequence increases. Preferably, the length of the antisense sequence in the vector will be greater than 100 nucleotides. Transcription of an antisense construct as described results in the production of RNA molecules that are the reverse complement of mRNA molecules transcribed from the endogenous transcription factor gene in the plant cell.

Suppression of endogenous transcription factor gene expression can also be achieved using a ribozyme. Ribozymes are RNA molecules that possess highly specific endoribonuclease activity. The production and use of ribozymes are disclosed in U.S. Pat. No. 4,987,071 and U.S. Pat. No. 5,543,508. Synthetic ribozyme sequences including antisense RNAs can be used to confer RNA cleaving activity on the antisense RNA, such that endogenous mRNA molecules that hybridize to the antisense RNA are cleaved, which in turn leads to an enhanced antisense inhibition of endogenous gene expression.

Vectors in which RNA encoded by a transcription factor or transcription factor homolog cDNA is over-expressed can also be used to obtain co-suppression of a corresponding endogenous gene, e.g., in the manner described in U.S. Pat. No. 5,231,020 to Jorgensen. Such co-suppression (also termed sense suppression) does not require that the entire transcription factor cDNA be introduced into the plant cells, nor does it require that the introduced sequence be exactly identical to the endogenous transcription factor gene of interest. However, as with antisense suppression, the suppressive efficiency will be enhanced as specificity of hybridization is increased, e.g., as the introduced sequence is lengthened, and/or as the sequence similarity between the introduced sequence and the endogenous transcription factor gene is increased.

Vectors expressing an untranslatable form of the transcription factor mRNA, e.g., sequences comprising one or more stop codon, or nonsense mutation) can also be used to suppress expression of an endogenous transcription factor, thereby reducing or eliminating its activity and modifying one or more traits. Methods for producing such constructs are described in U.S. Pat. No. 5,583,021. Preferably, such constructs are made by introducing a premature stop codon into the transcription factor gene. Alternatively, a plant trait can be modified by gene silencing using double-strand RNA (Sharp (1999) *Genes and Development* 13: 139-141). Another method for abolishing the expression of a gene is by insertion mutagenesis using the T-DNA of *Agrobacterium tumefaciens*. After generating the insertion mutants, the mutants can be screened to identify those containing the insertion in a transcription factor or transcription factor homolog gene. Plants containing a single transgene insertion event at the desired gene can be crossed to generate homozygous plants for the mutation. Such methods are well known to those of skill in the art (See for example Koncz et al. (1992) *Methods in Arabidopsis Research*, World Scientific Publishing Co. Pte. Ltd., River Edge, N.J.).

Alternatively, a plant phenotype can be altered by eliminating an endogenous gene, such as a transcription factor or transcription factor homolog, e.g., by homologous recombination (Kempin et al. (1997) *Nature* 389: 802-803).

A plant trait can also be modified by using the Cre-lox system (for example, as described in U.S. Pat. No. 5,658, 772). A plant genome can be modified to include first and second lox sites that are then contacted with a Cre recombinase. If the lox sites are in the same orientation, the intervening DNA sequence between the two sites is excised. If the lox sites are in the opposite orientation, the intervening sequence is inverted.

The polynucleotides and polypeptides of this invention can also be expressed in a plant in the absence of an expression cassette by manipulating the activity or expression level of the endogenous gene by other means, such as, for example, by ectopically expressing a gene by T-DNA activation tagging (Ichikawa et al. (1997) *Nature* 390 698-701; Kakimoto et al. (1996) *Science* 274: 982-985). This method entails transforming a plant with a gene tag containing multiple transcriptional enhancers and once the tag has inserted into the genome, expression of a flanking gene coding sequence becomes deregulated. In another example, the transcriptional machinery in a plant can be modified so as to increase transcription levels of a polynucleotide of the invention (See, e.g., PCT Publications WO 96/06166 and WO 98/53057 which describe the modification of the DNA-binding specificity of zinc finger proteins by changing particular amino acids in the DNA-binding motif).

The transgenic plant can also include the machinery necessary for expressing or altering the activity of a polypeptide encoded by an endogenous gene, for example, by altering the phosphorylation state of the polypeptide to maintain it in an activated state.

Transgenic plants (or plant cells, or plant explants, or plant tissues) incorporating the polynucleotides of the invention and/or expressing the polypeptides of the invention can be produced by a variety of well established techniques as described above. Following construction of a vector, most typically an expression cassette, including a polynucleotide, e.g., encoding a transcription factor or transcription factor homolog, of the invention, standard techniques can be used to introduce the polynucleotide into a plant, a plant cell, a plant explant or a plant tissue of interest. Optionally, the plant cell, explant or tissue can be regenerated to produce a transgenic plant.

The plant can be any higher plant, including gymnosperms, monocotyledonous and dicotyledenous plants. Suitable protocols are available for Leguminosae (alfalfa, soybean, clover, etc.), Umbelliferae (carrot, celery, parsnip), Cruciferae (cabbage, radish, rapeseed, broccoli, etc.), Curcurbitaceae (melons and cucumber), Gramineae (wheat, corn, rice, barley, millet, etc.), Solanaceae (potato, tomato, tobacco, peppers, etc.), and various other crops. See protocols described in Ammirato et al., Eds., (1984) *Handbook of Plant Cell Culture—Crop Species*, Macmillan Publ. Co., New York, N.Y.; Shimamoto et al. (1989) *Nature* 338: 274-276; Fromm et al. (1990) *Bio/Technol.* 8: 833-839; and Vasil et al. (1990) *Bio/Technol.* 8: 429-434.

Transformation and regeneration of both monocotyledonous and dicotyledonous plant cells are now routine, and the selection of the most appropriate transformation technique will be determined by the practitioner. The choice of method will vary with the type of plant to be transformed; those skilled in the art will recognize the suitability of particular methods for given plant types. Suitable methods can include, but are not limited to: electroporation of plant protoplasts; liposome-mediated transformation; polyethylene glycol (PEG) mediated transformation; transformation using viruses; micro-injection of plant cells; micro-projectile bombardment of plant cells; vacuum infiltration; and *Agrobacterium tumefaciens* mediated transformation. Transformation means introducing a nucleotide sequence into a plant in a manner to cause stable or transient expression of the sequence.

Successful examples of the modification of plant characteristics by transformation with cloned sequences which serve to illustrate the current knowledge in this field of technology, and which are herein incorporated by reference, include: U.S. Pat. Nos. 5,571,706; 5,677,175; 5,510,471; 5,750,386; 5,597,945; 5,589,615; 5,750,871; 5,268,526; 5,780,708; 5,538,880; 5,773,269; 5,736,369 and 5,610,042.

Following transformation, plants are preferably selected using a dominant selectable marker incorporated into the transformation vector. Typically, such a marker will confer antibiotic or herbicide resistance on the transformed plants, and selection of transformants can be accomplished by exposing the plants to appropriate concentrations of the antibiotic or herbicide.

After transformed plants are selected and grown to maturity, those plants showing a modified trait are identified. The modified trait can be any of those traits described above. Additionally, to confirm that the modified trait is due to changes in expression levels or activity of the polypeptide or polynucleotide of the invention can be determined by analyzing mRNA expression using Northern blots, RT-PCR or microarrays, or protein expression using immunoblots or Western blots or gel shift assays.

Integrated Systems—Sequence Identity

Additionally, the present invention may be an integrated system, computer or computer readable medium that comprises an instruction set for determining the identity of one or more sequences in a database. In addition, the instruction set can be used to generate or identify sequences that meet any specified criteria. Furthermore, the instruction set may be used to associate or link certain functional benefits, such improved characteristics, with one or more identified sequence.

For example, the instruction set can include, e.g., a sequence comparison or other alignment program, e.g., an available program such as, for example, the Wisconsin Package Version 10.0, such as BLAST, FASTA, PILEUP, FINDPATTERNS or the like (GCG, Madison, Wis.). Public sequence databases such as GenBank, EMBL, Swiss-Prot and PIR or private sequence databases such as PHYTOSEQ sequence database (Incyte Genomics, Palo Alto, Calif.) can be searched.

Alignment of sequences for comparison can be conducted by the local homology algorithm of Smith and Waterman (1981) *Adv. Appl. Math.* 2: 482-489, by the homology alignment algorithm of Needleman and Wunsch (1970) *J. Mol. Biol.* 48: 443-453, by the search for similarity method of Pearson and Lipman (1988) *Proc. Natl. Acad. Sci.* 85: 2444-2448, by computerized implementations of these algorithms. After alignment, sequence comparisons between two (or more) polynucleotides or polypeptides are typically performed by comparing sequences of the two sequences over a comparison window to identify and compare local regions of sequence similarity. The comparison window can be a segment of at least about 20 contiguous positions, usually about 50 to about 200, more usually about 100 to about 150 contiguous positions. A description of the method is provided in Ausubel et al. supra.

A variety of methods for determining sequence relationships can be used, including manual alignment and computer assisted sequence alignment and analysis. This later approach is a preferred approach in the present invention, due to the increased throughput afforded by computer assisted methods. As noted above, a variety of computer programs for performing sequence alignment are available, or can be produced by one of skill.

One example algorithm that is suitable for determining percent sequence identity and sequence similarity is the BLAST algorithm, which is described in Altschul et al. (1990) *J. Mol. Biol.* 215: 403-410. Software for performing BLAST analyses is publicly available, e.g., through the National Library of Medicine's National Center for Biotechnology Information (ncbi.nlm.nih; see at world wide web (www) National Institutes of Health US government (gov) website). This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al. supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, a cutoff of 100, M=5, N=−4, and a comparison of both strands. For amino acid sequences, the BLASTP program uses as defaults a wordlength (W) of 3, an expectation (E) of 10, and the BLOSUM62 scoring matrix (see Henikoff and Henikoff (1992) *Proc. Natl. Acad. Sci.* 89: 10915-10919). Unless otherwise indicated, "sequence identity" here refers to the % sequence identity generated from a tblastx using the NCBI version of the algorithm at the default settings using gapped alignments with the filter "off" (see, for example, NIH NLM NCBI website at ncbi.nlm.nih, supra).

In addition to calculating percent sequence identity, the BLAST algorithm also performs a statistical analysis of the similarity between two sequences (see, e.g. Karlin and Altschul (1993) *Proc. Natl. Acad. Sci.* 90: 5873-5787). One measure of similarity provided by the BLAST algorithm is the smallest sum probability (P(N)), which provides an indication of the probability by which a match between two nucleotide or amino acid sequences would occur by chance. For example, a nucleic acid is considered similar to a reference sequence (and, therefore, in this context, homologous) if the smallest sum probability in a comparison of the test nucleic acid to the reference nucleic acid is less than about 0.1, or less than about 0.01, and or even less than about 0.001. An additional example of a useful sequence alignment algorithm is PILEUP. PILEUP creates a multiple sequence alignment from a group of related sequences using progressive, pairwise alignments. The program can align, e.g., up to 300 sequences of a maximum length of 5,000 letters.

The integrated system, or computer typically includes a user input interface allowing a user to selectively view one or more sequence records corresponding to the one or more character strings, as well as an instruction set which aligns the one or more character strings with each other or with an additional character string to identify one or more region of sequence similarity. The system may include a link of one or more character strings with a particular phenotype or gene function. Typically, the system includes a user readable output element that displays an alignment produced by the alignment instruction set.

The methods of this invention can be implemented in a localized or distributed computing environment. In a distributed environment, the methods may implemented on a single computer comprising multiple processors or on a multiplicity of computers. The computers can be linked, e.g. through a common bus, but more preferably the computer(s) are nodes on a network. The network can be a generalized or a dedicated local or wide-area network and, in certain preferred embodiments, the computers may be components of an intra-net or an internet.

Thus, the invention provides methods for identifying a sequence similar or homologous to one or more polynucleotides as noted herein, or one or more target polypeptides encoded by the polynucleotides, or otherwise noted herein and may include linking or associating a given plant phenotype or gene function with a sequence. In the methods, a sequence database is provided (locally or across an inter or intra net) and a query is made against the sequence database using the relevant sequences herein and associated plant phenotypes or gene functions.

Any sequence herein can be entered into the database, before or after querying the database. This provides for both expansion of the database and, if done before the querying step, for insertion of control sequences into the database. The control sequences can be detected by the query to ensure the general integrity of both the database and the query. As noted, the query can be performed using a web browser based interface. For example, the database can be a centralized public database such as those noted herein, and the querying can be done from a remote terminal or computer across an internet or intranet.

Any sequence herein can be used to identify a similar, homologous, paralogous, or orthologous sequence in another plant. This provides means for identifying endogenous sequences in other plants that may be useful to alter a trait of progeny plants, which results from crossing two plants of different strain. For example, sequences that encode an ortholog of any of the sequences herein that naturally occur in a plant with a desired trait can be identified using the sequences disclosed herein. The plant is then crossed with a second plant of the same species but which does not have the desired trait to produce progeny which can then be used in further crossing experiments to produce the desired trait in the second plant. Therefore the resulting progeny plant contains no transgenes; expression of the endogenous sequence may also be regulated by treatment with a particular chemical or other means, such as EMR. Some examples of such compounds well known in the art include: ethylene; cytokinins; phenolic compounds, which stimulate the transcription of the genes needed for infection; specific monosaccharides and acidic environments which potentiate vir gene induction; acidic polysaccharides which induce one or more chromosomal genes; and opines; other mechanisms include light or dark treatment (for a review of examples of such treatments, see, Winans (1992) *Microbiol. Rev.* 56: 12-31; Eyal et al. (1992) *Plant Mol. Biol.* 19: 589-599; Chrispeels et al. (2000) *Plant Mol. Biol.* 42: 279-290; Piazza et al. (2002) *Plant Physiol.* 128: 1077-1086).

Table 10 lists sequences discovered to be orthologous to a number of representative transcription factors of the present invention. The column headings include the transcription factors listed by SEQ ID NO; corresponding Gene ID (GID) numbers; the species from which the orthologs to the transcription factors are derived; the type of sequence (i.e., DNA or protein) discovered to be orthologous to the transcription factors; and the SEQ ID NO of the orthologs, the latter corresponding to the ortholog SEQ ID NOs listed in the Sequence Listing.

TABLE 10

Orthologs of Representative *Arabidopsis* Transcription Factor Genes

| SEQ ID NO: of Ortholog or Nucleotide Encoding Ortholog | Ortholog GID NO | Species from Which Ortholog is Derived | Sequence type used for determination (DNA or Protein) | GID NO of Orthologous *Arabidopsis* Transcription Factor | SEQ ID NO: of Nucleotide Encoding Orthologous *Arabidopsis* Transcription Factor |
|---|---|---|---|---|---|
| 468 | | Glycine max | DNA | G19 | 3 |
| 469 | | Glycine max | DNA | G19 | 3 |
| 470 | | Glycine max | DNA | G19 | 3 |
| 471 | | Glycine max | DNA | G19 | 3 |
| 472 | | Oryza sativa | DNA | G19 | 3 |
| 473 | | Oryza sativa | DNA | G19 | 3 |
| 474 | | Oryza sativa | DNA | G19 | 3 |
| 475 | | Zea mays | DNA | G19 | 3 |
| 476 | | Zea mays | DNA | G19 | 3 |
| 477 | | Glycine max | DNA | G22 | 5 |
| 478 | | Glycine max | DNA | G22 | 5 |
| 491 | | Glycine max | DNA | G28 | 9 |
| 492 | | Glycine max | DNA | G28 | 9 |
| 493 | | Glycine max | DNA | G28 | 9 |
| 494 | | Glycine max | DNA | G28 | 9 |
| 495 | | Glycine max | DNA | G28 | 9 |
| 496 | | Glycine max | DNA | G28 | 9 |

TABLE 10-continued

Orthologs of Representative *Arabidopsis* Transcription Factor Genes

| SEQ ID NO: of Ortholog or Nucleotide Encoding Ortholog | Ortholog GID NO | Species from Which Ortholog is Derived | Sequence type used for determination (DNA or Protein) | GID NO of Orthologous *Arabidopsis* Transcription Factor | SEQ ID NO: of Nucleotide Encoding Orthologous *Arabidopsis* Transcription Factor |
|---|---|---|---|---|---|
| 497 | | *Glycine max* | DNA | G28 | 9 |
| 498 | | *Glycine max* | DNA | G28 | 9 |
| 499 | | *Oryza sativa* | DNA | G28 | 9 |
| 500 | | *Zea mays* | DNA | G28 | 9 |
| 501 | | *Oryza sativa* | PRT | G28 | 9 |
| 502 | | *Oryza sativa* | PRT | G28 | 9 |
| 503 | | *Mesembryanthemum crystallinum* | PRT | G28 | 9 |
| 504 | G3643 | *Glycine max* | DNA | G47, G2133 | 11, 407 |
| 505 | | *Oryza sativa* | PRT | G47, G2133 | 11, 407 |
| 550 | G3450 | *Glycine max* | DNA | G226, G682 | 37, 147 |
| 551 | | *Glycine max* | DNA | G226, G682 | 37 |
| 552 | | *Glycine max* | DNA | G226, G682 | 37, 147 |
| 553 | G3448 | *Glycine max* | DNA | G226, G682 | 37, 147 |
| 554 | G3449 | *Glycine max* | DNA | G226, G682 | 37, 147 |
| 555 | | *Oryza sativa* | DNA | G226, G682 | 37, 147 |
| 556 | G3431 | *Zea mays* | DNA | G226, G682 | 37, 147 |
| 557 | | *Zea mays* | DNA | G226, G682 | 37, 147 |
| 558 | | *Oryza sativa* | PRT | G226, G682 | 37, 147 |
| 559 | G3393 | *Oryza sativa* | PRT | G226, G682 | 37, 147 |
| 610 | | *Glycine max* | DNA | G353, G354 | 59, 61 |
| 611 | | *Glycine max* | DNA | G353, G354 | 59, 61 |
| 612 | | *Glycine max* | DNA | G353, G354 | 59, 61 |
| 613 | | *Oryza sativa* | DNA | G353, G354 | 59, 61 |
| 614 | | *Zea mays* | DNA | G353, G354 | 59, 61 |
| 615 | | *Zea mays* | DNA | G353, G354 | 59, 61 |
| 616 | | *Zea mays* | DNA | G353, G354 | 59, 61 |
| 617 | | *Zea mays* | DNA | G353, G354 | 59, 61 |
| 618 | | *Zea mays* | DNA | G353, G354 | 59, 61 |
| 619 | | *Zea mays* | DNA | G353, G354 | 59, 61 |
| 620 | | *Zea mays* | DNA | G353, G354 | 59, 61 |
| 621 | | *Oryza sativa* | PRT | G353, G354 | 59, 61 |
| 622 | | *Oryza sativa* | PRT | G353, G354 | 59, 61 |
| 623 | | *Oryza sativa* | PRT | G353, G354 | 59, 61 |
| 624 | | *Oryza sativa* | PRT | G353, G354 | 59, 61 |
| 625 | | *Oryza sativa* | PRT | G353, G354 | 59, 61 |
| 626 | | *Oryza sativa* | PRT | G353, G354 | 59, 61 |
| 746 | | *Glycine max* | DNA | G481, G482 | 87, 89 |
| 747 | | *Glycine max* | DNA | G481, G482 | 87, 89 |
| 748 | | *Glycine max* | DNA | G481, G482 | 87, 89 |
| 749 | G3476 | *Glycine max* | DNA | G481, G482 | 87, 89 |
| 750 | | *Glycine max* | DNA | G481, G482 | 87, 89 |
| 751 | | *Glycine max* | DNA | G481, G482 | 87, 89 |
| 752 | | *Glycine max* | DNA | G481, G482 | 87, 89 |
| 753 | | *Glycine max* | DNA | G481, G482 | 87, 89 |
| 754 | | *Glycine max* | DNA | G481, G482 | 87 |
| 755 | | *Glycine max* | DNA | G481, G482 | 87 |
| 756 | | *Oryza sativa* | DNA | G481, G482 | 87 |
| 757 | | *Oryza sativa* | DNA | G481, G482 | 87, 89 |
| 758 | | *Zea mays* | DNA | G481, G482 | 87 |
| 759 | | *Zea mays* | DNA | G481, G482 | 87, 89 |
| 760 | | *Zea mays* | DNA | G481, G482 | 87, 89 |
| 761 | | *Zea mays* | DNA | G481, G482 | 87, 89 |
| 762 | | *Zea mays* | DNA | G481, G482 | 87, 89 |
| 763 | | *Zea mays* | DNA | G481, G482 | 87, 89 |
| 764 | | *Zea mays* | DNA | G481, G482 | 87, 89 |
| 765 | | *Zea mays* | DNA | G481, G482 | 87, 89 |
| 766 | | *Zea mays* | DNA | G481, G482 | 87, 89 |
| 767 | | *Zea mays* | DNA | G481, G482 | 87, 89 |
| 768 | | *Gossypium arboreum* | DNA | G481, G482 | 87, 89 |
| 769 | | *Glycine max* | DNA | G481, G482 | 87, 89 |
| 770 | | *Gossypium hirsutum* | DNA | G481, G482 | 87, 89 |
| 771 | | *Lycopersicon esculentum* | DNA | G481, G482 | 87, 89 |
| 772 | | *Lycopersicon esculentum* | DNA | G481, G482 | 87, 89 |
| 773 | | *Medicago truncatula* | DNA | G481, G482 | 87, 89 |
| 774 | | *Lycopersicon esculentum* | DNA | G481, G482 | 87, 89 |

TABLE 10-continued

Orthologs of Representative *Arabidopsis* Transcription Factor Genes

| SEQ ID NO: of Ortholog or Nucleotide Encoding Ortholog | Ortholog GID NO | Species from Which Ortholog is Derived | Sequence type used for determination (DNA or Protein) | GID NO of Orthologous *Arabidopsis* Transcription Factor | SEQ ID NO: of Nucleotide Encoding Orthologous *Arabidopsis* Transcription Factor |
|---|---|---|---|---|---|
| 775 | | *Solanum tuberosum* | DNA | G481, G482 | 87, 89 |
| 776 | | *Triticum aestivum* | DNA | G481, G482 | 87, 89 |
| 777 | | *Hordeum vulgare* | DNA | G481, G482 | 87, 89 |
| 778 | | *Triticum monococcum* | DNA | G481, G482 | 87, 89 |
| 779 | | *Glycine max* | DNA | G481, G482 | 89 |
| 780 | | *Oryza sativa* | PRT | G481, G482 | 87, 89 |
| 781 | | *Oryza sativa* | PRT | G481, G482 | 87, 89 |
| 782 | | *Oryza sativa* | PRT | G481, G482 | 87, 89 |
| 783 | | *Oryza sativa* | PRT | G481, G482 | 87, 89 |
| 784 | | *Oryza sativa* | PRT | G481, G482 | 87, 89 |
| 785 | | *Zea mays* | PRT | G481, G482 | 87, 89 |
| 786 | | *Zea mays* | PRT | G481, G482 | 87, 89 |
| 787 | | *Oryza sativa* | PRT | G481, G482 | 87, 89 |
| 788 | | *Oryza sativa* | PRT | G481, G482 | 87, 89 |
| 789 | | *Oryza sativa* | PRT | G481, G482 | 87, 89 |
| 790 | G3395 | *Oryza sativa* | PRT | G481, G482 | 87, 89 |
| 791 | | *Oryza sativa* | PRT | G481, G482 | 87, 89 |
| 792 | | *Oryza sativa* | PRT | G481, G482 | 87, 89 |
| 793 | | *Oryza sativa* | PRT | G481, G482 | 87, 89 |
| 794 | G3397 | *Oryza sativa* | PRT | G481, G482 | 87, 89 |
| 795 | | *Oryza sativa* | PRT | G481, G482 | 87, 89 |
| 796 | G3398 | *Oryza sativa* | PRT | G481, G482 | 87, 89 |
| 797 | | *Glycine max* | PRT | G481, G482 | 87, 89 |
| 798 | G3476 | *Glycine max* | PRT | G481, G482 | 87, 89 |
| 799 | | *Glycine max* | PRT | G481, G482 | 87, 89 |
| 800 | G3475 | *Glycine max* | PRT | G481, G482 | 87, 89 |
| 801 | G3472 | *Glycine max* | PRT | G481, G482 | 87, 89 |
| 802 | | *Glycine max* | PRT | G481, G482 | 87, 89 |
| 803 | | *Glycine max* | PRT | G481, G482 | 87, 89 |
| 804 | | *Zea mays* | PRT | G481, G482 | 87, 89 |
| 805 | G3436 | *Zea mays* | PRT | G481, G482 | 87, 89 |
| 806 | G3434 | *Zea mays* | PRT | G481, G482 | 87, 89 |
| 807 | | *Zea mays* | PRT | G481, G482 | 87, 89 |
| 825 | | *Glycine max* | DNA | G489 | 93 |
| 826 | | *Glycine max* | DNA | G489 | 93 |
| 827 | | *Glycine max* | DNA | G489 | 93 |
| 828 | | *Glycine max* | DNA | G489 | 93 |
| 829 | | *Glycine max* | DNA | G489 | 93 |
| 830 | | *Glycine max* | DNA | G489 | 93 |
| 831 | | *Glycine max* | DNA | G489 | 93 |
| 832 | | *Oryza sativa* | DNA | G489 | 93 |
| 833 | | *Oryza sativa* | DNA | G489 | 93 |
| 834 | | *Zea mays* | DNA | G489 | 93 |
| 835 | | *Oryza sativa* | PRT | G489 | 93 |
| 836 | | *Oryza sativa* | PRT | G489 | 93 |
| 837 | | *Oryza sativa* | PRT | G489 | 93 |
| 981 | | *Oryza sativa* | DNA | G634 | 127 |
| 982 | | *Oryza sativa* | DNA | G634 | 127 |
| 983 | | *Oryza sativa* | DNA | G634 | 127 |
| 984 | | *Zea mays* | DNA | G634 | 127 |
| 985 | | *Zea mays* | DNA | G634 | 127 |
| 986 | | *Zea mays* | DNA | G634 | 127 |
| 987 | | *Oryza sativa* | PRT | G634 | 127 |
| 988 | | *Oryza sativa* | PRT | G634 | 127 |
| 1076 | G3450 | *Glycine max* | DNA | G682 | 147 |
| 1077 | | *Hordeum vulgare* subsp. *vulgare* | DNA | G682 | 147 |
| 1078 | | *Populus tremula* x *Populus tremuloides* | DNA | G682 | 147 |
| 1079 | | *Triticum aestivum* | DNA | G682 | 147 |
| 1080 | | *Gossypium arboreum* | DNA | G682 | 147 |
| 1081 | | *Oryza sativa* | PRT | G682 | 147 |
| 1082 | G3392 | *Oryza sativa* | PRT | G682 | 147 |
| 1083 | G3445 | *Glycine max* | PRT | G682 | 147 |
| 1084 | G3450 | *Glycine max* | PRT | G682 | 147 |
| 1085 | | *Glycine max* | PRT | G682 | 147 |
| 1086 | G3446 | *Glycine max* | PRT | G682 | 147 |
| 1087 | G3448 | *Glycine max* | PRT | G682 | 147 |
| 1088 | G3449 | *Glycine max* | PRT | G682 | 147 |
| 1089 | G3431 | *Zea mays* | PRT | G682 | 147 |

TABLE 10-continued

Orthologs of Representative *Arabidopsis* Transcription Factor Genes

| SEQ ID NO: of Ortholog or Nucleotide Encoding Ortholog | Ortholog GID NO | Species from Which Ortholog is Derived | Sequence type used for determination (DNA or Protein) | GID NO of Orthologous *Arabidopsis* Transcription Factor | SEQ ID NO: of Nucleotide Encoding Orthologous *Arabidopsis* Transcription Factor |
|---|---|---|---|---|---|
| 1090 | | *Zea mays* | PRT | G682 | 147 |
| 1154 | | *Glycine max* | DNA | G864 | 167 |
| 1155 | | *Glycine max* | DNA | G864 | 167 |
| 1156 | | *Zea mays* | DNA | G864 | 167 |
| 1157 | | *Oryza sativa* | PRT | G864 | 167 |
| 1158 | | *Oryza sativa* | PRT | G864 | 167 |
| 1159 | | *Glycine max* | DNA | G867, G1930 | 169, 369 |
| 1160 | G3451 | *Glycine max* | DNA | G867, G1930 | 169, 369 |
| 1161 | | *Glycine max* | DNA | G867, G1930 | 169, 369 |
| 1162 | G3452 | *Glycine max* | DNA | G867, G1930 | 169, 369 |
| 1163 | | *Glycine max* | DNA | G867, G1930 | 169, 369 |
| 1164 | | *Glycine max* | DNA | G867, G1930 | 169 |
| 1165 | | *Oryza sativa* | DNA | G867, G1930 | 169 |
| 1166 | | *Oryza sativa* | DNA | G867, G1930 | 169, 369 |
| 1167 | | *Zea mays* | DNA | G867, G1930 | 169, 369 |
| 1168 | | *Zea mays* | DNA | G867, G1930 | 169, 369 |
| 1169 | | *Zea mays* | DNA | G867, G1930 | 169, 369 |
| 1170 | | *Zea mays* | DNA | G867, G1930 | 169, 369 |
| 1171 | | *Glycine max* | DNA | G867, G1930 | 169, 369 |
| 1172 | | *Mesembryanthemum crystallinum* | DNA | G867, G1930 | 169, 369 |
| 1173 | | *Lycopersicon esculentum* | DNA | G867, G1930 | 169, 369 |
| 1174 | | *Solanum tuberosum* | DNA | G867, G1930 | 169, 369 |
| 1175 | | *Hordeum vulgare* | DNA | G867, G1930 | 169, 369 |
| 1176 | G3388 | *Oryza sativa* | PRT | G867, G1930 | 169, 369 |
| 1177 | G3389 | *Oryza sativa* | PRT | G867, G1930 | 169, 369 |
| 1178 | | *Oryza sativa* | PRT | G867, G1930 | 169, 369 |
| 1179 | G3390 | *Oryza sativa* | PRT | G867, G1930 | 169, 369 |
| 1180 | | *Oryza sativa* | PRT | G867, G1930 | 169, 369 |
| 1181 | | *Oryza sativa* | PRT | G867, G1930 | 169, 369 |
| 1182 | G3451 | *Glycine max* | PRT | G867, G1930 | 169, 369 |
| 1183 | G3452 | *Glycine max* | PRT | G867, G1930 | 169, 369 |
| 1184 | G3453 | *Glycine max* | PRT | G867, G1930 | 169, 369 |
| 1185 | G3433 | *Zea mays* | PRT | G867, G1930 | 169, 369 |
| 1186 | | *Zea mays* | PRT | G867, G1930 | 169, 369 |
| 1204 | | *Glycine max* | DNA | G912 | 185 |
| 1205 | | *Glycine max* | DNA | G912 | 185 |
| 1206 | | *Glycine max* | DNA | G912 | 185 |
| 1207 | | *Glycine max* | DNA | G912 | 185 |
| 1208 | | *Glycine max* | DNA | G912 | 185 |
| 1209 | | *Glycine max* | DNA | G912 | 185 |
| 1210 | | *Glycine max* | DNA | G912 | 185 |
| 1211 | | *Oryza sativa* | DNA | G912 | 185 |
| 1212 | | *Oryza sativa* | DNA | G912, G913 | 185, 187 |
| 1213 | G3440 | *Zea mays* | DNA | G912 | 185 |
| 1214 | | *Zea mays* | DNA | G912 | 185 |
| 1215 | | *Zea mays* | DNA | G912, G913 | 185, 187 |
| 1216 | | *Zea mays* | DNA | G912 | 185 |
| 1217 | | *Zea mays* | DNA | G912 | 185 |
| 1218 | | *Brassica napus* | DNA | G912, G913 | 185, 187 |
| 1219 | | *Solanum tuberosum* | DNA | G912 | 185 |
| 1220 | | *Descurainia sophia* | DNA | G912 | 185 |
| 1221 | G3377 | *Oryza sativa* | PRT | G912 | 185 |
| 1222 | G3373 | *Oryza sativa* | PRT | G912, G913 | 185, 187 |
| 1223 | G3375 | *Oryza sativa* | PRT | G912, G913 | 185, 187 |
| 1224 | G3372 | *Oryza sativa* | PRT | G912 | 185 |
| 1225 | | *Brassica napus* | PRT | G912 | 185 |
| 1226 | | *Nicotiana tabacum* | PRT | G912 | 185 |
| 1227 | | *Oryza sativa* | PRT | G912 | 185 |
| 1228 | | *Oryza sativa* | PRT | G912 | 185 |
| 1229 | | *Oryza sativa* | PRT | G912 | 185 |
| 1230 | G3379 | *Oryza sativa* | PRT | G912 | 185 |
| 1231 | | *Oryza sativa* | PRT | G912 | 185 |
| 1232 | G3376 | *Oryza sativa* | PRT | G912 | 185 |
| 1233 | | *Oryza sativa* | PRT | G912 | 185 |
| 1234 | | *Oryza sativa* | PRT | G912 | 185 |
| 1235 | | *Oryza sativa* | PRT | G912 | 185 |
| 1236 | | *Oryza sativa* | PRT | G912 | 185 |
| 1237 | | *Glycine max* | PRT | G912 | 185 |

TABLE 10-continued

Orthologs of Representative *Arabidopsis* Transcription Factor Genes

| SEQ ID NO: of Ortholog or Nucleotide Encoding Ortholog | Ortholog GID NO | Species from Which Ortholog is Derived | Sequence type used for determination (DNA or Protein) | GID NO of Orthologous *Arabidopsis* Transcription Factor | SEQ ID NO: of Nucleotide Encoding Orthologous *Arabidopsis* Transcription Factor |
|---|---|---|---|---|---|
| 1238 | | *Glycine max* | PRT | G912 | 185 |
| 1239 | | *Glycine max* | PRT | G912 | 185 |
| 1240 | | *Glycine max* | PRT | G912 | 185 |
| 1241 | | *Glycine max* | PRT | G912 | 185 |
| 1242 | | *Glycine max* | PRT | G912 | 185 |
| 1243 | | *Glycine max* | PRT | G912 | 185 |
| 1244 | | *Zea mays* | PRT | G912 | 185 |
| 1245 | | *Zea mays* | PRT | G912 | 185 |
| 1246 | G3440 | *Zea mays* | PRT | G912 | 185 |
| 1247 | | *Zea mays* | PRT | G912 | 185 |
| 1248 | | *Zea mays* | PRT | G912 | 185 |
| 1249 | | *Glycine max* | DNA | G922 | 189 |
| 1250 | G3811 | *Glycine max* | DNA | G922 | 189 |
| 1251 | | *Glycine max* | DNA | G922 | 189 |
| 1252 | | *Oryza sativa* | DNA | G922 | 189 |
| 1253 | | *Oryza sativa* | DNA | G922 | 189 |
| 1254 | | *Oryza sativa* | PRT | G922 | 189 |
| 1255 | | *Oryza sativa* | PRT | G922 | 189 |
| 1256 | | *Oryza sativa* | PRT | G922 | 189 |
| 1257 | G3813 | *Oryza sativa* | PRT | G922 | 189 |
| 1258 | | *Glycine max* | DNA | G926 | 191 |
| 1259 | | *Glycine max* | DNA | G926 | 191 |
| 1260 | | *Oryza sativa* | DNA | G926 | 191 |
| 1261 | | *Oryza sativa* | DNA | G926 | 191 |
| 1262 | | *Zea mays* | DNA | G926 | 191 |
| 1263 | | *Brassica napus* | PRT | G926 | 191 |
| 1292 | | *Glycine max* | DNA | G975, G2583 | 199, 449 |
| 1293 | | *Glycine max* | DNA | G975, G2583 | 199, 449 |
| 1294 | | *Glycine max* | DNA | G975, G2583 | 199, 449 |
| 1295 | | *Glycine max* | DNA | G975, G2583 | 199, 449 |
| 1296 | | *Glycine max* | DNA | G975, G2583 | 199, 449 |
| 1297 | | *Oryza sativa* | DNA | G975 | 199 |
| 1298 | | *Oryza sativa* | DNA | G975, G2583 | 199, 449 |
| 1299 | | *Zea mays* | DNA | G975, G2583 | 199, 449 |
| 1300 | | *Zea mays* | DNA | G975, G2583 | 199, 449 |
| 1301 | | *Brassica rapa* | DNA | G975, G2583 | 199, 449 |
| 1302 | | *Oryza sativa* | PRT | G975, G2583 | 199, 449 |
| 1393 | | *Glycine max* | DNA | G1069, G2153 | 221, 417 |
| 1394 | | *Glycine max* | DNA | G1069, G2153 | 221, 417 |
| 1395 | | *Oryza sativa* | PRT | G1069, G1073, G2153 | 221, 223, 417 |
| 1396 | | *Zea mays* | DNA | G1069, G2153 | 221, 417 |
| 1397 | | *Lotus japonicus* | DNA | G1069, G2153 | 221, 417 |
| 1398 | | *Lycopersicon esculentum* | DNA | G1073 | 223 |
| 1399 | G3399 | *Oryza sativa* | PRT | G1073 | 223 |
| 1400 | | *Oryza sativa* | PRT | G1073 | 223 |
| 1401 | G3400 | *Oryza sativa* | PRT | G1073 | 223 |
| 1402 | | *Oryza sativa* | PRT | G1073 | 223 |
| 1403 | | *Oryza sativa* | PRT | G1073 | 223 |
| 1404 | | *Oryza sativa* | PRT | G1073 | 223 |
| 1405 | | *Oryza sativa* | PRT | G1073 | 223 |
| 1406 | | *Oryza sativa* | PRT | G1073 | 223 |
| 1407 | | *Oryza sativa* | PRT | G1073 | 223 |
| 1408 | | *Oryza sativa* | PRT | G1073 | 223 |
| 1409 | | *Oryza sativa* | PRT | G1073 | 223 |
| 1410 | | *Oryza sativa* | PRT | G1073 | 223 |
| 1411 | | *Glycine max* | PRT | G1073 | 223 |
| 1412 | | *Glycine max* | PRT | G1073 | 223 |
| 1413 | | *Glycine max* | PRT | G1073 | 223 |
| 1414 | | *Glycine max* | PRT | G1073 | 223 |
| 1415 | | *Glycine max* | PRT | G1073 | 223 |
| 1416 | | *Glycine max* | PRT | G1073 | 223 |
| 1417 | | *Glycine max* | PRT | G1073 | 223 |
| 1418 | | *Zea mays* | PRT | G1073 | 223 |
| 1419 | | *Glycine max* | DNA | G1075 | 225 |
| 1420 | | *Glycine max* | DNA | G1075 | 225 |
| 1421 | | *Glycine max* | DNA | G1075 | 225 |
| 1422 | | *Glycine max* | DNA | G1075 | 225 |
| 1423 | | *Glycine max* | DNA | G1075 | 225 |

TABLE 10-continued

Orthologs of Representative *Arabidopsis* Transcription Factor Genes

| SEQ ID NO: of Ortholog or Nucleotide Encoding Ortholog | Ortholog GID NO | Species from Which Ortholog is Derived | Sequence type used for determination (DNA or Protein) | GID NO of Orthologous *Arabidopsis* Transcription Factor | SEQ ID NO: of Nucleotide Encoding Orthologous *Arabidopsis* Transcription Factor |
|---|---|---|---|---|---|
| 1424 | | *Oryza sativa* | DNA | G1075 | 225 |
| 1425 | | *Oryza sativa* | DNA | G1075 | 225 |
| 1426 | | *Oryza sativa* | DNA | G1075 | 225 |
| 1587 | | *Glycine max* | DNA | G1411, G2509 | 269, 439 |
| 1588 | | *Glycine max* | DNA | G1411, G2509 | 269, 439 |
| 1589 | | *Glycine max* | DNA | G1411, G2509 | 269, 439 |
| 1590 | | *Glycine max* | DNA | G1411, G2509 | 269, 439 |
| 1591 | | *Zea mays* | DNA | G1411, G2509 | 269, 439 |
| 1604 | | *Glycine max* | DNA | G1451 | 277 |
| 1605 | | *Glycine max* | DNA | G1451 | 277 |
| 1606 | | *Oryza sativa* | DNA | G1451 | 277 |
| 1607 | | *Oryza sativa* | DNA | G1451 | 277 |
| 1608 | | *Oryza sativa* | DNA | G1451 | 277 |
| 1609 | | *Zea mays* | DNA | G1451 | 277 |
| 1610 | | *Zea mays* | DNA | G1451 | 277 |
| 1611 | | *Zea mays* | DNA | G1451 | 277 |
| 1612 | | *Zea mays* | DNA | G1451 | 277 |
| 1613 | | *Medicago truncatula* | DNA | G1451 | 277 |
| 1614 | | *Solanum tuberosum* | DNA | G1451 | 277 |
| 1615 | | *Zea mays* | DNA | G1451 | 277 |
| 1616 | | *Sorghum propinquum* | DNA | G1451 | 277 |
| 1617 | | *Glycine max* | DNA | G1451 | 277 |
| 1618 | | *Sorghum bicolor* | DNA | G1451 | 277 |
| 1619 | | *Hordeum vulgare* | DNA | G1451 | 277 |
| 1620 | | *Lycopersicon esculentum* | DNA | G1451 | 277 |
| 1621 | | *Oryza sativa* | PRT | G1451 | 277 |
| 1622 | | *Oryza sativa* | PRT | G1451 | 277 |
| 1623 | | *Oryza sativa* | PRT | G1451 | 277 |
| 1624 | | *Oryza sativa* | PRT | G1451 | 277 |
| 1671 | | *Glycine max* | DNA | G1543 | 303 |
| 1672 | | *Oryza sativa* | DNA | G1543 | 303 |
| 1673 | | *Zea mays* | DNA | G1543 | 303 |
| 1674 | | *Oryza sativa* | PRT | G1543 | 303 |
| 1728 | | *Glycine max* | DNA | G1792 | 331 |
| 1729 | | *Glycine max* | DNA | G1792 | 331 |
| 1730 | | *Glycine max* | DNA | G1792 | 331 |
| 1731 | | *Glycine max* | DNA | G1792 | 331 |
| 1732 | | *Glycine max* | DNA | G1792 | 331 |
| 1733 | | *Zea mays* | DNA | G1792 | 331 |
| 1734 | | *Lycopersicon esculentum* | DNA | G1792 | 331 |
| 1735 | G3380 | *Oryza sativa* | PRT | G1792 | 331 |
| 1736 | G3381 | *Oryza sativa indica* | PRT | G1792 | 331 |
| 1737 | G3383 | *Oryza sativa japonica* | PRT | G1792 | 331 |
| 1795 | | *Oryza sativa* | DNA | G1930 | 369 |
| 1908 | | *Medicago truncatula* | DNA | G2155 | 419 |
| 1909 | | *Medicago truncatula* | DNA | G2155 | 419 |
| 1910 | | *Glycine max* | DNA | G2155 | 419 |
| 2907 | G3472 | *Glycine max* | DNA | G481, G482 | 87, 89 |
| 2908 | G3475 | *Glycine max* | DNA | G481, G482 | 87, 89 |
| 2909 | G3476 | *Glycine max* | DNA | G481, G482 | 87, 89 |
| 2910 | G3395 | *Oryza sativa* | DNA | G481, G482 | 87, 89 |
| 2911 | G3397 | *Oryza sativa* | DNA | G481, G482 | 87, 89 |
| 2912 | G3398 | *Oryza sativa* | DNA | G481, G482 | 87, 89 |
| 2913 | G3434 | *Zea mays* | DNA | G481, G482 | 87, 89 |
| 2914 | G3436 | *Zea mays* | DNA | G481, G482 | 87, 89 |
| 2915 | G3445 | *Glycine max* | DNA | G682 | 147 |
| 2916 | G3446 | *Glycine max* | DNA | G682 | 147 |
| 2917 | G3448 | *Glycine max* | DNA | G682 | 147 |
| 2918 | G3449 | *Glycine max* | DNA | G682 | 147 |
| 2919 | G3450 | *Glycine max* | DNA | G682 | 147 |
| 2920 | G3392 | *Oryza sativa* | DNA | G682 | 147 |
| 2921 | G3393 | *Oryza sativa* | DNA | G226, G682 | 37, 147 |
| 2922 | G3431 | *Zea mays* | DNA | G682 | 147 |
| 2923 | G3451 | *Glycine max* | DNA | G867, G1930 | 169, 369 |
| 2924 | G3452 | *Glycine max* | DNA | G867, G1930 | 169, 369 |
| 2925 | G3453 | *Glycine max* | DNA | G867, G1930 | 169, 369 |
| 2926 | G3388 | *Oryza sativa* | DNA | G867, G1930 | 169, 369 |
| 2927 | G3389 | *Oryza sativa* | DNA | G867, G1930 | 169, 369 |

TABLE 10-continued

Orthologs of Representative *Arabidopsis* Transcription Factor Genes

| SEQ ID NO: of Ortholog or Nucleotide Encoding Ortholog | Ortholog GID NO | Species from Which Ortholog is Derived | Sequence type used for determination (DNA or Protein) | GID NO of Orthologous *Arabidopsis* Transcription Factor | SEQ ID NO: of Nucleotide Encoding Orthologous *Arabidopsis* Transcription Factor |
|---|---|---|---|---|---|
| 2928 | G3390 | *Oryza sativa* | DNA | G867, G1930 | 169, 369 |
| 2929 | G3433 | *Zea mays* | DNA | G867, G1930 | 169, 369 |
| 2930 | G3376 | *Oryza sativa* | DNA | G912 | 185 |
| 2931 | G3372 | *Oryza sativa* | DNA | G912 | 185 |
| 2932 | G3373 | *Oryza sativa* | DNA | G912, G913 | 185, 187 |
| 2933 | G3375 | *Oryza sativa* | DNA | G912, G913 | 185, 187 |
| 2934 | G3377 | *Oryza sativa* | DNA | G912 | 185 |
| 2935 | G3379 | *Oryza sativa* | DNA | G912 | 185 |
| 2936 | G3440 | *Zea mays* | DNA | G912 | 185 |
| 2937 | G3399 | *Oryza sativa* | DNA | G1073 | 223 |
| 2938 | G3400 | *Oryza sativa* | DNA | G1073 | 223 |
| 2939 | G3380 | *Oryza sativa* | DNA | G1792 | 331 |
| 2940 | G3381 | *Oryza sativa indica* | DNA | G1792 | 331 |
| 2941 | G3383 | *Oryza sativa japonica* | DNA | G1792 | 331 |
| 2942 | G3643 | *Glycine max* | PRT | G47, G2133 | 11, 407 |
| 2943 | G3811 | *Glycine max* | PRT | G922 | 189 |
| 2944 | G3813 | *Oryza sativa* | DNA | G922 | 189 |
| 2945 | G3429 | *Oryza sativa* | DNA | G481, G482 | 87, 89 |
| 2946 | G3429 | *Oryza sativa* | PRT | G481, G482 | 87, 89 |
| 2947 | G3470 | *Glycine max* | DNA | G481, G482 | 87, 89 |
| 2948 | G3470 | *Glycine max* | PRT | G481, G482 | 87, 89 |
| 2949 | G3471 | *Glycine max* | DNA | G481, G482 | 87, 89 |
| 2950 | G3471 | *Glycine max* | PRT | G481, G482 | 87, 89 |

Table 11 lists a summary of homologous sequences identified using BLAST (tblastx program). The first column shows the polynucleotide sequence identifier (SEQ ID NO), the second column shows the corresponding cDNA identifier (Gene ID), the third column shows the orthologous or homologous polynucleotide GenBank Accession Number (Test Sequence ID), the fourth column shows the calculated probability value that the sequence identity is due to chance (Smallest Sum Probability), the fifth column shows the plant species from which the test sequence was isolated (Test Sequence Species), and the sixth column shows the orthologous or homologous test sequence GenBank annotation (Test Sequence GenBank Annotation).

TABLE 11

Summary of representative sequences that are homologous to presently disclosed transcription factors

| SEQ ID NO: | GID | Test Sequence ID | Smallest Sum Probability | Test Sequence Species | Test Sequence GenBank Annotation |
|---|---|---|---|---|---|
| 3 | G19 | BG321358 | 1.00E−101 | *Descurainia sophia* | Ds01__07d03__R Ds01__AAFC__ECORC__cold__stress |
| 3 | G19 | BH444831 | 1.00E−77 | *Brassica oleracea* | BOHPW42TR BOHP *Brassica oleracea* genomic |
| 3 | G19 | BM412184 | 2.00E−43 | *Lycopersicon esculentum* | EST586511 tomato breaker fruit Lyco |
| 3 | G19 | BU837697 | 3.00E−43 | *Populus tremula* x *Populus tremuloides* | T104G02 *Populus apica* |
| 3 | G19 | CA784650 | 6.00E−43 | *Glycine max* | sat87a10.y1 Gm-c1062 *Glycine max* cDNA clone SOY |
| 3 | G19 | BU819833 | 3.00E−41 | *Populus tremula* | UA48BPB07 *Populus tremula* cambium cDNA libr |
| 3 | G19 | BU870388 | 4.00E−41 | *Populus balsamifera* subsp. *trichocarpa* | Q011H05 *Populus* flow |
| 3 | G19 | CA797119 | 1.00E−38 | *Theobroma cacao* | Cac__BL__4204 Cac__BL (Bean and Leaf from Amel |
| 3 | G19 | BI436183 | 2.00E−38 | *Solanum tuberosum* | EST538944 cSTE *Solanum tuberosum* cDNA clo |
| 3 | G19 | BQ989448 | 2.00E−36 | *Lactuca sativa* | QGF17L05.yg.ab1 QG__EFGHJ lettuce serriola La |
| 3 | G19 | gi10798644 | 5.70E−36 | *Nicotiana tabacum* | AP2 domain-containing transcription fac |
| 3 | G19 | gi6176534 | 2.40E−35 | *Oryza sativa* | EREBP-like protein. |
| 3 | G19 | gi1688233 | 7.50E−34 | *Solanum tuberosum* | DNA binding protein homolog. |
| 3 | G19 | gi22074046 | 1.50E−33 | *Lycopersicon esculentum* | transcription factor JERF1. |

TABLE 11-continued

Summary of representative sequences that are homologous to presently disclosed transcription factors

| SEQ ID NO: | GID | Test Sequence ID | Smallest Sum Probability | Test Sequence Species | Test Sequence GenBank Annotation |
|---|---|---|---|---|---|
| 3 | G19 | gi18496063 | 4.90E−33 | *Fagus sylvatica* | ethylene responsive element binding prote |
| 3 | G19 | gi20805105 | 2.10E−32 | *Oryza sativa (japonica cultivar-group)* | contains ESTs AU06 |
| 3 | G19 | gi24940524 | 2.30E−31 | *Triticum aestivum* | ethylene response element binding prote |
| 3 | G19 | gi18266198 | 2.30E−31 | *Narcissus pseudonarcissus* | AP-2 domain containing protein. |
| 3 | G19 | gi3264767 | 1.30E−30 | *Prunus armeniaca* | AP2 domain containing protein. |
| 3 | G19 | gi24817250 | 4.00E−28 | *Cicer arietinum* | transcription factor EREBP-like protein. |
| 5 | G22 | AB016264 | 9.00E−48 | *Nicotiana sylvestris* | nserf2 gene for ethylene-responsive el |
| 5 | G22 | TOBBY4A | 1.00E−47 | *Nicotiana tabacum* | mRNA for ERF1, complete cds. |
| 5 | G22 | AP004533 | 4.00E−47 | *Lotus japonicus* | genomic DNA, chromosome 3, clone: LjT14G02, |
| 5 | G22 | LEU89255 | 6.00E−47 | *Lycopersicon esculentum* | DNA-binding protein Pti4 mRNA, comp |
| 5 | G22 | BQ517082 | 6.00E−46 | *Solanum tuberosum* | EST624497 Generation of a set of potato c |
| 5 | G22 | BE449392 | 1.00E−45 | *Lycopersicon hirsutum* | EST356151 *L. hirsutum* trichome, Corne |
| 5 | G22 | AF245119 | 5.00E−45 | *Mesembryanthemum crystallinum* | AP2-related transcription fac |
| 5 | G22 | BQ165291 | 7.00E−45 | *Medicago truncatula* | EST611160 KVKC *Medicago truncatula* cDNA |
| 5 | G22 | AW618245 | 8.00E−38 | *Lycopersicon pennellii* | EST314295 *L. pennellii* trichome, Cor |
| 5 | G22 | BG444654 | 2.00E−36 | *Gossypium arboreum* | GA__Ea0025B11f *Gossypium arboreum* 7-10 d |
| 5 | G22 | gi1208495 | 6.10E−48 | *Nicotiana tabacum* | ERF1. |
| 5 | G22 | gi3342211 | 3.30E−47 | *Lycopersicon esculentum* | Pti4. |
| 5 | G22 | gi8809571 | 8.90E−47 | *Nicotiana sylvestris* | ethylene-responsive element binding |
| 5 | G22 | gi17385636 | 2.70E−36 | *Matricaria chamomilla* | ethylene-responsive element binding |
| 5 | G22 | gi8980313 | 2.50E−33 | *Catharanthus roseus* | AP2-domain DNA-binding protein. |
| 5 | G22 | gi7528276 | 8.60E−33 | *Mesembryanthemum crystallinum* | AP2-related transcription f |
| 5 | G22 | gi21304712 | 3.10E−28 | *Glycine max* | ethylene-responsive element binding protein 1 |
| 5 | G22 | gi14140141 | 1.50E−26 | *Oryza sativa* | putative AP2-related transcription factor. |
| 5 | G22 | gi15623863 | 1.30E−22 | *Oryza sativa (japonica cultivar-group)* | contains EST~hypot |
| 5 | G22 | gi4099914 | 3.10E−21 | *Stylosanthes hamata* | ethylene-responsive element binding p |
| 9 | G28 | AF245119 | 2.00E−72 | *Mesembryanthemum crystallinum* | AP2-related transcription fac |
| 9 | G28 | BQ165291 | 1.00E−68 | *Medicago truncatula* | EST611160 KVKC *Medicago truncatula* cDNA |
| 9 | G28 | AB016264 | 1.00E−57 | *Nicotiana sylvestris* | nserf2 gene for ethylene-responsive el |
| 9 | G28 | TOBBY4D | 2.00E−57 | *Nicotiana tabacum* | Tobacco mRNA for EREBP-2, complete cds. |
| 9 | G28 | BQ047502 | 2.00E−57 | *Solanum tuberosum* | EST596620 *P. infestans*-challenged potato |
| 9 | G28 | LEU89255 | 2.00E−56 | *Lycopersicon esculentum* | DNA-binding protein Pti4 mRNA, comp |
| 9 | G28 | BH454277 | 2.00E−54 | *Brassica oleracea* | BOGSI45TR BOGS *Brassica oleracea* genomic |
| 9 | G28 | BE449392 | 1.00E−53 | *Lycopersicon hirsutum* | EST356151 *L. hirsutum* trichome, Corne |
| 9 | G28 | AB035270 | 2.00E−50 | *Matricaria chamomilla* | McEREBP1 mRNA for ethylene-responsive |
| 9 | G28 | AW233956 | 5.00E−50 | *Glycine max* | sf32e02.y1 Gm-c1028 *Glycine max* cDNA clone GENO |
| 9 | G28 | gi7528276 | 6.10E−71 | *Mesembryanthemum crystallinum* | AP2-related transcription f |
| 9 | G28 | gi8809571 | 3.30E−56 | *Nicotiana sylvestris* | ethylene-responsive element binding |
| 9 | G28 | gi3342211 | 4.20E−56 | *Lycopersicon esculentum* | Pti4. |

TABLE 11-continued

Summary of representative sequences that are homologous to presently disclosed transcription factors

| SEQ ID NO: | GID | Test Sequence ID | Smallest Sum Probability | Test Sequence Species | Test Sequence GenBank Annotation |
|---|---|---|---|---|---|
| 9 | G28 | gi1208498 | 8.70E−56 | *Nicotiana tabacum* | EREBP-2. |
| 9 | G28 | gi14140141 | 4.20E−49 | *Oryza sativa* | putative AP2-related transcription factor. |
| 9 | G28 | gi17385636 | 3.00E−46 | *Matricaria chamomilla* | ethylene-responsive element binding |
| 9 | G28 | gi21304712 | 2.90E−31 | *Glycine max* | ethylene-responsive element binding protein 1 |
| 9 | G28 | gi15623863 | 5.60E−29 | *Oryza sativa* (*japonica* cultivar-group) | contains EST~hypot |
| 9 | G28 | gi8980313 | 1.20E−26 | *Catharanthus roseus* | AP2-domain DNA-binding protein. |
| 9 | G28 | gi4099921 | 3.10E−21 | *Stylosanthes hamata* | EREBP-3 homolog. |
| 11 | G47 | BG543936 | 1.00E−60 | *Brassica rapa* subsp. *pekinensis* | E1686 Chinese cabbage etiol |
| 11 | G47 | BH420519 | 3.00E−43 | *Brassica oleracea* | BOGUH88TF BOGU *Brassica oleracea* genomic |
| 11 | G47 | AU292603 | 3.00E−30 | *Zinnia elegans* | AU292603 zinnia cultured mesophyll cell equa |
| 11 | G47 | BE320193 | 1.00E−24 | *Medicago truncatula* | NF024B04RT1F1029 Developing root Medica |
| 11 | G47 | AAAA01000718 | 1.00E−22 | *Oryza sativa* (*indica* cultivar-group) | ( ) scaffold000718 |
| 11 | G47 | AP003379 | 2.00E−22 | *Oryza sativa* | chromosome 1 clone P0408G07, *** SEQUENCING IN |
| 11 | G47 | AC124836 | 8.00E−21 | *Oryza sativa* (*japonica* cultivar-group) | ( ) chromosome 5 clo |
| 11 | G47 | BZ403609 | 2.00E−20 | *Zea mays* | OGABN17TM ZM_0.7_1.5_KB *Zea mays* genomic clone ZMM |
| 11 | G47 | BM112772 | 6.00E−17 | *Solanum tuberosum* | EST560308 potato roots *Solanum tuberosum* |
| 11 | G47 | BQ698717 | 1.00E−16 | *Pinus taeda* | NXPV_148_C06_F NXPV (Nsf Xylem Planings wood Ve |
| 11 | G47 | gi20161239 | 6.90E−24 | *Oryza sativa* (*japonica* cultivar-group) | hypothetical prote |
| 11 | G47 | gi14140155 | 6.80E−17 | *Oryza sativa* | putative AP2 domain transcription factor. |
| 11 | G47 | gi21908034 | 7.00E−15 | *Zea mays* | DRE binding factor 2. |
| 11 | G47 | gi20303011 | 1.90E−14 | *Brassica napus* | CBF-like protein CBF5. |
| 11 | G47 | gi8571476 | 3.00E−14 | *Atriplex hortensis* | apetala2 domain-containing protein. |
| 11 | G47 | gi8980313 | 2.10E−13 | *Catharanthus roseus* | AP2-domain DNA-binding protein. |
| 11 | G47 | gi19071243 | 4.40E−13 | *Hordeum vulgare* | CRT/DRE binding factor 1. |
| 11 | G47 | gi18650662 | 5.60E−13 | *Lycopersicon esculentum* | ethylene response factor 1. |
| 11 | G47 | gi17385636 | 1.20E−12 | *Matricaria chamomilla* | ethylene-responsive element binding |
| 11 | G47 | gi1208498 | 1.50E−12 | *Nicotiana tabacum* | EREBP-2. |
| 37 | G226 | BU872107 | 2.00E−21 | *Populus balsamifera* subsp. *trichocarpa* | Q039C07 *Populus* flow |
| 37 | G226 | BU831849 | 2.00E−21 | *Populus tremula* x *Populus tremuloides* | T026E01 *Populus apica* |
| 37 | G226 | BM437313 | 9.00E−21 | *Vitis vinifera* | VVA017F06_54121 An expressed sequence tag da |
| 37 | G226 | BI699876 | 1.00E−19 | *Glycine max* | sag49b09.y1 Gm-c1081 *Glycine max* cDNA clone GEN |
| 37 | G226 | AL750151 | 4.00E−16 | *Pinus pinaster* | AL750151 AS *Pinus pinaster* cDNA clone AS06C1 |
| 37 | G226 | CA744013 | 2.00E−12 | *Triticum aestivum* | wr1s.pk006.m22 wr1s *Triticum aestivum* c |
| 37 | G226 | BH961028 | 3.00E−12 | *Brassica oleracea* | odj30d06.g1 B. oleracea002 *Brassica olerac* |
| 37 | G226 | BJ472717 | 8.00E−12 | *Hordeum vulgare* subsp. *vulgare* | BJ472717 K. Sato unpublished |
| 37 | G226 | BF617445 | 8.00E−12 | *Hordeum vulgare* | HVSMEc0017G08f *Hordeum vulgare* seedling sho |
| 37 | G226 | CA762299 | 2.00E−11 | *Oryza sativa* (*indica* cultivar-group) | BR060003B10F03.ab1 IRR |
| 37 | G226 | gi9954118 | 2.20E−11 | *Solanum tuberosum* | tuber-specific and sucrose-responsive e |
| 37 | G226 | gi14269333 | 2.50E−10 | *Gossypium raimondii* | myb-like transcription factor Myb 3. |

TABLE 11-continued

Summary of representative sequences that are homologous to presently disclosed transcription factors

| SEQ ID NO: | GID | Test Sequence ID | Smallest Sum Probability | Test Sequence Species | Test Sequence GenBank Annotation |
|---|---|---|---|---|---|
| 37 | G226 | gi14269335 | 2.50E−10 | Gossypium herbaceum | myb-like transcription factor Myb 3. |
| 37 | G226 | gi14269337 | 2.50E−10 | Gossypium hirsutum | myb-like transcription factor Myb 3. |
| 37 | G226 | gi23476297 | 2.50E−10 | Gossypioides kirkii | myb-like transcription factor 3. |
| 37 | G226 | gi15082210 | 8.50E−10 | Fragaria x ananassa | transcription factor MYB1. |
| 37 | G226 | gi19072770 | 8.50E−10 | Oryza sativa | typical P-type R2R3 Myb protein. |
| 37 | G226 | gi15042108 | 1.40E−09 | Zea mays subsp. parviglumis | CI protein. |
| 37 | G226 | gi15042124 | 1.40E−09 | Zea luxurians | CI protein. |
| 37 | G226 | gi20514371 | 1.40E−09 | Cucumis sativus | werewolf. |
| 59 | G353 | BQ790831 | 5.00E−68 | Brassica rapa subsp. pekinensis | E4675 Chinese cabbage etiol |
| 59 | G353 | BZ019752 | 1.00E−67 | Brassica oleracea | oed85c06.g1 B. oleracea002 Brassica olerac |
| 59 | G353 | L46574 | 6.00E−40 | Brassica rapa | BNAF1975 Mustard flower buds Brassica rapa cD |
| 59 | G353 | AB006601 | 7.00E−26 | Petunia x hybrida | mRNA for ZPT2-14, complete cds. |
| 59 | G353 | BM437146 | 2.00E−25 | Vitis vinifera | VVA015A06_53787 An expressed sequence tag da |
| 59 | G353 | BI422808 | 1.00E−24 | Lycopersicon esculentum | EST533474 tomato callus, TAMU Lycop |
| 59 | G353 | BU867080 | 1.00E−24 | Populus tremula x Populus tremuloides | S074B01 Populus imbib |
| 59 | G353 | BM527789 | 3.00E−23 | Glycine max | sal65h07.y1 Gm-c1061 Glycine max cDNA clone SOY |
| 59 | G353 | BQ980246 | 5.00E−23 | Lactuca sativa | QGE10I12.yg.ab1 QG_EFGHJ lettuce serriola La |
| 59 | G353 | BQ121106 | 2.00E−22 | Solanum tuberosum | EST606682 mixed potato tissues Solanum tu |
| 59 | G353 | gi2346976 | 6.50E−28 | Petunia x hybrida | ZPT2-13. |
| 59 | G353 | gi15623820 | 4.40E−25 | Oryza sativa | hypothetical protein. |
| 59 | G353 | gi21104613 | 1.40E−18 | Oryza sativa (japonica cultivar-group) | contains ESTs AU07 |
| 59 | G353 | gi485814 | 3.10E−13 | Triticum aestivum | WZF1. |
| 59 | G353 | gi7228329 | 4.00E−12 | Medicago sativa | putative TFIIIA (or kruppel)-like zinc fi |
| 59 | G353 | gi1763063 | 1.70E−11 | Glycine max | SCOF-1. |
| 59 | G353 | gi2981169 | 2.60E−11 | Nicotiana tabacum | osmotic stress-induced zinc-finger prot |
| 59 | G353 | gi4666360 | 1.10E−10 | Datisca glomerata | zinc-finger protein 1. |
| 59 | G353 | gi2129892 | 2.30E−08 | Pisum sativum | probable finger protein Pszf1 - garden pea. |
| 59 | G353 | gi2058504 | 0.00018 | Brassica rapa | zinc-finger protein-1. |
| 61 | G354 | BZ083260 | 5.00E−49 | Brassica oleracea | lle29f02.g1 B. oleracea002 Brassica olerac |
| 61 | G354 | BQ790831 | 8.00E−45 | Brassica rapa subsp. pekinensis | E4675 Chinese cabbage etiol |
| 61 | G354 | AB006600 | 6.00E−27 | Petunia x hybrida | mRNA for ZPT2-13, complete cds. |
| 61 | G354 | L46574 | 1.00E−26 | Brassica rapa | BNAF1975 Mustard flower buds Brassica rapa cD |
| 61 | G354 | BM437146 | 3.00E−24 | Vitis vinifera | VVA015A06_53787 An expressed sequence tag da |
| 61 | G354 | BQ121105 | 6.00E−24 | Solanum tuberosum | EST606681 mixed potato tissues Solanum tu |
| 61 | G354 | BM527789 | 2.00E−23 | Glycine max | sal65h07.y1 Gm-c10611 Glycine max cDNA clone SOY |
| 61 | G354 | AI898309 | 2.00E−23 | Lycopersicon esculentum | EST267752 tomato ovary, TAMU Lycope |
| 61 | G354 | BU867080 | 5.00E−22 | Populus tremula x Populus tremuloides | S074B01 Populus imbib |
| 61 | G354 | BQ980246 | 1.00E−21 | Lactuca sativa | QGE10I12.yg.ab1 QG_EFGHJ lettuce serriola La |
| 61 | G354 | gi2346976 | 5.60E−29 | Petunia x hybrida | ZPT2-13. |
| 61 | G354 | gi15623820 | 1.90E−22 | Oryza sativa | hypothetical protein. |
| 61 | G354 | gi21104613 | 4.00E−19 | Oryza sativa (japonica cultivar-group) | contains ESTs AU07 |
| 61 | G354 | gi2981169 | 1.80E−17 | Nicotiana tabacum | osmotic stress-induced zinc-finger prot |
| 61 | G354 | gi1763063 | 4.10E−16 | Glycine max | SCOF-1. |
| 61 | G354 | gi4666360 | 8.90E−15 | Datisca glomerata | zinc-finger protein 1. |
| 61 | G354 | gi2058504 | 1.00E−14 | Brassica rapa | zinc-finger protein-1. |

TABLE 11-continued

Summary of representative sequences that are homologous to presently disclosed transcription factors

| SEQ ID NO: | GID | Test Sequence ID | Smallest Sum Probability | Test Sequence Species | Test Sequence GenBank Annotation |
|---|---|---|---|---|---|
| 61 | G354 | gi7228329 | 4.90E−14 | Medicago sativa | putative TFIIIA (or kruppel)-like zinc fi |
| 61 | G354 | gi485814 | 3.20E−13 | Triticum aestivum | WZF1. |
| 61 | G354 | gi2129892 | 1.20E−06 | Pisum sativum | probable finger protein Pszf1 - garden pea. |
| 87 | G481 | BU238020 | 9.00E−71 | Descurainia sophia | Ds01_14a12_A Ds01_AAFC_ECORC_cold_stress |
| 87 | G481 | BG440251 | 2.00E−56 | Gossypium arboreum | GA_Ea0006K20f Gossypium arboreum 7-10 d |
| 87 | G481 | BF071234 | 1.00E−54 | Glycine max | st06h05.y1 Gm-c1065 Glycine max cDNA clone GENO |
| 87 | G481 | BQ799965 | 2.00E−54 | Vitis vinifera | EST 2134 Green Grape berries Lambda Zap II L |
| 87 | G481 | BQ488908 | 5.00E−53 | Beta vulgaris | 95-E9134-006-006-M23-T3 Sugar beet MPIZ-ADIS- |
| 87 | G481 | BU499457 | 1.00E−52 | Zea mays | 946175D02.y1 946 - tassel primordium prepared by S |
| 87 | G481 | AI728916 | 2.00E−52 | Gossypium hirsutum | BNLGHi12022 Six-day Cotton fiber Gossypi |
| 87 | G481 | BG642751 | 3.00E−52 | Lycopersicon esculentum | EST510945 tomato shoot/meristem Lyc |
| 87 | G481 | BQ857127 | 3.00E−51 | Lactuca sativa | QGB6K24.yg.ab1 QG_ABCDI lettuce salinas Lact |
| 87 | G481 | BE413647 | 6.00E−51 | Triticum aestivum | SCU001.E10.R990714 ITEC SCU Wheat Endospe |
| 87 | G481 | gi115840 | 1.90E−51 | Zea mays | CCAAT-BINDING TRANSCRIPTION FACTOR SUBUNIT A (CB |
| 87 | G481 | gi20160792 | 2.60E−47 | Oryza sativa (japonica cultivar-group) | putative CAAT-box |
| 87 | G481 | gi15408794 | 7.10E−38 | Oryza sativa | putative CCAAT-binding transcription factor |
| 89 | G482 | BQ505706 | 7.00E−59 | Solanum tuberosum | EST613121 Generation of a set of potato c |
| 89 | G482 | AC122165 | 6.00E−57 | Medicago truncatula | clone mth2-32m22, WORKING DRAFT SEQUENC |
| 89 | G482 | BQ104671 | 2.00E−55 | Rosa hybrid cultivar | fc0546.e Rose Petals (Fragrant Cloud) |
| 89 | G482 | BI469382 | 4.00E−55 | Glycine max | sai11b10.y1 Gm-c1053 Glycine max cDNA clone GEN |
| 89 | G482 | AAAA01003638 | 1.00E−54 | Oryza sativa (indica cultivar-group) | ( ) scaffold003638 |
| 89 | G482 | AP005193 | 1.00E−54 | Oryza sativa (japonica cultivar-group) | ( ) chromosome 7 clo |
| 89 | G482 | BU880488 | 1.00E−53 | Populus balsamifera subsp. trichocarpa | UM49TG09 Populus flo |
| 89 | G482 | BJ248969 | 2.00E−53 | Triticum aestivum | BJ248969 Y. Ogihara unpublished cDNA libr |
| 89 | G482 | AC120529 | 4.00E−53 | Oryza sativa | chromosome 3 clone OSJNBa0039N21, *** SEQUENCI |
| 89 | G482 | BU896236 | 7.00E−53 | Populus tremula x Populus tremuloides | X037F04 Populus wood |
| 89 | G482 | gi115840 | 1.40E−46 | Zea mays | CCAAT-BINDING TRANSCRIPTION FACTOR SUBUNIT A (CB |
| 89 | G482 | gi20160792 | 2.30E−41 | Oryza sativa (japonica cultivar-group) | putative CAAT-box |
| 93 | G489 | BH679015 | 1.00E−111 | Brassica oleracea | BOHXO96TF BO_2_3_KB Brassica oleracea gen |
| 93 | G489 | AC136503 | 1.00E−75 | Medicago truncatula | clone mth2-15n1, WORKING DRAFT SEQUENCE |
| 93 | G489 | BQ118033 | 8.00E−73 | Solanum tuberosum | EST603609 mixed potato tissues Solanum tu |
| 93 | G489 | BU873518 | 4.00E−68 | Populus balsamifera subsp. trichocarpa | Q056D09 Populus flow |
| 93 | G489 | BI934205 | 2.00E−67 | Lycopersicon esculentum | EST554094 tomato flower, anthesis L |
| 93 | G489 | BQ797616 | 1.00E−66 | Vitis vinifera | EST 6554 Ripening Grape berries Lambda Zap I |
| 93 | G489 | BM064398 | 4.00E−63 | Capsicum annuum | KS01066E11 KS01 Capsicum annuum cDNA, mRNA |
| 93 | G489 | BU927107 | 4.00E−60 | Glycine max | sas95f12.y1 Gm-c1036 Glycine max cDNA clone SOY |

TABLE 11-continued

Summary of representative sequences that are homologous to presently disclosed transcription factors

| SEQ ID NO: | GID | Test Sequence ID | Smallest Sum Probability | Test Sequence Species | Test Sequence GenBank Annotation |
|---|---|---|---|---|---|
| 93 | G489 | BQ993879 | 6.00E−59 | Lactuca sativa | QGF5L12.yg.ab1 QG_EFGHJ lettuce serriola Lac |
| 93 | G489 | AP004113 | 1.00E−58 | Oryza sativa | chromosome 2 clone OJ1116_A06, *** SEQUENCING |
| 93 | G489 | gi5257260 | 6.20E−46 | Oryza sativa | Similar to sequence of BAC F7G19 from Arabid |
| 93 | G489 | gi20804442 | 6.60E−19 | Oryza sativa (japonica cultivar-group) | hypothetical prote |
| 93 | G489 | gi18481626 | 3.90E−09 | Zea mays | repressor protein. |
| 93 | G489 | gi1808688 | 0.051 | Sporobolus stapfianus | hypothetical protein. |
| 93 | G489 | gi8096192 | 0.21 | Lilium longiflorum | gH2A.1. |
| 93 | G489 | gi2130105 | 0.25 | Triticum aestivum | histone H2A.4 - wheat. |
| 93 | G489 | gi297871 | 0.27 | Picea abies | histone H2A. |
| 93 | G489 | gi297887 | 0.31 | Daucus carota | glycine rich protein. |
| 93 | G489 | gi15214035 | 0.75 | Cicer arietinum | HISTONE H2A. |
| 93 | G489 | gi2317760 | 0.75 | Pinus taeda | H2A homolog. |
| 127 | G634 | OSGT2 | 2.00E−47 | Oryza sativa | O. sativa gt-2 gene. |
| 127 | G634 | BU049946 | 1.00E−46 | Zea mays | 1111017E09.y1 1111 - Unigene III from Maize Genome |
| 127 | G634 | AF372499 | 6.00E−38 | Glycine max | GT-2 factor mRNA, partial cds. |
| 127 | G634 | AB052729 | 4.00E−37 | Pisum sativum | mRNA for DNA-binding protein DF1, complete cd |
| 127 | G634 | BU889446 | 4.00E−36 | Populus tremula | P021A05 Populus petioles cDNA library Popul |
| 127 | G634 | BH436958 | 2.00E−35 | Brassica oleracea | BOHBE67TF BOHB Brassica oleracea genomic |
| 127 | G634 | AI777252 | 3.00E−35 | Lycopersicon esculentum | EST258217 tomato resistant, Cornell |
| 127 | G634 | AW686754 | 1.00E−33 | Medicago truncatula | NF042C08NR1F1000 Nodulated root Medicag |
| 127 | G634 | AV410715 | 4.00E−33 | Lotus japonicus | AV410715 Lotus japonicus young plants (two- |
| 127 | G634 | AI730933 | 8.00E−30 | Gossypium hirsutum | BNLGHi8208 Six-day Cotton fiber Gossypiu |
| 127 | G634 | gi13786451 | 3.20E−78 | Oryza sativa | putative transcription factor. |
| 127 | G634 | gi13646986 | 3.50E−66 | Pisum sativum | DNA-binding protein DF1. |
| 127 | G634 | gi18182311 | 2.70E−38 | Glycine max | GT-2 factor. |
| 127 | G634 | gi20161567 | 8.90E−11 | Oryza sativa (japonica cultivar-group) | hypothetical prote |
| 127 | G634 | gi170271 | 4.70E−08 | Nicotiana tabacum | DNA-binding protein. |
| 127 | G634 | gi18349 | 0.0027 | Daucus carota | glycine rich protein (AA 1-96). |
| 127 | G634 | gi21388658 | 0.027 | Physcomitrella patens | glycine-rich RNA binding protein. |
| 127 | G634 | gi21322752 | 0.052 | Triticum aestivum | cold shock protein-1. |
| 127 | G634 | gi3126963 | 0.057 | Elaeagnus umbellata | acidic chitinase. |
| 127 | G634 | gi1166450 | 0.087 | Lycopersicon esculentum | Tfm5. |
| 147 | G682 | BU831849 | 8.00E−25 | Populus tremula x Populus tremuloides | T026E01 Populus apica |
| 147 | G682 | BU872107 | 8.00E−25 | Populus balsamifera subsp. trichocarpa | Q039C07 Populus flow |
| 147 | G682 | BM437313 | 1.00E−20 | Vitis vinifera | VVA017F06_54121 An expressed sequence tag da |
| 147 | G682 | BI699876 | 4.00E−19 | Glycine max | sag49b09.y1 Gm-c1081 Glycine max cDNA clone GEN |
| 147 | G682 | BH961028 | 1.00E−16 | Brassica oleracea | odj30d06.g1 B. oleracea002 Brassica olerac |
| 147 | G682 | AL750151 | 2.00E−14 | Pinus pinaster | AL750151 AS Pinus pinaster cDNA clone AS06C1 |
| 147 | G682 | BJ476463 | 1.00E−13 | Hordeum vulgare subsp. vulgare | BJ476463 K. Sato unpublished |
| 147 | G682 | AJ485557 | 1.00E−13 | Hordeum vulgare | AJ485557 S00011 Hordeum vulgare cDNA clone |
| 147 | G682 | CA762299 | 2.00E−13 | Oryza sativa (indica cultivar-group) | BR060003B10F03.ab1 IRR |
| 147 | G682 | CA736777 | 2.00E−12 | Triticum aestivum | wpi1s.pk008.n12 wpi1s Triticum aestivum c |
| 147 | G682 | gi23476287 | 8.30E−12 | Gossypium hirsutum | myb-like transcription factor 2. |
| 147 | G682 | gi23476291 | 8.30E−12 | Gossypium raimondii | myb-like transcription factor 2. |
| 147 | G682 | gi23476293 | 8.30E−12 | Gossypium herbaceum | myb-like transcription factor 2. |
| 147 | G682 | gi23476295 | 8.30E−12 | Gossypioides kirkii | myb-like transcription factor 2. |
| 147 | G682 | gi15042120 | 2.20E−11 | Zea luxurians | CI protein. |

TABLE 11-continued

Summary of representative sequences that are homologous to presently disclosed transcription factors

| SEQ ID NO: | GID | Test Sequence ID | Smallest Sum Probability | Test Sequence Species | Test Sequence GenBank Annotation |
|---|---|---|---|---|---|
| 147 | G682 | gi19548449 | 2.20E−11 | Zea mays | P-type R2R3 Myb protein. |
| 147 | G682 | gi9954118 | 2.80E−11 | Solanum tuberosum | tuber-specific and sucrose-responsive e |
| 147 | G682 | gi15042108 | 4.60E−11 | Zea mays subsp. parviglumis | C1 protein. |
| 147 | G682 | gi15082210 | 1.50E−10 | Fragaria x ananassa | transcription factor MYB1. |
| 147 | G682 | gi22266669 | 1.50E−10 | Vitis labrusca x Vitis vinifera | myb-related transcription |
| 167 | G864 | BH472654 | 1.00E−105 | Brassica oleracea | BOHPF07TF BOHP Brassica oleracea genomic |
| 167 | G864 | AP004902 | 2.00E−44 | Lotus japonicus | genomic DNA, chromosome 2, clone: LjT04G24, |
| 167 | G864 | BM886518 | 5.00E−40 | Glycine max | sam17f08.y1 Gm-c1068 Glycine max cDNA clone SOY |
| 167 | G864 | AW685524 | 5.00E−39 | Medicago truncatula | NF031C12NR1F1000 Nodulated root Medicag |
| 167 | G864 | AP001800 | 6.00E−36 | Oryza sativa | genomic DNA, chromosome 1, PAC clone: P0443E05. |
| 167 | G864 | LEU89257 | 6.00E−32 | Lycopersicon esculentum | DNA-binding protein Pti6 mRNA, comp |
| 167 | G864 | AAAA01000263 | 7.00E−31 | Oryza sativa (indica cultivar-group) | ( ) scaffold000263 |
| 167 | G864 | BQ873772 | 8.00E−30 | Lactuca sativa | QGI2I03.yg.ab1 QG_ABCDI lettuce salinas Lact |
| 167 | G864 | AF058827 | 7.00E−29 | Nicotiana tabacum | TSI1 (Tsi1) mRNA, complete cds. |
| 167 | G864 | BZ419846 | 3.00E−25 | Zea mays | if61a07.b1 WGS-ZmaysF (DH5a methyl filtered) Zea m |
| 167 | G864 | gi8096469 | 1.60E−38 | Oryza sativa | Similar to Arabidopsis thaliana chromosome 4 |
| 167 | G864 | gi2213785 | 1.00E−34 | Lycopersicon esculentum | Pti6. |
| 167 | G864 | gi23617235 | 3.70E−25 | Oryza sativa (japonica cultivar-group) | contains ESTs AU16 |
| 167 | G864 | gi3065895 | 7.60E−25 | Nicotiana tabacum | TSI1. |
| 167 | G864 | gi3264767 | 1.90E−21 | Prunus armeniaca | AP2 domain containing protein. |
| 167 | G864 | gi8571476 | 4.30E−21 | Atriplex hortensis | apetala2 domain-containing protein. |
| 167 | G864 | gi17385636 | 2.80E−20 | Matricaria chamomilla | ethylene-responsive element binding |
| 167 | G864 | gi8809571 | 4.50E−20 | Nicotiana sylvestris | ethylene-responsive element binding |
| 167 | G864 | gi7528276 | 5.70E−20 | Mesembryanthemum crystallinum | AP2-related transcription f |
| 167 | G864 | gi21908036 | 9.30E−20 | Zea mays | DRE binding factor 1. |
| 169 | G867 | BQ971511 | 2.00E−94 | Helianthus annuus | QHB7E05.yg.ab1 QH_ABCDI sunflower RHA801 |
| 169 | G867 | AP003450 | 6.00E−85 | Oryza sativa | chromosome 1 clone P0034C09, *** SEQUENCING IN |
| 169 | G867 | AC135925 | 1.00E−80 | Oryza sativa (japonica cultivar-group) | ( ) chromosome 5 clo |
| 169 | G867 | AAAA01000997 | 1.00E−79 | Oryza sativa (indica cultivar-group) | ( ) scaffold000997 |
| 169 | G867 | BQ405698 | 2.00E−77 | Gossypium arboreum | GA_Ed0085H02f Gossypium arboreum 7-10 d |
| 169 | G867 | BZ015521 | 4.00E−69 | Brassica oleracea | oeg86a05.g1 B. oleracea002 Brassica olerac |
| 169 | G867 | BF520598 | 2.00E−66 | Medicago truncatula | EST458071 DSIL Medicago truncatula cDNA |
| 169 | G867 | BU994579 | 4.00E−64 | Hordeum vulgare subsp. vulgare | HM07I08r HM Hordeum vulgare |
| 169 | G867 | BF424857 | 2.00E−62 | Glycine max | su59h03.y1 Gm-c1069 Glycine max cDNA clone GENO |
| 169 | G867 | BU871082 | 1.00E−61 | Populus balsamifera subsp. trichocarpa | Q026F06 Populus flow |
| 169 | G867 | gi18565433 | 2.40E−85 | Oryza sativa (japonica cultivar-group) | DNA-binding protei |
| 169 | G867 | gi12328560 | 2.90E−73 | Oryza sativa | putative DNA binding protein RAV2. |
| 169 | G867 | gi10798644 | 7.30E−13 | Nicotiana tabacum | AP2 domain-containing transcription fac |
| 169 | G867 | gi18266198 | 2.50E−10 | Narcissus pseudonarcissus | AP-2 domain containing protein. |

TABLE 11-continued

Summary of representative sequences that are homologous to presently disclosed transcription factors

| SEQ ID NO: | GID | Test Sequence ID | Smallest Sum Probability | Test Sequence Species | Test Sequence GenBank Annotation |
|---|---|---|---|---|---|
| 169 | G867 | gi20340233 | 2.50E−10 | *Thellungiella halophila* | ethylene responsive element bindi |
| 169 | G867 | gi22074046 | 1.50E−09 | *Lycopersicon esculentum* | transcription factor JERF1. |
| 169 | G867 | gi3264767 | 6.90E−09 | *Prunus armeniaca* | AP2 domain containing protein. |
| 169 | G867 | gi18496063 | 7.10E−09 | *Fagus sylvatica* | ethylene responsive element binding prote |
| 169 | G867 | gi13173164 | 8.30E−09 | *Pisum sativum* | APETAL2-like protein. |
| 169 | G867 | gi1730475 | 8.70E−09 | *Hordeum vulgare* | viviparous-1. |
| 185 | G912 | BH498662 | 2.00E−93 | *Brassica oleracea* | BOGTO66TR BOGT *Brassica oleracea* genomic |
| 185 | G912 | AF084185 | 2.00E−75 | *Brassica napus* | dehydration responsive element binding prote |
| 185 | G912 | AF211531 | 1.00E−59 | *Nicotiana tabacum* | Avr9/Cf-9 rapidly elicited protein 111B |
| 185 | G912 | AY034473 | 1.00E−55 | *Lycopersicon esculentum* | putative transcriptional activator |
| 185 | G912 | BG321601 | 4.00E−53 | *Descurainia sophia* | Ds01__01h03__R Ds01__AAFC__ECORC__cold_stress |
| 185 | G912 | AB080965 | 9.00E−53 | *Prunus avium* | DREB1-like gene for dehydratiion responsive el |
| 185 | G912 | BG590659 | 4.00E−51 | *Solanum tuberosum* | EST498501 *P. infestans*-challenged leaf So |
| 185 | G912 | BG644969 | 1.00E−50 | *Medicago truncatula* | EST506588 KV3 *Medicago truncatula* cDNA |
| 185 | G912 | BU016783 | 2.00E−49 | *Helianthus annuus* | QHE14A02.yg.ab1 QH__EFGHJ sunflower RHA280 |
| 185 | G912 | BU871514 | 1.00E−47 | *Populus balsamifera* subsp. *trichocarpa* | Q031D09 *Populus* flow |
| 185 | G912 | gi5616086 | 5.90E−73 | *Brassica napus* | dehydration responsive element binding pro |
| 185 | G912 | gi12003384 | 5.20E−58 | *Nicotiana tabacum* | Avr9/Cf-9 rapidly elicited protein 111B |
| 185 | G912 | gi23495458 | 3.90E−53 | *Prunus avium* | dehydratiion responsive element binding prot |
| 185 | G912 | gi18535580 | 2.00E−49 | *Lycopersicon esculentum* | putative transcriptional activato |
| 185 | G912 | gi19071243 | 1.30E−45 | *Hordeum vulgare* | CRT/DRE binding factor 1. |
| 185 | G912 | gi24474328 | 8.20E−44 | *Oryza sativa (japonica cultivar-group)* | apetala2 domain-co |
| 185 | G912 | gi6983877 | 9.00E−38 | *Oryza sativa* | Similar to mRNA for DREB1A (AB007787). |
| 185 | G912 | gi17148651 | 3.90E−35 | *Secale cereale* | CBF-like protein. |
| 185 | G912 | gi20152903 | 1.40E−32 | *Hordeum vulgare* subsp. *vulgare* | CRT/DRE binding factor 2. |
| 185 | G912 | gi17226801 | 2.10E−31 | *Triticum aestivum* | putative CRT/DRE-binding factor. |
| 187 | G913 | AI352878 | 4.00E−87 | *Brassica napus* | MB72-11D PZ204.BNlib *Brassica napus* cDNA clo |
| 187 | G913 | BH536782 | 1.00E−59 | *Brassica oleracea* | BOGCX29TR BOGC *Brassica oleracea* genomic |
| 187 | G913 | AW033835 | 2.00E−46 | *Lycopersicon esculentum* | EST277406 tomato callus, TAMU Lycop |
| 187 | G913 | BQ411166 | 1.00E−43 | *Gossypium arboreum* | GA__Ed0037B05f *Gossypium arboreum* 7-10 d |
| 187 | G913 | BQ165313 | 5.00E−43 | *Medicago truncatula* | EST611182 KVKC *Medicago truncatula* cDNA |
| 187 | G913 | AP006060 | 5.00E−43 | *Oryza sativa (japonica cultivar-group)* | ( ) chromosome 2 clo |
| 187 | G913 | AAAA01000810 | 2.00E−42 | *Oryza sativa (indica cultivar-group)* | ( ) scaffold000810 |
| 187 | G913 | OSJN00128 | 2.00E−38 | *Oryza sativa* | chromosome 4 clone OSJNBA0088I22, *** SEQUENC |
| 187 | G913 | BQ976989 | 3.00E−31 | *Helianthus annuus* | QHI23I22.yg.ab1 QH__ABCDI sunflower RHA801 |
| 187 | G913 | BQ592028 | 6.00E−30 | *Beta vulgaris* | E012695-024-021-K17-SP6 MPIZ-ADIS-024-develop |
| 187 | G913 | gi14140155 | 1.60E−32 | *Oryza sativa* | putative AP2 domain transcription factor. |
| 187 | G913 | gi12003382 | 1.40E−30 | *Nicotiana tabacum* | Avr9/Cf-9 rapidly elicited protein 111A |
| 187 | G913 | gi20303570 | 1.40E−30 | *Oryza sativa (japonica cultivar-group)* | putative transcrip |

TABLE 11-continued

Summary of representative sequences that are homologous to presently disclosed transcription factors

| SEQ ID NO: | GID | Test Sequence ID | Smallest Sum Probability | Test Sequence Species | Test Sequence GenBank Annotation |
|---|---|---|---|---|---|
| 187 | G913 | gi18535580 | 3.80E−30 | Lycopersicon esculentum | putative transcriptional activato |
| 187 | G913 | gi23495460 | 4.40E−29 | Prunus avium | dehydration responsive element binding prote |
| 187 | G913 | gi5616086 | 6.50E−28 | Brassica napus | dehydration responsive element binding pro |
| 187 | G913 | gi21908034 | 1.40E−25 | Zea mays | DRE binding factor 2. |
| 187 | G913 | gi19071243 | 1.20E−21 | Hordeum vulgare | CRT/DRE binding factor 1. |
| 187 | G913 | gi17148649 | 2.30E−17 | Secale cereale | CBF-like protein. |
| 187 | G913 | gi8571476 | 2.30E−17 | Atriplex hortensis | apetala2 domain-containing protein. |
| 189 | G922 | AP004485 | 1.0e−999 | Lotus japonicus | genomic DNA, chromosome 2, clone: LjT08D14, |
| 189 | G922 | AP003259 | 1.00E−130 | Oryza sativa | chromosome 1 clone P0466H10, *** SEQUENCING IN |
| 189 | G922 | AAAA01000374 | 1.00E−130 | Oryza sativa (indica cultivar-group) | ( ) scaffold000374 |
| 189 | G922 | BH493536 | 1.00E−121 | Brassica oleracea | BOGXB10TR BOGX Brassica oleracea genomic |
| 189 | G922 | CNS08CCP | 1.00E−92 | Oryza sativa (japonica cultivar-group) | ( ) chromosome 12 cl |
| 189 | G922 | BG643567 | 6.00E−82 | Lycopersicon esculentum | EST511761 tomato shoot/meristem Lyc |
| 189 | G922 | BQ124898 | 2.00E−81 | Medicago truncatula | EST610474 GLSD Medicago truncatula cDNA |
| 189 | G922 | BU764181 | 2.00E−71 | Glycine max | sas53f07.y1 Gm-c1023 Glycine max cDNA clone SOY |
| 189 | G922 | BG595716 | 3.00E−62 | Solanum tuberosum | EST494394 cSTS Solanum tuberosum cDNA clo |
| 189 | G922 | AF378125 | 6.00E−55 | Vitis vinifera | GAI-like protein 1 (GAI1) gene, complete cds |
| 189 | G922 | gi22830925 | 6.30E−127 | Oryza sativa (japonica cultivar-group) | putative gibberell |
| 189 | G922 | gi13365610 | 3.00E−57 | Pisum sativum | SCARECROW. |
| 189 | G922 | gi13170126 | 5.20E−55 | Brassica napus | unnamed protein product. |
| 189 | G922 | gi10178637 | 6.30E−51 | Zea mays | SCARECROW. |
| 189 | G922 | gi13937306 | 2.30E−50 | Oryza sativa | gibberellin-insensitive protein OsGAI. |
| 189 | G922 | gi18254373 | 9.20E−50 | Hordeum vulgare | nuclear transcription factor SLN1. |
| 189 | G922 | gi5640157 | 2.60E−49 | Triticum aestivum | gibberellin response modulator. |
| 189 | G922 | gi20257451 | 3.10E−49 | Calycadenia multiglandulosa | GIA/RGA-like gibberellin resp |
| 189 | G922 | gi13620224 | 1.30E−46 | Lycopersicon esculentum | lateral suppressor. |
| 189 | G922 | gi13620166 | 2.20E−41 | Capsella rubella | hypothetical protein. |
| 191 | G926 | BU573158 | 1.00E−56 | Prunus dulcis | PA_Ea0003A12f Almond developing seed Prunus |
| 191 | G926 | BI310587 | 2.00E−55 | Medicago truncatula | EST5312337 GESD Medicago truncatula cDN |
| 191 | G926 | BQ624240 | 1.00E−47 | Citrus sinensis | USDA-FP_01331 Ridge pineapple sweet orange |
| 191 | G926 | BH443554 | 3.00E−44 | Brassica oleracea | BOHGN12TR BOHG Brassica oleracea genomic |
| 191 | G926 | BNU33884 | 2.00E−39 | Brassica napus | clone bncbf-b1 CCAAT-binding factor B subuni |
| 191 | G926 | BF113081 | 8.00E−38 | Lycopersicon esculentum | EST440591 tomato breaker fruit Lyco |
| 191 | G926 | BG886494 | 2.00E−36 | Solanum tuberosum | EST512345 cSTD Solanum tuberosum cDNA clo |
| 191 | G926 | AW472517 | 3.00E−36 | Glycine max | si26c12.y1 Gm-r1030 Glycine max cDNA clone GENO |
| 191 | G926 | BQ407583 | 6.00E−36 | Gossypium arboreum | GA_Ed0108F07f Gossypium arboreum 7-10 d |
| 191 | G926 | BG343051 | 7.00E−34 | Hordeum vulgare | HVSMEg0001N16f Hordeum vulgare pre-anthesis |
| 191 | G926 | gi1173616 | 9.70E−41 | Brassica napus | CCAAT-binding factor B subunit homolog. |
| 191 | G926 | gi2826786 | 1.10E−27 | Oryza sativa | RAPB protein. |
| 191 | G926 | gi7141243 | 5.80E−27 | Vitis riparia | transcription factor. |
| 191 | G926 | gi4731314 | 4.00E−19 | Nicotiana tabacum | CCAAT-binding transcription factor subu |
| 191 | G926 | gi2104675 | 0.0061 | Vicia faba | transcription factor. |
| 191 | G926 | gi21667471 | 0.64 | Hordeum vulgare | CONSTANS-like protein. |

TABLE 11-continued

Summary of representative sequences that are homologous to presently disclosed transcription factors

| SEQ ID NO: | GID | Test Sequence ID | Smallest Sum Probability | Test Sequence Species | Test Sequence GenBank Annotation |
|---|---|---|---|---|---|
| 191 | G926 | gi13775107 | 0.67 | *Phaseolus vulgaris* | bZIP transcription factor 2. |
| 191 | G926 | gi1096930 | 0.69 | *Solanum tuberosum* | H ATPase inhibitor. |
| 191 | G926 | gi24413952 | 0.72 | *Oryza sativa* (*japonica* cultivar-group) | putative iron supe |
| 191 | G926 | gi1839593 | 0.78 | *Zea mays* | heat shock protein 70 homolog {clone CHEM 3} [Ze |
| 199 | G975 | BH477624 | 1.00E−69 | *Brassica oleracea* | BOGNB10TF BOGN *Brassica oleracea* genomic |
| 199 | G975 | CA486875 | 3.00E−64 | *Triticum aestivum* | WHE4337_A02_A03ZS Wheat meiotic anther cD |
| 199 | G975 | BI978981 | 2.00E−60 | *Rosa chinensis* | zD09 Old Blush petal SMART library *Rosa* chin |
| 199 | G975 | AP004869 | 9.00E−60 | *Oryza sativa* (*japonica* cultivar-group) | ( ) chromosome 2 clo |
| 199 | G975 | BU978490 | 1.00E−58 | *Hordeum vulgare* subsp. *vulgare* | HA13G05r HA *Hordeum vulgare* |
| 199 | G975 | BG642554 | 8.00E−57 | *Lycopersicon esculentum* | EST356031 tomato flower buds, anthe |
| 199 | G975 | BI958226 | 2.00E−54 | *Hordeum vulgare* | HVSMEn0013P17f *Hordeum vulgare* rachis EST 1 |
| 199 | G975 | BQ104740 | 1.00E−52 | *Rosa* hybrid cultivar | fc0212.e Rose Petals (Fragrant Cloud) |
| 199 | G975 | AW705973 | 3.00E−51 | *Glycine max* | sk64c02.y1 Gm-c1016 *Glycine max* cDNA clone GENO |
| 199 | G975 | AP003615 | 1.00E−47 | *Oryza sativa* | chromosome 6 clone P0486H12, *** SEQUENCING IN |
| 199 | G975 | gi18650662 | 1.80E−25 | *Lycopersicon esculentum* | ethylene response factor 1. |
| 199 | G975 | gi131754 | 2.10E−22 | *Lupinus polyphyllus* | PPLZ02 PROTEIN. |
| 199 | G975 | gi3065895 | 9.20E−20 | *Nicotiana tabacum* | TSI1. |
| 199 | G975 | gi8571476 | 9.30E−20 | *Atriplex hortensis* | apetala2 domain-containing protein. |
| 199 | G975 | gi19920190 | 1.90E−19 | *Oryza sativa* (*japonica* cultivar-group) | Putative AP2 domai |
| 199 | G975 | gi21908036 | 8.40E−19 | *Zea mays* | DRE binding factor 1. |
| 199 | G975 | gi4099914 | 1.10E−18 | *Stylosanthes hamata* | ethylene-responsive element binding p |
| 199 | G975 | gi10567106 | 1.60E−18 | *Oryza sativa* | osERF3. |
| 199 | G975 | gi8809573 | 9.60E−18 | *Nicotiana sylvestris* | ethylene-responsive element binding |
| 199 | G975 | gi7528276 | 1.20E−17 | *Mesembryanthemum crystallinum* | AP2-related transcription f |
| 221 | G1069 | BZ025139 | 1.00E−111 | *Brassica oleracea* | oeh63d12.g1 B. oleracea002 *Brassica olerac* |
| 221 | G1069 | AP004971 | 1.00E−93 | *Lotus japonicus* | genomic DNA, chromosome 5, clone: LjT45G21, |
| 221 | G1069 | AP004020 | 2.00E−79 | *Oryza sativa* | chromosome 2 clone OJ1119_A01, *** SEQUENCING |
| 221 | G1069 | AAAA01017331 | 2.00E−70 | *Oryza sativa* (*indica* cultivar-group) | ( ) scaffold017331 |
| 221 | G1069 | BQ165495 | 2.00E−62 | *Medicago truncatula* | EST611364 KVKC *Medicago truncatula* cDNA |
| 221 | G1069 | AC135209 | 2.00E−61 | *Oryza sativa* (*japonica* cultivar-group) | ( ) chromosome 3 clo |
| 221 | G1069 | AW621455 | 4.00E−59 | *Lycopersicon esculentum* | EST312253 tomato root during/after |
| 221 | G1069 | BM110212 | 4.00E−58 | *Solanum tuberosum* | EST557748 potato roots *Solanum tuberosum* |
| 221 | G1069 | BQ785950 | 7.00E−58 | *Glycine max* | saq61f09.y1 Gm-c1076 *Glycine max* cDNA clone SOY |
| 221 | G1069 | BQ863249 | 1.00E−57 | *Lactuca sativa* | QGC23G02.yg.ab1 QG_ABCDI lettuce salinas Lac |
| 221 | G1069 | gi24059979 | 2.10E−38 | *Oryza sativa* (*japonica* cultivar-group) | similar to DNA-bin |
| 221 | G1069 | gi15528814 | 4.50E−36 | *Oryza sativa* | hypothetical protein~similar to *Arabidopsis* |
| 221 | G1069 | gi4165183 | 7.60E−25 | *Antirrhinum majus* | SAP1 protein. |
| 221 | G1069 | gi2213534 | 1.20E−19 | *Pisum sativum* | DNA-binding PD1-like protein. |
| 221 | G1069 | gi2459999 | 1 | *Chlamydomonas reinhardtii* | tubulin Uni3. |
| 221 | G1069 | gi100872 | 1 | *Zea mays* | MFS18 protein - maize. |
| 221 | G1069 | gi1362165 | 1 | *Hordeum vulgare* | hypothetical protein 2 (clone ES1A) - bar |

TABLE 11-continued

Summary of representative sequences that are homologous to presently disclosed transcription factors

| SEQ ID NO: | GID | Test Sequence ID | Smallest Sum Probability | Test Sequence Species | Test Sequence GenBank Annotation |
|---|---|---|---|---|---|
| 223 | G1073 | AAAA01000486 | 4.00E−74 | Oryza sativa (indica cultivar-group) | ( ) scaffold000486 |
| 223 | G1073 | AP004165 | 4.00E−74 | Oryza sativa | chromosome 2 clone OJ1479_B12, *** SEQUENCING |
| 223 | G1073 | AP005477 | 2.00E−67 | Oryza sativa (japonica cultivar-group) | ( ) chromosome 6 clo |
| 223 | G1073 | BZ412041 | 3.00E−65 | Zea mays | OGACG56TC ZM_0.7_1.5_KB Zea mays genomic clone ZMM |
| 223 | G1073 | AJ502190 | 3.00E−64 | Medicago truncatula | AJ502190 MTAMP Medicago truncatula cDNA |
| 223 | G1073 | BQ865858 | 4.00E−63 | Lactuca sativa | QGC6B08.yg.ab1 QG_ABCDI lettuce salinas Lact |
| 223 | G1073 | BH975957 | 5.00E−63 | Brassica oleracea | odh67e11.g1 B. oleracea002 Brassica olerac |
| 223 | G1073 | BG134451 | 8.00E−62 | Lycopersicon esculentum | EST467343 tomato crown gall Lycoper |
| 223 | G1073 | AP004971 | 3.00E−60 | Lotus japonicus | genomic DNA, chromosome 5, clone: LjT45G21, |
| 223 | G1073 | BM110212 | 7.00E−58 | Solanum tuberosum | EST557748 potato roots Solanum tuberosum |
| 223 | G1073 | gi15528814 | 5.50E−38 | Oryza sativa | hypothetical protein~similar to Arabidopsis |
| 223 | G1073 | gi24059979 | 1.30E−29 | Oryza sativa (japonica cultivar-group) | similar to DNA-bin |
| 223 | G1073 | gi2213536 | 1.20E−21 | Pisum sativum | DNA-binding protein PD1. |
| 223 | G1073 | gi4165183 | 5.70E−20 | Antirrhinum majus | SAP1 protein. |
| 223 | G1073 | gi1166450 | 0.00059 | Lycopersicon esculentum | Tfm5. |
| 223 | G1073 | gi11545668 | 0.0051 | Chlamydomonas reinhardtii | CIA5. |
| 223 | G1073 | gi4755087 | 0.0054 | Zea mays | aluminum-induced protein; Al-induced protein. |
| 223 | G1073 | gi395147 | 0.0068 | Nicotiana tabacum | glycine-rich protein. |
| 223 | G1073 | gi21068672 | 0.017 | Cicer arietinum | putative glicine-rich protein. |
| 223 | G1073 | gi1346181 | 0.017 | Sinapis alba | GLYCINE-RICH RNA-BINDING PROTEIN GRP2A. |
| 225 | G1075 | BH596283 | 1.00E−108 | Brassica oleracea | BOGBL42TR BOGB Brassica oleracea genomic |
| 225 | G1075 | BQ165495 | 5.00E−88 | Medicago truncatula | EST611364 KVKC Medicago truncatula cDNA |
| 225 | G1075 | AAAA01003389 | 3.00E−84 | Oryza sativa (indica cultivar-group) | ( ) scaffold003389 |
| 225 | G1075 | OSJN00182 | 3.00E−84 | Oryza sativa | chromosome 4 clone OSJNBa0086O06, *** SEQUENC |
| 225 | G1075 | BZ412041 | 1.00E−76 | Zea mays | OGACG56TC ZM_0.7_1.5_KB Zea mays genomic clone ZMM |
| 225 | G1075 | AP005653 | 1.00E−68 | Oryza sativa (japonica cultivar-group) | ( ) chromosome 2 clo |
| 225 | G1075 | BQ863249 | 3.00E−65 | Lactuca sativa | QGC23G02.yg.ab1 QG_ABCDI lettuce salinas Lac |
| 225 | G1075 | BM110212 | 2.00E−63 | Solanum tuberosum | EST557748 potato roots Solanum tuberosum |
| 225 | G1075 | BQ838600 | 8.00E−63 | Triticum aestivum | WHE2912_D12_H24ZS Wheat aluminum-stressed |
| 225 | G1075 | AP004971 | 4.00E−62 | Lotus japonicus | genomic DNA, chromosome 5, clone: LjT45G21, |
| 225 | G1075 | gi15528814 | 3.80E−39 | Oryza sativa | hypothetical protein~similar to Arabidopsis |
| 225 | G1075 | gi24059979 | 6.60E−35 | Oryza sativa (japonica cultivar-group) | similar to DNA-bin |
| 225 | G1075 | gi4165183 | 7.30E−20 | Antirrhinum majus | SAP1 protein. |
| 225 | G1075 | gi2213534 | 2.50E−19 | Pisum sativum | DNA-binding PD1-like protein. |
| 225 | G1075 | gi3810890 | 3.70E−05 | Cucumis sativus | glycine-rich protein-2. |
| 225 | G1075 | gi7489009 | 0.0001 | Lycopersicon esculentum | glycine-rich protein (clone w10-1 |
| 225 | G1075 | gi4115615 | 0.0018 | Zea mays | root cap-specific glycine-rich protein. |
| 225 | G1075 | gi1628463 | 0.004 | Silene latifolia | Men-4. |
| 225 | G1075 | gi395147 | 0.005 | Nicotiana tabacum | glycine-rich protein. |
| 225 | G1075 | gi121631 | 0.0056 | Nicotiana sylvestris | GLYCINE-RICH CELL WALL STRUCTURAL PR |
| 269 | G1411 | BZ017225 | 3.00E−51 | Brassica oleracea | oei67e03.b1 B. oleracea002 Brassica olerac |

TABLE 11-continued

Summary of representative sequences that are homologous to presently disclosed transcription factors

| SEQ ID NO: | GID | Test Sequence ID | Smallest Sum Probability | Test Sequence Species | Test Sequence GenBank Annotation |
|---|---|---|---|---|---|
| 269 | G1411 | BQ138607 | 8.00E−44 | *Medicago truncatula* | NF005C01PH1F1004 Phoma-infected Medicag |
| 269 | G1411 | BQ786702 | 5.00E−36 | *Glycine max* | saq72b07.y1 Gm-c1076 *Glycine max* cDNA clone SOY |
| 269 | G1411 | BM062508 | 7.00E−32 | *Capsicum annuum* | KS01043F09 KS01 *Capsicum annuum* cDNA, mRNA |
| 269 | G1411 | AAAA01000832 | 2.00E−30 | *Oryza sativa* (indica cultivar-group) | ( ) scaffold000832 |
| 269 | G1411 | OSJN00240 | 2.00E−30 | *Oryza sativa* | genomic DNA, chromosome 4, BAC clone: OSJNBa0 |
| 269 | G1411 | BE419451 | 2.00E−29 | *Triticum aestivum* | WWS012.C2R000101 ITEC WWS Wheat Scutellum |
| 269 | G1411 | CA014817 | 6.00E−29 | *Hordeum vulgare* subsp. *vulgare* | HT12H01r HT *Hordeum vulgare* |
| 269 | G1411 | BE642320 | 1.00E−28 | *Ceratopteris richardii* | Cri2_5_L17_SP6 *Ceratopteris* Spore Li |
| 269 | G1411 | BE494041 | 2.00E−27 | *Secale cereale* | WHE1277_B09_D17ZS *Secale cereale* anther cDNA |
| 269 | G1411 | gi20160854 | 1.40E−29 | *Oryza sativa* (japonica cultivar-group) | hypothetical prote |
| 269 | G1411 | gi14140141 | 1.50E−24 | *Oryza sativa* | putative AP2-related transcription factor. |
| 269 | G1411 | gi3342211 | 1.40E−23 | *Lycopersicon esculentum* | Pti4. |
| 269 | G1411 | gi10798644 | 2.30E−23 | *Nicotiana tabacum* | AP2 domain-containing transcription fac |
| 269 | G1411 | gi8809571 | 2.30E−23 | *Nicotiana sylvestris* | ethylene-responsive element binding |
| 269 | G1411 | gi24817250 | 3.00E−23 | *Cicer arietinum* | transcription factor EREBP-like protein. |
| 269 | G1411 | gi3264767 | 3.00E−23 | *Prunus armeniaca* | AP2 domain containing protein. |
| 269 | G1411 | gi1688233 | 3.80E−23 | *Solanum tuberosum* | DNA binding protein homolog. |
| 269 | G1411 | gi7528276 | 3.80E−23 | *Mesembryanthemum crystallinum* | AP2-related transcription f |
| 269 | G1411 | gi21304712 | 6.20E−23 | *Glycine max* | ethylene-responsive element binding protein 1 |
| 277 | G1451 | AB071298 | 1.0e−999 | *Oryza sativa* | OsARF8 mRNA for auxin response factor 8, parti |
| 277 | G1451 | AY105215 | 1.00E−157 | *Zea mays* | PCO121637 mRNA sequence. |
| 277 | G1451 | AW690130 | 1.00E−109 | *Medicago truncatula* | NF028B12ST1F1000 Developing stem Medica |
| 277 | G1451 | BQ862285 | 1.00E−108 | *Lactuca sativa* | QGC20K23.yg.ab1 QG_ABCDI lettuce salinas Lac |
| 277 | G1451 | BG597435 | 1.00E−107 | *Solanum tuberosum* | EST496113 cSTS *Solanum tuberosum* cDNA clo |
| 277 | G1451 | BJ303602 | 1.00E−104 | *Triticum aestivum* | BJ303602 Y. Ogihara unpublished cDNA libr |
| 277 | G1451 | OSA306306 | 1.00E−103 | *Oryza sativa* (japonica cultivar-group) | *Oryza sativa* subsp. |
| 277 | G1451 | BQ595269 | 1.00E−89 | *Beta vulgaris* | E012710-024-023-D13-SP6 MPIZ-ADIS-024-develop |
| 277 | G1451 | CA801218 | 1.00E−86 | *Glycine max* | sau02f06.y2 Gm-c1062 *Glycine max* cDNA clone SOY |
| 277 | G1451 | BG159611 | 8.00E−79 | *Sorghum bicolor* | OV2_6_G07.b1_A002 Ovary 2 (OV2) *Sorghum* bic |
| 277 | G1451 | gi19352049 | 3.70E−247 | *Oryza sativa* | auxin response factor 8. |
| 277 | G1451 | gi20805236 | 3.10E−126 | *Oryza sativa* (japonica cultivar-group) | auxin response fac |
| 277 | G1451 | gi24785191 | 4.10E−55 | *Nicotiana tabacum* | hypothetical protein. |
| 277 | G1451 | gi23343944 | 2.40E−28 | *Mirabilis jalapa* | auxin-responsive factor protein. |
| 277 | G1451 | gi20269053 | 7.00E−10 | *Populus tremula* x *Populus tremuloides* | aux/IAA protein. |
| 277 | G1451 | gi287566 | 3.10E−06 | *Vigna radiata* | ORF. |
| 277 | G1451 | gi114733 | 1.10E−05 | *Glycine max* | AUXIN-INDUCED PROTEIN AUX22. |
| 277 | G1451 | gi871511 | 2.40E−05 | *Pisum sativum* | auxin-induced protein. |
| 277 | G1451 | gi18697008 | 0.00027 | *Zea mays* | unnamed protein product. |
| 277 | G1451 | gi17976835 | 0.00068 | *Pinus pinaster* | putative auxin induced transcription facto |
| 303 | G1543 | AF145727 | 4.00E−51 | *Oryza sativa* | homeodomain leucine zipper protein (hox3) mRNA |
| 303 | G1543 | CA030381 | 6.00E−41 | *Hordeum vulgare* subsp. *vulgare* | HX06O07r HX *Hordeum vulgare* |
| 303 | G1543 | BQ741095 | 6.00E−39 | *Glycine max* | saq14c10.y1 Gm-c1045 *Glycine max* cDNA clone SOY |

TABLE 11-continued

Summary of representative sequences that are homologous to presently disclosed transcription factors

| SEQ ID NO: | GID | Test Sequence ID | Smallest Sum Probability | Test Sequence Species | Test Sequence GenBank Annotation |
|---|---|---|---|---|---|
| 303 | G1543 | AT002118 | 1.00E−38 | Brassica rapa subsp. pekinensis | AT002118 Flower bud cDNA Br |
| 303 | G1543 | BQ857226 | 2.00E−37 | Lactuca sativa | QGB6P03.yg.ab1 QG__ABCDI lettuce salinas Lact |
| 303 | G1543 | AB028075 | 4.00E−37 | Physcomitrella patens | mRNA for homeobox protein PpHB4, comp |
| 303 | G1543 | PBPHZ4GEN | 4.00E−37 | Pimpinella brachycarpa | P. brachycarpa mRNA for homeobox-leu |
| 303 | G1543 | LEHDZIPP | 5.00E−37 | Lycopersicon esculentum | L. esculentum mRNA for HD-ZIP protei |
| 303 | G1543 | AF443619 | 1.00E−36 | Craterostigma plantagineum | homeodomain leucine zipper prote |
| 303 | G1543 | AJ498394 | 2.00E−36 | Medicago truncatula | AJ498394 MTPOSE Medicago truncatula cDN |
| 303 | G1543 | gi5006851 | 8.30E−51 | Oryza sativa | homeodomain leucine zipper protein. |
| 303 | G1543 | gi20161555 | 1.70E−50 | Oryza sativa (japonica cultivar-group) | putative homeodoma |
| 303 | G1543 | gi18034437 | 1.60E−38 | Craterostigma plantagineum | homeodomain leucine zipper pro |
| 303 | G1543 | gi1149535 | 4.30E−38 | Pimpinella brachycarpa | homeobox-leucine zipper protein. |
| 303 | G1543 | gi992598 | 1.20E−37 | Lycopersicon esculentum | HP-ZIP protein. |
| 303 | G1543 | gi7415620 | 1.50E−37 | Physcomitrella patens | homeobox protein PpHB4. |
| 303 | G1543 | gi1234900 | 3.10E−37 | Glycine max | homeobox-leucine zipper protein. |
| 303 | G1543 | gi3868847 | 1.90E−35 | Ceratopteris richardii | CRHB10. |
| 303 | G1543 | gi8919876 | 1.90E−35 | Capsella rubella | hypothetical protein. |
| 303 | G1543 | gi1032372 | 3.20E−35 | Helianthus annuus | homeodomain protein. |
| 331 | G1792 | AI776626 | 5.00E−35 | Lycopersicon esculentum | EST257726 tomato resistant, Cornell |
| 331 | G1792 | BQ045702 | 1.00E−32 | Solanum tuberosum | EST594820 P. infestans-challenged potato |
| 331 | G1792 | BM178875 | 7.00E−32 | Glycine max | saj60f01.y1 Gm-c1072 Glycine max cDNA clone SOY |
| 331 | G1792 | BF649790 | 1.00E−31 | Medicago truncatula | NF084C07EC1F1052 Elicited cell culture |
| 331 | G1792 | BZ020356 | 1.00E−30 | Brassica oleracea | oeg04a10.g1 B. oleracea002 Brassica olerac |
| 331 | G1792 | BZ337899 | 3.00E−30 | Sorghum bicolor | ia91fl1.b1 WGS-SbicolorF (JM107 adapted met |
| 331 | G1792 | AC025907 | 3.00E−30 | Oryza sativa | chromosome 10 clone nbxb0094K20, *** SEQUENCIN |
| 331 | G1792 | AAAA01002491 | 3.00E−30 | Oryza sativa (indica cultivar-group) | ( ) scaffold002491 |
| 331 | G1792 | BZ359367 | 8.00E−30 | Zea mays | id72f11.b1 WGS-ZmaysF (JM107 adapted methyl filter |
| 331 | G1792 | AC137635 | 2.00E−27 | Oryza sativa (japonica cultivar-group) | Genomic sequence for |
| 331 | G1792 | gi23452024 | 4.00E−26 | Lycopersicon esculentum | transcription factor TSRF1. |
| 331 | G1792 | gi1732406 | 2.10E−25 | Nicotiana tabacum | S25-XP1 DNA binding protein. |
| 331 | G1792 | gi12597874 | 3.70E−25 | Oryza sativa | putative ethylene-responsive element binding |
| 331 | G1792 | gi7528276 | 7.60E−25 | Mesembryanthemum crystallinum | AP2-related transcription f |
| 331 | G1792 | gi24060081 | 1.30E−23 | Oryza sativa (japonica cultivar-group) | putative ethylene |
| 331 | G1792 | gi8980313 | 1.80E−23 | Catharanthus roseus | AP2-domain DNA-binding protein. |
| 331 | G1792 | gi8809571 | 1.80E−23 | Nicotiana sylvestris | ethylene-responsive element binding |
| 331 | G1792 | gi17385636 | 1.20E−21 | Matricaria chamomilla | ethylene-responsive element binding |
| 331 | G1792 | gi21304712 | 3.10E−21 | Glycine max | ethylene-responsive element binding protein 1 |
| 331 | G1792 | gi8571476 | 1.10E−20 | Atriplex hortensis | apetala2 domain-containing protein. |
| 341 | G1820 | AW776719 | 1.00E−43 | Medicago truncatula | EST335784 DSIL Medicago truncatula cDNA |
| 341 | G1820 | BM065544 | 3.00E−40 | Capsicum annuum | KS07004F12 KS07 Capsicum annuum cDNA, mRNA |

TABLE 11-continued

Summary of representative sequences that are homologous to presently disclosed transcription factors

| SEQ ID NO: | GID | Test Sequence ID | Smallest Sum Probability | Test Sequence Species | Test Sequence GenBank Annotation |
|---|---|---|---|---|---|
| 341 | G1820 | BG591677 | 4.00E−40 | Solanum tuberosum | EST499519 P. infestans-challenged leaf So |
| 341 | G1820 | BI701620 | 1.00E−38 | Glycine max | sai18a04.y1 Gm-c1053 Glycine max cDNA clone GEN |
| 341 | G1820 | BQ411597 | 3.00E−37 | Gossypium arboreum | GA__Ed0041B06f Gossypium arboreum 7-10 d |
| 341 | G1820 | BE208917 | 6.00E−37 | Citrus x paradisi | GF-FV-P3F5 Marsh grapefruit young flavedo |
| 341 | G1820 | BH725354 | 1.00E−36 | Brassica oleracea | BOHVO37TF BO__2__3__KB Brassica oleracea gen |
| 341 | G1820 | AW093662 | 9.00E−36 | Lycopersicon esculentum | EST286842 tomato mixed elicitor, BT |
| 341 | G1820 | BU819346 | 4.00E−35 | Populus tremula | UA42BPF01 Populus tremula cambium cDNA libr |
| 341 | G1820 | AAAA01002977 | 3.00E−34 | Oryza sativa (indica cultivar-group) | ( ) scaffold002977 |
| 341 | G1820 | gi5257260 | 1.40E−34 | Oryza sativa | Similar to sequence of BAC F7G19 from Arabid |
| 341 | G1820 | gi20804442 | 1.70E−15 | Oryza sativa (japonica cultivar-group) | hypothetical prote |
| 341 | G1820 | gi18481626 | 6.30E−08 | Zea mays | repressor protein. |
| 341 | G1820 | gi297871 | 0.39 | Picea abies | histone H2A. |
| 341 | G1820 | gi297887 | 0.41 | Daucus carota | glycine rich protein. |
| 341 | G1820 | gi2130105 | 0.54 | Triticum aestivum | histone H2A.4 - wheat. |
| 341 | G1820 | gi6782438 | 0.74 | Nicotiana glauca | glycine-rich protein. |
| 341 | G1820 | gi15214035 | 0.98 | Cicer arietinum | HISTONE H2A. |
| 341 | G1820 | gi2317760 | 0.98 | Pinus taeda | H2A homolog. |
| 341 | G1820 | gi1173628 | 0.99 | Phalaenopsis sp. SM9108 | glycine-rich protein. |
| 343 | G1836 | BI701620 | 7.00E−35 | Glycine max | sai18a04.y1 Gm-c1053 Glycine max cDNA clone GEN |
| 343 | G1836 | AW776719 | 2.00E−33 | Medicago truncatula | EST335784 DSIL Medicago truncatula cDNA |
| 343 | G1836 | BQ411597 | 2.00E−33 | Gossypium arboreum | GA__Ed0041B06f Gossypium arboreum 7-10 d |
| 343 | G1836 | BM065544 | 2.00E−32 | Capsicum annuum | KS07004F12 KS07 Capsicum annuum cDNA, mRNA |
| 343 | G1836 | BG591677 | 3.00E−31 | Solanum tuberosum | EST499519 P. infestans-challenged leaf So |
| 343 | G1836 | BU819346 | 6.00E−31 | Populus tremula | UA42BPF01 Populus tremula cambium cDNA libr |
| 343 | G1836 | BH725354 | 4.00E−30 | Brassica oleracea | BOHVO37TF BO__2__3__KB Brassica oleracea gen |
| 343 | G1836 | BE208917 | 6.00E−30 | Citrus x paradisi | GF-FV-P3F5 Marsh grapefruit young flavedo |
| 343 | G1836 | AAAA01024926 | 5.00E−29 | Oryza sativa (indica cultivar-group) | ( ) scaffold024926 |
| 343 | G1836 | AW093662 | 9.00E−29 | Lycopersicon esculentum | EST286842 tomato mixed elicitor, BT |
| 343 | G1836 | gi5257260 | 2.10E−29 | Oryza sativa | Similar to sequence of BAC F7G19 from Arabid |
| 343 | G1836 | gi20804442 | 6.30E−16 | Oryza sativa (japonica cultivar-group) | hypothetical prote |
| 343 | G1836 | gi18481626 | 2.00E−06 | Zea mays | repressor protein. |
| 343 | G1836 | gi18539425 | 0.84 | Pinus sylvestris | putative malate dehydrogenase. |
| 343 | G1836 | gi122084 | 1 | Hordeum vulgare | Histone H3. |
| 343 | G1836 | gi225348 | 1 | Hordeum vulgare subsp. vulgare | histone H3. |
| 369 | G1930 | BU025988 | 5.00E−88 | Helianthus annuus | QHG12J17.yg.ab1 QH__EFGHJ sunflower RHA280 |
| 369 | G1930 | AP003450 | 8.00E−80 | Oryza sativa | chromosome 1 clone P0034C09, *** SEQUENCING IN |
| 369 | G1930 | AC135925 | 7.00E−79 | Oryza sativa (japonica cultivar-group) | ( ) chromosome 5 clo |
| 369 | G1930 | AAAA01000997 | 3.00E−78 | Oryza sativa (indica cultivar-group) | ( ) scaffold000997 |
| 369 | G1930 | BU994579 | 1.00E−65 | Hordeum vulgare subsp. vulgare | HM07I08r HM Hordeum vulgare |
| 369 | G1930 | BQ405698 | 1.00E−65 | Gossypium arboreum | GA__Ed0085H02f Gossypium arboreum 7-10 d |
| 369 | G1930 | BF520598 | 1.00E−64 | Medicago truncatula | EST458071 DSIL Medicago truncatula cDNA |
| 369 | G1930 | BZ015521 | 1.00E−64 | Brassica oleracea | oeg86a05.g1 B. oleracea002 Brassica olerac |

TABLE 11-continued

Summary of representative sequences that are homologous to presently disclosed transcription factors

| SEQ ID NO: | GID | Test Sequence ID | Smallest Sum Probability | Test Sequence Species | Test Sequence GenBank Annotation |
|---|---|---|---|---|---|
| 369 | G1930 | BF424857 | 2.00E−58 | *Glycine max* | su59h03.y1 Gm-c1069 *Glycine max* cDNA clone GENO |
| 369 | G1930 | BU870896 | 1.00E−56 | *Populus balsamifera* subsp. *trichocarpa* | Q019F06 *Populus* flow |
| 369 | G1930 | gi18565433 | 4.10E−74 | *Oryza sativa (japonica* cultivar-group) | DNA-binding protei |
| 369 | G1930 | gi12328560 | 1.80E−71 | *Oryza sativa* | putative DNA binding protein RAV2. |
| 369 | G1930 | gi10798644 | 1.40E−13 | *Nicotiana tabacum* | AP2 domain-containing transcription fac |
| 369 | G1930 | gi20340233 | 5.10E−11 | *Thellungiella halophila* | ethylene responsive element bindi |
| 369 | G1930 | gi4099921 | 1.30E−10 | *Stylosanthes hamata* | EREBP-3 homolog. |
| 369 | G1930 | gi18496063 | 1.60E−10 | *Fagus sylvatica* | ethylene responsive element binding prote |
| 369 | G1930 | gi22074046 | 2.10E−10 | *Lycopersicon esculentum* | transcription factor JERF1. |
| 369 | G1930 | gi3264767 | 2.30E−10 | *Prunus armeniaca* | AP2 domain containing protein. |
| 369 | G1930 | gi18266198 | 1.10E−09 | *Narcissus pseudonarcissus* | AP-2 domain containing protein. |
| 369 | G1930 | gi24940524 | 1.10E−09 | *Triticum aestivum* | ethylene response element binding prote |
| 407 | G2133 | BH420519 | 1.00E−53 | *Brassica oleracea* | BOGUH88TF BOGU *Brassica oleracea* genomic |
| 407 | G2133 | BG543936 | 6.00E−43 | *Brassica rapa* subsp. *pekinensis* | E1686 Chinese cabbage etiol |
| 407 | G2133 | AU292603 | 2.00E−28 | *Zinnia elegans* | AU292603 *zinnia* cultured mesophyll cell equa |
| 407 | G2133 | BE320193 | 6.00E−24 | *Medicago truncatula* | NF024B04RT1F1029 Developing root Medica |
| 407 | G2133 | AP003346 | 3.00E−22 | *Oryza sativa* | chromosome 1 clone P0434C04, *** SEQUENCING IN |
| 407 | G2133 | AAAA01000718 | 3.00E−22 | *Oryza sativa (indica* cultivar-group) | ( ) scaffold000718 |
| 407 | G2133 | AC124836 | 6.00E−22 | *Oryza sativa (japonica* cultivar-group) | ( ) chromosome 5 clo |
| 407 | G2133 | BZ403609 | 2.00E−20 | *Zea mays* | OGABN17TM ZM_0.7_1.5_KB *Zea mays* genomic clone ZMM |
| 407 | G2133 | BM985484 | 6.00E−19 | *Thellungiella halophila* | 10_C12_T Ath *Thellungiella halophil* |
| 407 | G2133 | BM403179 | 3.00E−17 | *Selaginella lepidophylla* | SLA012F10_35741 An expressed seque |
| 407 | G2133 | gi20161239 | 6.90E−24 | *Oryza sativa (japonica* cultivar-group) | hypothetical prote |
| 407 | G2133 | gi8571476 | 6.00E−17 | *Atriplex hortensis* | apetala2 domain-containing protein. |
| 407 | G2133 | gi14140155 | 7.80E−16 | *Oryza sativa* | putative AP2 domain transcription factor. |
| 407 | G2133 | gi5616086 | 7.00E−15 | *Brassica napus* | dehydration responsive element binding pro |
| 407 | G2133 | gi21908034 | 8.90E−15 | *Zea mays* | DRE binding factor 2. |
| 407 | G2133 | gi19071243 | 6.30E−14 | *Hordeum vulgare* | CRT/DRE binding factor 1. |
| 407 | G2133 | gi18535580 | 2.10E−13 | *Lycopersicon esculentum* | putative transcriptional activato |
| 407 | G2133 | gi1208496 | 3.30E−13 | *Nicotiana tabacum* | EREBP-3. |
| 407 | G2133 | gi8980313 | 4.40E−13 | *Catharanthus roseus* | AP2-domain DNA-binding protein. |
| 407 | G2133 | gi15488459 | 2.20E−12 | *Triticum aestivum* | AP2-containing protein. |
| 417 | G2153 | BH566718 | 1.00E−127 | *Brassica oleracea* | BOHCV23TR BOHC *Brassica oleracea* genomic |
| 417 | G2153 | AP004971 | 2.00E−90 | *Lotus japonicus* | genomic DNA, chromosome 5, clone: LjT45G21, |
| 417 | G2153 | AP004020 | 1.00E−79 | *Oryza sativa* | chromosome 2 clone OJ1119_A01, *** SEQUENCING |
| 417 | G2153 | AAAA01017331 | 2.00E−72 | *Oryza sativa (indica* cultivar-group) | ( ) scaffold017331 |
| 417 | G2153 | BQ165495 | 2.00E−67 | *Medicago truncatula* | EST611364 KVKC *Medicago truncatula* cDNA |
| 417 | G2153 | AP005653 | 1.00E−66 | *Oryza sativa (japonica* cultivar-group) | ( ) chromosome 2 clo |
| 417 | G2153 | BQ785950 | 8.00E−64 | *Glycine max* | saq61f09.y1 Gm-c1076 *Glycine max* cDNA clone SOY |

TABLE 11-continued

Summary of representative sequences that are homologous to presently disclosed transcription factors

| SEQ ID NO: | GID | Test Sequence ID | Smallest Sum Probability | Test Sequence Species | Test Sequence GenBank Annotation |
|---|---|---|---|---|---|
| 417 | G2153 | BZ412041 | 3.00E−63 | Zea mays | OGACG56TC ZM_0.7_1.5_KB Zea mays genomic clone ZMM |
| 417 | G2153 | BM110212 | 3.00E−63 | Solanum tuberosum | EST557748 potato roots Solanum tuberosum |
| 417 | G2153 | BQ865858 | 7.00E−63 | Lactuca sativa | QGC6B08.yg.ab1 QG_ABCDI lettuce salinas Lact |
| 417 | G2153 | gi24059979 | 3.80E−39 | Oryza sativa (japonica cultivar-group) | similar to DNA-bin |
| 417 | G2153 | gi15528814 | 1.70E−36 | Oryza sativa | hypothetical protein~similar to Arabidopsis |
| 417 | G2153 | gi4165183 | 5.00E−21 | Antirrhinum majus | SAP1 protein. |
| 417 | G2153 | gi2213534 | 1.30E−19 | Pisum sativum | DNA-binding PD1-like protein. |
| 417 | G2153 | gi7439981 | 2.60E−08 | Triticum aestivum | glycine-rich RNA-binding protein GRP1 - |
| 417 | G2153 | gi21623 | 1.90E−06 | Sorghum bicolor | glycine-rich RNA-binding protein. |
| 417 | G2153 | gi11545668 | 3.50E−06 | Chlamydomonas reinhardtii | CIA5. |
| 417 | G2153 | gi21068672 | 6.60E−06 | Cicer arietinum | putative glicine-rich protein. |
| 417 | G2153 | gi7489714 | 6.60E−06 | Zea mays | aluminum-induced protein aII - maize. |
| 417 | G2153 | gi395147 | 1.60E−05 | Nicotiana tabacum | glycine-rich protein. |
| 419 | G2155 | BG543096 | 2.00E−69 | Brassica rapa subsp. pekinensis | E0571 Chinese cabbage etiol |
| 419 | G2155 | BH480897 | 7.00E−66 | Brassica oleracea | BOGRA01TF BOGR Brassica oleracea genomic |
| 419 | G2155 | BG646893 | 2.00E−53 | Medicago truncatula | EST508512 HOGA Medicago truncatula cDNA |
| 419 | G2155 | BU023570 | 3.00E−44 | Helianthus annuus | QHF11M19.yg.ab1 QH_EFGHJ sunflower RHA280 |
| 419 | G2155 | AP004020 | 2.00E−41 | Oryza sativa | chromosome 2 clone OJ1119_A01, *** SEQUENCING |
| 419 | G2155 | BI426899 | 4.00E−41 | Glycine max | sag08g12.y1 Gm-c1080 Glycine max cDNA clone GEN |
| 419 | G2155 | AAAA01000383 | 2.00E−40 | Oryza sativa (indica cultivar-group) | ( ) scaffold000383 |
| 419 | G2155 | AP004971 | 2.00E−40 | Lotus japonicus | genomic DNA, chromosome 5, clone: LjT45G21, |
| 419 | G2155 | AP005755 | 2.00E−40 | Oryza sativa (japonica cultivar-group) | ( ) chromosome 9 clo |
| 419 | G2155 | BZ412041 | 8.00E−39 | Zea mays | OGACG56TC ZM_0.7_1.5_KB Zea mays genomic clone ZMM |
| 419 | G2155 | gi15528814 | 3.70E−32 | Oryza sativa | hypothetical protein~similar to Arabidopsis |
| 419 | G2155 | gi24059979 | 1.20E−21 | Oryza sativa (japonica cultivar-group) | similar to DNA-bin |
| 419 | G2155 | gi4165183 | 3.50E−20 | Antirrhinum majus | SAP1 protein. |
| 419 | G2155 | gi2213534 | 1.60E−16 | Pisum sativum | DNA-binding PD1-like protein. |
| 419 | G2155 | gi2224911 | 0.98 | Daucus carota | somatic embryogenesis receptor-like kinase. |
| 419 | G2155 | gi454279 | 1 | Avena sativa | DNA-binding protein. |
| 439 | G2509 | BH989379 | 8.00E−66 | Brassica oleracea | oed22b05.b1 B. oleracea002 Brassica olerac |
| 439 | G2509 | BQ138607 | 4.00E−41 | Medicago truncatula | NF005C01PH1F1004 Phoma-infected Medicag |
| 439 | G2509 | BQ786702 | 4.00E−36 | Glycine max | saq72b07.y1 Gm-c1076 Glycine max cDNA clone SOY |
| 439 | G2509 | OSJN00240 | 7.00E−31 | Oryza sativa | genomic DNA, chromosome 4, BAC clone: OSJ7NBa0 |
| 439 | G2509 | AAAA01000832 | 7.00E−31 | Oryza sativa (indica cultivar-group) | ( ) scaffold000832 |
| 439 | G2509 | BE419451 | 2.00E−29 | Triticum aestivum | WWS012.C2R000101 ITEC WWS Wheat Scutellum |
| 439 | G2509 | BM062508 | 5.00E−29 | Capsicum annuum | KS01043F09 KS01 Capsicum annuum cDNA, mRNA |
| 439 | G2509 | AI771755 | 2.00E−28 | Lycopersicon esculentum | EST252855 tomato ovary, TAMU Lycope |
| 439 | G2509 | CA015575 | 7.00E−28 | Hordeum vulgare subsp. vulgare | HT14L19r HT Hordeum vulgare |
| 439 | G2509 | BE642320 | 2.00E−27 | Ceratopteris richardii | Cri2_5_L17_SP6 Ceratopteris Spore Li |
| 439 | G2509 | gi20160854 | 2.10E−29 | Oryza sativa (japonica cultivar-group) | hypothetical prote |

TABLE 11-continued

Summary of representative sequences that are homologous to presently disclosed transcription factors

| SEQ ID NO: | GID | Test Sequence ID | Smallest Sum Probability | Test Sequence Species | Test Sequence GenBank Annotation |
|---|---|---|---|---|---|
| 439 | G2509 | gi3264767 | 8.40E−28 | Prunus armeniaca | AP2 domain containing protein. |
| 439 | G2509 | gi24817250 | 1.10E−25 | Cicer arietinum | transcription factor EREBP-like protein. |
| 439 | G2509 | gi15217291 | 7.10E−25 | Oryza sativa | Putative AP2 domain containing protein. |
| 439 | G2509 | gi1208498 | 1.60E−24 | Nicotiana tabacum | EREBP-2. |
| 439 | G2509 | gi8809571 | 1.60E−24 | Nicotiana sylvestris | ethylene-responsive element binding |
| 439 | G2509 | gi7528276 | 3.00E−24 | Mesembryanthemum crystallinum | AP2-related transcription f |
| 439 | G2509 | gi1688233 | 1.10E−23 | Solanum tuberosum | DNA binding protein homolog. |
| 439 | G2509 | gi4099921 | 1.60E−23 | Stylosanthes hamata | EREBP-3 homolog. |
| 439 | G2509 | gi18496063 | 2.40E−23 | Fagus sylvatica | ethylene responsive element binding prote |
| 449 | G2583 | BH658452 | 1.00E−59 | Brassica oleracea | BOMCP74TF BO__2__3__KB Brassica oleracea gen |
| 449 | G2583 | BE023297 | 5.00E−54 | Glycine max | sm80e10.y1 Gm-c1015 Glycine max cDNA clone GENO |
| 449 | G2583 | CA486875 | 1.00E−50 | Triticum aestivum | WHE4337__A02__A03ZS Wheat meiotic anther cD |
| 449 | G2583 | BG642554 | 8.00E−48 | Lycopersicon esculentum | EST356031 tomato flower buds, anthe |
| 449 | G2583 | BI978981 | 2.00E−47 | Rosa chinensis | zD09 Old Blush petal SMART library Rosa chin |
| 449 | G2583 | BU978490 | 4.00E−47 | Hordeum vulgare subsp. vulgare | HA13G05r HA Hordeum vulgare |
| 449 | G2583 | BQ106328 | 4.00E−46 | Rosa hybrid cultivar | gg1388.e Rose Petals (Golden Gate) Lam |
| 449 | G2583 | BI958226 | 1.00E−44 | Hordeum vulgare | HVSMEn0013P17f Hordeum vulgare rachis EST1 |
| 449 | G2583 | AP004869 | 1.00E−43 | Oryza sativa (japonica cultivar-group) | ( ) chromosome 2 clo |
| 449 | G2583 | BU832200 | 6.00E−43 | Populus tremula x Populus tremuloides | T030G01 Populus apica |
| 449 | G2583 | gi18650662 | 2.30E−23 | Lycopersicon esculentum | ethylene response factor 1. |
| 449 | G2583 | gi131754 | 7.30E−20 | Lupinus polyphyllus | PPLZ02 PROTEIN. |
| 449 | G2583 | gi20160854 | 2.80E−18 | Oryza sativa (japonica cultivar-group) | hypothetical prote |
| 449 | G2583 | gi10798644 | 2.80E−18 | Nicotiana tabacum | AP2 domain-containing transcription fac |
| 449 | G2583 | gi8571476 | 2.80E−18 | Atriplex hortensis | apetala2 domain-containing protein. |
| 449 | G2583 | gi14018047 | 3.30E−17 | Oryza sativa | Putative protein containing AP2 DNA binding |
| 449 | G2583 | gi12225884 | 1.10E−16 | Zea mays | unnamed protein product. |
| 449 | G2583 | gi3264767 | 1.10E−16 | Prunus armeniaca | AP2 domain containing protein. |
| 449 | G2583 | gi4099914 | 1.10E−16 | Stylosanthes hamata | ethylene-responsive element binding p |
| 449 | G2583 | gi8809573 | 1.40E−16 | Nicotiana sylvestris | ethylene-responsive element binding |

Table 12 lists sequences discovered to be paralogous to a number of transcription factors of the present invention. The columns headings include, from left to right, the Arabidopsis SEQ ID NO; corresponding Arabidopsis Gene ID (GID) numbers; the GID numbers of the paralogs discovered in a database search; and the SEQ ID NOs of the paralogs (a paralog appearing in any cell of the fourth column is also paralogous to the other sequences in that cell).

TABLE 12

Arabidopsis Transcription Factors and Paralogs

| SEQ ID NO: | GID NO. | Paralog SEQ ID NO: | Paralog GID No. |
|---|---|---|---|
| 10 | G28 | 6, 2074 | G6, G1006 |
| 12 | G47 | 408 | G2133 |
| 60 | G353 | 62, 2150, 2156, 2200 | G354, G1889, G1974, G2839 |
| 88 | G481 | 90, 2010, 2102, 2172 | G482, G485, G1364, G2345 |
| 94 | G489 | 2054 | G714 |
| 148 | G682 | 38, 1972, 2142, 2192 | G225, G226, G1816, G2718 |
| 170 | G867 | 1950, 2072, 370 | G9, G993, G1930 |
| 186 | G912 | 1958, 1960, 1962, 2162, 2184 | G40, G41, G42, G2107, G2513 |
| 188 | G913 | 2162 | G2107 |
| 200 | G975 | 2106, 450 | G1387, G2583 |
| 224 | G1073 | 2078, 2166 | G1067, G2156 |

TABLE 12-continued

Arabidopsis Transcription Factors and Paralogs

| SEQ ID NO: | GID NO. | Paralog SEQ ID NO: | Paralog GID No. |
|---|---|---|---|
| 226 | G1075 | 2080 | G1076 |
| 270 | G1411 | 440 | G2509 |
| 278 | G1451 | 2070 | G990 |
| 332 | G1792 | 1954, 2134, 2136 | G30, G1791, G1795 |
| 344 | G1836 | 340 | G1818 |
| 2158 | G1995 | 64, 66, 2198 | G361, G362, G2838 |
| 420 | G2155 | 2154 | G1945 |

Table 13 lists the gene identification number (GID) and homologous relationships found using analyses according to Example VIII for the sequences of the Sequence Listing.

TABLE 13

Homologous relationships found within the Sequence Listing

| SEQ ID NO: | GID | DNA or Protein (PRT) | Species from Which Homologous Sequence is Derived | Relationship of SEQ ID NO: to Other Genes |
|---|---|---|---|---|
| 468 | | DNA | Glycine max | Predicted polypeptide sequence is orthologous to G19 |
| 469 | | DNA | Glycine max | Predicted polypeptide sequence is orthologous to G19 |
| 470 | | DNA | Glycine max | Predicted polypeptide sequence is orthologous to G19 |
| 471 | | DNA | Glycine max | Predicted polypeptide sequence is orthologous to G19 |
| 472 | | DNA | Oryza sativa | Predicted polypeptide sequence is orthologous to G19 |
| 473 | | DNA | Oryza sativa | Predicted polypeptide sequence is orthologous to G19 |
| 474 | | DNA | Oryza sativa | Predicted polypeptide sequence is orthologous to G19 |
| 475 | | DNA | Zea mays | Predicted polypeptide sequence is orthologous to G19 |
| 476 | | DNA | Zea mays | Predicted polypeptide sequence is orthologous to G19 |
| 477 | | DNA | Glycine max | Predicted polypeptide sequence is orthologous to G22, G28, G1006 |
| 478 | | DNA | Glycine max | Predicted polypeptide sequence is orthologous to G22, G28, G1006 |
| 491 | | DNA | Glycine max | Predicted polypeptide sequence is orthologous to G22, G28, G1006 |
| 492 | | DNA | Glycine max | Predicted polypeptide sequence is orthologous to G22, G28, G1006 |
| 493 | | DNA | Glycine max | Predicted polypeptide sequence is orthologous to G22, G28, G1006 |
| 494 | | DNA | Glycine max | Predicted polypeptide sequence is orthologous to G22, G28, G1006 |
| 495 | | DNA | Glycine max | Predicted polypeptide sequence is orthologous to G22, G28, G1006 |
| 496 | | DNA | Glycine max | Predicted polypeptide sequence is orthologous to G22, G28, G1006 |
| 497 | | DNA | Glycine max | Predicted polypeptide sequence is orthologous to G22, G28, G1006 |
| 498 | | DNA | Glycine max | Predicted polypeptide sequence is orthologous to G22, G28, G1006 |
| 499 | | DNA | Oryza sativa | Predicted polypeptide sequence is orthologous to G22, G28, G1006 |
| 500 | | DNA | Zea mays | Predicted polypeptide sequence is orthologous to G22, G28, G1006 |
| 501 | | PRT | Oryza sativa | Orthologous to G22, G28, G1006 |
| 502 | | PRT | Oryza sativa | Orthologous to G22, G28, G1006 |
| 503 | | PRT | Mesembryanthemum crystallinum | Orthologous to G22, G28, G1006 |
| 504 | | DNA | Glycine max | Predicted polypeptide sequence is orthologous to G47, G2133 |
| 505 | | PRT | Oryza sativa | Orthologous to G47, G2133 |
| 550 | | DNA | Glycine max | Predicted polypeptide sequence is orthologous to G226, G682, G1816, G2718 |
| 551 | | DNA | Glycine max | Predicted polypeptide sequence is orthologous to G226, G682, G1816, G2718 |
| 552 | | DNA | Glycine max | Predicted polypeptide sequence is orthologous to G226, G682, G1816, G2718 |
| 553 | | DNA | Glycine max | Predicted polypeptide sequence is orthologous to G226, G682, G1816, G2718 |

TABLE 13-continued

Homologous relationships found within the Sequence Listing

| SEQ ID NO: | GID | DNA or Protein (PRT) | Species from Which Homologous Sequence is Derived | Relationship of SEQ ID NO: to Other Genes |
|---|---|---|---|---|
| 554 | | DNA | Glycine max | Predicted polypeptide sequence is orthologous to G226, G682, G1816, G2718 |
| 555 | | DNA | Oryza sativa | Predicted polypeptide sequence is orthologous to G226, G682, G1816, G2718 |
| 556 | | DNA | Zea mays | Predicted polypeptide sequence is orthologous to G226, G682, G1816, G2718 |
| 557 | | DNA | Zea mays | Predicted polypeptide sequence is orthologous to G226, G682, G1816, G2718 |
| 558 | | PRT | Oryza sativa | Orthologous to G226, G682, G1816, G2718 |
| 559 | | PRT | Oryza sativa | Orthologous to G226, G682, G1816, G2718 |
| 610 | | DNA | Glycine max | Predicted polypeptide sequence is orthologous to G353, G354, G1974, G1889, G2839 |
| 611 | | DNA | Glycine max | Predicted polypeptide sequence is orthologous to G353, G354, G1974, G1889, G2839 |
| 612 | | DNA | Glycine max | Predicted polypeptide sequence is orthologous to G353, G354, G1974, G1889, G2839 |
| 613 | | DNA | Oryza sativa | Predicted polypeptide sequence is orthologous to G353, G354, G1974, G1889, G2839 |
| 614 | | DNA | Zea mays | Predicted polypeptide sequence is orthologous to G353, G354, G1974, G1889, G2839 |
| 615 | | DNA | Zea mays | Predicted polypeptide sequence is orthologous to G353, G354, G1974, G1889, G2839 |
| 616 | | DNA | Zea mays | Predicted polypeptide sequence is orthologous to G353, G354, G1974, G1889, G2839 |
| 617 | | DNA | Zea mays | Predicted polypeptide sequence is orthologous to G353, G354, G1974, G1889, G2839 |
| 618 | | DNA | Zea mays | Predicted polypeptide sequence is orthologous to G353, G354, G1974, G1889, G2839 |
| 619 | | DNA | Zea mays | Predicted polypeptide sequence is orthologous to G353, G354, G1974, G1889, G2839 |
| 620 | | DNA | Zea mays | Predicted polypeptide sequence is orthologous to G353, G354, G1974, G1889, G2839 |
| 621 | | PRT | Oryza sativa | Orthologous to G353, G354, G1974, G1889, G2839 |
| 622 | | PRT | Oryza sativa | Orthologous to G353, G354, G1974, G1889, G2839 |
| 623 | | PRT | Oryza sativa | Orthologous to G353, G354, G1974, G1889, G2839 |
| 624 | | PRT | Oryza sativa | Orthologous to G353, G354, G1974, G1889, G2839 |
| 625 | | PRT | Oryza sativa | Orthologous to G353, G354, G1974, G1889, G2839 |
| 626 | | PRT | Oryza sativa | Orthologous to G353, G354, G1974, G1889, G2839 |
| 746 | | DNA | Glycine max | Predicted polypeptide sequence is orthologous to G481, G482, G485, G1364, G2345 |
| 747 | | DNA | Glycine max | Predicted polypeptide sequence is orthologous to G481, G482, G485, G1364, G2345 |
| 748 | | DNA | Glycine max | Predicted polypeptide sequence is orthologous to G481, G482, G485, G1364, G2345 |
| 749 | | DNA | Glycine max | Predicted polypeptide sequence is orthologous to G481, G482, G485, G1364, G2345 |
| 750 | | DNA | Glycine max | Predicted polypeptide sequence is orthologous to G481, G482, G485, G1364, G2345 |
| 751 | | DNA | Glycine max | Predicted polypeptide sequence is orthologous to G481, G482, G485, G1364, G2345 |
| 752 | | DNA | Glycine max | Predicted polypeptide sequence is orthologous to G481, G482, G485, G1364, G2345 |
| 753 | | DNA | Glycine max | Predicted polypeptide sequence is orthologous to G481, G482, G485, G1364, G2345 |
| 754 | | DNA | Glycine max | Predicted polypeptide sequence is orthologous to G481, G482, G485, G1364, G2345 |
| 755 | | DNA | Glycine max | Predicted polypeptide sequence is orthologous to G481, G482, G485, G1364, G2345 |
| 756 | | DNA | Oryza sativa | Predicted polypeptide sequence is orthologous to G481, G482, G485, G1364, G2345 |
| 757 | | DNA | Oryza sativa | Predicted polypeptide sequence is orthologous to G481, G482, G485, G1364, G2345 |
| 758 | | DNA | Zea mays | Predicted polypeptide sequence is orthologous to G481, G482, G485, G1364, G2345 |
| 759 | | DNA | Zea mays | Predicted polypeptide sequence is orthologous to G481, G482, G485, G1364, G2345 |
| 760 | | DNA | Zea mays | Predicted polypeptide sequence is orthologous to G481, G482, G485, G1364, G2345 |

TABLE 13-continued

Homologous relationships found within the Sequence Listing

| SEQ ID NO: | GID | DNA or Protein (PRT) | Species from Which Homologous Sequence is Derived | Relationship of SEQ ID NO: to Other Genes |
|---|---|---|---|---|
| 761 | | DNA | Zea mays | Predicted polypeptide sequence is orthologous to G481, G482, G485, G1364, G2345 |
| 762 | | DNA | Zea mays | Predicted polypeptide sequence is orthologous to G481, G482, G485, G1364, G2345 |
| 763 | | DNA | Zea mays | Predicted polypeptide sequence is orthologous to G481, G482, G485, G1364, G2345 |
| 764 | | DNA | Zea mays | Predicted polypeptide sequence is orthologous to G481, G482, G485, G1364, G2345 |
| 765 | | DNA | Zea mays | Predicted polypeptide sequence is orthologous to G481, G482, G485, G1364, G2345 |
| 766 | | DNA | Zea mays | Predicted polypeptide sequence is orthologous to G481, G482, G485, G1364, G2345 |
| 767 | | DNA | Zea mays | Predicted polypeptide sequence is orthologous to G481, G482, G485, G1364, G2345 |
| 768 | | DNA | Gossypium arboreum | Predicted polypeptide sequence is orthologous to G481, G482, G485, G1364, G2345 |
| 769 | | DNA | Glycine max | Predicted polypeptide sequence is orthologous to G481, G482, G485, G1364, G2345 |
| 770 | | DNA | Gossypium hirsutum | Predicted polypeptide sequence is orthologous to G481, G482, G485, G1364, G2345 |
| 771 | | DNA | Lycopersicon esculentum | Predicted polypeptide sequence is orthologous to G481, G482, G485, G1364, G2345 |
| 772 | | DNA | Lycopersicon esculentum | Predicted polypeptide sequence is orthologous to G481, G482, G485, G1364, G2345 |
| 773 | | DNA | Medicago truncatula | Predicted polypeptide sequence is orthologous to G481, G482, G485, G1364, G2345 |
| 774 | | DNA | Lycopersicon esculentum | Predicted polypeptide sequence is orthologous to G481, G482, G485, G1364, G2345 |
| 775 | | DNA | Solanum tuberosum | Predicted polypeptide sequence is orthologous to G481, G482, G485, G1364, G2345 |
| 776 | | DNA | Triticum aestivum | Predicted polypeptide sequence is orthologous to G481, G482, G485, G1364, G2345 |
| 777 | | DNA | Hordeum vulgare | Predicted polypeptide sequence is orthologous to G481, G482, G485, G1364, G2345 |
| 778 | | DNA | Triticum monococcum | Predicted polypeptide sequence is orthologous to G481, G482, G485, G1364, G2345 |
| 779 | | DNA | Glycine max | Predicted polypeptide sequence is orthologous to G481, G482, G485, G1364, G2345 |
| 780 | | PRT | Oryza sativa | Orthologous to G481, G482, G485, G1364, G2345 |
| 781 | | PRT | Oryza sativa | Orthologous to G481, G482, G485, G1364, G2345 |
| 782 | | PRT | Oryza sativa | Orthologous to G481, G482, G485, G1364, G2345 |
| 783 | | PRT | Oryza sativa | Orthologous to G481, G482, G485, G1364, G2345 |
| 784 | | PRT | Oryza sativa | Orthologous to G481, G482, G485, G1364, G2345 |
| 785 | | PRT | Zea mays | Orthologous to G481, G482, G485, G1364, G2345 |
| 786 | | PRT | Zea mays | Orthologous to G481, G482, G485, G1364, G2345 |
| 787 | | PRT | Oryza sativa | Orthologous to G481, G482, G485, G1364, G2345 |
| 788 | | PRT | Oryza sativa | Orthologous to G481, G482, G485, G1364, G2345 |
| 789 | | PRT | Oryza sativa | Orthologous to G481, G482, G485, G1364, G2345 |
| 790 | | PRT | Oryza sativa | Orthologous to G481, G482, G485, G1364, G2345 |
| 791 | | PRT | Oryza sativa | Orthologous to G481, G482, G485, G1364, G2345 |
| 792 | | PRT | Oryza sativa | Orthologous to G481, G482, G485, G1364, G2345 |
| 793 | | PRT | Oryza sativa | Orthologous to G481, G482, G485, G1364, G2345 |
| 794 | | PRT | Oryza sativa | Orthologous to G481, G482, G485, G1364, G2345 |
| 795 | | PRT | Oryza sativa | Orthologous to G481, G482, G485, G1364, G2345 |
| 796 | | PRT | Oryza sativa | Orthologous to G481, G482, G485, G1364, G2345 |
| 797 | | PRT | Glycine max | Orthologous to G481, G482, G485, G1364, G2345 |

TABLE 13-continued

Homologous relationships found within the Sequence Listing

| SEQ ID NO: | GID | DNA or Protein (PRT) | Species from Which Homologous Sequence is Derived | Relationship of SEQ ID NO: to Other Genes |
|---|---|---|---|---|
| 798 | | PRT | Glycine max | Orthologous to G481, G482, G485, G1364, G2345 |
| 799 | | PRT | Glycine max | Orthologous to G481, G482, G485, G1364, G2345 |
| 800 | | PRT | Glycine max | Orthologous to G481, G482, G485, G1364, G2345 |
| 801 | | PRT | Glycine max | Orthologous to G481, G482, G485, G1364, G2345 |
| 802 | | PRT | Glycine max | Orthologous to G481, G482, G485, G1364, G2345 |
| 803 | | PRT | Glycine max | Orthologous to G481, G482, G485, G1364, G2345 |
| 804 | | PRT | Zea mays | Orthologous to G481, G482, G485, G1364, G2345 |
| 805 | | PRT | Zea mays | Orthologous to G481, G482, G485, G1364, G2345 |
| 806 | | PRT | Zea mays | Orthologous to G481, G482, G485, G1364, G2345 |
| 807 | | PRT | Zea mays | Orthologous to G481, G482, G485, G1364, G2345 |
| 825 | | DNA | Glycine max | Predicted polypeptide sequence is orthologous to G489, G714 |
| 826 | | DNA | Glycine max | Predicted polypeptide sequence is orthologous to G489, G714 |
| 827 | | DNA | Glycine max | Predicted polypeptide sequence is orthologous to G489, G714 |
| 828 | | DNA | Glycine max | Predicted polypeptide sequence is orthologous to G489, G714 |
| 829 | | DNA | Glycine max | Predicted polypeptide sequence is orthologous to G489, G714 |
| 830 | | DNA | Glycine max | Predicted polypeptide sequence is orthologous to G489, G714 |
| 831 | | DNA | Glycine max | Predicted polypeptide sequence is orthologous to G489, G714 |
| 832 | | DNA | Oryza sativa | Predicted polypeptide sequence is orthologous to G489, G714 |
| 833 | | DNA | Oryza sativa | Predicted polypeptide sequence is orthologous to G489, G714 |
| 834 | | DNA | Zea mays | Predicted polypeptide sequence is orthologous to G489, G714 |
| 835 | | PRT | Oryza sativa | Orthologous to G489, G714 |
| 836 | | PRT | Oryza sativa | Orthologous to G489, G714 |
| 837 | | PRT | Oryza sativa | Orthologous to G489, G714 |
| 981 | | DNA | Oryza sativa | Predicted polypeptide sequence is orthologous to G634 |
| 982 | | DNA | Oryza sativa | Predicted polypeptide sequence is orthologous to G634 |
| 983 | | DNA | Oryza sativa | Predicted polypeptide sequence is orthologous to G634 |
| 984 | | DNA | Zea mays | Predicted polypeptide sequence is orthologous to G634 |
| 985 | | DNA | Zea mays | Predicted polypeptide sequence is orthologous to G634 |
| 986 | | DNA | Zea mays | Predicted polypeptide sequence is orthologous to G634 |
| 987 | | PRT | Oryza sativa | Orthologous to G634 |
| 988 | | PRT | Oryza sativa | Orthologous to G634 |
| 1076 | | DNA | Glycine max | Predicted polypeptide sequence is orthologous to G226, G682, G1816, G2718 |
| 1077 | | DNA | Hordeum vulgare subsp. vulgare | Predicted polypeptide sequence is orthologous to G226, G682, G1816, G2718 |
| 1078 | | DNA | Populus tremula x Populus tremuloides | Predicted polypeptide sequence is orthologous to G226, G682, G1816, G2718 |
| 1079 | | DNA | Triticum aestivum | Predicted polypeptide sequence is orthologous to G226, G682, G1816, G2718 |
| 1080 | | DNA | Gossypium arboreum | Predicted polypeptide sequence is orthologous to G226, G682, G1816, G2718 |
| 1081 | | PRT | Oryza sativa | Orthologous to G226, G682, G1816, G2718 |
| 1082 | | PRT | Oryza sativa | Orthologous to G226, G682, G1816, G2718 |
| 1083 | | PRT | Glycine max | Orthologous to G226, G682, G1816, G2718 |
| 1084 | | PRT | Glycine max | Orthologous to G226, G682, G1816, G2718 |
| 1085 | | PRT | Glycine max | Orthologous to G226, G682, G1816, G2718 |
| 1086 | | PRT | Glycine max | Orthologous to G226, G682, G1816, G2718 |
| 1087 | | PRT | Glycine max | Orthologous to G226, G682, G1816, G2718 |

TABLE 13-continued

Homologous relationships found within the Sequence Listing

| SEQ ID NO: GID | DNA or Protein (PRT) | Species from Which Homologous Sequence is Derived | Relationship of SEQ ID NO: to Other Genes |
|---|---|---|---|
| 1088 | PRT | Glycine max | Orthologous to G226, G682, G1816, G2718 |
| 1089 | PRT | Zea mays | Orthologous to G226, G682, G1816, G2718 |
| 1090 | PRT | Zea mays | Orthologous to G226, G682, G1816, G2718 |
| 1159 | DNA | Glycine max | Predicted polypeptide sequence is orthologous to G9, G867, G993, G1930 |
| 1160 | DNA | Glycine max | Predicted polypeptide sequence is orthologous to G9, G867, G993, G1930 |
| 1161 | DNA | Glycine max | Predicted polypeptide sequence is orthologous to G9, G867, G993, G1930 |
| 1162 | DNA | Glycine max | Predicted polypeptide sequence is orthologous to G9, G867, G993, G1930 |
| 1163 | DNA | Glycine max | Predicted polypeptide sequence is orthologous to G9, G867, G993, G1930 |
| 1164 | DNA | Glycine max | Predicted polypeptide sequence is orthologous to G9, G867, G993, G1930 |
| 1165 | DNA | Oryza sativa | Predicted polypeptide sequence is orthologous to G9, G867, G993, G1930 |
| 1166 | DNA | Oryza sativa | Predicted polypeptide sequence is orthologous to G9, G867, G993, G1930 |
| 1167 | DNA | Zea mays | Predicted polypeptide sequence is orthologous to G9, G867, G993, G1930 |
| 1168 | DNA | Zea mays | Predicted polypeptide sequence is orthologous to G9, G867, G993, G1930 |
| 1169 | DNA | Zea mays | Predicted polypeptide sequence is orthologous to G9, G867, G993, G1930 |
| 1170 | DNA | Zea mays | Predicted polypeptide sequence is orthologous to G9, G867, G993, G1930 |
| 1171 | DNA | Glycine max | Predicted polypeptide sequence is orthologous to G9, G867, G993, G1930 |
| 1172 | DNA | Mesembryanthemum crystallinum | Predicted polypeptide sequence is orthologous to G9, G867, G993, G1930 |
| 1173 | DNA | Lycopersicon esculentum | Predicted polypeptide sequence is orthologous to G9, G867, G993, G1930 |
| 1174 | DNA | Solanum tuberosum | Predicted polypeptide sequence is orthologous to G9, G867, G993, G1930 |
| 1175 | DNA | Hordeum vulgare | Predicted polypeptide sequence is orthologous to G9, G867, G993, G1930 |
| 1176 | PRT | Oryza sativa | Orthologous to G9, G867, G993, G1930 |
| 1177 | PRT | Oryza sativa | Orthologous to G9, G867, G993, G1930 |
| 1178 | PRT | Oryza sativa | Orthologous to G9, G867, G993, G1930 |
| 1179 | PRT | Oryza sativa | Orthologous to G9, G867, G993, G1930 |
| 1180 | PRT | Oryza sativa | Orthologous to G9, G867, G993, G1930 |
| 1181 | PRT | Oryza sativa | Orthologous to G9, G867, G993, G1930 |
| 1182 | PRT | Glycine max | Orthologous to G9, G867, G993, G1930 |
| 1183 | PRT | Glycine max | Orthologous to G9, G867, G993, G1930 |
| 1184 | PRT | Glycine max | Orthologous to G9, G867, G993, G1930 |
| 1185 | PRT | Zea mays | Orthologous to G9, G867, G993, G1930 |
| 1186 | PRT | Zea mays | Orthologous to G9, G867, G993, G1930 |
| 1204 | DNA | Glycine max | Predicted polypeptide sequence is orthologous to G912, G2107, G2513 |
| 1205 | DNA | Glycine max | Predicted polypeptide sequence is orthologous to G912, G2107, G2513 |
| 1206 | DNA | Glycine max | Predicted polypeptide sequence is orthologous to G912, G2107, G2513 |
| 1207 | DNA | Glycine max | Predicted polypeptide sequence is orthologous to G912, G2107, G2513 |
| 1208 | DNA | Glycine max | Predicted polypeptide sequence is orthologous to G912, G2107, G2513 |
| 1209 | DNA | Glycine max | Predicted polypeptide sequence is orthologous to G912, G2107, G2513 |
| 1210 | DNA | Glycine max | Predicted polypeptide sequence is orthologous to G912, G2107, G2513 |
| 1211 | DNA | Oryza sativa | Predicted polypeptide sequence is orthologous to G912, G2107, G2513 |
| 1212 | DNA | Oryza sativa | Predicted polypeptide sequence is orthologous to G912, G913 |
| 1213 | DNA | Zea mays | Predicted polypeptide sequence is orthologous to G912, G2107, G2513 |
| 1214 | DNA | Zea mays | Predicted polypeptide sequence is orthologous to G912, G2107, G2513 |
| 1215 | DNA | Zea mays | Predicted polypeptide sequence is orthologous to G912, G913 |
| 1216 | DNA | Zea mays | Predicted polypeptide sequence is orthologous to G912, G2107, G2513 |

TABLE 13-continued

Homologous relationships found within the Sequence Listing

| SEQ ID NO: GID | DNA or Protein (PRT) | Species from Which Homologous Sequence is Derived | Relationship of SEQ ID NO: to Other Genes |
|---|---|---|---|
| 1217 | DNA | Zea mays | Predicted polypeptide sequence is orthologous to G912, G2107, G2513 |
| 1218 | DNA | Brassica napus | Predicted polypeptide sequence is orthologous to G912, G913 |
| 1219 | DNA | Solanum tuberosum | Predicted polypeptide sequence is orthologous to G912, G2107, G2513 |
| 1220 | DNA | Descurainia sophia | Predicted polypeptide sequence is orthologous to G912, G2107, G2513 |
| 1221 | PRT | Oryza sativa | Orthologous to G912, G2107, G2513 |
| 1222 | PRT | Oryza sativa | Orthologous to G912, G913 |
| 1223 | PRT | Oryza sativa | Orthologous to G912, G913 |
| 1224 | PRT | Oryza sativa | Orthologous to G912, G2107, G2513 |
| 1225 | PRT | Brassica napus | Orthologous to G912, G2107, G2513 |
| 1226 | PRT | Nicotiana tabacum | Orthologous to G912, G2107, G2513 |
| 1227 | PRT | Oryza sativa | Orthologous to G912, G2107, G2513 |
| 1228 | PRT | Oryza sativa | Orthologous to G912, G2107, G2513 |
| 1229 | PRT | Oryza sativa | Orthologous to G912, G2107, G2513 |
| 1230 | PRT | Oryza sativa | Orthologous to G912, G2107, G2513 |
| 1231 | PRT | Oryza sativa | Orthologous to G912, G2107, G2513 |
| 1232 | PRT | Oryza sativa | Orthologous to G912, G2107, G2513 |
| 1233 | PRT | Oryza sativa | Orthologous to G912, G2107, G2513 |
| 1234 | PRT | Oryza sativa | Orthologous to G912, G2107, G2513 |
| 1235 | PRT | Oryza sativa | Orthologous to G912, G2107, G2513 |
| 1236 | PRT | Oryza sativa | Orthologous to G912, G2107, G2513 |
| 1237 | PRT | Glycine max | Orthologous to G912, G2107, G2513 |
| 1238 | PRT | Glycine max | Orthologous to G912, G2107, G2513 |
| 1239 | PRT | Glycine max | Orthologous to G912, G2107, G2513 |
| 1240 | PRT | Glycine max | Orthologous to G912, G2107, G2513 |
| 1241 | PRT | Glycine max | Orthologous to G912, G2107, G2513 |
| 1242 | PRT | Glycine max | Orthologous to G912, G2107, G2513 |
| 1243 | PRT | Glycine max | Orthologous to G912, G2107, G2513 |
| 1244 | PRT | Zea mays | Orthologous to G912, G2107, G2513 |
| 1245 | PRT | Zea mays | Orthologous to G912, G2107, G2513 |
| 1246 | PRT | Zea mays | Orthologous to G912, G2107, G2513 |
| 1247 | PRT | Zea mays | Orthologous to G912, G2107, G2513 |
| 1248 | PRT | Zea mays | Orthologous to G912, G2107, G2513 |
| 1249 | DNA | Glycine max | Predicted polypeptide sequence is orthologous to G922 |
| 1250 | DNA | Glycine max | Predicted polypeptide sequence is orthologous to G922 |
| 1251 | DNA | Glycine max | Predicted polypeptide sequence is orthologous to G922 |
| 1252 | DNA | Oryza sativa | Predicted polypeptide sequence is orthologous to G922 |
| 1253 | DNA | Oryza sativa | Predicted polypeptide sequence is orthologous to G922 |
| 1254 | PRT | Oryza sativa | Orthologous to G922 |
| 1255 | PRT | Oryza sativa | Orthologous to G922 |
| 1256 | PRT | Oryza sativa | Orthologous to G922 |
| 1257 | PRT | Oryza sativa | Orthologous to G922 |
| 1258 | DNA | Glycine max | Predicted polypeptide sequence is orthologous to G926 |
| 1259 | DNA | Glycine max | Predicted polypeptide sequence is orthologous to G926 |
| 1260 | DNA | Oryza sativa | Predicted polypeptide sequence is orthologous to G926 |
| 1261 | DNA | Oryza sativa | Predicted polypeptide sequence is orthologous to G926 |
| 1262 | DNA | Zea mays | Predicted polypeptide sequence is orthologous to G926 |
| 1263 | PRT | Brassica napus | Orthologous to G926 |
| 1292 | DNA | Glycine max | Predicted polypeptide sequence is orthologous to G975, G1387, G2583 |
| 1293 | DNA | Glycine max | Predicted polypeptide sequence is orthologous to G975, G1387, G2583 |
| 1294 | DNA | Glycine max | Predicted polypeptide sequence is orthologous to G975, G1387, G2583 |
| 1295 | DNA | Glycine max | Predicted polypeptide sequence is orthologous to G975, G1387, G2583 |
| 1296 | DNA | Glycine max | Predicted polypeptide sequence is orthologous to G975, G1387, G2583 |
| 1297 | DNA | Oryza sativa | Predicted polypeptide sequence is orthologous to G975, G1387, G2583 |

TABLE 13-continued

Homologous relationships found within the Sequence Listing

| SEQ ID NO: GID | DNA or Protein (PRT) | Species from Which Homologous Sequence is Derived | Relationship of SEQ ID NO: to Other Genes |
|---|---|---|---|
| 1298 | DNA | Oryza sativa | Predicted polypeptide sequence is orthologous to G975, G1387, G2583 |
| 1299 | DNA | Zea mays | Predicted polypeptide sequence is orthologous to G975, G1387, G2583 |
| 1300 | DNA | Zea mays | Predicted polypeptide sequence is orthologous to G975, G1387, G2583 |
| 1301 | DNA | Brassica rapa | Predicted polypeptide sequence is orthologous to G975, G1387, G2583 |
| 1302 | PRT | Oryza sativa | Orthologous to G975, G1387, G2583 |
| 1393 | DNA | Glycine max | Predicted polypeptide sequence is orthologous to G1069, G2153 |
| 1394 | DNA | Glycine max | Predicted polypeptide sequence is orthologous to G1069, G2153 |
| 1395 | PRT | Oryza sativa | Orthologous to G1069, G2153 |
| 1396 | DNA | Zea mays | Predicted polypeptide sequence is orthologous to G1069, G2153 |
| 1397 | DNA | Lotus japonicus | Predicted polypeptide sequence is orthologous to G1069, G2153 |
| 1398 | DNA | Lycopersicon esculentum | Predicted polypeptide sequence is orthologous to G1067, G1073, G2156 |
| 1399 | PRT | Oryza sativa | Orthologous to G1067, G1073, G2156 |
| 1400 | PRT | Oryza sativa | Orthologous to G1067, G1073, G2156 |
| 1401 | PRT | Oryza sativa | Orthologous to G1067, G1073, G2156 |
| 1402 | PRT | Oryza sativa | Orthologous to G1067, G1073, G2156 |
| 1403 | PRT | Oryza sativa | Orthologous to G1067, G1073, G2156 |
| 1404 | PRT | Oryza sativa | Orthologous to G1067, G1073, G2156 |
| 1405 | PRT | Oryza sativa | Orthologous to G1067, G1073, G2156 |
| 1406 | PRT | Oryza sativa | Orthologous to G1067, G1073, G2156 |
| 1407 | PRT | Oryza sativa | Orthologous to G1067, G1073, G2156 |
| 1408 | PRT | Oryza sativa | Orthologous to G1067, G1073, G2156 |
| 1409 | PRT | Oryza sativa | Orthologous to G1067, G1073, G2156 |
| 1410 | PRT | Oryza sativa | Orthologous to G1067, G1073, G2156 |
| 1411 | PRT | Glycine max | Orthologous to G1067, G1073, G2156 |
| 1412 | PRT | Glycine max | Orthologous to G1067, G1073, G2156 |
| 1413 | PRT | Glycine max | Orthologous to G1067, G1073, G2156 |
| 1414 | PRT | Glycine max | Orthologous to G1067, G1073, G2156 |
| 1415 | PRT | Glycine max | Orthologous to G1067, G1073, G2156 |
| 1416 | PRT | Glycine max | Orthologous to G1067, G1073, G2156 |
| 1417 | PRT | Glycine max | Orthologous to G1067, G1073, G2156 |
| 1418 | PRT | Zea mays | Orthologous to G1067, G1073, G2156 |
| 1419 | DNA | Glycine max | Predicted polypeptide sequence is orthologous to G1075, G1076 |
| 1420 | DNA | Glycine max | Predicted polypeptide sequence is orthologous to G1075, G1076 |
| 1421 | DNA | Glycine max | Predicted polypeptide sequence is orthologous to G1075, G1076 |
| 1422 | DNA | Glycine max | Predicted polypeptide sequence is orthologous to G1075, G1076 |
| 1423 | DNA | Glycine max | Predicted polypeptide sequence is orthologous to G1075, G1076 |
| 1424 | DNA | Oryza sativa | Predicted polypeptide sequence is orthologous to G1075, G1076 |
| 1425 | DNA | Oryza sativa | Predicted polypeptide sequence is orthologous to G1075, G1076 |
| 1426 | DNA | Oryza sativa | Predicted polypeptide sequence is orthologous to G1075, G1076 |
| 1587 | DNA | Glycine max | Predicted polypeptide sequence is orthologous to G1411, G2509 |
| 1588 | DNA | Glycine max | Predicted polypeptide sequence is orthologous to G1411, G2509 |
| 1589 | DNA | Glycine max | Predicted polypeptide sequence is orthologous to G1411, G2509 |
| 1590 | DNA | Glycine max | Predicted polypeptide sequence is orthologous to G1411, G2509 |
| 1591 | DNA | Zea mays | Predicted polypeptide sequence is orthologous to G1411, G2509 |
| 1604 | DNA | Glycine max | Predicted polypeptide sequence is orthologous to G990, G1451 |
| 1605 | DNA | Glycine max | Predicted polypeptide sequence is orthologous to G990, G1451 |
| 1606 | DNA | Oryza sativa | Predicted polypeptide sequence is orthologous to G990, G1451 |
| 1607 | DNA | Oryza sativa | Predicted polypeptide sequence is orthologous to G990, G1451 |

TABLE 13-continued

Homologous relationships found within the Sequence Listing

| SEQ ID NO: | GID | DNA or Protein (PRT) | Species from Which Homologous Sequence is Derived | Relationship of SEQ ID NO: to Other Genes |
|---|---|---|---|---|
| 1608 | | DNA | Oryza sativa | Predicted polypeptide sequence is orthologous to G990, G1451 |
| 1609 | | DNA | Zea mays | Predicted polypeptide sequence is orthologous to G990, G1451 |
| 1610 | | DNA | Zea mays | Predicted polypeptide sequence is orthologous to G990, G1451 |
| 1611 | | DNA | Zea mays | Predicted polypeptide sequence is orthologous to G990, G1451 |
| 1612 | | DNA | Zea mays | Predicted polypeptide sequence is orthologous to G990, G1451 |
| 1613 | | DNA | Medicago truncatula | Predicted polypeptide sequence is orthologous to G990, G1451 |
| 1614 | | DNA | Solanum tuberosum | Predicted polypeptide sequence is orthologous to G990, G1451 |
| 1615 | | DNA | Zea mays | Predicted polypeptide sequence is orthologous to G990, G1451 |
| 1616 | | DNA | Sorghum propinquum | Predicted polypeptide sequence is orthologous to G990, G1451 |
| 1617 | | DNA | Glycine max | Predicted polypeptide sequence is orthologous to G990, G1451 |
| 1618 | | DNA | Sorghum bicolor | Predicted polypeptide sequence is orthologous to G990, G1451 |
| 1619 | | DNA | Hordeum vulgare | Predicted polypeptide sequence is orthologous to G990, G1451 |
| 1620 | | DNA | Lycopersicon esculentum | Predicted polypeptide sequence is orthologous to G990, G1451 |
| 1621 | | PRT | Oryza sativa | Orthologous to G990, G1451 |
| 1622 | | PRT | Oryza sativa | Orthologous to G990, G1451 |
| 1623 | | PRT | Oryza sativa | Orthologous to G990, G1451 |
| 1624 | | PRT | Oryza sativa | Orthologous to G990, G1451 |
| 1671 | | DNA | Glycine max | Predicted polypeptide sequence is orthologous to G1543 |
| 1672 | | DNA | Oryza sativa | Predicted polypeptide sequence is orthologous to G1543 |
| 1673 | | DNA | Zea mays | Predicted polypeptide sequence is orthologous to G1543 |
| 1674 | | PRT | Oryza sativa | Orthologous to G1543 |
| 1728 | | DNA | Glycine max | Predicted polypeptide sequence is orthologous to G30, G1791, G1792, G1795 |
| 1729 | | DNA | Glycine max | Predicted polypeptide sequence is orthologous to G30, G1791, G1792, G1795 |
| 1730 | | DNA | Glycine max | Predicted polypeptide sequence is orthologous to G30, G1791, G1792, G1795 |
| 1731 | | DNA | Glycine max | Predicted polypeptide sequence is orthologous to G30, G1791, G1792, G1795 |
| 1732 | | DNA | Glycine max | Predicted polypeptide sequence is orthologous to G30, G1791, G1792, G1795 |
| 1733 | | DNA | Zea mays | Predicted polypeptide sequence is orthologous to G30, G1791, G1792, G1795 |
| 1734 | | DNA | Lycopersicon esculentum | Predicted polypeptide sequence is orthologous to G30, G1791, G1792, G1795 |
| 1735 | G3380 | PRT | Oryza sativa | Orthologous to G30, G1791, G1792, G1795 |
| 1736 | G3381 | PRT | Oryza sativa indica | Orthologous to G30, G1791, G1792, G1795 |
| 1737 | G3383 | PRT | Oryza sativa japonica | Orthologous to G30, G1791, G1792, G1795 |
| 1795 | | DNA | Oryza sativa | Predicted polypeptide sequence is orthologous to G9, G867, G993, G1930 |
| 1908 | | DNA | Medicago truncatula | Predicted polypeptide sequence is orthologous to G1945, G2155 |
| 1909 | | DNA | Medicago truncatula | Predicted polypeptide sequence is orthologous to G1945, G2155 |
| 1910 | | DNA | Glycine max | Predicted polypeptide sequence is orthologous to G1945, G2155 |
| 1949 | G9 | DNA | Arabidopsis thaliana | Predicted polypeptide sequence is paralogous to G9, G867, G993, G1930 |
| 1950 | G9 | PRT | Arabidopsis thaliana | Paralogous to G9, G867, G993, G1930 |
| 1953 | G30 | DNA | Arabidopsis thaliana | Predicted polypeptide sequence is paralogous to G30, G1791, G1792, G1795 |
| 1954 | G30 | PRT | Arabidopsis thaliana | start Paralogous to G30, G1791, G1792, G1795 |
| 1955 | G40 | DNA | Arabidopsis thaliana | Predicted polypeptide sequence is paralogous to G912, G2107, G2513 |
| 1956 | G40 | PRT | Arabidopsis thaliana | Paralogous to G912, G2107, G2513 |
| 1957 | G41 | DNA | Arabidopsis thaliana | Predicted polypeptide sequence is paralogous to G912, G2107, G2513 |

TABLE 13-continued

Homologous relationships found within the Sequence Listing

| SEQ ID NO: | GID | DNA or Protein (PRT) | Species from Which Homologous Sequence is Derived | Relationship of SEQ ID NO: to Other Genes |
|---|---|---|---|---|
| 1958 | G41 | PRT | *Arabidopsis thaliana* | Paralogous to G912, G2107, G2513 |
| 1959 | G42 | DNA | *Arabidopsis thaliana* | Predicted polypeptide sequence is paralogous to G912, G2107, G2513 |
| 1960 | G42 | PRT | *Arabidopsis thaliana* | Paralogous to G912, G2107, G2513 |
| 1971 | G225 | DNA | *Arabidopsis thaliana* | Predicted polypeptide sequence is paralogous to G226, G682, G1816, G2718 |
| 1972 | G225 | PRT | *Arabidopsis thaliana* | Paralogous to G226, G682, G1816, G2718 |
| 1991 | G370 | DNA | *Arabidopsis thaliana* | Predicted polypeptide sequence is paralogous to G361, G362, G370, G1995, G2826, G2838 |
| 1992 | G370 | PRT | *Arabidopsis thaliana* | Paralogous to G361, G362, G370, G1995, G2826, G2838 |
| 2009 | G485 | DNA | *Arabidopsis thaliana* | Predicted polypeptide sequence is paralogous to 481, G482, G485, G1364, G2345 |
| 2010 | G485 | PRT | *Arabidopsis thaliana* | Paralogous to 481, G482, G485, G1364, G2345 |
| 2053 | G714 | DNA | *Arabidopsis thaliana* | Predicted polypeptide sequence is paralogous to G489, G714 |
| 2054 | G714 | PRT | *Arabidopsis thaliana* | Paralogous to G489, G714 |
| 2069 | G990 | DNA | *Arabidopsis thaliana* | Predicted polypeptide sequence is paralogous to G990, G1451 |
| 2070 | G990 | PRT | *Arabidopsis thaliana* | Paralogous to G990, G1451 |
| 2071 | G993 | DNA | *Arabidopsis thaliana* | Predicted polypeptide sequence is paralogous to G9, G867, G993, G1930 |
| 2072 | G993 | PRT | *Arabidopsis thaliana* | Paralogous to G9, G867, G993, G1930 |
| 2073 | G1006 | DNA | *Arabidopsis thaliana* | Predicted polypeptide sequence is paralogous to G22, G28, G1006 |
| 2074 | G1006 | PRT | *Arabidopsis thaliana* | Paralogous to G22, G28, G1006 |
| 2077 | G1067 | DNA | *Arabidopsis thaliana* | Predicted polypeptide sequence is paralogous to G1067, G1073, G2156 |
| 2078 | G1067 | PRT | *Arabidopsis thaliana* | Paralogous to G1067, G1073, G2156 |
| 2079 | G1076 | DNA | *Arabidopsis thaliana* | Predicted polypeptide sequence is paralogous to G1075, G1076 |
| 2080 | G1076 | PRT | *Arabidopsis thaliana* | Paralogous to G1075, G1076 |
| 2101 | G1364 | DNA | *Arabidopsis thaliana* | Predicted polypeptide sequence is paralogous to 481, G482, G485, G1364, G2345 |
| 2102 | G1364 | PRT | *Arabidopsis thaliana* | Paralogous to 481, G482, G485, G1364, G2345 |
| 2105 | G1387 | DNA | *Arabidopsis thaliana* | Predicted polypeptide sequence is paralogous to G975, G1387, G2583 |
| 2106 | G1387 | PRT | *Arabidopsis thaliana* | Paralogous to G975, G1387, G2583 |
| 2133 | G1791 | DNA | *Arabidopsis thaliana* | Predicted polypeptide sequence is paralogous to G30, G1791, G1792, G1795 |
| 2134 | G1791 | PRT | *Arabidopsis thaliana* | Paralogous to G30, G1791, G1792, G1795 |
| 2135 | G1795 | DNA | *Arabidopsis thaliana* | Predicted polypeptide sequence is paralogous to G30, G1791, G1792, G1795 |
| 2136 | G1795 | PRT | *Arabidopsis thaliana* | Paralogous to G30, G1791, G1792, G1795 |
| 2141 | G1816 | DNA | *Arabidopsis thaliana* | Predicted polypeptide sequence is paralogous to G226, G682, G1816, G2718 |
| 2142 | G1816 | PRT | *Arabidopsis thaliana* | Paralogous to G226, G682, G1816, G2718 |
| 2149 | G1889 | DNA | *Arabidopsis thaliana* | Predicted polypeptide sequence is paralogous to G353, G354, G1974, G1889, G2839 |
| 2150 | G1889 | PRT | *Arabidopsis thaliana* | Paralogous to G353, G354, G1974, G1889, G2839 |
| 2153 | G1945 | DNA | *Arabidopsis thaliana* | Predicted polypeptide sequence is paralogous to G1945, G2155 |
| 2154 | G1945 | PRT | *Arabidopsis thaliana* | Paralogous to G1945, G2155 |
| 2155 | G1974 | DNA | *Arabidopsis thaliana* | Predicted polypeptide sequence is paralogous to G353, G354, G1974, G1889, G2839 |
| 2156 | G1974 | PRT | *Arabidopsis thaliana* | Paralogous to G353, G354, G1974, G1889, G2839 |
| 2157 | G1995 | DNA | *Arabidopsis thaliana* | Predicted polypeptide sequence is paralogous to G361, G362, G1995, G2826, G2838 |
| 2158 | G1995 | PRT | *Arabidopsis thaliana* | Paralogous to G361, G362, G1995, G2826, G2838 |
| 2161 | G2107 | DNA | *Arabidopsis thaliana* | Predicted polypeptide sequence is paralogous to G912, G2107, G2513 |
| 2162 | G2107 | PRT | *Arabidopsis thaliana* | Paralogous to G912, G2107, G2513 |
| 2165 | G2156 | DNA | *Arabidopsis thaliana* | Predicted polypeptide sequence is paralogous to G1067, G1073, G2156 |
| 2166 | G2156 | PRT | *Arabidopsis thaliana* | Paralogous to G1067, G1073, G2156 |
| 2171 | G2345 | DNA | *Arabidopsis thaliana* | Predicted polypeptide sequence is paralogous to 481, G482, G485, G1364, G2345 |
| 2172 | G2345 | PRT | *Arabidopsis thaliana* | Paralogous to 481, G482, G485, G1364, G2345 |
| 2183 | G2513 | DNA | *Arabidopsis thaliana* | Predicted polypeptide sequence is paralogous to G912, G2107, G2513 |

TABLE 13-continued

Homologous relationships found within the Sequence Listing

| SEQ ID NO: | GID | DNA or Protein (PRT) | Species from Which Homologous Sequence is Derived | Relationship of SEQ ID NO: to Other Genes |
|---|---|---|---|---|
| 2184 | G2513 | PRT | Arabidopsis thaliana | Paralogous to G912, G2107, G2513 |
| 2191 | G2718 | DNA | Arabidopsis thaliana | Predicted polypeptide sequence is paralogous to G226, G682, G1816, G2718 |
| 2192 | G2718 | PRT | Arabidopsis thaliana | Paralogous to G226, G682, G1816, G2718 |
| 2199 | G2839 | DNA | Arabidopsis thaliana | Predicted polypeptide sequence is paralogous to G353, G354, G1974, G1889, G2839 |
| 2200 | G2839 | PRT | Arabidopsis thaliana | Paralogous to G353, G354, G1974, G1889, G2839 |

EXAMPLES

The invention, now being generally described, will be more readily understood by reference to the following examples, which are included merely for purposes of illustration of certain aspects and embodiments of the present invention and are not intended to limit the invention. It will be recognized by one of skill in the art that a transcription factor that is associated with a particular first trait may also be associated with at least one other, unrelated and inherent second trait which was not predicted by the first trait.

The complete descriptions of the traits associated with each polynucleotide of the invention are fully disclosed in Table 7 and Table 9. The complete description of the transcription factor gene family and identified conserved domains of the polypeptide encoded by the polynucleotide is fully disclosed in Table 8.

Example I

Full Length Gene Identification and Cloning

Putative transcription factor sequences (genomic or ESTs) related to known transcription factors were identified in the Arabidopsis thaliana GenBank database using the tblastn sequence analysis program using default parameters and a P-value cutoff threshold of −4 or −5 or lower, depending on the length of the query sequence. Putative transcription factor sequence hits were then screened to identify those containing particular sequence strings. If the sequence hits contained such sequence strings, the sequences were confirmed as transcription factors.

Alternatively, Arabidopsis thaliana cDNA libraries derived from different tissues or treatments, or genomic libraries were screened to identify novel members of a transcription family using a low stringency hybridization approach. Probes were synthesized using gene specific primers in a standard PCR reaction (annealing temperature 60° C.) and labeled with $^{32}$P dCTP using the High Prime DNA Labeling Kit (Boehringer Mannheim Corp. (now Roche Diagnostics Corp., Indianapolis, Ind.). Purified radiolabelled probes were added to filters immersed in Church hybridization medium (0.5 M NaPO$_4$ pH 7.0, 7% SDS, 1% w/v bovine serum albumin) and hybridized overnight at 60° C. with shaking. Filters were washed two times for 45 to 60 minutes with 1×SCC, 1% SDS at 60° C.

To identify additional sequence 5' or 3' of a partial cDNA sequence in a cDNA library, 5' and 3' rapid amplification of cDNA ends (RACE) was performed using the MARATHON cDNA amplification kit (Clontech, Palo Alto, Calif.). Generally, the method entailed first isolating poly(A) mRNA, performing first and second strand cDNA synthesis to generate double stranded cDNA, blunting cDNA ends, followed by ligation of the MARATHON Adaptor to the cDNA to form a library of adaptor-ligated ds cDNA.

Gene-specific primers were designed to be used along with adaptor specific primers for both 5' and 3' RACE reactions. Nested primers, rather than single primers, were used to increase PCR specificity. Using 5' and 3' RACE reactions, 5' and 3' RACE fragments were obtained, sequenced and cloned. The process can be repeated until 5' and 3' ends of the full-length gene were identified. Then the full-length cDNA was generated by PCR using primers specific to 5' and 3' ends of the gene by end-to-end PCR.

Example II

Construction of Expression Vectors

For the experiments in Example XIII, two types of constructs were used to modulate the activity of lead transcription factors and test the activity of orthologs and paralogs in transgenic plants. These included direct promoter fusion constructs and two component transformation systems.

For direct promoter fusion, expression of a single full-length wild-type version of a transcription factor polynucleotide sequence was driven by fusing the polynucleotide directly to a promoter. A number of different promoters may be used, such as the native promoter or that gene, or a promoter that drives tissue specific or conditional expression. In the direct promoter fusion assays found in Example XIII, the CaMV 35S constitutive promoter was used. To clone the sequence into the vector, both pMEN20, derived from pMON316 (Sanders et al. (1987) Nucleic Acids Res. 15:1543-1558), and the amplified DNA fragment (the sequence was amplified from a genomic or cDNA library using primers specific to sequences upstream and downstream of the coding region) were digested separately with SalI and NotI restriction enzymes at 37° C. for 2 hours. The digestion products were subject to electrophoresis in a 0.8% agarose gel and visualized by ethidium bromide staining. The DNA fragments containing the sequence and the linearized plasmid were excised and purified by using a QIAQUICK gel extraction kit (Qiagen, Valencia Calif.). The fragments of interest were ligated at a ratio of 3:1 (vector to insert). Ligation reactions using T4 DNA ligase (New England Biolabs, Beverly Mass.) were carried out at 16° C. for 16 hours. The ligated DNAs were transformed into competent cells of the E. coli strain DH5alpha by using the heat shock method. The transformations were plated on LB plates containing 50 mg/l kanamycin (Sigma Chemical Co. St. Louis Mo.). Individual colonies were grown overnight in five milliliters of LB broth containing 50 mg/l kanamycin at 37° C. Plasmid DNA was purified by using Qiaquick Mini Prep kits (Qiagen).

For two component supertransformation (2 comp. supTfn), two separate constructs were used: Promoter::LexA-GAL4TA and opLexA::TF. The first of these (Promoter:: LexA-GAL4TA) comprised a desired promoter cloned in front of a LexA DNA binding domain fused to a GAL4 activation domain. The construct vector backbone (pMEN48; P5375) also carried a kanamycin resistance marker, along with an opLexA::GFP reporter. Transgenic lines were obtained containing this first component, and a line was selected that showed reproducible expression of the reporter gene in the desired pattern through a number of generations. A homozygous population was established for that line, and the population was supertransformed with the second construct (opLexA::TF) carrying the transcription factor of interest cloned behind a LexA operator site. This second construct vector backbone (pMEN53; P5381) also contained a sulfonamide resistance marker.

Example III

Transformation of *Agrobacterium* with the Expression Vector

After the plasmid vector containing the gene was constructed, the vector was used to transform *Agrobacterium tumefaciens* cells expressing the gene products. The stock of *Agrobacterium tumefaciens* cells for transformation was made as described by Nagel et al. (1990) *FEMS Microbiol Letts.* 67: 325-328. *Agrobacterium* strain ABI was grown in 250 ml LB medium (Sigma) overnight at 28° C. with shaking until an absorbance over 1 cm at 600 nm ($A_{600}$) of 0.5-1.0 was reached. Cells were harvested by centrifugation at 4,000×g for 15 min at 4° C. Cells were then resuspended in 250 µl chilled buffer (1 mM HEPES, pH adjusted to 7.0 with KOH). Cells were centrifuged again as described above and resuspended in 125 µl chilled buffer. Cells were then centrifuged and resuspended two more times in the same HEPES buffer as described above at a volume of 100 µl and 750 respectively. Resuspended cells were then distributed into 40 µl aliquots, quickly frozen in liquid nitrogen, and stored at −80° C.

*Agrobacterium* cells were transformed with plasmids prepared as described above following the protocol described by Nagel et al. (supra). For each DNA construct to be transformed, 50-100 ng DNA (generally resuspended in 10 mM Tris-HCl, 1 mM EDTA, pH 8.0) was mixed with 40 µl of *Agrobacterium* cells. The DNA/cell mixture was then transferred to a chilled cuvette with a 2 mm electrode gap and subject to a 2.5 kV charge dissipated at 25 µF and 200 µF using a Gene Pulser II apparatus (Bio-Rad, Hercules, Calif.). After electroporation, cells were immediately resuspended in 1.0 ml LB and allowed to recover without antibiotic selection for 2-4 hours at 28° C. in a shaking incubator. After recovery, cells were plated onto selective medium of LB broth containing 100 µg/ml spectinomycin (Sigma) and incubated for 24-48 hours at 28° C. Single colonies were then picked and inoculated in fresh medium. The presence of the plasmid construct was verified by PCR amplification and sequence analysis.

Example IV

Transformation of *Arabidopsis* Plants with *Agrobacterium tumefaciens* with Expression Vector After transformation of *Agrobacterium tumefaciens* with plasmid vectors containing the gene, single *Agrobacterium* colonies were identified, propagated, and used to transform *Arabidopsis* plants. Briefly, 500 ml cultures of LB medium containing 50 mg/l kanamycin were inoculated with the colonies and grown at 28° C. with shaking for 2 days until an optical absorbance at 600 nm wavelength over 1 cm ($A_{600}$) of >2.0 is reached. Cells were then harvested by centrifugation at 4,000×g for 10 min, and resuspended in infiltration medium (½× Murashige and Skoog salts (Sigma), 1× Gamborg's B-5 vitamins (Sigma), 5.0% (w/v) sucrose (Sigma), 0.044 µM benzylamino purine (Sigma), 200 µl/l Silwet L-77 (Lehle Seeds) until an $A_{600}$ of 0.8 was reached.

Prior to transformation, *Arabidopsis thaliana* seeds (ecotype Columbia) were sown at a density of ~10 plants per 4" pot onto Pro-Mix BX potting medium (Hummert International) covered with fiberglass mesh (18 mm×16 mm). Plants were grown under continuous illumination (50-75 µE/m²/sec) at 22-23° C. with 65-70% relative humidity. After about 4 weeks, primary inflorescence stems (bolts) are cut off to encourage growth of multiple secondary bolts. After flowering of the mature secondary bolts, plants were prepared for transformation by removal of all siliques and opened flowers.

The pots were then immersed upside down in the mixture of *Agrobacterium* infiltration medium as described above for 30 sec, and placed on their sides to allow draining into a 1'×2' flat surface covered with plastic wrap. After 24 h, the plastic wrap was removed and pots are turned upright. The immersion procedure was repeated one week later, for a total of two immersions per pot. Seeds were then collected from each transformation pot and analyzed following the protocol described below.

Example V

Identification of *Arabidopsis* Primary Transformants

Seeds collected from the transformation pots were sterilized essentially as follows. Seeds were dispersed into in a solution containing 0.1% (v/v) Triton X-100 (Sigma) and sterile water and washed by shaking the suspension for 20 min. The wash solution was then drained and replaced with fresh wash solution to wash the seeds for 20 min with shaking. After removal of the ethanol/detergent solution, a solution containing 0.1% (v/v) Triton X-100 and 30% (v/v) bleach (CLOROX; Clorox Corp. Oakland Calif.) was added to the seeds, and the suspension was shaken for 10 min. After removal of the bleach/detergent solution, seeds were then washed five times in sterile distilled water. The seeds were stored in the last wash water at 4° C. for 2 days in the dark before being plated onto antibiotic selection medium (1× Murashige and Skoog salts (pH adjusted to 5.7 with 1M KOH), 1× Gamborg's B-5 vitamins, 0.9% phytagar (Life Technologies), and 50 mg/l kanamycin). Seeds were germinated under continuous illumination (50-75 µE/m²/sec) at 22-23° C. After 7-10 days of growth under these conditions, kanamycin resistant primary transformants ($T_1$ generation) were visible and obtained. These seedlings were transferred first to fresh selection plates where the seedlings continued to grow for 3-5 more days, and then to soil (Pro-Mix BX potting medium).

Primary transformants were crossed and progeny seeds ($T_2$) collected; kanamycin resistant seedlings were selected and analyzed. The expression levels of the recombinant polynucleotides in the transformants vary from about a 5% expression level increase to a least a 100% expression level increase. Similar observations are made with respect to polypeptide level expression.

Example VI

Identification of *Arabidopsis* Plants with Transcription Factor Gene Knockouts The screening of insertion mutagenized *Arabidopsis* collections for null mutants in a known target gene was essentially as described in Krysan et al. (1999) *Plant Cell* 11: 2283-2290. Briefly, gene-specific primers, nested by 5-250 base pairs to each other, were designed from the 5' and 3' regions of a known target gene. Similarly, nested sets of primers were also created specific to each of the T-DNA or transposon ends (the "right" and "left" borders). All possible combinations of gene specific and T-DNA/transposon primers were used to detect by PCR an insertion event within or close to the target gene. The amplified DNA fragments were then sequenced which allows the precise determination of the T-DNA/transposon insertion point relative to the target gene. Insertion events within the coding or intervening sequence of the genes were deconvoluted from a pool comprising a plurality of insertion events to a single unique mutant plant for functional characterization. The method is described in more detail in Yu and Adam, U.S. application Ser. No. 09/177,733 filed Oct. 23, 1998.

Example VII

Identification of Modified Phenotypes in Overexpression or Gene Knockout Plants Experiments were performed to identify those transformants or knockouts that exhibited modified biochemical characteristics. Among the biochemicals that were assayed were insoluble sugars, such as arabinose, fucose, galactose, mannose, rhamnose or xylose or the like; prenyl lipids, such as lutein, beta-carotene, xanthophyll-1, xanthophyll-2, chlorophylls A or B, or alpha-, delta- or gamma-tocopherol or the like; fatty acids, such as 16:0 (palmitic acid), 16:1 (palmitoleic acid), 18:0 (stearic acid), 18:1 (oleic acid), 18:2 (linoleic acid), 20:0, 18:3 (linolenic acid), 20:1 (eicosenoic acid), 20:2, 22:1 (erucic acid) or the like; waxes, such as by altering the levels of C29, C31, or C33 alkanes; sterols, such as brassicasterol, campesterol, stigmasterol, sitosterol or stigmastanol or the like, glucosinolates, protein or oil levels.

Fatty acids were measured using two methods depending on whether the tissue was from leaves or seeds. For leaves, lipids were extracted and esterified with hot methanolic $H_2SO_4$ and partitioned into hexane from methanolic brine. For seed fatty acids, seeds were pulverized and extracted in methanol:heptane:toluene:2,2-dimethoxypropane:$H_2SO_4$ (39:34:20:5:2) for 90 minutes at 80° C. After cooling to room temperature the upper phase, containing the seed fatty acid esters, was subjected to GC analysis. Fatty acid esters from both seed and leaf tissues were analyzed with a SUPELCO SP-2330 column (Supelco, Bellefonte, Pa.).

Glucosinolates were purified from seeds or leaves by first heating the tissue at 95° C. for 10 minutes. Preheated ethanol:water (50:50) is added and after heating at 95° C. for a further 10 minutes, the extraction solvent is applied to a DEAE Sephadex column (Pharmacia) which had been previously equilibrated with 0.5 M pyridine acetate. Desulfoglucosinolates were eluted with 300 µl water and analyzed by reverse phase HPLC monitoring at 226 nm.

For wax alkanes, samples were extracted using an identical method as fatty acids and extracts were analyzed on a HP 5890 GC coupled with a 5973 MSD. Samples were chromatographically isolated on a J&W DB35 mass spectrometer (J&W Scientific Agilent Technologies, Folsom, Calif.).

To measure prenyl lipid levels, seeds or leaves were pulverized with 1 to 2% pyrogallol as an antioxidant. For seeds, extracted samples were filtered and a portion removed for tocopherol and carotenoid/chlorophyll analysis by HPLC. The remaining material was saponified for sterol determination. For leaves, an aliquot was removed and diluted with methanol and chlorophyll A, chlorophyll B, and total carotenoids measured by spectrophotometry by determining optical absorbance at 665.2 nm, 652.5 nm, and 470 nm. An aliquot was removed for tocopherol and carotenoid/chlorophyll composition by HPLC using a Waters µBondapak C18 column (4.6 mm×150 mm). The remaining methanolic solution was saponified with 10% KOH at 80° C. for one hour. The samples were cooled and diluted with a mixture of methanol and water. A solution of 2% methylene chloride in hexane was mixed in and the samples were centrifuged. The aqueous methanol phase was again re-extracted 2% methylene chloride in hexane and, after centrifugation, the two upper phases were combined and evaporated. 2% methylene chloride in hexane was added to the tubes and the samples were then extracted with one ml of water. The upper phase was removed, dried, and resuspended in 400 µl of 2% methylene chloride in hexane and analyzed by gas chromatography using a 50 m DB-5 ms (0.25 mm ID, 0.25 µm phase, J&W Scientific).

Insoluble sugar levels were measured by the method essentially described by Reiter et al. (1999), *Plant J.* 12: 335-345. This method analyzes the neutral sugar composition of cell wall polymers found in *Arabidopsis* leaves. Soluble sugars were separated from sugar polymers by extracting leaves with hot 70% ethanol. The remaining residue containing the insoluble polysaccharides was then acid hydrolyzed with allose added as an internal standard. Sugar monomers generated by the hydrolysis were then reduced to the corresponding alditols by treatment with $NaBH_4$, then were acetylated to generate the volatile alditol acetates which were then analyzed by GC-FID. Identity of the peaks was determined by comparing the retention times of known sugars converted to the corresponding alditol acetates with the retention times of peaks from wild-type plant extracts. Alditol acetates were analyzed on a Supelco SP-2330 capillary column (30 m×250 µm×0.2 µm) using a temperature program beginning at 180° C. for 2 minutes followed by an increase to 220° C. in 4 minutes. After holding at 220° C. for 10 minutes, the oven temperature is increased to 240° C. in 2 minutes and held at this temperature for 10 minutes and brought back to room temperature.

To identify plants with alterations in total seed oil or protein content, 150 mg of seeds from T2 progeny plants were subjected to analysis by Near Infrared Reflectance Spectroscopy (NIRS) using a Foss NirSystems Model 6500 with a spinning cup transport system. NIRS is a non-destructive analytical method used to determine seed oil and protein composition. Infrared is the region of the electromagnetic spectrum located after the visible region in the direction of longer wavelengths. 'Near infrared' owns its name for being the infrared region near to the visible region of the electromagnetic spectrum. For practical purposes, near infrared comprises wavelengths between 800 and 2500 nm. NIRS is applied to organic compounds rich in O—H bonds (such as moisture, carbohydrates, and fats), C—H bonds (such as organic compounds and petroleum derivatives), and N—H bonds (such as proteins and amino acids). The NIRS analytical instruments operate by statistically correlating NIRS signals at several wavelengths with the characteristic or property intended to be measured. All biological substances contain thousands of C—H, O—H, and N—H bonds. Therefore, the exposure to near infrared radiation of a biological sample, such as a seed, results in a complex spectrum which contains qualitative and quantitative information about the physical and chemical composition of that sample.

The numerical value of a specific analyte in the sample, such as protein content or oil content, is mediated by a calibration approach known as chemometrics. Chemometrics applies statistical methods such as multiple linear regression (MLR), partial least squares (PLS), and principle component analysis (PCA) to the spectral data and correlates them with a physical property or other factor, that property or factor is directly determined rather than the analyte concentration itself. The method first provides "wet chemistry" data of the samples required to develop the calibration.

Calibration of NIRS response was performed using data obtained by wet chemical analysis of a population of *Arabidopsis* ecotypes that were expected to represent diversity of oil and protein levels.

The exact oil composition of each ecotype used in the calibration experiment was performed using gravimetric analysis of oils extracted from seed samples (0.5 g or 1.0 g) by the accelerated solvent extraction method (ASE; Dionex Corp, Sunnyvale, Calif.). The extraction method was validated against certified canola samples (Community Bureau of Reference, Belgium). Seed samples from each ecotype (0.5 g or 1 g) were subjected to accelerated solvent extraction and the resulting extracted oil weights compared to the weight of oil recovered from canola seed that has been certified for oil content (Community Bureau of Reference). The oil calibration equation was based on 57 samples with a range of oil contents from 27.0% to 50.8%. To check the validity of the calibration curve, an additional set of samples was extracted by ASE and predicted using the oil calibration equation. This validation set counted 46 samples, ranging from 27.9% to 47.5% oil, and had a predicted standard error of performance of 0.63%. The wet chemical method for protein was elemental analysis (% N X 6.0) using the average of 3 representative samples of 5 mg each validated against certified ground corn (NIST). The instrumentation was an Elementar Vario-EL III elemental analyzer operated in CNS operating mode (Elementar Analysensysteme GmbH, Hanau, Germany).

The protein calibration equation was based on a library of 63 samples with a range of protein contents from 17.4% to 31.2%. An additional set of samples was analyzed for protein by elemental analysis (n=57) and scanned by NIRS in order to validate the protein prediction equation. The protein range of the validation set was from 16.8% to 31.2% and the standard error of prediction was 0.468%.

NIRS analysis of *Arabidopsis* seed was carried out on between 40-300 mg experimental sample. The oil and protein contents were predicted using the respective calibration equations.

Data obtained from NIRS analysis was analyzed statistically using a nearest-neighbor (N-N) analysis. The N-N analysis allows removal of within-block spatial variability in a fairly flexible fashion, which does not require prior knowledge of the pattern of variability in the chamber. Ideally, all hybrids are grown under identical experimental conditions within a block (rep). In reality, even in many block designs, significant within-block variability exists. Nearest-neighbor procedures are based on assumption that environmental effect of a plot is closely related to that of its neighbors. Nearest-neighbor methods use information from adjacent plots to adjust for within-block heterogeneity and so provide more precise estimates of treatment means and differences. If there is within-plot heterogeneity on a spatial scale that is larger than a single plot and smaller than the entire block, then yields from adjacent plots will be positively correlated. Information from neighboring plots can be used to reduce or remove the unwanted effect of the spatial heterogeneity, and hence improve the estimate of the treatment effect. Data from neighboring plots can also be used to reduce the influence of competition between adjacent plots. The Papadakis N-N analysis can be used with designs to remove within-block variability that would not be removed with the standard split plot analysis (Papadakis (1973) Inst. d'Amelior. Plantes Thessaloniki (Greece) Bull. *Scientif.* No. 23; Papadakis (1984) *Proc. Acad. Athens* 59: 326-342.

Experiments were performed to identify those transformants or knockouts that exhibited modified sugar-sensing. For such studies, seeds from transformants were germinated on media containing 5% glucose or 9.4% sucrose which normally partially restrict hypocotyl elongation. Plants with altered sugar sensing may have either longer or shorter hypocotyls than normal plants when grown on this media. Additionally, other plant traits may be varied such as root mass.

Experiments may be performed to identify those transformants or knockouts that exhibited an improved pathogen tolerance. For such studies, the transformants are exposed to biotropic fungal pathogens, such as *Erysiphe orontii*, and necrotropic fungal pathogens, such as *Fusarium oxysporum*. *Fusarium oxysporum* isolates cause vascular wilts and damping off of various annual vegetables, perennials and weeds (Mauch-Mani and Slusarenko (1994) *Molec Plant-Microbe Interact.* 7: 378-383). For *Fusarium oxysporum* experiments, plants are grown on Petri dishes and sprayed with a fresh spore suspension of *F. oxysporum*. The spore suspension is prepared as follows: A plug of fungal hyphae from a plate culture is placed on a fresh potato dextrose agar plate and allowed to spread for one week. Five ml sterile water is then added to the plate, swirled, and pipetted into 50 ml Armstrong *Fusarium* medium. Spores are grown overnight in *Fusarium* medium and then sprayed onto plants using a Preval paint sprayer. Plant tissue is harvested and frozen in liquid nitrogen 48 hours post-infection.

*Erysiphe orontii* is a causal agent of powdery mildew. For *Erysiphe orontii* experiments, plants are grown approximately 4 weeks in a greenhouse under 12 hour light (20° C., ~30% relative humidity (rh)). Individual leaves are infected with *E. orontii* spores from infected plants using a camel's hair brush, and the plants are transferred to a Percival growth chamber (20° C., 80% rh.). Plant tissue is harvested and frozen in liquid nitrogen 7 days post-infection.

*Botrytis cinerea* is a necrotrophic pathogen. *Botrytis cinerea* is grown on potato dextrose agar under 12 hour light (20° C., ~30% relative humidity (rh)). A spore culture is made by spreading 10 ml of sterile water on the fungus plate, swirling and transferring spores to 10 ml of sterile water. The spore inoculum (approx. 105 spores/ml) is then used to spray 10 day-old seedlings grown under sterile conditions on MS (minus sucrose) media. Symptoms are evaluated every day up to approximately 1 week.

*Sclerotinia sclerotiorum* hyphal cultures are grown in potato dextrose broth. One gram of hyphae is ground, filtered, spun down and resuspended in sterile water. A 1:10 dilution is used to spray 10 day-old seedlings grown aseptically under a 12 hour light/dark regime on MS (minus sucrose) media. Symptoms are evaluated every day up to approximately 1 week.

*Pseudomonas syringae* pv maculicola (Psm) strain 4326 and pv maculicola strain 4326 was inoculated by hand at two doses. Two inoculation doses allows the differentiation between plants with enhanced susceptibility and plants with enhanced resistance to the pathogen. Plants are grown for 3 weeks in the greenhouse, then transferred to the growth chamber for the remainder of their growth. Psm ES4326 may be hand inoculated with 1 ml syringe on 3 fully-expanded leaves per plant (4½ wk old), using at least 9 plants per overexpressing line at two inoculation doses, OD=0.005 and OD=0.0005. Disease scoring is performed at day 3 post-inoculation with pictures of the plants and leaves taken in parallel.

In some instances, expression patterns of the pathogen-induced genes (such as defense genes) may be monitored by microarray experiments. In these experiments, cDNAs are generated by PCR and resuspended at a final concentration of ~100 ng/μl in 3×SSC or 150 mM Na-phosphate (Eisen and Brown (1999) *Methods Enzymol.* 303: 179-205). The cDNAs are spotted on microscope glass slides coated with polylysine. The prepared cDNAs are aliquoted into 384 well plates and spotted on the slides using, for example, an x-y-z gantry (OmniGrid) which may be purchased from GeneMachines (Menlo Park, Calif.) outfitted with quill type pins which may be purchased from Telechem International (Sunnyvale, Calif.). After spotting, the arrays are cured for a minimum of one week at room temperature, rehydrated and blocked following the protocol recommended by Eisen and Brown (1999; supra).

Sample total RNA (10 μg) samples are labeled using fluorescent Cy3 and Cy5 dyes. Labeled samples are resuspended in 4×SSC/0.03% SDS/4 μg salmon sperm DNA/2 μg tRNA/50 mM Na-pyrophosphate, heated for 95° C. for 2.5 minutes, spun down and placed on the array. The array is then covered with a glass coverslip and placed in a sealed chamber. The chamber is then kept in a water bath at 62° C. overnight. The arrays are washed as described in Eisen and Brown (1999, supra) and scanned on a General Scanning 3000 laser scanner. The resulting files are subsequently quantified using IMA-GENE, software (BioDiscovery, Los Angeles Calif.).

RT-PCR experiments may be performed to identify those genes induced after exposure to biotropic fungal pathogens, such as *Erysiphe orontii*, necrotropic fungal pathogens, such as *Fusarium oxysporum*, bacteria, viruses and salicylic acid, the latter being involved in a nonspecific resistance response in *Arabidopsis thaliana*. Generally, the gene expression patterns from ground plant leaf tissue is examined.

Reverse transcriptase PCR was conducted using gene specific primers within the coding region for each sequence identified. The primers were designed near the 3' region of each DNA binding sequence initially identified.

Total RNA from these ground leaf tissues was isolated using the CTAB extraction protocol. Once extracted total RNA was normalized in concentration across all the tissue types to ensure that the PCR reaction for each tissue received the same amount of cDNA template using the 28S band as reference. Poly(A+) RNA was purified using a modified protocol from the Qiagen OLIGOTEX purification kit batch protocol. cDNA was synthesized using standard protocols. After the first strand cDNA synthesis, primers for Actin 2 were used to normalize the concentration of cDNA across the tissue types. Actin 2 is found to be constitutively expressed in fairly equal levels across the tissue types being investigated.

For RT PCR, cDNA template was mixed with corresponding primers and Taq DNA polymerase. Each reaction consisted of 0.2 μl cDNA template, 2 μl 10× Tricine buffer, 2 μl 10× Tricine buffer and 16.8 μl water, 0.05 μl Primer 1, 0.05 Primer 2, 0.3 μl Taq DNA polymerase and 8.6 μl water.

The 96 well plate is covered with microfilm and set in the thermocycler to start the reaction cycle. By way of illustration, the reaction cycle may comprise the following steps:
STEP 1: 93° C. FOR 3 MIN;
Step 2: 93° C. for 30 sec;
Step 3: 65° C. for 1 min;
Step 4: 72° C. for 2 min;
Steps 2, 3 and 4 are repeated for 28 cycles;
Step 5: 72° C. for 5 min; and
Step 6 4° C.

To amplify more products, for example, to identify genes that have very low expression, additional steps may be performed: The following method illustrates a method that may be used in this regard. The PCR plate is placed back in the thermocycler for 8 more cycles of steps 2-4.
Step 2 93° C. for 30 sec;
Step 3 65° C. for 1 min;
Step 4 72° C. for 2 min, repeated for 8 cycles; and
Step 5 4° C.

Eight microliters of PCR product and 1.5 μl of loading dye are loaded on a 1.2% agarose gel for analysis after 28 cycles and 36 cycles. Expression levels of specific transcripts are considered low if they were only detectable after 36 cycles of PCR. Expression levels are considered medium or high depending on the levels of transcript compared with observed transcript levels for an internal control such as acting. Transcript levels are determined in repeat experiments and compared to transcript levels in control (e.g., non-transformed) plants.

Example VIII

Identification of Homologous Sequences

This example describes identification of genes that are orthologous to *Arabidopsis thaliana* transcription factors from a computer homology search.

Homologous sequences, including those of paralogs and orthologs from *Arabidopsis* and other plant species, were identified using database sequence search tools, such as the Basic Local Alignment Search Tool (BLAST) (Altschul et al. (1990) *J. Mol. Biol.* 215: 403-410; and Altschul et al. (1997) *Nucleic Acid Res.* 25: 3389-3402). The tblastx sequence analysis programs were employed using the BLOSUM-62 scoring matrix (Henikoff and Henikoff (1992) *Proc. Natl. Acad. Sci.* 89: 10915-10919). The entire NCBI GenBank database was filtered for sequences from all plants except *Arabidopsis thaliana* by selecting all entries in the NCBI GenBank database associated with NCBI taxonomic ID 33090 (Viridiplantae; all plants) and excluding entries associated with taxonomic ID 3701 (*Arabidopsis thaliana*).

These sequences are compared to sequences representing genes of SEQ ID NO: 2N-1, wherein N=1-229, using the Washington University TBLASTX algorithm (version 2.0a19MP) at the default settings using gapped alignments with the filter "off". For each gene of SEQ ID NO: 2N-1, wherein N=1-229, individual comparisons were ordered by probability score (P-value), where the score reflects the probability that a particular alignment occurred by chance. For example, a score of 3.6e-40 is 3.6×10-40. In addition to P-values, comparisons were also scored by percentage identity. Percentage identity reflects the degree to which two segments of DNA or protein are identical over a particular length. Examples of sequences so identified are presented in Table 10 and Table 12. Paralogous or orthologous sequences were readily identified and available in GenBank by Accession number (Table 10; Test sequence ID). The percent sequence identity among these sequences can be as low as 47%, or even lower sequence identity.

Candidate paralogous sequences were identified among *Arabidopsis* transcription factors through alignment, identity, and phylogenic relationships. A list of paralogs is shown in Table 12. Candidate orthologous sequences were identified from proprietary unigene sets of plant gene sequences in *Zea mays, Glycine max* and *Oryza sativa* based on significant homology to *Arabidopsis* transcription factors. These candidates were reciprocally compared to the set of *Arabidopsis* transcription factors. If the candidate showed maximal similarity in the protein domain to the eliciting transcription factor or to a paralog of the eliciting transcription factor, then it was considered to be an ortholog. Identified non-*Arabidopsis* sequences that were shown in this manner to be orthologous to the *Arabidopsis* sequences are provided in Table 10.

Example IX

Identification of Orthologous and Paralogous Sequences

Orthologs to *Arabidopsis* genes may identified by several methods, including experimental methods such as hybridization and/or amplification. This example describes how one may identify equivalogs to the *Arabidopsis* AP2 family transcription factor CBF1 (polynucleotide SEQ ID NO: 1955, encoded polypeptide SEQ ID NO: 1956), which confers tolerance to abiotic stresses (Thomashow et al. (2002) U.S. Pat. No. 6,417,428), and an example to confirm the function of homologous sequences. In this example, orthologs to CBF1 were found in canola (*Brassica napus*) using polymerase chain reaction (PCR).

Degenerate primers were designed for regions of AP2 binding domain and outside of the AP2 (carboxyl terminal domain):

```
       Mol 368 (reverse)
                                      (SEQ ID NO: 2205)
       5'- CAY CCN ATH TAY MGN GGN GT -3'

Mol 378 (forward)
                                      (SEQ ID NO: 2206)
       5'- GGN ARN ARC ATN CCY TCN GCC -3'
(Y: C/T, N: A/C/G/T, H: A/C/T, M: A/C, R: A/G)
```

Primer Mol 368 is in the AP2 binding domain of CBF1 (amino acid sequence: His-Pro-Ile-Tyr-Arg-Gly-Val) while primer Mol 378 is outside the AP2 domain (carboxyl terminal domain) (amino acid sequence: Met-Ala-Glu-Gly-Met-Leu-Leu-Pro).

The genomic DNA isolated from *B. napus* was PCR-amplified by using these primers following these conditions: an initial denaturation step of 2 min at 93° C.; 35 cycles of 93° C. for 1 min, 55° C. for 1 min, and 72° C. for 1 min; and a final incubation of 7 min at 72° C. at the end of cycling.

The PCR products were separated by electrophoresis on a 1.2% agarose gel and transferred to nylon membrane and hybridized with the AT CBF1 probe prepared from *Arabidopsis* genomic DNA by PCR amplification. The hybridized products were visualized by colorimetric detection system (Boehringer Mannheim) and the corresponding bands from a similar agarose gel were isolated using the Qiagen Extraction Kit (Qiagen). The DNA fragments were ligated into the TA clone vector from TOPO TA Cloning Kit (Invitrogen) and transformed into *E. coli* strain TOP10 (Invitrogen).

Seven colonies were picked and the inserts were sequenced on an ABI 377 machine from both strands of sense and antisense after plasmid DNA isolation. The DNA sequence was edited by sequencer and aligned with the AtCBF1 by GCG software and NCBI blast searching.

The nucleic acid sequence and amino acid sequence of one canola ortholog found in this manner (bnCBF1; polynucleotide SEQ ID NO: 2203 and polypeptide SEQ ID NO: 2204) identified by this process is shown in the Sequence Listing.

The aligned amino acid sequences show that the bnCBF1 gene has 88% identity with the *Arabidopsis* sequence in the AP2 domain region and 85% identity with the *Arabidopsis* sequence outside the AP2 domain when aligned for two insertion sequences that are outside the AP2 domain.

Similarly, paralogous sequences to *Arabidopsis* genes, such as CBF1, may also be identified.

Two paralogs of CBF1 from *Arabidopsis thaliana*: CBF2 and CBF3. CBF2 and CBF3 have been cloned and sequenced as described below. The sequences of the DNA SEQ ID NO: 1957 and 1959 and encoded proteins SEQ ID NO: 1958 and 1960 are set forth in the Sequence Listing.

A lambda cDNA library prepared from RNA isolated from *Arabidopsis thaliana* ecotype Columbia (Lin and Thomashow (1992) *Plant Physiol.* 99: 519-525) was screened for recombinant clones that carried inserts related to the CBF1 gene (Stockinger et al. (1997) *Proc. Natl. Acad. Sci.* 94:1035-1040). CBF1 was $^{32}$P-radiolabeled by random priming (Sambrook et al. (1998) supra) and used to screen the library by the plaque-lift technique using standard stringent hybridization and wash conditions (Hajela et al. (1990) *Plant Physiol.* 93:1246-1252; Sambrook et al. (1998) supra) 6×SSPE buffer, 60° C. for hybridization and 0.1×SSPE buffer and 60° C. for washes). Twelve positively hybridizing clones were obtained and the DNA sequences of the cDNA inserts were determined. The results indicated that the clones fell into three classes. One class carried inserts corresponding to CBF1. The two other classes carried sequences corresponding to two different homologs of CBF1, designated CBF2 and CBF3. The nucleic acid sequences and predicted protein coding sequences for *Arabidopsis* CBF1, CBF2 and CBF3 are listed in the Sequence Listing (SEQ ID NOs: 1955, 1957, 1959 and SEQ ID NOs: 1956, 1958, 1960, respectively). The nucleic acid sequences and predicted protein coding sequence for *Brassica napus* CBF ortholog is listed in the Sequence Listing (SEQ ID NOs: 2203 and 2204, respectively).

A comparison of the nucleic acid sequences of *Arabidopsis* CBF1, CBF2 and CBF3 indicate that they are 83 to 85% identical as shown in Table 14.

TABLE 14

| | Percent identity[a] | |
|---|---|---|
| | DNA[b] | Polypeptide |
| cbf1/cbf2 | 85 | 86 |
| cbf1/cbf3 | 83 | 84 |
| cbf2/cbf3 | 84 | 85 |

[a]Percent identity was determined using the Clustal algorithm from the Megalign program (DNASTAR, Inc.).
[b]Comparisons of the nucleic acid sequences of the open reading frames are shown.

Similarly, the amino acid sequences of the three CBF polypeptides range from 84 to 86% identity. An alignment of the three amino acidic sequences reveals that most of the differences in amino acid sequence occur in the acidic C-terminal half of the polypeptide. This region of CBF1 serves as an activation domain in both yeast and *Arabidopsis* (not shown).

Residues 47 to 106 of CBF1 correspond to the AP2 domain of the protein, a DNA binding motif that to date, has only been found in plant proteins. A comparison of the AP2 domains of CBF1, CBF2 and CBF3 indicates that there are a few differences in amino acid sequence. These differences in amino acid sequence might have an effect on DNA binding specificity.

Example X

Screen of Plant cDNA library for Sequence Encoding a Transcription Factor DNA Binding Domain that Binds to a Transcription Factor Binding Promoter Element and Demonstration of Protein Transcription Regulation Activity The "one-hybrid" strategy (Li and Herskowitz (1993) *Science* 262: 1870-1874) is used to screen for plant cDNA clones encoding a polypeptide comprising a transcription factor DNA binding domain, a conserved domain. In brief, yeast strains are constructed that contain a lacZ reporter gene with either wild-type or mutant transcription factor binding promoter element sequences in place of the normal UAS (upstream activator sequence) of the GAL1 promoter. Yeast reporter strains are constructed that carry transcription factor binding promoter element sequences as UAS elements are operably linked upstream (5') of a lacZ reporter gene with a minimal GAL1 promoter. The strains are transformed with a plant expression library that contains random cDNA inserts fused to the GAL4 activation domain (GAL4-ACT) and screened for blue colony formation on X-gal-treated filters (X-gal: 5-bromo-4-chloro-3-indolyl-β-D-galactoside; Invitrogen Corporation, Carlsbad Calif.). Alternatively, the strains are transformed with a cDNA polynucleotide encoding a known transcription factor DNA binding domain polypeptide sequence.

Yeast strains carrying these reporter constructs produce low levels of beta-galactosidase and form white colonies on filters containing X-gal. The reporter strains carrying wild-type transcription factor binding promoter element sequences are transformed with a polynucleotide that encodes a polypeptide comprising a plant transcription factor DNA binding domain operably linked to the acidic activator domain of the yeast GAL4 transcription factor, "GAL4-ACT". The clones that contain a polynucleotide encoding a transcription factor DNA binding domain operably linked to GAL4-ACT can bind upstream of the lacZ reporter genes carrying the wild-type transcription factor binding promoter element sequence, activate transcription of the lacZ gene and result in yeast forming blue colonies on X-gal-treated filters.

Upon screening about 2×10$^6$ yeast transformants, positive cDNA clones are isolated; i.e., clones that cause yeast strains carrying lacZ reporters operably linked to wild-type transcription factor binding promoter elements to form blue colonies on X-gal-treated filters. The cDNA clones do not cause a yeast strain carrying a mutant type transcription factor binding promoter elements fused to LacZ to turn blue. Thus, a polynucleotide encoding transcription factor DNA binding domain, a conserved domain, is shown to activate transcription of a gene.

Example XI

Gel Shift Assays

The presence of a transcription factor comprising a DNA binding domain which binds to a DNA transcription factor binding element is evaluated using the following gel shift assay. The transcription factor is recombinantly expressed and isolated from *E. coli* or isolated from plant material. Total soluble protein, including transcription factor, (40 ng) is incubated at room temperature in 10 μl of 1× binding buffer (15 mM HEPES (pH 7.9), 1 mM EDTA, 30 mM KCl, 5% glycerol, 5% bovine serum albumin, 1 mM DTT) plus 50 ng poly(dl-dC):poly(dl-dC)(Pharmacia, Piscataway N.J.) with or without 100 ng competitor DNA. After 10 minutes incubation, probe DNA comprising a DNA transcription factor binding element (1 ng) that has been $^{32}$P-labeled by end-filling (Sambrook et al. (1989) supra) is added and the mixture incubated for an additional 10 minutes. Samples are loaded onto polyacrylamide gels (4% w/v) and fractionated by electrophoresis at 150V for 2 h (Sambrook et al. (1998) supra). The degree of transcription factor-probe DNA binding is visualized using autoradiography. Probes and competitor DNAs are prepared from oligonucleotide inserts ligated into the BamHI site of pUC118 (Vieira et al. (1987) *Methods Enzymol.* 153: 3-11). Orientation and concatenation number of the inserts are determined by dideoxy DNA sequence analysis (Sambrook et al. (1998) supra). Inserts are recovered after restriction digestion with EcoRI and HindIII and fractionation on polyacrylamide gels (12% w/v) (Sambrook et al. (1998) supra).

Example XII

Introduction of Polynucleotides into Dicotyledonous Plants

Transcription factor sequences listed in the Sequence Listing recombined into pMEN20 or pMEN65 expression vectors are transformed into a plant for the purpose of modifying plant traits. The cloning vector may be introduced into a variety of cereal plants by means well known in the art such as, for example, direct DNA transfer or *Agrobacterium tumefaciens*-mediated transformation. It is now routine to produce transgenic plants using most dicot plants (see Weissbach and Weissbach, (1989) supra; Gelvin et al. (1990) supra; Herrera-Estrella et al. (1983) supra; Bevan (1984) supra; and Klee (1985) supra). Methods for analysis of traits are routine in the art and examples are disclosed above.

Example XIII

Examples of Genes that Confer Significant Improvements to Plants

Experiments were performed to identify those transformants or knockouts that exhibited a morphological difference relative to wild-type control plants, i.e., a modified structure and/or development characteristics. For such studies, the transformants were observed by eye to identify novel structural or developmental characteristics associated with the ectopic expression of the polynucleotides or polypeptides of the invention. Examples of genes and equivalogs that confer significant improvements to overexpressing plants are noted below. Experimental observations made with regard to specific genes whose expression has been modified in overexpressing plants, and potential applications based on these observations, are also presented.

Modified phenotypes observed for particular overexpressor or knockout plants are provided in Table 7. For a particular overexpressor that shows a less beneficial characteristic, it may be more useful to select a plant with a decreased expression of the particular transcription factor. For a particular knockout that shows a less beneficial characteristic, it may be more useful to select a plant with an increased expression of the particular transcription factor.

Table 7 provides exemplary polynucleotide and polypeptide sequences of the invention. The sequences of the Sequence Listing or those in Tables 7-11, or those disclosed here, can be used to prepare transgenic plants and plants with altered traits. The specific transgenic plants listed below are produced from the sequences of the Sequence Listing as noted. A number of genes and homologs that confer significant improvements to knockout or overexpressing plants were noted below. Experimental observations made with regard to specific genes whose expression was modified in overexpressing or knockout plants, and potential applications based on these observations, were also presented. As noted in the results of the plate-based physiology assays presented in the tables of this Example, a representative number of sequences from diverse plant species conferred various levels of increased stress tolerance in a range of abiotic stress assays, as noted below. Observed effects of overexpression on flowering time are also noted in the text below. These comparable effects indicate that sequences found within specific clades or subclades are functionally related and can be used to confer various types of abiotic stress tolerance in plants. A number of these genes concurrently confer tolerance to multiple abiotic stresses.

Salt stress assays are intended to find genes that confer better germination, seedling vigor or growth in high salt. Evaporation from the soil surface causes upward water movement and salt accumulation in the upper soil layer where the seeds are placed. Thus, germination normally takes place at a salt concentration much higher than the mean salt concentration of in the whole soil profile. Plants differ in their tolerance to NaCl depending on their stage of development, therefore seed germination, seedling vigor, and plant growth responses are evaluated.

Hyperosmotic stress assays (including NaCl and mannitol assays) are intended to determine if an osmotic stress phenotype is NaCl-specific or if it is a general osmotic stress related phenotype. Plants tolerant to hyperosmotic stress could also have more tolerance to drought and/or freezing.

Drought assays are intended to find genes that mediate better plant survival after short-term, severe water deprivation. Ion leakage will be measured if needed. Hyperosmotic stress tolerance would also support a drought tolerant phenotype.

Temperature stress assays are intended to find genes that confer better germination, seedling vigor or plant growth under temperature stress (cold, freezing and heat).

Sugar sensing assays are intended to find genes involved in sugar sensing by germinating seeds on high concentrations of sucrose and glucose and looking for degrees of hypocotyl elongation. The germination assay on mannitol controls for responses related to hyperosmotic stress. Sugars are key regulatory molecules that affect diverse processes in higher plants including germination, growth, flowering, senescence, sugar metabolism and photosynthesis. Sucrose is the major transport form of photosynthate and its flux through cells has been shown to affect gene expression and alter storage compound accumulation in seeds (source-sink relationships). Glucose-specific hexose-sensing has also been described in plants and is implicated in cell division and repression of "famine" genes (photosynthetic or glyoxylate cycles).

Germination assays followed modifications of the same basic protocol. Sterile seeds were sown on the conditional media listed below. Plates were incubated at 22° C. under 24-hour light (120-130 µEin/m$^2$/s) in a growth chamber. Evaluation of germination and seedling vigor was conducted 3 to 15 days after planting. The basal media was 80% Murashige-Skoog medium (MS)+vitamins.

For salt and hyperosmotic stress germination experiments, the medium was supplemented with 150 mM NaCl or 300 mM mannitol. Growth regulator sensitivity assays were performed in MS media, vitamins, and either 0.3 µM ABA, 9.4% sucrose, or 5% glucose.

Temperature stress cold germination experiments were carried out at 8° C. Heat stress germination experiments were conducted at 32° C. to 37° C. for 6 hours of exposure.

For stress experiments conducted with more mature plants, seeds were germinated and grown for seven days on MS+vitamins+1% sucrose at 22° C. and then transferred to chilling and heat stress conditions. The plants were either exposed to chilling stress (6 hour exposure to 4-8° C.), or heat stress (32° C. was applied for five days, after which the plants were transferred back 22° C. for recovery and evaluated after 5 days relative to controls not exposed to the depressed or elevated temperature).

Soil-based drought screens were performed with *Arabidopsis* plants overexpressing the transcription factors listed in the Sequence Listing, where noted below. Seeds from wild-type *Arabidopsis* plants, or plants overexpressing a polypeptide of the invention, were stratified for three days at 4° C. in 0.1% agarose. Fourteen seeds of each overexpressor or wild-type were then sown in three inch clay pots containing a 50:50 mix of vermiculite:perlite topped with a small layer of Metro-Mix 200 and grown for fifteen days under 24 hr light. Pots containing wild-type and overexpressing seedlings were placed in flats in random order. Drought stress was initiated by placing pots on absorbent paper for seven to eight days. The seedlings were considered to be sufficiently stressed when the majority of the pots containing wild-type seedlings within a flat had become severely wilted. Pots were then re-watered and survival was scored four to seven days later. Plants were ranked against wild-type controls for each of two criteria: tolerance to the drought conditions and recovery (survival) following rewatering At the end of the initial drought period, each pot was assigned a numeric value score depending on the above criteria. A low value was assigned to plants with an extremely poor appearance (i.e., the plants were uniformly brown) and a high value given to plants that were rated very healthy in appearance (i.e., the plants were all green). After the plants were rewatered and incubated an additional four to seven days, the plants were reevaluated to indicate the degree of recovery from the water deprivation treatment.

An analysis was then conducted to determine which plants best survived water deprivation, identifying the transgenes that consistently conferred drought-tolerant phenotypes and their ability to recover from this treatment. The analysis was performed by comparing overall and within-flat tabulations with a set of statistical models to account for variations between batches. Several measures of survival were tabulated, including: (a) the average proportion of plants surviving relative to wild-type survival within the same flat; (b) the median proportion surviving relative to wild-type survival within the same flat; (c) the overall average survival (taken over all batches, flats, and pots); (d) the overall average survival relative to the overall wild-type survival; and (e) the average visual score of plant health before rewatering.

Flowering time was measured by the number of rosette leaves present when a visible inflorescence of approximately 3 cm is apparent. Rosette and total leaf number on the progeny stem are tightly correlated with the timing of flowering (Koornneef et al. (1991) *Mol. Gen. Genet.* 229: 57-66). The vernalization response was also measured. For vernalization treatments, seeds were sown to MS agar plates, sealed with micropore tape, and placed in a 4° C. cold room with low light levels for 6-8 weeks. The plates were then transferred to the growth rooms alongside plates containing freshly sown non-vernalized controls. Rosette leaves were counted when a visible inflorescence of approximately 3 cm was apparent.

Results:

Empty cells found in the tables in this Example indicate that results have not yet been obtained for that particular stress experiment. The following improved traits or survival were determined relative to control plants, which were generally wild-type, non-transformed plants, or may be plants transformed with an "empty" vector that does not encode the protein of interest. Abbreviations used in the tables in this example include:

- (++) Substantially enhanced performance compared to controls. The phenotype was very consistent and growth was much greater than the normal levels of variability observed for that assay.
- (+) Enhanced performance compared to controls. The response was consistently above the normal levels of variability observed for that assay.
- (wt) response similar to wild-type; and
- (germ.) germination.

G9 (SEQ ID NO: 1949 and 1950)

G9 is a putative paralog of G867, and has been referenced in the public literature as RAP2.8 and RAV2 (Okamuro et al. (1997) *Proc. Natl. Acad. Sci. USA* 94: 7076-7081; Kagaya et al. (1999) *Nucleic Acids Res.* 27: 470-478). No genetic analysis of the locus has yet been published. G9 and closely-related clade member sequences each comprise a conserved AP2 domain that is expected to function in a similar manner in each of these related sequences, that is, by playing a central role in transcriptional regulation and in the conferring of shared traits.

Experimental Observations

We have previously observed that G9 overexpression enhanced root growth. The aim of the present study was to re-assess 35S::G9 lines and determine whether overexpression of the gene could confer enhanced stress tolerance in a comparable manner to G867. We also sought to test whether use of a two-component overexpression system would produce any strengthening of the phenotype relative to the use of a 35S direct promoter-fusion.

New overexpression lines have been obtained using both a direct promoter fusion construct and a two component expression system. Lines generated by either of these methods exhibited similar phenotypes and displayed a number of morphological effects that had not been observed during our earlier genomics screens. These included a reduction in overall size, alterations in leaf orientation (which potentially indicated a disruption in circadian control), slow growth, and floral abnormalities relative to controls.

We have tested the 35S::G9 two-component and direct-fusion lines under a variety of plate based treatments. All of the direct fusion lines and most of the two-component lines out-performed controls in a germination assay on sodium chloride plates. In addition, many of these lines also showed positive phenotypes, relative to control plants, when germinated on sucrose, and ABA, as well as in a growth assay under cold conditions.

It should be emphasized that we have obtained comparable developmental effects as well as a strong enhancement of drought related stress tolerance in 35S::G867 lines and in overexpression lines for the other two putative paralogs, G1930 and G993. The almost identical phenotypic effects observed for the four genes strongly suggest that they are functionally equivalent.

TABLE 15

| | | G9 35S, Direct promoter-fusion and 2-components-supTfn | | | | | | | | |
|---|---|---|---|---|---|---|---|---|---|---|
| Line | Transformation | Germ. in high NaCl | Germ. in high mannitol | Sucrose | ABA | Germ in heat | Germ in cold | Growth in heat | Drought | Chilling |
| 302 | Direct-fusion | + | wt | + | wt | wt | wt | wt | wt | + |
| 304 | Direct-fusion | + | wt | wt | wt | wt | wt | wt | wt | wt |
| 305 | Direct-fusion | ++ | wt | + | wt | wt | wt | wt | wt | + |
| 306 | Direct-fusion | + | wt | wt | wt | wt | wt | wt | wt | wt |
| 307 | Direct-fusion | + | wt | wt | wt | wt | wt | wt | wt | wt |
| 310 | Direct-fusion | + | wt | + | ++ | wt | wt | wt | wt | + |
| 311 | Direct-fusion | ++ | wt | + | wt | wt | wt | wt | wt | + |
| 312 | Direct-fusion | ++ | wt | wt | + | wt | wt | wt | wt | + |
| 313 | Direct-fusion | + | wt | + | + | wt | wt | wt | wt | + |
| 318 | Direct-fusion | ++ | wt | + | wt | wt | wt | wt | wt | wt |
| 483 | 2-comp | wt | wt | + | + | wt | wt | wt | wt | wt |
| 485 | 2-comp | + | wt | wt | wt | wt | wt | wt | wt | wt |
| 486 | 2-comp | wt | wt | wt | wt | wt | wt | wt | wt | wt |
| 488 | 2-comp | + | wt | + | ++ | wt | wt | wt | wt | wt |
| 489 | 2-comp | + | wt | wt | ++ | wt | wt | wt | wt | wt |
| 490 | 2-comp | wt | wt | + | ++ | wt | wt | wt | wt | wt |
| 491 | 2-comp | wt | wt | + | ++ | wt | + | wt | wt | wt |
| 493 | 2-comp | wt | wt | + | ++ | wt | wt | wt | wt | wt |

TABLE 15-continued

G9 35S, Direct promoter-fusion and 2-components-supTfn

| Line | Transformation | Germ. in high NaCl | Germ. in high mannitol | Sucrose | ABA | Germ in heat | Germ in cold | Growth in heat | Drought | Chilling |
|---|---|---|---|---|---|---|---|---|---|---|
| 494 | 2-comp | + | wt | wt | ++ | wt | wt | wt | wt | wt |
| 498 | 2-comp | + | wt | + | ++ | wt | wt | wt | wt | wt |

Potential Applications

Based on the results of these abiotic stress assays, G867 and related genes such as G9 are excellent candidate genes for improvement of drought and cold-related stress tolerance in commercial species. The morphological effects associated with their overexpression suggests that tissue-enhanced, tissue-specific or conditional promoters might be used to optimize the utility of these genes.

G19 (SEQ ID NO: 3 and 5)

G19 belongs to the EREBP subfamily of transcription factors and contains only one AP2 domain. G19 corresponds to the previously described gene RAP2.3 (Okamuro et al. (1997) Proc. Natl. Acad. Sci. 94:7076-7081). Close inspection of the Arabidopsis cDNA sequences of RAP2.3 (AF003096; Okamuro et al. (1997) supra), AtEBP (Y09942; Buttner et al. (1997) Proc. Natl. Acad. Sci. 94:5961-5966), and ATCAD-INP (Z37504) suggests that they may correspond to the same gene (Riechmann et al. (1998) Biol. Chem. 379:633-646). G19/RAP2.3 is ubiquitously expressed (Okamuro et al. (1997) supra). AtEBP was isolated by virtue of the protein-protein interaction between AtEBP and OBF4, a basic-region leucine zipper transcription factor (Buttner et al. (1997) supra). AtEBP expression levels in seedlings were increased after treatment with ethylene (ethephon) (Buttner et al. (1997) supra). AtEBP was found to bind to GCC-box containing sequences, like that of the PRB-1b promoter (Buttner et al. (1997) supra). It has been suggested that the interaction between AtEBP and OBF4 reflects cross-coupling between EREBP and bZIP transcription factors that might be important in regulating gene expression during the plant defense response (Buttner et al. (1997) supra). G19 and closely-related clade member sequences each comprise a conserved AP2 domain that is expected to function in a similar manner in each of these related sequences, that is, by playing a central role in transcriptional regulation and in the conferring of shared traits.

Experimental Observations

Transgenic plants in which G19 is expressed under the control of the 35S promoter were morphologically similar to control plants. G19 is constitutively expressed in the different tissues examined; however G19 expression was significantly repressed by methyl jasmonate (MeJ) and induced by ACC (this latter result correlates with the previously described increase in G19 expression levels in seedlings after treatment with ethylene (ethephon); Buttner et al. (1997) supra). G19 was significantly induced upon infection by the fungal pathogen Erysiphe orontii. In addition, G19 overexpressing plants were more tolerant to infection with a moderate dose of Erysiphe orontii. G19 overexpressing plants were also tested for their tolerance to two other pathogens, the necrotrophic fungal pathogen Fusarium oxysporum and the bacterial pathogen Pseudomonas syringae; the transgenic plants were not found to have altered susceptibility to the pathogens.

Both the jasmonic acid and the ethylene signal transduction pathways were involved in the regulation of the defense response and the wound response, and the two pathways have been found to interact synergistically. The regulation of G19 expression by both hormones, its induction upon Erysiphe orontii infection, as well as the preliminary data indicating that increased tolerance to that pathogen was conferred by G19 overexpression, suggest that G19 plays a role in the control of the defense and/or wound response. It would be of interest to test G19 overexpressing plants in insect-plant interaction experiments. The increase in tolerance to Erysiphe orontii that is conferred by G19 overexpression can be tested using other races of the pathogen. It would also be of interest to test other pathogens in addition to Erysiphe orontii, Fusarium oxysporum, and Pseudomonas syringae.

Since G19 was expressed at significant levels in a constitutive fashion, similar experiments to those described here can be performed with G19 knockout mutant plants to further elucidate the function of this gene.

Potential Applications

G19 or its equivalogs can be used to manipulate the plant defense-wound- or insect-response, as well as the jasmonic acid and ethylene signal transduction pathways themselves.

G22 (SEQ ID NO: 5 and 6)

G22 was identified in the sequence of BAC T13E15 (gene T13E15.5) by The Institute of Genomic Research (TIGR) as a "TINY transcription factor isolog". G22 belongs to the EREBP subfamily and contains only one AP2 domain, and phylogenetic analyses place G22 relatively close to other EREBP subfamily genes, such as, TINY and ATDL4400C (Riechmann et al. (1998) Biol. Chem. 379:633-646). G22 and closely-related clade member sequences each comprise a conserved AP2 domain that is expected to function in a similar manner in each of these related sequences, that is, by playing a central role in transcriptional regulation and in the conferring of shared traits.

Experimental Observations

G22 was constitutively expressed at medium levels. There appeared to be no phenotypic alteration on plant morphology upon G22 overexpression. Plants ectopically overexpressing G22 were more tolerant to high NaCl containing media in a root growth assay compared with wild-type controls.

Potential Applications

G22 or its equivalogs can be used to increase plant tolerance to soil salinity during germination, at the seedling stage, or throughout the plant life cycle. Salt tolerance is a particularly desirable phenotype during the germination stage of a crop plant, which would impact survivability and yield.

G28 (SEQ ID NO: 9 and 10)

G28 corresponds to AtERF1 (GenBank accession number AB008103) (Fujimoto et al. (2000) Plant Cell 12:393-404). G28 appears as gene AT4g17500 in the annotated sequence of Arabidopsis chromosome 4 (AL161546.2).

AtERF1 has been shown to have GCC-box binding activity [some defense-related genes that were induced by ethylene were found to contain a short cis-acting element known as the GCC-box: AGCCGCC (Ohme et al. (1990) Plant Mol. Biol. 15:941-946)]. Using transient assays in Arabidopsis leaves, AtERF1 was found to be able to act as a GCC-box sequence specific transactivator (Fujimoto et al. (2000) supra).

AtERF1 expression has been described to be induced by ethylene (two- to three-fold increase in AtERF1 transcript levels 12 h after ethylene treatment) (Fujimoto et al. (2000) supra). In the ein2 mutant, the expression of AtERF1 was not induced by ethylene, suggesting that the ethylene induction of AtERF1 is regulated under the ethylene signaling pathway (Fujimoto et al. (2000) supra). AtERF1 expression was also induced by wounding, but not by other abiotic stresses (such as cold, salinity, or drought) (Fujimoto et al. (2000) supra).

It has been suggested that AtERFs, in general, may act as transcription factors for stress-responsive genes, and that the GCC-box may act as a cis-regulatory element for biotic and abiotic stress signal transduction in addition to its role as an ethylene responsive element (ERE) (Fujimoto et al. (2000) supra), but there is no data available on the physiological functions of AtERF1.

G28 and closely-related clade member sequences each comprise a conserved AP2 domain that is expected to function in a similar manner in each of these related sequences, that is, by playing a central role in transcriptional regulation and in the conferring of shared traits.

Experimental Observations

The function of G28 was analyzed using transgenic plants in which this gene was expressed under the control of the 35S promoter. G28 overexpressing lines were more tolerant to infection with a moderate dose of the fungal pathogen *Erysiphe orontii*. G28 overexpression did not seem to have detrimental effects on plant growth or vigor, since plants from most of the lines were morphologically wild-type. In addition, no difference was detected between those lines and the corresponding wild-type controls in all the biochemical assays that were performed. G28 was ubiquitously expressed.

Relative to control plants, G28 overexpressing lines were also more tolerant to *Sclerotinia sclerotiorum* and *Botrytis cinerea*. In a repeat experiment using individual lines, all three lines analyzed showed tolerance to *S. sclerotiorum*, and two of the three lines tested were more tolerant to *B. cinerea*.

Potential Applications

G28 transgenic plants had an altered response to fungal pathogens, in that those plants were more tolerant to the pathogens. Therefore, G28 or its equivalogs can be used to manipulate the defense response in order to generate pathogen-resistant plants.

G47 (SEQ ID NO: 11 and 12)

G47 corresponds to gene T22J18.2 (AAC25505). G47 and closely-related clade member sequences each comprise a conserved AP2 domain that is expected to function in a similar manner in each of these related sequences, that is, by playing a central role in transcriptional regulation and in the conferring of shared traits.

Experimental Observations

G47 expression levels can be altered by environmental conditions, in particular reduced by salt and osmotic stresses.

The function of G47 was studied using transgenic plants in which the gene was expressed under the control of the 35S promoter. 35S::G47 plants showed enhanced tolerance to osmotic stress. In a root growth assay on PEG containing media, G47 overexpressing transgenic seedlings were larger and had more root growth compared with the wild-type controls. G47 overexpressors also were significantly more drought tolerant than wild-type control plants in a soil-based assay.

Overexpression of G47 also produced a substantial delay in flowering time and caused a marked change in shoot architecture. 35S::G47 transformants were small at early stages and switched to flowering more than a week later than wild-type controls (continuous light conditions). The inflorescences from these plants appeared thick and fleshy, had reduced apical dominance, and exhibited reduced internode elongation leading to a short compact stature. The branching pattern of the stems also appeared abnormal, with the primary shoot becoming "kinked" at each coflorescence node. Additionally, the plants showed reduced fertility and formed rather small siliques that were borne on short pedicels and held vertically, close against the stem.

Additional alterations were detected in the inflorescence stems of 35S::G47 plants. Stem sections from T2-21 and T2-24 plants were of wider diameter, and had large irregular vascular bundles containing a much greater number of xylem vessels than wild type. Furthermore, some of the xylem vessels within the bundles appeared narrow and were possibly more lignified than were those of controls.

G47 was expressed at higher levels in rosette leaves, and transcripts were detected in other tissues (flower, embryo, silique, and germinating seedling), but not in roots.

Potential Applications

G47 or its equivalogs can be used to manipulate flowering time, to modify plant architecture and stem structure (including development of vascular tissues and lignin content) and to improve plant performance under osmotic stress and drought conditions.

Transcription factor equivalogs that modulate lignin content can be valuable. This modulation can allow the quality of wood used for furniture or construction to be improved. Lignin is energy rich; increasing lignin composition is valuable in raising the energy content of wood used for fuel. Conversely, the pulp and paper industries seek wood with a reduced lignin content. Currently, lignin must be removed in a costly process that involves the use of many polluting chemicals. Consequently, lignin is a serious barrier to efficient pulp and paper production. In addition to forest biotechnology applications, changing lignin content can increase the palatability of various fruits and vegetables.

G226 (SEQ ID NO: 37 and 38)

G226 was identified from the *Arabidopsis* BAC sequence, AC002338, based on its sequence similarity within the conserved domain to other Myb family members in *Arabidopsis*. G226 and closely-related clade member sequences each comprise a conserved Myb-related domain that is expected to function in a similar manner in each of these related sequences, that is, by playing a central role in transcriptional regulation and in the conferring of shared traits.

Experimental Observations

The function of G226 was analyzed through its ectopic overexpression in plants. Relative to control plants, G226 overexpressors were more tolerant to low nitrogen and high salt stress. They showed more root growth and possibly more root hairs under conditions of nitrogen limitation compared with wild-type controls. Many plants were glabrous and lacked anthocyanin production when under stress such as growth conditions of low nitrogen and high salt. Several G226 overexpressors were glabrous and produce less anthocyanin under stress; these effects might be due to binding site competition with other Myb family transcription factors involved in these functions and not directly related to the primary function of this gene.

Results from the biochemical analysis of G226 overexpressors suggested that one line had higher amounts of seed protein, which could have been a result of increased nitrogen uptake by these plants.

A microarray experiment was done on a separate G226 overexpressing line. The G226 sequence itself was overexpressed 16-fold above wild type, however, very few changes in other gene expression were observed in this line. On the array, a chlorate/nitrate transporter DNA sequence was induced 2.7-fold over wild type, which could explain the low nitrogen tolerant phenotype of the plants and the increased amounts of seed protein in one of the lines. The same DNA sequence was present several times on the array and in all cases the DNA sequence showed induction, adding more validity to the data. Five other genes/DNA sequences induced but had unknown function. A methyltransferase, a pollen-specific protein, and a zinc binding peroxisomal membrane protein encoding sequences were also induced, however their role in regard to the phenotype of the plants is not known.

TABLE 16

G226 35S, 2-components supTfn

| Line | Germ. in high NaCl | Germ. in high mannitol | Sucrose | ABA | Germ in heat | Germ in cold | Growth in heat | Drought | Chilling | G682-like root morph. |
|---|---|---|---|---|---|---|---|---|---|---|
| 308 | wt | wt | ++ | + | wt | wt | wt | wt | wt | + |
| 309 | wt | wt | wt | + | wt | + | wt | wt | + | + |
| 313 | wt | wt | ++ | ++ | wt | + | wt | wt | + | + |
| 316 | wt | wt | ++ | ++ | wt | wt | wt | wt | wt | + |
| 318 | wt | wt | wt | ++ | wt | wt | wt | wt | wt | + |
| 381 | wt | wt | + | wt | wt | wt | wt | wt | wt | + |
| 383 | wt | wt | + | + | wt | wt | wt | wt | wt | + |
| 583 | wt | wt | wt | + | wt | wt |  | wt | wt | + |
| 585 | wt | wt | wt | + | wt | wt | wt | wt | wt | + |

Potential Applications

The results of these abiotic stress tolerance assays indicate that G682 and related genes such as G226 may be used to improve drought and cold-related stress tolerance in plants.

The utilities of a gene or its equivalogs conferring tolerance to conditions of low nitrogen include: (1) Cost savings to the farmer by reducing the amounts of fertilizer needed; (2) Environmental benefits of reduced fertilizer runoff; (3) Improved yield and stress tolerance. In addition, G226 can be used to increase seed protein amounts and/or composition, which may impact yield as well as the nutritional value and production of various food products.

G682 and related genes such as G226 can be used to alter trichome number and distribution in plants. Trichome glands on the surface of many higher plants produce and secrete exudates, which give protection from the elements and pests such as insects, microbes and herbivores. These exudates may physically immobilize insects and spores, may be insecticidal or antimicrobial or they may allergens or irritants to protect against herbivores. It has also been suggested that trichomes may decrease transpiration by decreasing leaf surface airflow, and by exuding chemicals that protect the leaf from the sun.

The reduction in size that was apparent in these lines suggests that the utility of G226 might be optimized by use of different promoters or protein modifications.

G353 (SEQ ID NO: 59 and 60)

G353 was identified in the sequence of P1 clone MMN10, GenBank accession number AB0154751, released by the *Arabidopsis* Genome Initiative. G353 corresponds to RHL41 (Kazuoka et al. (2000) *Plant J.* 24:191-203) and Zat12 (Meissner et al. (1997) *Plant Mol. Biol.* 33:615-624). Transgenic *Arabidopsis* plants over-expressing the RHL41 gene showed an increased tolerance to high-intensity light, and also morphological changes of thicker and dark green leaves. The palisade parenchyma was highly developed in the leaves of the transgenic plants. Anthocyanin content, as well as the chlorophyll content, also increased. Antisense transgenic plants exhibited decreased tolerance to high irradiation. RHL41 protein may play a key role in the acclimatization response to changes in light intensity.

G353 and closely-related clade member sequences each comprise a conserved C2H2 domain that is expected to function in a similar manner in each of these related sequences, that is, by playing a central role in transcriptional regulation and in the conferring of shared traits.

Experimental Observations

G353 was uniformly expressed in all tissues and under all conditions tested in RT-PCR experiments. The highest level of expression was observed in rosette leaves, embryos, and siliques.

The function of this gene was analyzed using transgenic plants in which G353 was expressed under the control of the 35S promoter. Overexpression of G353 in resulted in enhanced tolerance to osmotic stress and drought tolerance in a soil-based assay.

Overexpression also affected flower morphology to a significant degree. 35S::G353 plants had a reduction in flower pedicel length, and downward pointing siliques. This phenotype was very similar to that described for the brevipedicellus (bp) mutant (Koornneef et al. (1983) *J. Hered.* 74:265-272) and in overexpression of a related gene, G354. Other morphological changes in shoots were also observed in 35S::G353 plants. Leaves had short petioles, were rather flat, rounded, and sometimes showed changes in coloration. These effects were observed in varying degrees in the majority of transformants. Severely affected plants were tiny, had contorted leaves, poor fertility, and produced few seeds. Overexpression of G353 in *Arabidopsis* resulted in an increase in seed glucosinolate M39494 in two T2 lines.

Potential Applications

G353 or its equivalogs can be used to alter inflorescence structure, which may have value in production of novel ornamental plants.

G353 or its equivalogs can be used to alter a plant's response to water deficit conditions and, therefore, be used to engineer plants with enhanced tolerance to drought, salt stress, and freezing.

Increases or decreases in specific glucosinolates or total glucosinolate content may be desirable depending upon the particular application. For example: (1) Glucosinolates are undesirable components of the oilseeds used in animal feed, since they produce toxic effects. Low-glucosinolate varieties of canola have been developed to combat this problem; (2) Some glucosinolates have anti-cancer activity; thus, increasing the levels or composition of these compounds might be of interest from a nutraceutical standpoint; (3) Glucosinolates form part of a plants natural defense against insects; modification of glucosinolate composition or quantity could therefore afford increased protection from predators; furthermore, in edible crops, tissue specific promoters might be used to ensure that these compounds accumulate specifically in tissues, such as the epidermis, which are not taken for consumption.

G354 (SEQ ID NO: 61 and 62)

G354 was identified in the sequence of BAC clone F12M12, GenBank accession number AL355775, released by the *Arabidopsis* Genome Initiative. G354 corresponds to ZAT7 (Meissner et al. Plant Mol. Biol. 33:615-624).

G354 and closely-related clade member sequences each comprise a conserved C2H2 domain that is expected to function in a similar manner in each of these related sequences, that is, by playing a central role in transcriptional regulation and in the conferring of shared traits.

Experimental Observations

Greatest levels of expression of G354 were observed in rosette leaves, embryos, and siliques. Some expression of G354 was also observed in flowers.

The function of this gene was analyzed using transgenic plants in which G353 was overexpressed under the control of the 35S promoter. 35S::G354 plants had a reduction in flower pedicel length, and downward pointing siliques. This phenotype was very similar to that described for the brevipedicellus (bp) mutant (Koornneef et al. (1983) *J. Hered.* 74:265-272) and in overexpression of a related gene, G353. Other morphological changes in shoots were also observed in 35S::G354 plants. Many 35S::G354 seedlings had abnormal cotyledons, elongated, thickened hypocotyls, and short roots. The majority of T1 plants had a very extreme phenotype, were tiny, and arrested development without forming inflorescences. T1 plants showing more moderate effects had poor seed yield.

Overexpression of G354 in *Arabidopsis* resulted in seedlings with an altered response to light. In darkness, G354 seedlings failed to etiolate. The phenotype was most severe in seedlings from one line where overexpression of the transgene resulted in reduced open and greenish cotyledons.

Potential Applications

G354 or its equivalogs can be used to alter inflorescence structure, which may have value in production of novel ornamental plants.

G354 modifies the light response and thus G354 or its equivalogs may be useful for modifying plant growth or development, for example, photomorphogenesis in poor light, or accelerating flowering time in response to various light intensities, quality or duration to which a non-transformed plant would not similarly respond. Elimination of shading responses may lead to increased planting densities with subsequent yield enhancement.

G481 (SEQ ID NO: 87 and 88)

G481 is a member of the HAP3 subgroup of the CCAAT box-binding transcription factor family, and is equivalent to AtHAP3a which was identified by Edwards et al. ((1998) *Plant Physiol.* 117:1015-1022) as an EST with extensive sequence homology to the yeast HAP3. Northern blot data from five different tissue samples indicated that G481 was primarily expressed in flower and/or silique, and root tissue. G481 and closely-related clade member sequences each comprise a conserved CCAAT box-binding domain that is expected to function in a similar manner in each of these related sequences, that is, by playing a central role in transcriptional regulation and in the conferring of shared traits.

Experimental Observations

We have now generated additional sets of 35S lines for G481 using the two component system. Two batches of 2-component 35S lines were obtained (lines 301-320 and 741-751). The majority of plants from these T1 sets displayed no consistent difference in morphology to wild-type controls. However, a number of individuals were observed to be late flowering (#305, 310, 315, 744, 748) under the conditions of continuous light.

To confirm the above phenotype, a selection of T2 lines were examined under 24-hour light conditions; late flowering was also observed in that generation in a significant number of these plants, as detailed below:

T2-303: 6/6 plants were slightly late flowering (approximately 2-3 days after controls).

T2-307: 4/6 plants were slightly late flowering (approximately 2-3 days after controls), 2/6 appeared wild type.

T2-309: 4/6 plants were slightly late flowering (approximately 2-3 days after controls), 2/6 appeared wild type.

T2-310: 6/6 plants were moderately late flowering (1-2 weeks after controls).

T2-312: 6/6 plants were moderately late flowering (approximately 1 week after controls).

T2-741: 6/6 plants appeared wild-type.

T2-742: 6/6 plants appeared wild-type.

T2-744: 6/6 plants appeared wild-type.

In addition to analyzing these two component lines, we also re-examined some of the 35S::G481 lines that we had generated during our genomics screens. 35S::G481 line 3 was back-crossed to wild-type and F1 plants were examined. 18/18 of these F1 plants showed a moderate delay in the onset of flowering by about 1-2 weeks.

Of the ten two-component lines submitted for physiological assays, the following showed a segregation on selection plates in the T2 generation that was compatible with the transgene being present at a single locus: 304, 309, 312, 317, 741, 748. Lines 305, 315, 318, 742 showed segregations that were compatible with insertions at multiple loci.

In plate-based physiology assays, tolerance was seen to drought related stress: four of ten two-component lines tested were less sensitive relative to control plants in the ABA germination assay, and two of these lines also displayed cold tolerance than control plants in a germination assay.

G481 overexpressing plants were found to be more tolerant, relative to control plants, to drought in a soil-based assay.

TABLE 17

| | G481 35S, 2-components-supertransformation (supTfn) | | | | | | | | |
|---|---|---|---|---|---|---|---|---|---|
| Line | Germ. in high NaCl | Germ. in high mannitol | Sucrose | ABA | Germ. in heat | Germ. in cold | Growth in heat | Drought | Chilling |
| 304 | wt | wt | wt | + | wt | wt | wt | wt | wt |
| 305 | wt | wt | wt | wt | wt | wt | wt | wt | wt |
| 309 | wt | wt | wt | wt | wt | wt | wt | wt | wt |
| 312 | wt | wt | wt | + | wt | wt | wt | wt | wt |
| 315 | wt | wt | wt | + | wt | + | wt | wt | wt |
| 317 | wt | wt | wt | wt | wt | wt | wt | wt | wt |

TABLE 17-continued

| | | | G481 35S, 2-components-supertransformation (supTfn) | | | | | | |
|---|---|---|---|---|---|---|---|---|---|
| Line | Germ. in high NaCl | Germ. in high mannitol | Sucrose | ABA | Germ. in heat | Germ. in cold | Growth in heat | Drought | Chilling |
| 318 | wt | wt | wt | + | wt | + | wt | wt | wt |
| 741 | wt | wt | wt | wt | wt | wt | wt | wt | wt |
| 744 | wt | wt | wt | wt | wt | wt | wt | wt | wt |
| 748 | wt | wt | wt | wt | wt | wt | wt | wt | wt |

Potential Applications

The results of these latest overexpression studies confirm our earlier conclusion that G481 and its equivalogs are excellent candidates for improvement of drought related stress tolerance in commercial species. Additionally, G481 related genes could also be used to manipulate flowering time.

G482 (SEQ ID NO: 89 and 90)

G482 is a member of the HAP3 subgroup of the CCAAT box-binding transcription factor family, and is equivalent to AtHAP3b which was identified by Edwards et al. ((1998) *Plant Physiol.* 117:1015-1022) as an EST with homology to the yeast gene HAP3b. Edwards' northern blot data suggests that AtHAP3b is expressed primarily in roots. G482 and closely-related clade member sequences each comprise a conserved CCAAT box-binding domain that is expected to function in a similar manner in each of these related sequences, that is, by playing a central role in transcriptional regulation and in the conferring of shared traits.

Experimental Observations

RT-PCR analysis of endogenous levels of G482 transcripts indicated that this gene was expressed constitutively in all tissues tested. A cDNA array experiment supported the RT-PCR derived tissue distribution data. G482 was not induced above basal levels in response to any environmental stress treatments tested.

We have now generated 35S lines for G482 using the two component system; two batches of T1 lines (321-341 and 341-360) were examined and many of the plants showed a striking acceleration of flowering (1-2 weeks sooner than wild-type) under 24 hour light conditions.

The early flowering effect was seen in 10/20 lines from the 321-341 set (#323, 325, 326, 327, 329, 330, 332, 333, 335, 336) and 7/20 lines from the 341-360 set (#341, 351, 355, 356, 357, 358, 360). Comparable effects on flowering time were also seen in each of three T2 populations (329, 330, 333) that were morphologically examined. In addition to the accelerated flowering, the majority of 35S::G482 lines also displayed a slight reduction in overall size; in fact a number of lines were very small (#321, 328, 331, 338, 339, 340 and #342, 344, 345, 349, 350) and did not survive to maturity.

All of the two-component lines showed segregation on selection plates in the T2 generation that was compatible with the transgene being present at a single locus.

G482 function was analyzed through its ectopic overexpression in plants under the control of a 35S promoter using the two component system.

In plate-based physiology assays, half of the two-component lines tested showed increased vigor on mannitol media and three lines performed better than wild-type in the heat germination assay.

It should be emphasized that we have observed stress-related tolerance phenotypes for several other G481 related genes including G485 and G1820. The similar effects seen when these genes are overexpressed strongly suggest a functional relationship between them.

TABLE 18

| | | | G482 35S, 2-components-supTfn | | | | | | |
|---|---|---|---|---|---|---|---|---|---|
| Line | Germ. in high NaCl | Germ. in high mannitol | Sucrose | ABA | Germ. in heat | Germ. in cold | Growth in heat | Drought | Chilling |
| 324 | wt | wt | wt | wt | wt | wt | wt | wt | wt |
| 327 | wt | wt | wt | wt | wt | wt | wt | wt | wt |
| 330 | wt | wt | wt | wt | wt | wt | wt | wt | wt |
| 333 | wt | wt | wt | wt | wt | wt | wt | wt | wt |
| 343 | wt | wt | wt | wt | wt | wt | wt | wt | wt |
| 346 | wt | + | wt | wt | wt | wt | + | wt | wt |
| 347 | wt | + | wt | wt | wt | wt | wt | wt | wt |
| 351 | wt | + | wt | wt | wt | wt | + | wt | wt |
| 353 | wt | + | wt | wt | wt | wt | wt | wt | wt |
| 354 | wt | + | wt | wt | wt | wt | + | wt | wt |

Potential Applications

The results of this study bolster our conclusion that G481 and the related genes, including G482, are excellent candidates for improvement of drought related stress tolerance in commercial species.

Additionally, G482 could be useful for manipulating flowering time.

*Arabidopsis* G485 (SEQ ID NO: 2009 and 2010)

G485 is paralog of G481, and is a member of the HAP3 subgroup of the CCAAT box-binding transcription factor family. It has been referenced as sequence 1042 from Patent Application WO0216655 on stress-regulated genes, transgenic plants and methods of use. G485 was reported therein to be cold responsive in a microarray analysis (Harper et al. (2002) Patent Application WO 0216655-A 1042 28 Feb. 2002). No other functional information regarding G485 is publicly available.

During our earlier genomics program, we determined that plants overexpressing G485 had accelerated flowering, bolting up to 1 week earlier than wild-type or non-transformed plants grown under 24 hr lights. These studies, combined with related studies on plants lacking G485 expression have implicated G485 as both sufficient to act as a floral activator, and also necessary in that role within the plant.

G485 and closely-related clade member sequences each comprise a conserved CCAAT box-binding domain that is expected to function in a similar manner in each of these related sequences, that is, by playing a central role in transcriptional regulation and in the conferring of shared traits.

Experimental Observations

The aim of this study was to re-assess the effects of overexpression of G485 using a two-component system and determine if this gene can confer enhanced stress tolerance in a manner comparable to G481.

We have now generated 35S lines for G485 using the two component system. These plants showed a comparable early flowering phenotype to that observed for 35S direct promoter fusion lines in our earlier genomics program.

Many of the 35S::G485 two-component lines exhibited a marked acceleration in the onset of flowering and generally formed flower buds 1-2 weeks sooner than wild type under continuous light conditions. Many of the lines also showed a reduction in rosette biomass compared to wild type. In fact, three of twenty lines (308, 312, 320) showed a severe dwarf phenotype and did not survive to maturity. Early flowering was exhibited by 11/20 of the T1 lines (#301, 302, 303, 304, 306, 307, 309, 313, 315, 317, 319). The remaining lines appeared wild-type, apart from lines 310 and 314, which were noted to be slightly delayed in the onset of flowering. Line 14 was also infertile and failed to yield seed.

Flowering time was also assessed in a number of T2 populations: plants from the T2-302, T2-305, T2-307, and T2-309 all displayed early flowering comparable to that seen in the parental lines. Plants from the T2-310 and T2-311 populations flowered at the same time as controls.

All of the ten two-component lines submitted for physiological assays showed segregation on selection plates in the T2 generation that was compatible with the transgene being present at a single locus.

In plate-based physiology assays, 35S::G485 two-component lines were more tolerant to salt stress in a germination assay compared to wild-type or non-transformed seedlings. Several salt tolerant lines were also less sensitive to sucrose, ABA, and cold stress relative to control plants in separate germination assays.

Potential Applications

Based on the results of these abiotic stress assays indicate that G481 and related genes, including G485, are excellent candidates for improvement of drought related stress tolerance in commercial species.

Additionally, G485 could be used to manipulate flowering time.

G489 (SEQ ID NO: 93 and 94)

G489 was identified from a BAC sequence that showed high sequence homology to AtHAP5-like transcription factors in *Arabidopsis*. During our earlier genomics program, we observed that plants overexpressing G489 were tolerant of NaCl and mannitol in separate germination assays. Morphologically, the plants were similar to wild-type or non-transformed plants.

G489 and closely-related clade member sequences each comprise a conserved CCAAT binding factor domain that is expected to function in a similar manner in each of these related sequences, that is, by playing a central role in transcriptional regulation and in the conferring of shared traits.

Experimental Observations

Two sets of 35S::G489 lines (301-320 and 421-440) were generated. Lines 301-320 harbored the 35S direct promoter-fusion construct (P51). The second batch of plants (421-440) overexpressed G489 via the two component system. Neither of the two sets of 35S::G489 plants showed any consistent differences in morphology to wild type controls.

The function of G489 was analyzed through its ectopic overexpression in plants. G489 overexpressors were more tolerant to high NaCl stress, showing more root growth and leaf expansion compared with the controls in culture. Two well characterized ways in which NaCl toxicity is manifested in the plant is through general osmotic stress and potassium deficiency due to the inhibition of its transport. These G489 overexpressor lines were more tolerant to osmotic stress in general, showing more root growth on mannitol containing media. G489 overexpressors were also more tolerant to drought than wild-type control plants in soil-based assays.

RT-PCR analysis of endogenous levels of G489 transcripts indicated that this gene was expressed constitutively in all tissues tested. A cDNA array experiment confirmed the RT-PCR derived tissue distribution data. G489 was not induced above basal levels in response to stress treatments tested.

TABLE 19

G485 35S, 2-components-supTfn

| Line | Germ. in high NaCl | Germ. in high mannitol | Sucrose | ABA | Germ. in heat | Germ. in cold | Growth in heat | Drought | Chilling |
|---|---|---|---|---|---|---|---|---|---|
| 302 | + | wt | wt | + | wt | wt | wt | wt | wt |
| 305 | + | wt | wt | + | wt | + | wt | wt | wt |
| 307 | + | wt | wt | wt | wt | wt | wt | wt | wt |
| 309 | wt | wt | wt | wt | wt | wt | wt | wt | wt |
| 310 | + | wt | wt | wt | wt | + | wt | wt | wt |
| 311 | + | wt | + | wt | wt | + | wt | wt | wt |
| 316 | + | wt | + | + | wt | + | wt | wt | wt |
| 317 | + | wt | wt | wt | wt | wt | wt | wt | wt |
| 318 | wt | wt | wt | + | wt | + | wt | wt | wt |
| 319 | + | wt | + | wt | wt | + | wt | wt | wt |

Several 35S::G489 lines derived from direct promoter fusions were created and characterized morphologically. These plants showed no consistent differences in morphology from wild type controls. As shown in Table 20, five of ten G489-overexpressing lines tested were better able to germinate in cold conditions relative to control plants. Relative to control plants, three lines of more mature plants were also better able to tolerate cold conditions.

Experimental Observations

The boundaries of G634 in were experimentally determined and the function of G634 was investigated by constitutively expressing G634 using the CaMV 35S promoter.

Three constructs were made for G634: P324, P1374 and P1717. P324 was found to encode a truncated protein. P1374 and P1717 represent full length splice variants of G634; P1374, the shorter of the two splice variants was used for the

TABLE 20

G489 35S, Direct promoter-fusion and 2-components-supTfn

| Line | Transformation | Germ. in high NaCl | Germ. in high mannitol | Sucrose | ABA | Germ in heat | Germ in cold | Growth in heat | Drought | Chilling |
|---|---|---|---|---|---|---|---|---|---|---|
| 301 | Direct fusion | wt | wt | wt | wt | wt | wt | wt | wt | + |
| 302 | Direct fusion | wt | wt | wt | wt | wt | + | wt | wt | wt |
| 303 | Direct fusion | wt | wt | wt | wt | wt | + | wt | wt | wt |
| 304 | Direct fusion | wt | wt | wt | wt | wt | wt | wt | + | + |
| 305 | Direct fusion | wt | wt | wt | wt | wt | + | wt | + | + |
| 308 | Direct fusion | wt | wt | wt | wt | wt | + | wt | wt | wt |
| 310 | Direct fusion | wt | wt | wt | wt | wt | + | wt | wt | wt |
| 314 | Direct fusion | wt | wt | wt | wt | wt | wt | wt | wt | wt |
| 316 | Direct fusion | wt | wt | wt | wt | wt | wt | wt | wt | wt |
| 317 | Direct fusion | wt | wt | wt | wt | wt | wt | wt | wt | wt |
| 421 | 2-comp | wt | wt | wt | wt | wt | wt | wt | + | wt |
| 422 | 2-comp | wt | wt | wt | wt | wt | wt | wt | wt | wt |
| 423 | 2-comp | wt | wt | wt | wt | wt | wt | wt | wt | wt |
| 424 | 2-comp | wt | wt | wt | wt | wt | wt | wt | wt | wt |
| 425 | 2-comp | wt | wt | wt | wt | wt | wt | wt | wt | wt |
| 426 | 2-comp | wt | wt | wt | wt | wt | wt | wt | wt | wt |
| 430 | 2-comp | wt | wt | wt | wt | wt | wt | wt | wt | wt |
| 434 | 2-comp | wt | wt | wt | wt | wt | wt | wt | wt | wt |
| 437 | 2-comp | wt | wt | wt | wt | wt | wt | wt | + | wt |
| 440 | 2-comp | wt | wt | wt | wt | wt | + | wt | wt | wt |

Potential Applications

The results of this study bolster our conclusion that G481 and the related genes, including G489, are excellent candidates for improvement of drought related stress tolerance in commercial species.

G634 (SEQ ID NO: 127 and 128)

G634 was initially identified as public partial cDNAs sequences for GTL1 and GTL2 which are splice variants of the same gene (Small et al (1998) *Proc. Natl. Acad. Sci. USA*. 95:3318-3322). The published expression pattern of GTL1 shows that G634 is highly expressed in siliques and not expressed in leaves, stems, flowers or roots.

Closely Related Genes from Other Species

The closest non-Arabidopsis relative of G634 is the *O. sativa* gt-2 gene (*EMBO J.* (1992) 11:4131-4144), which is proposed to bind and regulate the phyA promoter. In addition, the pea DNA-binding protein DF1 (13786451) shows strong homology to G634. The homology of these proteins to G634 extends to outside of the conserved domains and thus these genes are likely to be orthologs of G634.

G634 and closely-related clade member sequences each comprise at least one conserved TH domain that is expected to function in a similar manner in each of these related sequences, that is, by playing a central role in transcriptional regulation and in the conferring of shared traits.

experiments described here. The longest available cDNA (P1717), confirmed by RACE, has the same ATG and stop codons as the genomic sequence.

Plants overexpressing G634 from construct P1374 showed a dramatic increase the density of trichomes, which additionally appear larger in size. The increase in trichome density was most noticeable on later arising rosette leaves, cauline leaves, inflorescence stems and sepals with the stem trichomes being more highly branched than controls. Approximately half of the primary transformants and two of three T2 lines showed the phenotype. Apart from slight smallness, there did not appear to be any other clear phenotype associated with the overexpression of G634. However, a reduction in germination was observed in T2 seeds grown in culture. It is not clear whether this defect was due to the quality of the seed lot tested or whether this characteristic is related to the transgene overexpression.

RT PCR data showed that G634 is potentially preferentially expressed in flowers and germinating seedlings, and induced by auxin. The role of auxin in trichome initiation and development has not been established in the published literature.

The increase in trichome density observed in G634 overexpressors suggested a possible role for this gene in drought-stress tolerance, a presumption subsequently confirmed in soil-based drought assays. We tested lines overexpressing G634 in a soil drought assay and found that they showed an enhanced performance versus wild type; G634 overexpressors recovered from the effects of a drought treatment significantly better than wild-type control plants. Additionally, our recent array experiments on plants undergoing a soil-drought experiment indicated that G634 shows a small but significant up-regulation specifically in the recovery phase following re-watering.

G634 overexpressing lines did not exhibit a shade avoidance phenotype when grown under light deficient in the red region of the visible spectrum. When the assay was repeated on individual lines, all three lines analyzed showed the phenotype and had short hypocotyls compared with wild-type seedlings. On control plates, seedlings from line 5 were small while lines 6 and 8 were comparable in size to wild-type seedlings.

Potential Applications

Trichome glands on the surface of many higher plants produce and secrete exudates that give protection from the elements and pests such as insects, microbes and herbivores. These exudates may physically immobilize insects and spores, may be insecticidal or ant-microbial or they may allergens or irritants to protect against herbivores. Trichomes have also been suggested to decrease transpiration by decreasing leaf surface air flow, and by exuding chemicals that protect the leaf from the sun.

Depending on the plant species, varying amounts of diverse secondary biochemicals (often lipophilic terpenes) are produced and exuded or volatilized by trichomes. These exotic secondary biochemicals, which are relatively easy to extract because they are on the surface of the leaf, have been widely used in such products as flavors and aromas, drugs, pesticides and cosmetics. One class of secondary metabolites, the diterpenes, can effect several biological systems such as tumor progression, prostaglandin synthesis and tissue inflammation. In addition, diterpenes can act as insect pheromones, termite allomones, and can exhibit neurotoxic, cytotoxic and antimitotic activities. As a result of this functional diversity, diterpenes have been the target of research several pharmaceutical ventures. In most cases where the metabolic pathways are impossible to engineer, increasing trichome density or size on leaves may be the only way to increase plant productivity.

Thus, the use of G634 and its equivalogs to increase trichome density, size or type may therefore have profound utilities in so called molecular farming practices (i.e. the use of trichomes as a manufacturing system for complex secondary metabolites), and in producing resistant insect and herbivore resistant plants.

Of particular significance, G634 and its equivalogs may also be used to increase the osmotic stress, drought and shade tolerance of plants.

G682 (SEQ ID NO: 147 and 148)

G682 was identified from the Arabidopsis BAC, AF007269, based on sequence similarity to other members of the Myb family within the conserved domain. G682 and closely-related clade member sequences each comprise a conserved Myb-related domain that is expected to function in a similar manner in each of these related sequences, that is, by playing a central role in transcriptional regulation and in the conferring of shared traits.

Experimental Observations

RT-PCR analysis of the endogenous levels of G682 transcripts indicated that this gene was expressed in all tissues tested, however, a very low level of transcript was detected in roots and shoots. Array tissue print data indicated that G682 was expressed primarily, but not exclusively, in flower tissue.

An array experiment was performed on one G682 overexpressing line. The data from this one experiment indicated that this gene could be a negative regulator of chloroplast development and/or light dependent development because the gene Albino3 and many chloroplast genes are repressed. Albino3 functions to regulate chloroplast development (Sundberg et al (1997) Plant Cell 9:717-730). The gene G682 was itself induced 20-fold. Other than a few additional transcription factors, very few genes are induced as a result of the ectopic expression of G682.

The function of G682 was analyzed through its ectopic overexpression in plants. G682 overexpressors were glabrous, had tufts of more root hairs and germinated better under heat stress conditions. Older plants were not more tolerant to heat stress compared to wild-type controls.

G682 overexpressors are glabrous, have tufts of more root hairs and germinated better under heat stress conditions. Older plants were not more tolerant to heat stress compared to wild-type controls. At the time these experiments were performed, it was suggested that further experiments were needed to address whether or not the heat germination phenotype of the G682 overexpressors was related to water deficit stress tolerance in the germinating seedling, and correlated with a possible drought tolerance phenotype. More recent experiments have shown that G682 overexpressors were more tolerant to water deprivation conditions in soil-based drought assays than wild-type plants, and two of three lines tested were significantly more drought tolerant than the wild-type controls.

In addition to the paralogous sequences disclosed above, orthologous sequences from other plant species were also identified using BLAST analysis. Such orthologous sequences, together with the paralogous sequences were determined to be members of the G682 TF family of Myb-related proteins (equivalogs). The paralogous sequences and the orthologous sequences were aligned using MACVECTOR software (Accelrys, Inc.). The software program also generated an exemplary consensus amino acid residue sequence of the aligned sequences.

As shown in FIGS. 3A and 3B, the orthologous sequences shared a consensus sequence with the conserved domain of G682 (amino acid residues 27-63 of SEQ ID NO:148) and also shared identity with regions flanking the conserved domain (flanking regions). In particular, G682 shared a region of the conserved domain with sequences from soy (Glycine max; SEQ ID NOs: 1084, 1085, 1086, 1083, 1087, and 1088), rice (Oryza sativa; SEQ ID NOs: 559, 1082, and 1081), and maize (corn) (Zea mays; SEQ ID NOs: 1089 and 1090).

An exemplary consensus of the conserved domain of the G682 TF family of Myb-related proteins is Val-Xaa-Met/Phe-Ser/Thr-Gln/Glu-Xaa-Glu-Glu-Asp-Leu-Val-Xaa-Arg-Met-His/Tyr-Lys/Arg-Leu-Val-Gly-Asp/Glu-Arg/Lys-Trp-Glu/Asp-Leu-Ile-Ile-Ala-Gly-Arg-Ile/Val-Pro-Gly-Arg, where Xaa is any amino acid residue. An alternative exemplary consensus of the conserved domain is Val-Xaa-Met/Phe-Ser/Thr-Gln/Glu-Xaa-Glu-Glu-Asp-Leu-Val-Ser-Arg-Met-His-Arg-Leu-Val-Gly-Asn-Arg-Trp-Glu-Leu-Ile-Ala-Gly-Arg-Ile-Xaa-Gly-Arg, where Xaa is any amino acid residue. A further alternative exemplary consensus of the conserved domain is Val-Xaa-Met/Phe-Ser/Thr-Gln/Glu-Xaa-Glu-Glu-Asp-Leu-Val-Ser-Arg-Met-Tyr-Xaa-Leu-Val-Gly-Asn/Glu-Arg-Trp-Ser-Leu-Ile-Ala-Gly-Arg-Ile-Pro-Gly-Arg, where Xaa is any amino acid residue.

Potential Applications

The potential utility of this gene or its equivalogs is to confer heat tolerance to germinating seeds.

G682 or its equivalogs could be used to alter trichome number and distribution in plants. Trichome glands on the surface of many higher plants produce and secrete exudates, which give protection from the elements and pests such as insects, microbes and herbivores. These exudates may physically immobilize insects and spores, may be insecticidal or ant-microbial or they may allergens or irritants to protect against herbivores. Trichomes have also been suggested to decrease transpiration by decreasing leaf surface air flow, and by exuding chemicals that protect the leaf from the sun.

G864 (SEQ ID NO: 167 and 168)

G864 was identified in an *Arabidopsis* EST (H37693). G864 appears as gene AT4g23750 in the annotated sequence of *Arabidopsis* chromosome 4 (AL161560). G864 and closely-related clade member sequences each comprise a conserved AP2 domain that is expected to function in a similar manner in each of these related sequences, that is, by playing a central role in transcriptional regulation and in the conferring of shared traits.

Experimental Observations

G864 was discovered and initially identified as a public *Arabidopsis* EST. G864 was ubiquitously expressed, and was not significantly induced under any of the conditions tested.

The complete sequence of G864 was determined, and G864 was found to be related to two additional *Arabidopsis* AP2/EREBP genes, G1421 and G1755. The function of G864 was analyzed using transgenic plants in which this gene was expressed under the control of the 35S promoter. G864 overexpressing plants exhibited a variety of phenotypic alterations. They were smaller than wild-type plants, and those with the strongest phenotypes were classified as dwarf. However, G864 overexpressing lines showed more seedling vigor in a heat stress tolerance germination assay compared to wild-type controls. Conversely, G864 overexpressing lines were also somewhat more sensitive to chilling. One of the three T2 lines analyzed showed significant increase in fucose and arabinose levels in leaves.

In soil-based assays, G864 overexpressing plants were significantly more drought tolerant than wild-type control plants.

Potential Applications

The germination of many crops is very sensitive to temperature. A gene that would enhance germination in hot conditions such as G864 or its equivalogs would be useful for crops that are planted late in the season or in hot climates. G864 and its equivalogs may also be used to improve the drought or other osmotic stress tolerance of plants.

G867 (SEQ ID NO: 169 and 170)

G867 corresponds to RAV1 (Kagaya et al. (1999) *Nucleic Acids Res.* 27: 470-478). G867/RAV1 belongs to a small subgroup within the AP2/EREBP family of transcription factors, whose distinguishing characteristic is that its members contain a second DNA-binding domain, in addition to the conserved AP2 domain, that is related to the B3 domain of VP1/ABI3 (Kagaya et al. (1999) supra). It has been shown that the two DNA-binding domains of RAV1 can separately recognize each of two motifs that constitute a bipartite binding sequence and together cooperatively enhance its DNA-binding affinity and specificity (Kagaya et al. (1999) supra).

G867 and closely-related clade member sequences each comprise a conserved AP2 domain that is expected to function in a similar manner in each of these related sequences, that is, by playing a central role in transcriptional regulation and in the conferring of shared traits.

Experimental Observations

G867 was discovered and initially identified as a public *Arabidopsis* EST. G867 appeared to be constitutively expressed at medium levels.

G867 was first characterized using a line that contained a T-DNA insertion in the gene. The insertion in that line resided immediately downstream of the conserved AP2 domain, and would therefore be expected to result in a severe or null mutation. G867 knockout mutant plants did not show significant changes in overall plant morphology, significant differences between these plants and control plants have not been detected in any of the assays that have been performed so far.

Subsequently, the function of G867 was analyzed using transgenic plants in which this gene was expressed under the control of the 35S promoter. G867 overexpressing lines were morphologically wild-type and no phenotypic alterations in G867 overexpressing lines were detected in the biochemical assays that were performed. However, G867 overexpressing lines showed increased seedling vigor (manifested by increased expansion of the cotyledons) in germination assays on both high salt and high sucrose containing media, compared to wild-type controls.

The *Arabidopsis* paralogs G1930 (SEQ ID NO: 369) and G9 (SEQ ID NO: 1949) also showed stress related phenotypes. G9 exhibited increased root biomass, and thus could be used to produce better plant growth under adverse osmotic conditions. Genetic and physiological evidence indicates that roots subjected to various stresses, including water deficit, alter the export of specific compounds, such as ACC and ABA, to the shoot, via the xylem Bradford et al. (1980) *Plant Physiol.* 65: 322-326; Schurr et al. (1992) *Plant Cell Environ.* 15, 561-567).

G1930 plants responded to high NaCl and high sucrose on plates with more seedling vigor, and root biomass compared to wild-type control plants; this phenotype was identical to that seen in 35S::G867 lines. These results indicate a general involvement of this clade in abiotic stress responses:

The polypeptide sequences of G1930 and G9 share 72% (249/345 residues) and 64% (233/364 residues) with G867, respectively. The conserved domains of G1930 and G9 are 86% (56/65 residues) and 86% (56/65 residues) identical with the conserved domain of G867, respectively.

In addition to the paralogous sequences disclosed above, orthologous sequences from other plant species were also identified using BLAST analysis. Such orthologous sequences, together with the paralogous sequences were determined to be members of the G867 TF family of AP2 proteins (equivalogs). The paralogous sequences and the orthologous sequences were aligned using MACVECTOR software (Accelrys, Inc.). The software program also generated an exemplary consensus amino acid residue sequence of the aligned sequences.

As shown in FIGS. 4A, 4B, 4C, and 4D, the orthologous sequences shared a consensus sequence with the conserved domain of G867 (amino acid residues 59-116 of SEQ ID NO:170) and also shared identity with regions flanking the conserved domain (flanking regions). In particular, G867 shared a region of the conserved domain with sequences from soy (*Glycine max*; SEQ ID NOs: 1184, 1183, and 1182), rice (*Oryza sativa*; SEQ ID NOs: 1176, 1177, and 1178), and maize (corn) (*Zea mays*; SEQ ID NOs: 1186 and 1185).

An exemplary consensus of the conserved domain of the G867 TF family of AP2 proteins is Ser-Ser-Lys/Arg-Tyr/Phe-Gly-Val-Val-Pro-Gln-Pro-Asn-Gly-Arg-Typ-Gly-Ala-Gln-Ile-Tyr-Glu-Lys/Arg-His-Gln-Arg-Val-Trp-Leu-Gly-Thr-Phe-Xaa-Glu/Asp-Glu-Glu/Asp-Glu/Asp-Ala-Ala/Val-Arg-Ala/Ser-Tyr-Asp-Val/Ile-Ala/Val-Val/Ala-Xaa-Arg-Phe/

Tyr-Arg-Arg/Gly-Arg-Asp-Ala-Val-ThrNal-Asn-Phe-Lys/ Arg, where Xaa is any amino acid residue. An alternative exemplary consensus of the conserved domain is Ser-Ser-Lys/Arg-Tyr/Phe-Gly-Val-Val-Pro-Gln-Pro-Asn-Gly-Arg-Typ-Gly-Ala-Gln-Ile-Tyr-Glu-Lys/Arg-His-Gln-Arg-Val-Trp-Leu-Gly-Thr-Phe-Xaa-Glu/Asp-Glu-Glu/Asp-Ala-Ala-Ala-Arg-Ala-Tyr-Asp-Val/Ile-AlaNaI-Val/Ala-Xaa-Arg-Phe/Tyr-Arg-Arg/Gly-Arg-Asp-Ala-Val-Thr/Val-Asn, where Xaa is any amino acid residue. A further alternative exemplary consensus of the conserved domain is Ser-Ser-Lys/Arg-Tyr/Phe-Gly-Val-Val-Pro-Gln-Pro-Asn-Gly-Arg-Typ-Gly-Ala-Gln-Ile-Tyr-Glu-Lys/Arg-His-Gln-Arg-Val-Trp-Leu-Gly-Thr-Phe-Xaa-Gly-Glu-Ala/Asp-Glu/Asp-Ala-Ala/Val-Arg-Ala-Tyr-Asp-Val-Ala-Ala-Gln-Arg-Phe/Tyr-Arg-Arg/Gly-Arg-Asp-Ala-Val-Thr/Val-Asn-Phe-Arg, where Xaa is any amino acid residue.

Potential Applications

G867 or its equivalogs could be used to increase or facilitate seed germination and seedling growth under adverse environmental conditions, in particular salt stress.

G867 or its equivalogs may also be used to modify sugar sensing.

G912 (SEQ ID NO: 185 and 186)

G912 was identified in the sequence of P1 clone MSG15 (GenBank accession number AB015478; gene MSG15.6). G912 and closely-related clade member sequences each comprise a conserved AP2 domain that is expected to function in a similar manner in each of these related sequences, that is, by playing a central role in transcriptional regulation and in the conferring of shared traits.

Experimental Observations

G912 was recognized as the AP2/EREBP gene most closely related to *Arabidopsis* CBF1, CBF2, and CBF3 (Stockinger et al (1997) *Proc. Natl. Acad. Sci. USA* 94:1035-1040; Gilmour et al. (1998) *Plant J.* 16:433-442). In fact, G912 is the only other AP2/EREBP transcription factor for which sequence similarity with CBF1, CBF 2, and CBF3 extends beyond the conserved AP2 domain.

The function of G912 was studied using transgenic plants in which this gene was expressed under the control of the 35S promoter. Plants overexpressing G912 were more freezing and drought tolerant than the wild-type controls, but were also small, dark green, and late flowering. There was a positive correlation between the degree of growth impairment and the freezing tolerance. In addition, G912 expression appeared to be induced by cold, drought, and osmotic stress.

In addition, G912 overexpressing plants also exhibited a sugar sensing phenotype: reduced seedling vigor and cotyledon expansion upon germination on high glucose media.

These results mirror the extensive body of work that has shown that CBF1, CBF2, and CBF3 are involved in the control of the low-temperature response in *Arabidopsis*, and that those genes can be used to improve freezing, drought, and salt tolerance in plants (Stockinger et al., (1997) *Proc. Natl. Acad. Sci. USA* 94:1035-1040; Gilmour et al. (1998) *Plant J.* 16:433-442; Jaglo-Ottosen et al. (1998) *Science.* 280:104-106; Liu et al. (1998) *Plant Cell.* 10:1391-1406, Kasuga et al. (1999) *Nat. Biotechnol.* 17:287-291).

The polypeptide sequences of G40, G41, and G42 share 71% (140 of 195 residues), 68% (144 of 211 residues), and 65% (147 of 224 residues) identity with G912, respectively. The conserved domains of G40, G41, and G42 share 94% (64 of 68 residues), 92% (63 of 68 residues), and 94% (64 of 68 residues) identity with G912, respectively.

In addition to the paralogous sequences disclosed above, orthologous sequences from other plant species were also identified using BLAST analysis. Such orthologous sequences, together with the paralogous sequences were determined to be members of the G912 TF family of AP2/EREBP proteins (equivalogs). The paralogous sequences and the orthologous sequences were aligned using MACVECTOR software (Accelrys, Inc.). The software program also generated an exemplary consensus amino acid residue sequence of the aligned sequences.

As shown in FIGS. 5A, 5B, 5C, 5D, 5E, and 5F, the orthologous sequences shared a consensus sequence with the conserved domain of G912 (amino acid residues 51-118 of SEQ ID NO: 186) and also shared identity with regions flanking the conserved domain (flanking regions). In particular, G912 shared a region of the conserved domain with sequences from soy (*Glycine max*; SEQ ID NOs: 1238, 1242, 1240, 1241, and 1243), rice (*Oryza sativa*; SEQ ID NOs: 1222, 1223, 1232, 1221, 1231, 1227, 1235, 1230, 1229, and 1228), and maize (corn) (*Zea mays*; SEQ ID NOs: 1246, 1247, 1244, and 1245).

An exemplary consensus of the conserved domain of the G912 TF family of AP2/EREBP proteins is His-Pro-Ile/Val-Tyr/Phe-Arg/Lys-Gly-Val-Arg-Gln/Arg-Arg-Gly/Asn-Xaa$_{(1-3)}$-Lys/Arg-Trp-Val-Cys/Ser-Glu-Val/Leu-Arg-Glu/Val-Pro-Asn-Lys-Xaa$_{(2)}$-Arg-Ile/Leu-Trp-Leu-Gly-Thr-Phe/Tyr-Xaa$_{(2)}$-Ala/Pro-Glu-Met-Ala-Ala-Arg-Ala-His-Asp-Val-Ala-Ala/Met-Leu/Met-Ala-Leu-Arg-Gly-Xaa$_{(1-8)}$-Ala-Cys-Leu-Asn-Phe-Ala-Asp-Ser-Xaa$_{(1-5)}$-Val/Ile-Pro/Asp, where Xaa is any amino acid residue. An alternative exemplary consensus of the conserved domain is His-Pro-Ile/Val-Tyr/Phe-Arg/Lys-Gly-Val-Arg-Xaa-Arg-Gly/Asn-Xaa$_{(1-3)}$-Lys/Arg-Trp-Val-Cys/Ser-Glu-Val/Leu-Arg-Glu/Val-Pro-Xaa$_{(1-5)}$-Arg-Ile/Leu/Phe-Trp-Leu-Gly-Thr-Phe/Tyr-Xaa$_{(2)}$-Ala/Pro-Glu-Xaa-Ala-Ala-Arg-Ala-His-Asp-Val-Ala-Ala/Met-Leu/Met-Ala-Leu-Arg-Gly-Xaa$_{(1-8)}$-Ala-Cys/Ser-Leu-Asn-Phe-Ala-Asp-Ser-Xaa$_{(1-5)}$-Val/Ile-Pro/Asp, where Xaa is any amino acid residue.

An exemplary flanking region consensus sequence of the G912 TF family of AP2/EREBP proteins is Pro-Lys-Xaa-Xaa-Ala-Gly-Arg (amino acids 37-43 of SEQ ID NO: 186), or Ala-Gly-Arg-Xaa-Lys-Phe (amino acids 41-46 of SEQ ID NO: 186) or Glu-Thr-Arg-His-Pro (amino acids 48-52 of SEQ ID NO: 186), where Xaa is any amino acid residue.

Potential Applications

G912 or its equivalogs could be used to improve plant tolerance to cold, freezing, drought, and salt stress. In addition, G912 or its equivalogs could be used to change a plant's flowering time and size.

G913 (SEQ ID NO: 187 and 188)

G913 was identified in the sequence of clone MSG15; it corresponds to gene MSG15.10 (GenBank PID BAB11050). G913 and closely-related clade member sequences each comprise a conserved AP2 domain that is expected to function in a similar manner in each of these related sequences, that is, by playing a central role in transcriptional regulation and in the conferring of shared traits.

Experimental Observations

The cDNA sequence of G913 was determined. To investigate the function(s) of G913, this gene was expressed under the control of the 35S promoter in transgenic plants. G913 overexpressing plants had dark green leaves that occasionally curled downward. These plants showed a delay in flowering and were also late senescing. Overexpressing G913 lines were more freezing tolerant and more drought tolerant than the wild-type controls.

In an ethylene sensitivity assay where the plants were tested for a triple response phenotype on plates containing ACC, G913 overexpressing plants showed stunting and curling in the hypocotyl region that was more exaggerated than the wild type triple response.

Potential Applications

G913 or its equivalogs could be used to improve plant tolerance to freezing and drought. G913 could also be used to manipulate the ethylene response.

G913 or its equivalogs may be used to delay flowering or senescence in plants. Extending vegetative development could bring about large increases in yields.

Additionally, a major concern is the escape of transgenic pollen from GMOs to wild species or so-called organic crops. Systems that prevent vegetative transgenic crops from flowering would eliminate this worry.

G922 (SEQ ID NO: 189 and 190)

G922 corresponds to Scarecrow-like 3 (SCL3) first described by Pysh et al. (GenBank accession number AF036301; (1999) *Plant J.* 18: 111-119). Northern blot analysis results show that G922 is expressed in siliques, roots, and to a lesser extent in shoot tissue from 14 day old seedlings. Pysh et al did not test any other tissues for G922 expression. In situ hybridization results showed that G922 was expressed predominantly in the endodermis in the root tissue. This pattern of expression was very similar to that of SCARECROW (SCR), G306. Experimental evidence indicated that the co-localization of the expression is not due to cross-hybridization of the G922 probe with G306. Pysh et al proposed that G922 may play a role in epidermal cell specification and that G922 may either regulate or be regulated by G306.

The sequence for G922 can also be found in the annotated BAC clone F11F12 from chromosome 1 (GenBank accession number AC012561). The sequence for F11F12 was submitted to GenBank by the DNA Sequencing and Technology Center at Stanford University.

G922 and closely-related clade member sequences each comprise at least one conserved SCR domain that is expected to function in a similar manner in each of these related sequences, that is, by playing a central role in transcriptional regulation and in the conferring of shared traits.

Experimental Observations

The function of this gene was analyzed using transgenic plants in which G922 was expressed under the control of the 35S promoter. Transgenic plants overexpressing G922 were more salt tolerant than wild-type plants as determined by a root growth assay on MS media supplemented with 150 mM NaCl. Plant overexpressing G922 also were more tolerant to osmotic stress as determined by germination assays in salt-containing (150 mM NaCl) and sucrose-containing (9.4%) media. Morphologically, plants overexpressing G922 had altered leaf morphology, coloration, fertility, and overall plant size. In wild-type plants, expression of G922 was induced by auxin, ABA, heat, and drought treatments. In non-induced wild-type plants, G922 was expressed constitutively at low levels.

The high salt assays suggested that this gene would confer drought tolerance, a supposition confirmed by soil-based assays, in which G922-overexpressing plants were significantly healthier after water deprivation treatment than wild-type control plants.

Potential Applications

Based upon results observed in plants overexpressing G922 or its equivalogs could be used to alter salt tolerance, tolerance to osmotic and drought stress, and leaf morphology in other plant species.

G926 (SEQ ID NO: 191 and 192)

G926 is equivalent to Hap2a (Y13720), a member of the CCAAT box-binding transcription factor family. The gene was identified by Edwards et al. ((1998) *Plant Physiol.* 117: 1015-1022), who demonstrated that G926 or AtHap2a were able to functionally complement a Hap2 deficient mutant of yeast suggesting that there is functional conservation between these proteins from diverse organisms. In addition, the AtHap2a gene was shown to be ubiquitously expressed in *Arabidopsis*.

G926 and closely-related clade member sequences each comprise a conserved CCAAT-binding factor domain that is expected to function in a similar manner in each of these related sequences, that is, by playing a central role in transcriptional regulation and in the conferring of shared traits.

Experimental Observations

Consistent with the published expression pattern (Edwards et al. (1998) *Plant Physiol.* 117: 1015-1022), G926 was determined to be ubiquitously expressed and transcript levels appeared to be unaltered by any environmental stress-related condition tested. A line homozygous for a T-DNA insertion in G926 was used to determine the function of this gene.

The G926 knockout mutant line was morphologically wild-type. Physiological analysis revealed that in the presumed absence of G926 function, the plants became more tolerant to high osmotic conditions during germination. This osmotic stress tolerance could be related to the plant's apparent insensitivity to the growth hormone ABA. This was the second instance where a member of a CCAAT-box protein complex altered the plants osmotic stress response and ABA sensitivity during germination.

ABA plays an important regulatory role in the initiation and maintenance of seed dormancy. Lopez-Molina, L. et al. ((2001) *Proc. Natl. Acad. Sci. USA* 98: 4782-4787) describe a bZIP transcription factor, ABI5, that is involved in maintaining seeds in a quiescent state, preventing germination under adverse conditions such as drought stress. It is possible G926 also functions as part of this checkpoint for the germinating seeds and loss of G926 function promotes germination regardless of the osmotic status of the environment.

Potential Applications

G926 or its equivalogs could be used to improve plant tolerance to drought, and salt stress. Evaporation from the soil surface causes upward water movement and salt accumulation in the upper soil layer where the seeds are placed. Thus, germination normally takes place at a salt concentration much higher than the mean salt concentration of in the whole soil profile. Increased salt tolerance during the germination stage of a crop plant would impact survivability and yield.

G975 (SEQ ID NO: 199 and 200)

G975 has appeared in the sequences released by the *Arabidopsis* Genome Initiative (BAC F9L1, GenBank accession number AC007591). G975 and closely-related clade member sequences each comprise a conserved AP2 domain that is expected to function in a similar manner in each of these related sequences, that is, by playing a central role in transcriptional regulation and in the conferring of shared traits.

Experimental Observations

G975 was expressed in flowers and, at lower levels, in shoots, leaves, and siliques. GC-FID and GC-MS analyses of leaves from G975 overexpressing plants showed that the levels of C29, C31, and C33 alkanes were substantially increased (up to ten-fold) compared with control plants. A number of additional compounds of similar molecular weight, presumably also wax components, also accumulated to significantly higher levels in G975 overexpressing plants. C29 alkanes constituted close to 50% of the wax content in wild-type plants (Millar et al. (1998) *Plant Cell* 11:1889-1902), suggesting that a major increase in total wax content occurred in the G975 transgenic plants. However, the transgenic plants had an almost normal phenotype (although small morphological differences were detected in leaf appearance), indicating that overexpression of G975 was not deleterious to the plant. Overexpression of G975 did not cause the dramatic alterations in plant morphology that had been reported for *Arabidopsis* plants in which the FATTY ACID ELONGATION1 gene was overexpressed (Millar et al. 1998, *Plant Cell* 11:1889-1902). G975 may regulate the expression of some of the genes involved in wax metabolism. One *Arabidopsis* AP2 sequence (G1387) that is significantly more closely related to G975 than the rest of the members of the AP2/EREBP family is predicted to have a function and a use related to that of G975.

G975 overexpressing plants were significantly more drought tolerant than wild-type control plants in soil-based drought assays.

out-performed control plants in one or more plate based stress assays including germination on salt, germination on sucrose, germination in the cold, or growth under chilling conditions. Interestingly, two 35S::G993 lines showed a very dramatic increase in root hair density when grown on regular MS plates (this phenotype was comparable to that observed in 35S::G9 lines during our phase I genomics program). Interestingly, though, the two lines that exhibited increased root hair development did not show a positive result in the stress assays.

It should be emphasized that we have obtained comparable developmental effects as well as a strong enhancement of drought related stress tolerance in all four of the *Arabidopsis* genes in the G867 study group (G9, G867, G993, and G1930). The almost identical phenotypic effects produced by these genes strongly suggest that they are functionally equivalent.

TABLE 21

| | G993 35S, Direct promoter-fusion | | | | | | | | |
|---|---|---|---|---|---|---|---|---|---|
| Line | Germ. in high NaCl | Germ. in high mannitol | Sucrose | ABA | Germ. in heat | Germ. in cold | Growth in heat | Drought | Chilling |
| 321 | + | wt | wt | wt | wt | wt | wt | wt | + |
| 322 | wt | wt | + | wt | wt | + | wt | wt | + |
| 324 | wt | wt | wt | wt | wt | wt | wt | wt | + |
| 326 | + | wt | wt | wt | wt | wt | wt | wt | + |
| 330 | wt | wt | wt | wt | wt | wt | wt | wt | wt |
| 331 | + | wt | + | wt | wt | wt | wt | wt | + |
| 334 | + | wt | ++ | wt | wt | ++ | wt | wt | wt |
| 335 | + | wt | ++ | wt | wt | + | wt | wt | wt |
| 337 | wt | wt | wt | wt | wt | wt | wt | wt | wt |
| 340 | + | wt | + | wt | wt | wt | wt | wt | + |

Potential Applications

G975 or its equivalogs can be used to manipulate wax composition, amount, or distribution, which in turn can modify plant tolerance to drought and/or low humidity or resistance to insects, as well as plant appearance (shiny leaves).

G975 or its equivalogs can also be used to specifically alter wax composition, amount, or distribution in those plants and crops from which wax is a valuable product.

G993 (SEQ ID NO: 2071 and 2072)

G993 is a putative paralog of G867. No genetic analysis of the locus has been published.

G993 and closely-related clade member sequences each comprise a conserved AP2 domain that is expected to function in a similar manner in each of these related sequences, that is, by playing a central role in transcriptional regulation and in the conferring of shared traits.

During our earlier genomics program, we observed that G993 overexpression lines exhibited a number of morphological abnormalities. The aim of this study was to re-assess 35S::G993 transformants (using a greater number of lines), and determine whether overexpression of the gene could confer enhanced stress tolerance in a comparable manner to G867.

New overexpression lines have been obtained using a direct promoter fusion construct. These lines exhibited similar phenotypes to those observed during our phase I genomics studies and were generally small, slow developing, and poorly fertile. Some lines also showed features that suggested a disruption in light regulated development, such as long hypocotyls and alterations in leaf orientation.

We have tested ten of the 35S::G993 direct-fusion lines under a variety of plate based treatments. Eight of these lines Potential Applications Based on the results of our overexpression studies, G867 and related sequences such as G993 are excellent candidates for improvement of drought and cold-related stress tolerance in commercial species. The morphological effects associated with their overexpression suggests that tissue-enhanced, tissue-specific or conditional promoters might be used to optimize the utility of these genes.

The increased root hair production seen in 35S::G993 lines indicates that the gene might be used to enhance root growth and differentiation and might thereby improve performance under other stresses, such as low nutrient availability.

G1048 (SEQ ID NO: 2515 and 2516)

G1048 (AT1G42990) was initially identified as public partial EST T88194 and in BAC F13A11 (GenBank accession AC068324) released by the *Arabidopsis* Genome Initiative.

Experimental Observations.

RT-PCR expression analysis indicated that G1048 was constitutively expressed and not induced by any condition tested. At that time, the function of G1048 was investigated by constitutively expressing G1048 using the 35S promoter. Plants overexpressing G1048 were not significantly different to controls in any assay performed.

G1048 and closely-related clade member sequences each comprise a conserved bZIP domain that is expected to function in a similar manner in each of these related sequences, that is, by playing a central role in transcriptional regulation and in the conferring of shared traits.

In initial experiments, G1048 overexpressing lines did not exhibit a shade avoidance phenotype when grown under light deficient in the red region of the visible spectrum. This effect was seen in two repeat experiments on a batch of mixed seed from three independent lines.

In repeat experiments, 35S::G1048 lines grown under white light versus light deficient in red light were analyzed. A significant shade tolerance phenotype was observed, indicating that G1048 might be involved in the transcriptional regulation of response to shade or light quality. G1048 is potentially related to HY5 (Oyama et al. (1997) Genes Dev. 11:2983-2995), a gene that is well established to be involved in light regulated development.

G1069 (SEQ ID NO: 221 and 222)

The sequence of G1069 was obtained from EU *Arabidopsis* sequencing project, GenBank accession number Z97336, based on its sequence similarity within the conserved domain to other AT-Hook related proteins in *Arabidopsis*. G1069 and closely-related clade member sequences each comprise a conserved AT-hook domain and a conserved second domain or DUF 296 domain that are expected to function in a similar manner in each of these related sequences, that is, by playing a central role in transcriptional regulation and in the conferring of shared traits.

Experimental Observations

The sequence of G1069 was experimentally determined and the function of G1069 was analyzed using transgenic plants in which G1069 was expressed under the control of the 35S promoter.

Plants overexpressing G1069 showed changes in leaf architecture, reduced overall plant size, and retarded progression through the life cycle. This is a common phenomenon for most transgenic plants in which AT-HOOK proteins are overexpressed if the gene is predominantly expressed in root in the wild-type background. G1069 was predominantly expressed in roots, based on analysis of RT-PCR results. To minimize these detrimental effects, G1069 may be overexpressed under a tissue specific promoter such as root- or leaf-specific promoter or under inducible promoter.

One of G1069 overexpressing lines showed more tolerance to osmotic stress when they were germinated in high sucrose plates. This line also showed insensitivity to ABA in a germination assay.

Potential Applications

The osmotic stress results indicate that G1069 could be used to alter a plant's response to water deficit conditions and, therefore, the gene or its equivalogs could be used to engineer plants with enhanced tolerance to drought, salt stress, and freezing.

G1069 affects ABA sensitivity, and thus when transformed into a plant the gene or its equivalogs may diminish cold, drought, oxidative and other stress sensitivities, and also be used to alter plant architecture, and yield.

G1073 (SEQ ID NO: 223 and 224)

G1073 has been identified in the sequence of a BAC clone from chromosome 4 (BAC clone F23E12, gene F23E12.50, GenBank accession number AL022604), released by EU *Arabidopsis* Sequencing Project. G1073 and closely-related clade member sequences each comprise a conserved At-hook domain and a second domain or DUF296 domain that are expected to function in a similar manner in each of these related sequences, that is, by playing a central role in transcriptional regulation and in the conferring of shared traits.

Experimental Observations

The function of G1073 was analyzed using transgenic plants in which G1073 was expressed under the control of the 35S promoter. Transgenic plants overexpressing G1073 were substantially larger than wild-type controls, with at least a 60% increase in biomass. The increased mass of 35S::G1073 transgenic plants was attributed to enlargement of multiple organ types including leaves, stems, roots and floral organs. Petal size in the 35S::G1073 lines was increased by 40-50% compared to wild type controls. Petal epidermal cells in those same lines were approximately 25-30% larger than those of the control plants. Furthermore, 15-20% more epidermal cells per petal were produced compared to wild type. Thus, at least in petals, the increase in size was associated with an increase in cell size as well as in cell number. Additionally, images from the stem cross-sections of 35S::G1073 plants revealed that cortical cells are large and that vascular bundles contained more cells in the phloem and xylem relative to wild type Seed yield was increased compared to control plants. 5S::G1073 lines showed an increase of at least 70% in seed yield. This increased seed production was associated with an increased number of siliques per plant, rather than seeds per silique.

Flowering of G1073 overexpressing plants was delayed. Leaves of G1073 overexpressing plants were generally more serrated than those of wild-type plants. Improved drought tolerance was observed in 35S::G1073 transgenic lines.

Potential Applications

Transgenic plants overexpressing G1073 are large and late flowering with serrated leaves. Large size and late flowering produced as a result of G1073 or equivalog overexpression would be extremely useful in crops where the vegetative portion of the plant is the marketable portion (often vegetative growth stops when plants make the transition to flowering). In this case, it would be advantageous to prevent or delay flowering with the use of this gene or its equivalogs in order to increase yield (biomass). Prevention of flowering by this gene or its equivalogs would be useful in these same crops in order to prevent the spread of transgenic pollen and/or to prevent seed set. This gene or its equivalogs could also be used to manipulate leaf shape and drought tolerance.

G1075 (SEQ ID NO: 225 and 226)

The sequence of G1075 was obtained from the *Arabidopsis* genome sequencing project, GenBank accession number AC004667, based on its sequence similarity within the conserved domain to other AT-Hook related proteins in *Arabidopsis*. G1075 and closely-related clade member sequences each comprise a conserved At-hook domain and a second domain or DUF296 domain that are expected to function in a similar manner in each of these related sequences, that is, by playing a central role in transcriptional regulation and in the conferring of shared traits.

Experimental Observations

The function of G1075 was analyzed using transgenic plants in which G1075 was expressed under the control of the 35S promoter. Overexpression of G1075 produced very small, sterile plants. Pointed leaves were noted in some seedlings, and twisted or curled leaves and abnormal leaf serrations were noted in rosette stage plants. Bolts were short and thin with short internodes. Flowers from severely affected plants had reduced or absent petals and stamen filaments that partially or completely fail to elongate. Because of the severe phenotypes of these T1 plants, no T2 seed was produced for physiological and biochemical analysis.

RT-PCR analysis indicated that G1075 transcripts are found primarily in roots. The expression of G1075 appeared to be induced by cold and heat stresses.

Potential Applications

G1075 or its equivalogs could be used to modify plant architecture and development, including flower structure. If expressed under a flower-specific promoter, the gene or its equivalogs might also be useful for engineering male sterility. Because expression of G1075 is root specific, its promoter could be useful for targeted gene expression in this tissue.

*Arabidopsis* G1364 (SEQ ID NO: 2101 and 2102)

G1364, a putative paralog of G481, is a member of the HAP3 subgroup of the CCAAT box-binding transcription factor family. G1364 and closely-related clade member sequences each a conserved CCAAT box-binding domain that is expected to function in a similar manner in each of these related sequences, that is, by playing a central role in transcriptional regulation and in the conferring of shared traits.

Experimental Observations

The aim of the present study was to reevaluate the effects of G1364 overexpression and determine whether the gene confers similar effects to G481. We have now obtained two sets of 35S::G1364 lines using a two-component approach. A significant number of these transformants showed delayed flowering, indicating that G1364 can act as a repressor of the floral transition. Plants from this set also senesced later than wild type. In other respects, these transformants showed wild-type morphology.

As shown in Table 22, two G1364-overexpressing lines tested were less sensitive to ABA than wild-type or non-transformed plants.

TABLE 22

G1364 35S, 2-components-supTfn

| Line | Germ. in high NaCl | Germ. in high mannitol | Sucrose | ABA | Germ. in heat | Germ. in cold | Growth in heat | Drought | Chilling |
|---|---|---|---|---|---|---|---|---|---|
| 341 | wt | wt | wt | wt | wt | wt | wt | wt | wt |
| 342 | wt | wt | wt | wt | wt | wt | wt | wt | wt |
| 343 | wt | wt | wt | wt | wt | wt | wt | wt | wt |
| 344 | wt | wt | wt | wt | wt | wt | wt | wt | wt |
| 345 | wt | wt | wt | wt | wt | wt | wt | wt | wt |
| 346 | wt | wt | wt | wt | wt | wt | wt | wt | wt |
| 423 | wt | wt | wt | wt | wt | wt | wt | wt | wt |
| 431 | wt | wt | wt | wt | wt | wt | wt | wt | wt |
| 432 | wt | wt | wt | + | wt | wt | wt | wt | wt |
| 435 | wt | wt | wt | + | wt | wt | wt | wt | wt |

Potential Applications

Based on the results of the ABA germination assay, G481 and related sequences such as G1364 may be used to improve the stress tolerance in plants.

G1364 might also be used to modify flowering time related traits.

G1411 (SEQ ID NO: 269 and 270)

G1411 was identified in the sequence of TAC clone K22G18 (GenBank accession number AB022212). G1411 and closely-related clade member sequences each comprise a conserved AP2 domain that is expected to function in a similar manner in each of these related sequences, that is, by playing a central role in transcriptional regulation and in the conferring of shared traits.

Experimental Observations

The complete sequence of G1411 was determined. The function of G1411 was analyzed using transgenic plants in which this gene was expressed under the control of the 35S promoter. G1411 overexpressing plants were smaller than wild-type controls and showed reduced apical dominance: axillary shoots develop prematurely amongst primary rosette leaves, resulting in a bushy plant. G1411 overexpressing plants behaved like the corresponding wild-type controls in all physiological and biochemical assays that were performed.

Potential Applications

G1411 or its equivalogs could be used to manipulate plant architecture.

G1451 (SEQ ID NO: 277 and 278)

G1451 is ARF8, a member of the ARF class of proteins with a VP1-like N-terminal domain and a C-terminal domain with homology to Aux/IAA proteins. ARF8, like several other ARFs, contains a glutamine-rich central domain that can function as a transcriptional activation domain (1). ARF8 was shown to bind to an auxin response element (2). It was also shown that a truncated version of ARF8 lacking the DNA binding domain but containing the activation domain and the C-terminal domain could activate transcription on an auxin responsive promoter, presumably through interactions with another factor bound to the auxin response element (1). ARF8 is closely related in sequence to ARF6 (2).

G1451 and closely-related clade member sequences each comprise a conserved B3 DNA binding domain, a conserved Auxin response factor domain, and a c-terminal AUX/IAA family conserved domain that are expected to function in a similar manner in each of these related sequences, that is, by playing a central role in transcriptional regulation and in the conferring of shared traits.

Experimental Observations

G1451 was expressed throughout the plant, with the highest expression in flowers. Transcripts of G1451 were induced in leaves by a variety of stress conditions. A line homozygous for a T-DNA insertion in G1451 was used to determine the function of this gene. The T-DNA insertion of G1451 is approximately one-fifth of the way into the coding sequence of the gene and therefore is likely to result in a null mutation.

As measured by NIR, G1451 knockout mutants had increased total combined seed oil and seed protein content compared to wild-type plants.

Potential Applications

G1451 or its equivalogs may be used to alter seed oil and protein content, which may be very important for the nutritional value and production of various food products G1451 or its equivalogs could also be used to increase plant biomass. Large size is useful in crops where the vegetative portion of the plant is the marketable portion since vegetative growth often stops when plants make the transition to flowering.

G1543 (SEQ ID NO: 303 and 304)

G1543 was identified as a novel homeobox gene within section 3 of 255 from the complete sequence of Chromosome II (GenBank accession number AC005560, released by the *Arabidopsis* Genome Initiative). G1543 and closely-related clade member sequences each comprise a conserved NAC domain that is expected to function in a similar manner in each of these related sequences, that is, by playing a central role in transcriptional regulation and in the conferring of shared traits.

Experimental Observations

The ends of G1543 were determined by RACE and a full-length cDNA was isolated by PCR from mixed cDNA. The encoded 275 amino acid product was found to be a member the HD-ZIP class II group of HD proteins. The public annotation for this gene was incorrect; the protein predicted in the BAC report was only 162 amino acids in length.

RT-PCR analysis revealed that G1543 was expressed ubiquitously but was up-regulated in response to auxin applications.

The function of G1543 was analyzed using transgenic plants in which the gene was expressed under the control of the 35S promoter. 35S::G1543 Arabidopsis plants exhibited a range of phenotypes; most consistently, however, the plants possessed dark green leaves and an altered branching pattern that led to a shorter more compact stature. These morphological phenotypes, along with the expression data, implicate G1543 as a component of a growth or developmental response to auxin.

Biochemical assays reflected the changes in leaf color noted during morphological analysis. All three T2 lines examined displayed increased levels of leaf chlorophylls and carotenoids. Additionally, one of three lines had a decrease in seed oil combined with an increase in seed protein. A repeat experiment verified the altered seed oil and protein composition in two lines.

Physiological assays identified no clear differences between 35S::G1543 and wild-type plants.

Potential Applications

The altered levels of chlorophylls, carotenoids, seed oils, and proteins that resulted from overexpression of the gene in Arabidopsis indicate that G1543 or its equivalogs or its equivalogs might used to manipulate the composition of these substances in seed, with applications toward the improvement in the nutritional value of foodstuffs (for example, by increasing lutein).

Enhanced chlorophyll and carotenoid levels could also improve yield in crop plants. For instance lutein, like other xanthophylls such as zeaxanthin and violaxanthin, is an essential component in the protection of the plant against the damaging effects of excessive light. Specifically, lutein contributes, directly or indirectly, to the rapid rise of non-photochemical quenching in plants exposed to high light. Crop plants engineered to contain higher levels of lutein could therefore have improved photo-protection, possibly leading to less oxidative damage and better growth under high light. Additionally, elevated chlorophyll levels might increase photosynthetic capacity.

G1543 or its equivalogs might be applied to modify plant stature. This could be used to produce crops that are more resistant to damage by wind and rain, or more amenable to harvest. Plants with altered stature might also be of interest to the ornamental plant market.

This gene or its equivalogs may also be used to alter oil production in seeds, which may be very important for the nutritional quality and caloric content of foods G1792 (SEQ ID NO: 331 and 332)

G1792 was identified in the sequence of BAC clone K14B15 (AB025608, gene K14B15.14). G1792 and closely-related clade member sequences each comprise a conserved AP2 domain that is expected to function in a similar manner in each of these related sequences, that is, by playing a central role in transcriptional regulation and in the conferring of shared traits.

Experimental Observations

G1792 (SEQ ID NO: 331) was studied using transgenic plants in which the gene was expressed under the control of the 35S promoter. 35S::G1792 plants were more tolerant to the fungal pathogens *Fusarium oxysporum* and *Botrytis cinerea* and showed fewer symptoms after inoculation with a low dose of each pathogen. This result was confirmed in T2 lines. The effect of G1792 overexpression in increasing tolerance to pathogens received further, incidental confirmation. T2 plants of two 35S::G1792 lines had been growing in a room that suffered a serious powdery mildew infection. For each line, a pot of six plants was present in a flat containing nine other pots of lines from unrelated genes. In either of the two different flats, the only plants that were free from infection were those from the 35S::G1792 line. This observation indicated that G1792 overexpression might be used to increase resistance to powdery mildew. Additional experiments confirmed that 35S::G1792 plants showed increased tolerance to *Erysiphe*. G1792 was ubiquitously expressed, but appeared to be induced by salicylic acid.

Relative to control plants, 35S::G1792 overexpressing plants also showed more tolerance to growth under nitrogen-limiting conditions. In a root growth assay under conditions of limiting N, 35S::G1792 lines were slightly less stunted. In a germination assay that monitored the effect of C on N signaling through anthocyanin production on high sucrose plus and minus glutamine the 35S::G1792 lines made less anthocyanin on high sucrose plus glutamine, suggesting that the gene can be involved in the plants ability to monitor their carbon and nitrogen status.

G1792 overexpressors were more tolerant to drought conditions than wild-type plants in soil-based assays.

G1792 overexpressing plants showed several mild morphological alterations: leaves were dark green and shiny, and plants bolted, subsequently senesced, slightly later than wild-type controls. Among the T1 plants, additional morphological variation (not reproduced later in the T2 plants) was observed: many showed reductions in size as well as aberrations in leaf shape, phyllotaxy, and flower development.

Potential Applications

G1792 or its equivalogs can be used to engineer pathogen-resistant plants. In addition, it can also be used to improve seedling germination and performance under conditions of limited nitrogen.

Potential utilities of this gene or its equivalogs also include increasing chlorophyll content allowing more growth and productivity in conditions of low light. With a potentially higher photosynthetic rate, fruits could have higher sugar content. Increased carotenoid content could be used as a nutraceutical to produce foods with greater antioxidant capability.

G1792 or its equivalogs could be used to manipulate wax composition, amount, or distribution, which in turn could modify plant tolerance to drought and/or low humidity or resistance to insects, as well as plant appearance (shiny leaves). In particular, it would be interesting to see what the effect of increased wax deposition on leaves of a plant like cotton would do to drought resistance or water use efficiency. A possible application for this gene might be in reducing the wax coating on sunflower seeds (the wax fouls the oil extraction system during sunflower seed processing for oil). For this purpose, antisense or co-suppression of the gene in a tissue specific manner might be useful G1816 (SEQ ID NO: 2142 and 2143)

G1816 corresponds to TRIPTYCHON (TRY), a gene that regulates epidermal cell specification in the leaf and root (Schnittger et al., 1998; 1999; Schellmann et al., 2002). The gene was included in our earlier studies as a putative paralog of G682 and based on the increased resistance of 35S::G1816 lines to osmotic stress conditions such as high levels of glucose.

G1816 and closely-related clade member sequences each comprise a conserved Myb-related domain that is expected to function in a similar manner in each of these related sequences, that is, by playing a central role in transcriptional regulation and in the conferring of shared traits.

The aim of this study was to re-assess 35S::G1816 lines and determine whether overexpression of the gene could confer enhanced stress tolerance in a comparable manner to G682. We also sought to examine whether use of a two-component overexpression system would produce any strengthening of the phenotype relative to the use of a 35S direct promoter-fusion.

We have now generated 35S::G1816 lines using the two component system. These lines showed a strong glabrous phenotype, similar to what was observed during our phase I study, and similar to the effect produced by G682 overexpression. However, many of the 35S::G1816 lines were noted to be smaller than controls, an effect that had not been previously recognized.

Ten of the two component lines were tested in plate based physiology assays, and relative to control plants, all ten lines showed a strong resistance to osmotic stress when germinated on sucrose plates. All the lines examined also showed increased density of root hairs. These effects are broadly comparable to those observed in G682 lines, suggesting that the two genes likely have very related functions. However, 35S::G682 lines showed positive results in a greater number of assays than the 35S::G1816 lines (see 35S::G682 report), perhaps indicating that G682 can protect against a greater range of drought related stresses than G1816.

the BAC clone MBA10, accession number AB025619 released by the *Arabidopsis* Genome sequencing project. G1820 and closely-related clade member sequences each comprise a conserved CCAAT binding factor domain that is expected to function in a similar manner in each of these related sequences, that is, by playing a central role in transcriptional regulation and in the conferring of shared traits.

Experimental Observations

The complete sequence of G1820 was determined.

In soil-based assays, 35S::G1820 direct fusion overexpressing plants were significantly more drought tolerant than wild-type control plants The function of this gene was also analyzed using transgenic plants in which G1820 was expressed under the control of the 35S promoter with the two-component transformation system. A wide range of morphological alterations was observed, similar to those seen in our earlier studies.

In plate-based physiology assays on the two-component lines, many of our previously observed drought stress-related phenotypes were confirmed. Relative to control plants, the majority of lines were more tolerant, to varying extents, in salt, mannitol, sucrose, ABA and cold in germination assays.

It should be emphasized that we have observed stress tolerance phenotypes for several other G481 related genes including G482, G485, G1836, and non-Arabidopsis sequences. The similar effects seen when these genes are overexpressed strongly suggest that they are likely be functionally related, at least with respect to this phenotype.

Overexpression of G1820 also consistently reduced the time to flowering. Under continuous light conditions at 20-25 C, the 35S::G1820 transformants displayed visible flower buds several days earlier than control plants. The primary shoots of these plants typically started flower initiation 1-4

TABLE 23

G1816 35S, 2-components supTfn

| Line | Germ. in high NaCl | Germ. in high mannitol | Sucrose | ABA | Germ in heat | Germ in cold | Growth in heat | Drought | Chilling | G682-like root morph. |
|---|---|---|---|---|---|---|---|---|---|---|
| 304 | wt | wt | ++ | wt | wt | wt | wt | wt | wt | + |
| 306 | wt | wt | + | wt | wt | wt | wt | wt | wt | + |
| 311 | wt | wt | ++ | wt | wt | wt | wt | wt | wt | + |
| 313 | wt | wt | + | wt | wt | wt | wt | wt | wt | + |
| 325 | wt | wt | ++ | wt | wt | wt | wt | wt | wt | + |
| 327 | wt | wt | + | wt | wt | wt | wt | wt | wt | + |
| 345 | wt | wt | ++ | wt | wt | wt | wt | wt | wt | + |
| 350 | wt | wt | + | wt | wt | wt | wt | wt | wt | + |
| 351 | wt | wt | + | wt | wt | wt | wt | wt | wt | + |
| 353 | wt | wt | ++ | wt | wt | wt | wt | wt | wt | + |

Potential Applications

Based on the tolerance of 35S::G1816 lines to osmotic stress, G682 and related sequences such as G1816 are good candidates for use in the alleviation of drought related stress. The strong performance of 35S::G1816 lines on plates containing high levels of sugar particularly suggests that the gene might also be applied to manipulate sugar-sensing responses. The decrease in size seen in some of the lines, suggests that optimization of stress tolerance gene might benefit by use of different promoters or protein modifications.

The epidermal phenotypes seen in 35S::G1816 lines indicate that the gene could also be used to modify developmental characters such as the formation of trichomes or root hairs.

G1820 (SEQ ID NO: 341 and 342)

G1820 is a member of the Hap5 subfamily of CCAAT-box-binding transcription factors. G1820 was identified as part of leaf plastochrons sooner than those of wild type. Such effects were observed in all three T2 populations and in a substantial number of primary transformants.

When biochemical assays were performed, some changes in leaf fames were detected. In one line, an increase in the percentage of 18:3 and a decrease in 16:1 were observed. G1820 overexpressors behaved similarly to wild-type controls in other biochemical assays. As determined by RT-PCR, G1820 was highly expressed in embryos and siliques. No expression of G1820 was detected in the other tissues tested. G1820 expression appeared to be induced in rosette leaves by cold and drought stress treatments, and overexpressing lines showed tolerance to water deficit and high salt conditions.

One possible explanation for the complexity of the G1820 overexpression phenotype is that the gene is involved in the cross talk between ABA and GA signal transduction pathways. It is well known that seed dormancy and germination are regulated by the plant hormones abscisic acid (ABA) and gibberellin (GA). These two hormones act antagonistically with each other. ABA induces seed dormancy in maturing embryos and inhibits germination of seeds. GA breaks seed dormancy and promotes germination. It is conceivable that the flowering time and ABA insensitive phenotypes observed in the G1820 overexpressors are related to an enhanced sensitivity to GA, or an increase in the level of GA, and that the phenotype of the overexpressors is unrelated to ABA. In Arabidopsis, GA is thought to be required to promote flowering in non-inductive photoperiods. However, the drought and salt tolerant phenotypes would indicate that ABA signal transduction is also perturbed in these plants. It seems counterintuitive for a plant with salt and drought tolerance to be ABA insensitive since ABA seems to activate signal transduction pathways involved in tolerance to salt and dehydration stresses. One explanation is that ABA levels in the G1820 overexpressors are also high but that the plant is unable to perceive or transduce the signal.

G1820 overexpressors also had decreased seed oil content and increased seed protein content compared to wild-type plants relative to control plants.

Potential Applications

G1820 or equivalog overexpression may be used to alter seed protein content, which may be very important for the nutritional value and production of various food products G1836 (SEQ ID NO: 343 and 344)

G1836 was identified in the sequence of BAC F14123, GenBank accession number AC007399, released by the Arabidopsis Genome Initiative. G1836 and closely-related clade member sequences each comprise a conserved CCAAT binding domain that is expected to function in a similar manner in each of these related sequences, that is, by playing a central role in transcriptional regulation and in the conferring of shared traits.

Experimental Observations

The complete sequence of G1836 was determined. The function of this gene was analyzed using transgenic plants in which G1836 was expressed under the control of the 35S promoter. Morphologically, the plants were somewhat paler than the wild-type controls. This observation did not translate into a detectable difference in the chlorophyll a or chlorophyll b content in these transgenics (see biochemistry data). Overexpression of G1836 affected the plants' ability to tolerate high concentrations of salt in a germination assay. All of the

TABLE 24

G1820 35S, 2-components-supTfn

| Line | Germ. in high NaCl | Germ. in high mannitol | Sucrose | ABA | Germ. in heat | Germ. in cold | Growth in heat | Drought | Chilling |
|---|---|---|---|---|---|---|---|---|---|
| 305 | wt | wt | + | ++ | wt | + | wt | wt | + |
| 310 | wt | wt | wt | + | wt | wt | wt | wt | wt |
| 321 | wt | wt | + | + | wt | + | wt | wt | wt |
| 323 | wt | wt | wt | wt | wt | wt | wt | wt | wt |
| 325 | wt | wt | wt | + | wt | wt | wt | wt | + |
| 326 | wt | wt | + | + | wt | wt | wt | wt | wt |
| 327 | wt | wt | wt | wt | wt | wt | wt | wt | wt |
| 341 | ++ | + | + | ++ | wt | + | wt | wt | wt |
| 343 | ++ | + | + | ++ | wt | wt | wt | wt | wt |
| 352 | ++ | + | + | + | wt | wt | wt | wt | wt |

Potential Applications

G1820 affects ABA sensitivity, and thus when transformed into a plant this transcription factor or its equivalogs may diminish cold, drought, oxidative and other stress sensitivities, and also be used to alter plant architecture, and yield.

The osmotic stress and cold assay results indicate that G481 and related sequences, including G1820, could be used to alter a plant's response to water deficit and can be used to engineer plants with enhanced tolerance to drought, salt stress, and freezing.

G1820 or its equivalogs may also be used to increase a plant's tolerance to cold.

G1820 or its equivalogs could also be used to accelerate flowering time.

G1820 or its equivalogs may be used to modify levels of saturation in oils.

G1820 or its equivalogs may be used to seed protein content.

The promoter of G1820 could be used to drive seed-specific gene expression.

lines showed greater expansion of the cotyledons when seeds are germinated on MS media containing high concentrations of NaCl, indicating they had more tolerance to salt stress compared to the wild-type controls. There was no enhanced tolerance to high salt in older seedlings in a root growth assay. This was not unexpected because salt tolerance in the two developmental stages in often uncoupled in nature indicating mechanistic differences.

G1836 overexpression also resulted in plants that were more drought tolerant than wild-type control plants.

Expression of G1836 was also repressed by Erysiphe orontii infection.

Relative to control plants, seven of ten lines tested in a recent series of plate-based assays showed enhanced abiotic stress tolerance, as indicated in Table 25. These results included six lines with improved salt tolerance, and several of the lines showed altered sugar sensing in sucrose- and mannitol-based assays, less sensitivity to ABA, and improved tolerance to cold in germination and chilling assays relative to control plants.

TABLE 25

G1836 35S, 2 components-supTfn

| Line | Germ. in high NaCl | Germ. in high mannitol | Sucrose | ABA | Germ. in heat | Germ. in cold | Growth in heat | Drought | Chilling |
|---|---|---|---|---|---|---|---|---|---|
| 306 | + | wt | + | ++ | wt | wt | wt | wt | + |
| 362 | wt | wt | wt | wt | wt | wt | wt | wt | wt |
| 363 | wt | wt | wt | wt | wt | wt | wt | wt | wt |
| 365 | wt | wt | wt | wt | wt | wt | wt | wt | wt |
| 367 | wt | wt | wt | wt | wt | ++ | wt | wt | + |
| 381 | + | wt | + | + | wt | wt | wt | wt | + |
| 383 | + | wt | wt | wt | wt | wt | wt | wt | + |
| 384 | + | wt | + | + | wt | wt | wt | wt | wt |
| 385 | + | + | + | wt | wt | wt | wt | wt | wt |
| 386 | + | wt | + | + | wt | wt | wt | wt | wt |

Potential Applications

The results of these abiotic stress assays indicate that G1836 can be used to increase plant tolerance to drought, soil salinity and cold conditions during germination or at the seedling stage. The results of these studies confirm our earlier conclusions that G481 and its related genes, including G1836, are excellent candidates for improvement of drought and cold-related stress tolerance in plants.

G1930 (SEQ ID NO: 369 and 370)

G1930 was identified in the sequence of P1 clone K13N2 (gene K13N2.7, GenBank protein accession number BAA95760). G1930 and closely-related clade member sequences each comprise a conserved AP2 domain that is expected to function in a similar manner in each of these related sequences, that is, by playing a central role in transcriptional regulation and in the conferring of shared traits.

Experimental Observations

G1930 was ubiquitously expressed and did not appear to be induced by any of the conditions tested.

We generated 35S::G1930 lines via both the direct promoter-fusion and the 2-component methods. Both types of lines exhibited a variety of morphological phenotypes including reduced size, slow growth, and alterations in leaf orientation. In some lines, changes in leaf shape, hypocotyl length, trichome density, flowering time and non-specific floral abnormalities that reduced fertility were also observed.

We tested both two component and direct promoter-fusion lines under a variety of plate based treatments. Comparable results were obtained with both types of lines, but the 2-component lines generally showed stronger phenotypes, suggesting perhaps, that this system afforded an amplification of G1930 activity relative to the direct promoter-fusion. Relative to control plants, all twenty of the lines tested gave positive results in one or more of the stress treatments, including, sucrose, NaCl, ABA, cold germination and cold growth. Particularly strong resistance was seen in the NaCl and sucrose germination assays.

Relative to control plants, an increase in the amount of chlorophylls a and b in seeds of two T2 lines was detected.

We have obtained comparable developmental effects as well as a strong enhancement of drought related stress tolerance relative to control plants from all four of the *Arabidopsis* genes in the G867 study group (G9, G867, G993, and G1930). The almost identical phenotypic effects produced by these genes strongly suggest that they are functionally equivalent.

TABLE 26

G1930 35S, Direct promoter-fusion and 2-components-supTfn

| Line | Transformation | Germ. in high NaCl | Germ. in high mannitol | Sucrose | ABA | Germ in heat | Germ in cold | Growth in heat | Drought | Chilling |
|---|---|---|---|---|---|---|---|---|---|---|
| 304 | Direct fusion | + | wt | wt | wt | wt | wt | wt | wt | wt |
| 305 | Direct fusion | wt | wt | ++ | wt | wt | + | wt | wt | wt |
| 306 | Direct fusion | + | wt | wt | wt | wt | wt | wt | wt | + |
| 308 | Direct fusion | wt | wt | ++ | wt | wt | wt | wt | wt | + |
| 309 | Direct fusion | wt | wt | wt | wt | wt | wt | wt | wt | + |
| 311 | Direct fusion | wt | wt | + | wt | wt | + | wt | wt | + |
| 365 | Direct fusion | + | wt | ++ | wt | wt | wt | wt | wt | wt |
| 367 | Direct fusion | + | wt | ++ | wt | wt | wt | wt | wt | + |
| 369 | Direct fusion | + | wt | wt | wt | wt | wt | wt | wt | + |
| 370 | Direct fusion | + | wt | wt | wt | wt | wt | wt | wt | + |
| 321 | 2-comp | + | wt | ++ | wt | wt | wt | wt | wt | + |
| 322 | 2-comp | + | wt | + | + | wt | wt | wt | wt | + |
| 324 | 2-comp | + | wt | + | + | wt | wt | wt | wt | + |
| 327 | 2-comp | + | wt | + | wt | wt | wt | wt | wt | wt |

TABLE 26-continued

| | | G1930 35S, Direct promoter-fusion and 2-components-supTfn | | | | | | | |
|---|---|---|---|---|---|---|---|---|---|
| Line | Transformation | Germ. in high NaCl | Germ. in high mannitol | Sucrose | ABA | Germ in heat | Germ in cold | Growth in heat | Drought | Chilling |
| 329 | 2-comp | + | wt | + | wt | wt | wt | wt | wt | + |
| 331 | 2-comp | + | wt | ++ | + | wt | + | wt | wt | + |
| 332 | 2-comp | + | wt | + | + | wt | wt | wt | wt | wt |
| 334 | 2-comp | + | wt | wt | wt | wt | wt | wt | wt | wt |
| 336 | 2-comp | + | wt | ++ | + | wt | wt | wt | wt | + |
| 339 | 2-comp | + | wt | wt | wt | wt | wt | wt | wt | wt |

Potential Applications

Based on the results of our overexpression studies, G867 and related sequences such as G1930 are excellent candidate genes for improvement of abiotic stress tolerance in commercial plant species. The morphological effects associated with their overexpression indicate that tissue specific or conditional promoters might be used to optimize the utility of these genes.

This gene could also be used to regulate the levels of chlorophyll in seeds.

G2053 (SEQ ID NO: 389 and 390)

G2053 was identified in the sequence of BAC T27C4, GenBank accession number AC022287, released by the *Arabidopsis* Genome Initiative. G2053 and closely-related clade member sequences each comprise a conserved NAC domain that is expected to function in a similar manner in each of these related sequences, that is, by playing a central role in transcriptional regulation and in the conferring of shared traits.

Experimental Observations

The function of G2053 was analyzed using transgenic plants in which the gene was expressed under the control of the 35S promoter. In a root growth assay on media containing high concentrations of PEG, G2053 overexpressors showed more root growth compared to wild-type controls. G2053 overexpressors also were significantly more drought tolerant than wild-type control plants.

Potential Applications

G2053 or its equivalogs could be used to alter a plant's response water deficit conditions and, therefore, could be used to engineer plants with enhanced tolerance to drought, salt stress, and freezing.

G2133 (SEQ ID NO: 407 and 408)

G2133 corresponds to gene F26A9.11 (AAF23336).

Experimental Observations

The function of G2133 was studied using transgenic plants in which the gene was expressed under the control of the 35S promoter. G2133 and closely-related clade member sequences each comprise a conserved AP2 domain that is expected to function in a similar manner in each of these related sequences, that is, by playing a central role in transcriptional regulation and in the conferring of shared traits.

G2133 expression was detected in a variety of tissues: flower, leaf, embryo, and silique samples. Its expression might be altered by several conditions, including auxin treatment, osmotic stress, and *Fusarium* infection. Overexpression of G2133 caused a variety of alterations in plant growth and development: delayed flowering, altered inflorescence architecture, and a decrease in overall size and fertility. G2133 plants were more tolerant to glyphosate than wild-type control plants.

At early stages, 35S::G2133 transformants were markedly smaller than controls and displayed curled, dark-green leaves. Most of these plants remained in a vegetative phase of development substantially longer than controls, and produced an increased number of leaves before bolting. In the most severely affected plants, bolting occurred more than a month later than in wild type (24-hour light). In addition, the plants displayed a reduction in apical dominance and formed large numbers of shoots simultaneously, from the axils of rosette leaves. These inflorescence stems had short internodes, and carried increased numbers of cauline leaf nodes, giving them a very leafy appearance. The fertility of 35S::G2133 plants was generally very low. In addition, G2133 overexpressing lines were found to be more resistant to the herbicide glyphosate in initial and repeat experiments.

G2133 is a paralog of G47, the latter having been known from earlier studies to confer a drought tolerance phenotype when overexpressed. It was thus not surprising when G2133 was also shown to induce drought tolerance in a number of 35S::G2133 lines challenged in soil-based drought assays. After re-watering, all of the plants of both G2133 overexpressor lines became reinvigorated, and all of the control plants died or were severely affected by the drought treatment.

Potential Applications

G2133 and its equivalogs can be used to increase the tolerance of plants to drought and to other osmotic stresses. G2133 could also be used for the generation of glyphosate resistant plants, and to increase plant resistance to oxidative stress and glyphosate.

G2153 (SEQ ID NO: 417 and 418)

The sequence of G2153 was obtained from *Arabidopsis* genomic sequencing project, GenBank accession number AC011437, based on its sequence similarity within the conserved domain to other AT-hook related proteins in *Arabidopsis*. G2153 corresponds to gene F7O18.4 (AAF04888). G2153 and closely-related clade member sequences each comprise a conserved At-hook domain and a conserved second domain or DUF296 domain that is expected to function in a similar manner in each of these related sequences, that is, by playing a central role in transcriptional regulation and in the conferring of shared traits.

Experimental Observations

The complete sequence of G2153 was determined. G2153 was strongly expressed in roots, embryos, siliques, and germinating seed, but at low or undetectable levels in shoots, flowers, and rosette leaves. It was not significantly induced or repressed by any condition tested.

The function of this gene was analyzed using transgenic plants in which G2153 was expressed under the control of the 35S promoter. Overexpression of G2153 in *Arabidopsis* resulted in seedlings with an altered response to osmotic stress. In a germination assay on media containing high sucrose, G2153 overexpressors had more expanded cotyledons and longer roots than the wild-type controls. This phenotype was confirmed in repeat experiments on individual lines, and all three lines showed osmotic tolerance. Increased tolerance to high sucrose could also be indicative of effects on sugar sensing. Overexpression of G2153 produced no consistent effects on *Arabidopsis* morphology, and no altered phenotypes were noted in any of the biochemical assays.

Potential Applications

G2153 or its equivalogs can be improve a plant's response to drought, salt stress, and freezing.

G2153 or its equivalogs may also be useful for altering a plant's response to sugars.

G2155 (SEQ ID NO: 419 and 420)

The sequence of G2155 was obtained from *Arabidopsis* genomic sequencing project, GenBank accession number AC012188. G2155 and closely-related clade member sequences each comprise a conserved At-hook domain and a conserved second domain or DUF296 domain that are expected to function in a similar manner in each of these related sequences, that is, by playing a central role in transcriptional regulation and in the conferring of shared traits.

Experimental Observations

The complete sequence of G2155 was determined. G2155 expression was detected at low levels only in flowers and embryos. It was not induced in rosette leaves by any condition tested.

The function of this gene was analyzed using transgenic plants in which G2155 was expressed under the control of the 35S promoter. Overexpression of G2155 produced a marked delay in the time to flowering. Under continuous light conditions, 35S::G2155 transformants displayed a considerable extension of vegetative development, and typically formed flower buds about two weeks later than wild-type controls. At early stages, the plants were slightly small and had rather rounded leaves compared to wild type. However, later in development, when the leaves were fully expanded, 35S::G2155 plants became very large, dark-green, and senesced much later than controls.

In addition, overexpression of G2155 resulted in an increase in seed glucosinolate M39497 in two T2 lines. No other phenotypic alterations were observed in any of the biochemical or physiological assays.

Potential Applications

G2155 or equivalog overexpression may be used to delay flowering.

G2155 or its equivalogs could also be used to alter seed glucosinolate composition.

G2345 (SEQ ID NO: 2171 and 2172)

G2345 is a putative paralog of G481, and is a member of the HAP3 subgroup of the CCAAT transcription factor family. G2345 and closely-related clade member sequences each comprise a conserved CCAAT box-binding domain that is expected to function in a similar manner in each of these related sequences, that is, by playing a central role in transcriptional regulation and in the conferring of shared traits.

During our earlier program, we found that G2345-overexpressing plants were similar to wild-type plants in all assays performed. The aim of this study was to reassess the role of G2345 in drought stress related tolerance via two-component overexpression.

We have now generated 35S lines for G2345 using the two component system; three batches of T1 lines were obtained, including lines 301-302, 341-347, and 381-400. Some size variation was apparent in the second batch of plants (341-347), but otherwise, no consistent differences in morphology were observed compared to wild-type controls.

Relative to control plants, four of ten lines of overexpressors tested showed better germination in cold conditions than did wild-type control plants.

TABLE 27

| | G2345 35S, 2-components supTfn | | | | | | | | |
|---|---|---|---|---|---|---|---|---|---|
| Line | Germ. in high NaCl | Germ. in high mannitol | Sucrose | ABA | Germ. in heat | Germ. in cold | Growth in heat | Drought | Chilling |
| 301 | wt | wt | wt | wt | wt | wt | wt | wt | wt |
| 302 | wt | wt | wt | wt | wt | wt | wt | wt | wt |
| 341 | wt | wt | wt | wt | wt | wt | wt | wt | wt |
| 386 | wt | wt | wt | wt | wt | wt | wt | wt | wt |
| 387 | wt | wt | wt | wt | wt | wt | wt | wt | wt |
| 389 | wt | wt | wt | wt | wt | + | wt | wt | wt |
| 390 | wt | wt | wt | wt | wt | + | wt | wt | wt |
| 392 | wt | wt | wt | wt | wt | wt | wt | wt | wt |
| 393 | wt | wt | wt | wt | wt | + | wt | wt | wt |
| 400 | wt | wt | wt | wt | wt | + | wt | wt | wt |

Potential Applications

The results of the cold germination assay confirm that G481 and its related sequences, including G2345, are excellent candidates for improving abiotic stress tolerance in plants.

G2509 (SEQ ID NO: 439 and 440)

G2509 corresponds to gene T2I1_20 (CAB87920). G2509 and closely-related clade member sequences each comprise a conserved AP2 domain that is expected to function in a similar manner in each of these related sequences, that is, by playing a central role in transcriptional regulation and in the conferring of shared traits.

Experimental Observations

G2509 (SEQ ID NO: 439) was studied using transgenic plants in which the gene was expressed under the control of the 35S promoter. Overexpression of G2509 caused multiple alterations in plant growth and development, most notably, altered branching patterns, and a reduction in apical dominance, giving the plants a shorter, bushier stature than wild type. Twenty 35S::G2509 primary transformants were examined; at early stages of rosette development, these plants displayed a wild-type phenotype. However, at the switch to flowering, almost all T1 lines showed a marked loss of apical dominance and large numbers of secondary shoots developed from axils of primary rosette leaves. In the most extreme cases, the shoots had very short internodes, giving the inflorescence a very bushy appearance. Such shoots were often very thin and flowers were relatively small and poorly fertile. At later stages, many plants appeared very small and had a low seed yield compared to wild type. In addition to the effects on branching, a substantial number of 35S::G2509 primary transformants also flowered early and had buds visible several days prior to wild type. Similar effects on inflorescence development were noted in each of three T2 populations examined. The branching and plant architecture phenotypes observed in 35S::G2509 lines resemble phenotypes observed for three other AP2/EREBP genes: G865, G1411, and G1794. G2509, G865, and G1411 form a small clade within the large AP2/EREBP family, and G1794, although not belonging to the clade, is one of the AP2/EREBP genes closest to it in the phylogenetic tree. It is thus likely that all these genes share a related function, such as affecting hormone balance.

G2509 overexpressing plants had increased seed protein compared to wild-type control plants.

Overexpression of G2509 in *Arabidopsis* resulted in an increase in alpha-tocopherol in seeds in two T2 lines. G2509 was ubiquitously expressed in *Arabidopsis* plant tissue. G2509 expression levels were altered by a variety of environmental or physiological conditions.

Potential Applications

G2509 or its equivalogs can be used to manipulate plant architecture and development, alter tocopherol composition, and flowering time.

G2583 (SEQ ID NO: 449 and 450)

G2583 corresponds to gene F2I11_80 (CAB96654). G2583 and closely-related clade member sequences each comprise a conserved AP2 domain that is expected to function in a similar manner in each of these related sequences, that is, by playing a central role in transcriptional regulation and in the conferring of shared traits.

equivalogs can be used to manipulate wax composition, amount, or distribution, which in turn can modify plant tolerance to drought and/or low humidity or resistance to insects.

G2718 (SEQ ID NO: 2191 and 2192)

G2718 was included in our earlier studies as a putative paralog of G682. G2718 and closely-related clade member sequences each comprise a conserved Myb-related domain that is expected to function in a similar manner in each of these related sequences, that is, by playing a central role in transcriptional regulation and in the conferring of shared traits.

A genetic analysis of G2718 function has not yet been published. The aim of this study was to re-assess 35S::G2718 lines and determine whether overexpression of the gene could confer enhanced stress tolerance in a comparable manner to G682. We also sought to examine whether use of a two-component overexpression system would produce any strengthening of the phenotype relative to the use of a 35S direct promoter-fusion.

We have now generated 35S::G2718 lines using the two component system. These lines showed a strong glabrous phenotype, similar to what was observed during our earlier studies, and similar to the effect produced by G682 overexpression. Relative to control plants, all of the lines tested were more tolerant to high sucrose in an osmotic stress assay.

TABLE 28

| | G1816 35S, 2-components supTfn | | | | | | | | | |
|---|---|---|---|---|---|---|---|---|---|---|
| Line | Germ. in high NaCl | Germ. in high mannitol | Sucrose | ABA | Germ in heat | Germ in cold | Growth in heat | Drought | Chilling | G682-like root morph. |
| 311 | wt | wt | ++ | + | wt | wt | wt | wt | wt | = |
| 345 | wt | wt | ++ | + | wt | wt | wt | wt | wt | + |
| 325 | wt | wt | ++ | wt | wt | wt | wt | wt | wt | + |
| 351 | wt | wt | + | wt | wt | wt | wt | wt | wt | + |
| 327 | wt | wt | + | wt | wt | wt | wt | wt | wt | + |
| 306 | wt | wt | + | wt | wt | wt | wt | wt | wt | + |
| 304 | wt | wt | ++ | wt | wt | wt | wt | wt | wt | + |
| 353 | wt | wt | ++ | wt | wt | wt | wt | wt | wt | + |
| 313 | wt | wt | + | wt | wt | wt | wt | wt | wt | + |
| 350 | wt | wt | + | wt | wt | wt | wt | wt | wt | + |

Experimental Observations

35S::G2583 plants exhibited extremely glossy leaves. At early stages, 35S::G2583 seedlings appeared normal, but by about two weeks after sowing, the plants exhibited very striking shiny leaves, which were apparent until very late in development. Many lines displayed a variety of other effects such as a reduction in overall size, narrow curled leaves, or various non-specific floral abnormalities, which reduced fertility. These effects on leaf appearance were observed in 18 of 20 primary transformants, and in all the plants from 4 of 6 T2 lines. The glossy nature of the leaves may be a consequence of changes in epicuticular wax content or composition. G2583 belongs to a small clade within the large AP2/EREBP Arabidopsis family that also contains G975, G1387, and G977. G975 overexpression causes a substantial increase in leaf wax and a morphology resembling that of 35S::G2583 plants. G2583 was ubiquitously expressed at higher levels in root, flower, embryo, and siliques.

Potential Applications

G2583 or its equivalogs can be used to modify plant appearance by producing shiny leaves. In addition, it or its Potential Applications Based on the tolerance of 35S::G1816 lines to osmotic stress, G682 and related sequences such as G1816 are good candidates for use in the alleviation of drought related stress. The strong performance of 35S::G1816 lines on plates containing high levels of sugar particularly suggests that the gene might also be applied to manipulate sugar-sensing responses. However, the decrease in size seen in some of the lines, suggests that the gene might require optimization by use of different promoters or protein modifications, prior to product development.

The epidermal phenotypes seen in 35S::G1816 lines indicate that the gene could also be used to modify developmental characters such as the formation of trichomes or root hairs.

Rice G3377 (SEQ ID NO: 1221 and 2934)

G3377 is a rice gene that was identified as being a putative ortholog of G912. G3377 and closely-related clade member sequences each comprise a conserved AP2 domain that is expected to function in a similar manner in each of these related sequences, that is, by playing a central role in transcriptional regulation and in the conferring of shared traits.

The aim of this project was to determine whether G3377 has an equivalent function to G912 via the analysis of 35S::G3377 Arabidopsis lines. 35S::G3377 overexpressors were obtained at relatively low frequency. The lines that were recovered showed a number of striking morphological effects including a reduction in size, dark coloration and delayed flowering. Such features were somewhat comparable to those shown by 35S::G912 lines, indicating that the two genes likely have a similar function.

Lines of plants overexpressing these rice sequences were shown to have increased germination in high salt, mannitol, sucrose and hot conditions, relative to control plants, as seen in the following table.

The results of the abiotic stress assays confirm that G912 and its related sequences, including the rice G3377 sequence, are excellent candidates for improving abiotic stress tolerance in plants.

Rice G3392 (SEQ ID NO: 1082 and 2920)

G3392 is a rice gene that was identified as being a putative ortholog of G682. The aim of this project was to determine whether G3392 has an equivalent function to the G682-related genes from Arabidopsis via the analysis of 35S::G3392 Arabidopsis lines. G3392 and closely-related clade member sequences each comprise a conserved Myb-related domain that is expected to function in a similar manner in each of

TABLE 29

G3377 35S, Direct promoter-fusion

| Line | Germ. in high NaCl | Germ. in high mannitol | Sucrose | ABA | Germ. in heat | Germ. in cold | Growth in heat | Drought | Chilling |
|---|---|---|---|---|---|---|---|---|---|
| 382 | + | + | + | wt | wt | + | wt | + | |
| 383 | wt | + | + | wt | wt | + | wt | wt | wt |
| 384 | wt | wt | wt | wt | + | wt | wt | wt | wt |
| 385 | wt | wt | wt | wt | wt | wt | wt | wt | wt |
| 386 | wt | wt | + | wt | wt | wt | wt | wt | + |
| 388 | wt | wt | wt | wt | wt | wt | wt | wt | wt |
| 389 | wt | wt | wt | wt | + | + | wt | wt | wt |
| 390 | wt | wt | wt | wt | wt | + | wt | wt | + |
| 391 | wt | wt | wt | wt | wt | wt | wt | wt | wt |
| 392 | wt | wt | wt | wt | wt | + | wt | wt | wt |

Potential Applications

Given the comparable morphological effects of G3377 and G912 overexpression, it is probable that the genes have comparable roles.

The delayed flowering exhibited by 35S::G3377 lines suggest that the gene might also be applied to modify flowering time; in particular, an extension of vegetative growth can significantly increase biomass and result in substantial yield increases. In some species (for example sugar beet), where the vegetative parts of the plant constitute the crop, it would be advantageous to delay or suppress flowering in order to prevent resources being diverted into reproductive development. Additionally, delaying flowering beyond the normal time of harvest could alleviate the risk of transgenic pollen escape from such crops.

these related sequences, that is, by playing a central role in transcriptional regulation and in the conferring of shared traits.

We have now generated 35S::G3392 lines; these plants showed comparable morphological effects to 35S::G682 lines and exhibited a glabrous phenotype combined with a reduction in overall size. Such similarities in phenotypes suggest that the genes have similar functions. Interestingly, many of the 35S::G3392 lines also produced pale yellow seed, which likely indicated a reduction in anthocyanin levels in the seed coat. Such an effect was not observed 35S::G682 seed, but G682 and its paralogs were found during our genomics studies to inhibit anthocyanin production. 35S::G3392 plants were more tolerant to a wide range of abiotic stresses relative to control plants, as shown in the table below.

TABLE 30

3392 35S, Direct promoter-fusion

| Line | Germ in high NaCl | Germ. in high mannitol | Sucrose | ABA | Germ in heat | Germ in cold | Heat growth | Drought | Chilling | G682-like root morph. |
|---|---|---|---|---|---|---|---|---|---|---|
| 301 | wt | wt | wt | wt | wt | + | wt | + | + | + |
| 305 | wt | wt | + | wt | wt | + | wt | + | + | + |
| 306 | + | wt | + | wt | wt | + | − | + | + | + |
| 321 | wt | wt | + | wt | wt | + | wt | + | + | + |
| 322 | + | wt | wt | wt | wt | + | − | wt | + | + |
| 341 | wt | + | + | wt | wt | + | wt | + | + | + |
| 342 | + | + | ++ | wt | wt | + | wt | + | + | + |
| 346 | wt | + | + | wt | wt | + | wt | + | + | + |
| 347 | wt | wt | wt | wt | wt | + | wt | + | + | + |
| 348 | wt | wt | + | wt | wt | + | wt | + | + | + |

Potential Applications

The results of these abiotic stress assays confirm that G682 and its related sequences, including the rice G3392 sequence, are excellent candidates for improving abiotic stress tolerance in plants.

The effect of G3392 on epidermal patterning indicates that the gene could be applied to manipulate trichome development; in some species trichomes accumulate valuable secondary metabolites and in other instances are thought to provide protection against predation. The lighter coloration of 35S::G3392 plants could indicate that G3392 might be used to regulate the production of flavonoid related compounds, which contribute to the nutritional value of foodstuffs.

Rice G3393 (SEQ ID NO: 559 and 2921)

G3393 is a putative rice ortholog of G682. G3393 and closely-related clade member sequences each comprise a conserved Myb-related domain that is expected to function in a similar manner in each of these related sequences, that is, by playing a central role in transcriptional regulation and in the conferring of shared traits.

35S::G3393 lines plants showed comparable morphological effects to 35S::G682 lines and exhibited a glabrous phenotype combined with a reduction in overall size. These similarities in phenotypes suggest that the genes have similar functions. Many of the 35S::G3393 lines also produced pale yellow seed, which likely indicated a reduction in anthocyanin levels in the seed coat. Such an effect was not observed 35S::G682 seed, but we did find that G682 and its paralogs inhibited anthocyanin production.

G3393 overexpressors were much more tolerant to chilling conditions than control plants, and one line was more tolerant to sucrose than controls. Relative to control plants, two lines of *Arabidopsis* 35S::G3393 overexpressors recovered better from a soil drought treatment than control plants.

TABLE 31

G3393 35S, Direct promoter-fusion

| Line | Germ in high NaCl | Germ. in high mannitol | Sucrose | ABA | Germ in heat | Germ in cold | Heat growth | Drought | Chilling | G682-like root morph. |
|---|---|---|---|---|---|---|---|---|---|---|
| 305 | wt | wt | + | wt | wt | wt | − | wt | ++ | + |
| 307 | wt | wt | wt | wt | wt | wt | − | wt | + | + |
| 308 | wt | wt | wt | wt | wt | wt | − | wt | ++ | + |
| 323 | wt | wt | wt | wt | wt | wt | wt | wt | + | + |
| 324 | wt | wt | wt | wt | wt | wt | wt | wt | + | + |
| 326 | wt | wt | wt | wt | wt | wt | wt | wt | + | + |
| 327 | wt | wt | wt | wt | wt | wt | wt | wt | ++ | + |
| 328 | wt | wt | wt | wt | wt | wt | wt | wt | ++ | + |
| 331 | wt | wt | wt | wt | wt | wt | wt | wt | wt | + |
| 333 | wt | wt | wt | wt | wt | wt | wt | wt | + | + |

Potential Applications

The results of the cold germination and sucrose assays confirm that G682 and its related sequences, including the rice G3393 sequence, are excellent candidates for improving abiotic stress tolerance in plants.

The effect of G3393 on epidermal patterning indicates that the gene could be applied to manipulate trichome development; in some species trichomes accumulate valuable secondary metabolites and in other instances are thought to provide protection against predation. The lighter coloration of 35S::G3393 plants could indicate that G3393 might be used to regulate the production of flavonoid related compounds, which contribute to the nutritional value of foodstuffs.

Rice G3395 (SEQ ID NO: 790 and 2910)

G3395 is an ortholog of G481 from Oryza sativa. G3395 is a member of the HAP3 subgroup of the CCAAT box-binding transcription factor family and corresponds to OsHAP3A and has been recently been shown to influence chloroplast biogenesis (Miyoshi et al. (2003) Plant J. 36: 532-540). G3395 and closely-related clade member sequences each comprise a conserved CCAAT box-binding domain that is expected to function in a similar manner in each of these related sequences, that is, by playing a central role in transcriptional regulation and in the conferring of shared traits.

We have previously indicated that overexpression of G3395 conferred a salt tolerant phenotype in *Arabidopsis* plants (U.S. patent application Ser. No. 10/675,852, filed Sep. 30, 2003).

Experimental Observations

The aim of the present study was to assess the role of G3395 in drought stress-related tolerance via overexpression, and compare the effects with that of the other G481 orthologs and paralogs.

The majority of 35S::G3395 plants showed a very slight acceleration in flowering time, but a single line showed slightly late flowering. Relative to control plants, one G3395-overexpressing line was shown to have improved tolerance to drought in a plate-based assay. The same line also showed increased tolerance to high salt concentration relative to wild-type or non-transformed controls, confirming the prior observed result.

Potential Applications

The results of this drought assay confirm that G481 and its related sequences, including the rice sequence G3395, are excellent candidates for improving abiotic stress tolerance in plants.

Rice G3397 (SEQ ID NO: 794 and 2911)

G3397, an ortholog of G481 from *Oryza sativa*, is a member of the HAP3 subgroup of the CCAAT box-binding transcription factor family. This gene is phylogenetically most closely related to G485, another member of the HAP3 subgroup. G3397 corresponds to OsHAP3C and has been recently been shown to influence chloroplast biogenesis (Miyoshi et al. (2003) supra). G3397 and closely-related clade member sequences each comprise a conserved CCAAT box-binding domain that is expected to function in a similar manner in each of these related sequences, that is, by playing a central role in transcriptional regulation and in the conferring of shared traits.

Experimental Observations

The aim of this study was to assess the role of G3397 in drought stress-related tolerance via overexpression, and compare the effects with that of the other G481 orthologs and paralogs.

35S::G3397 plants showed a 1-2 week acceleration in flowering time, compared to wild-type or non-transformed plants. This same phenotype was also noted for the most closely related *Arabidopsis* gene G485. These early flowering lines also were smaller than controls. Ten lines were tested in plate-based physiology assays. One of these lines showed insensitivity to ABA, and another germinated better than wild-type or non-transformed plants in hot conditions. Four lines were more tolerant to cold during their germination than control plants.

TABLE 32

| | G3395 35S, Direct promoter-fusion | | | | | | | | |
|---|---|---|---|---|---|---|---|---|---|
| Line | Germ. in high NaCl | Germ. in high mannitol | Sucrose | ABA | Germ. in heat | Germ in cold | Growth in heat | Drought | Chilling |
| 301 | wt | wt | wt | wt | wt | wt | wt | wt | wt |
| 302 | + | wt | wt | wt | wt | wt | wt | + | wt |
| 303 | wt | wt | wt | wt | wt | wt | wt | wt | wt |
| 304 | wt | wt | wt | wt | wt | wt | wt | wt | wt |
| 305 | wt | wt | wt | wt | wt | wt | wt | wt | wt |
| 306 | wt | wt | wt | wt | wt | wt | wt | wt | wt |
| 307 | wt | wt | wt | wt | wt | wt | wt | wt | wt |
| 308 | wt | wt | wt | wt | wt | wt | wt | wt | wt |
| 309 | wt | wt | wt | wt | wt | wt | wt | wt | wt |
| 310 | wt | wt | wt | wt | wt | wt | wt | wt | wt |

TABLE 33

G3397 35S, Direct promoter-fusion

| Line | Germ. in high NaCl | Germ. in high mannitol | Sucrose | ABA | Germ. in heat | Germ. in cold | Growth in heat | Drought | Chilling |
|---|---|---|---|---|---|---|---|---|---|
| 322 | wt | wt | wt | wt | wt | wt | wt | wt | wt |
| 323 | wt | wt | wt | wt | wt | wt | wt | wt | wt |
| 324 | wt | wt | wt | wt | wt | wt | wt | wt | wt |
| 326 | wt | wt | wt | + | wt | wt | wt | wt | wt |
| 328 | wt | wt | wt | wt | wt | + | wt | wt | wt |
| 330 | wt | wt | wt | wt | wt | + | wt | wt | wt |
| 334 | wt | wt | wt | wt | wt | + | wt | + | wt |
| 335 | wt | wt | wt | wt | wt | + | wt | wt | wt |
| 338 | wt | wt | wt | wt | wt | wt | wt | wt | wt |
| 339 | wt | wt | wt | wt | + | wt | wt | + | wt |

Potential Applications

The results of the heat and ABA germination assays confirm that G481 and its related sequences, including the rice sequence G3397, are excellent candidates for improving abiotic stress tolerance in plants.

Rice G3398 (SEQ ID NO: 796 and 2912)

G3398 from *Oryza sativa* is related to G481, and phylogenetically most closely related to G485. Like G481 and G485, G3398 is a member of the HAP3 subgroup of the CCAAT box-binding transcription factor family. G3398 and closely-related clade member sequences each comprise a conserved CCAAT box-binding domain that is expected to function in a similar manner in each of these related sequences, that is, by playing a central role in transcriptional regulation and in the conferring of shared traits.

Experimental Observations

The aim of this study was to assess the role of G3398 in drought stress-related tolerance via overexpression, and compare the effects with that of the other G481 orthologs and paralogs.

35S::G3398 plants showed a 1-2 week acceleration in flowering time, compared to wild-type or non-transformed plants. This same phenotype was also noted for the most closely related *Arabidopsis* gene, G485. These early flowering lines also were smaller than controls.

In the most recent study, six lines overexpressing G3398 have thus far been tested in physiological assays. One line was shown to germinate better in heat than wild-type or non-transformed controls. Four of six lines were more tolerant to drought stress in a soil-based assay.

Potential Applications

The results of the heat germination assay confirm that G481 and its related sequences, including the rice G3398 sequence, are excellent candidates for improving abiotic stress tolerance in plants.

Rice G3399 (SEQ ID NO: 1399 and 2937)

G3399 identified as a putative rice ortholog of G1073. Phylogenetic analysis identifies G3399 along with G3400 as being the most closely related orthologs to G1073. G3399 and closely-related clade member sequences each comprise at least one conserved At-Hook domain and at least one DUF296 or second conserved domain that are expected to function in a similar manner in each of these related sequences, that is, by playing a central role in transcriptional regulation and in the conferring of shared traits.

The aim of this project is to determine whether overexpression of G3399 in *Arabidopsis* produces comparable effects to those of G1073 overexpression. 35S::G3399 lines have been obtained containing either of two different constructs. Both constructs produced similar morphological phenotypes; many of the lines were small at early stages, showed alterations in leaf shape, and had slightly delayed flowering. However a significant number of lines developed enlarged lateral organs (leaves and flowers), particularly at later stages.

It is noteworthy that one of the constructs (P21269) contained an amino acid conversion (proline to a glutamine at residue 198, in a conserved domain) relative to the native protein. Lines for this mutated protein showed fewer undesirable morphologies than the wild type version.

TABLE 34

G3398 35S, Direct promoter-fusion

| Line | Germ. in high NaCl | Germ. in high mannitol | Sucrose | ABA | Germ. in heat | Germ. in cold | Growth in heat | Drought | Chilling |
|---|---|---|---|---|---|---|---|---|---|
| 303 | wt | wt | wt | wt | + | wt | − | wt | wt |
| 323 | wt | wt | wt | wt | wt | wt | wt | wt | wt |
| 324 | wt | wt | wt | wt | wt | wt | wt | wt | wt |
| 329 | wt | wt | wt | wt | wt | wt | wt | wt | wt |
| 332 | wt | wt | wt | wt | wt | wt | wt | wt | wt |
| 335 | wt | wt | wt | wt | wt | wt | wt | wt | wt |

The morphologically similar effects caused by overexpression of this rice gene versus G1073 and the *Arabidopsis* paralogs, suggest that they likely have related functions.

TABLE 35

G3399 35S, Direct promoter-fusion

| Line | Germ. in high NaCl | Germ. in high mannitol | Sucrose | ABA | Germ. in heat | Germ. in cold | Growth in heat | Drought | Chilling |
|---|---|---|---|---|---|---|---|---|---|
| 321 | wt | wt | wt | wt | wt | wt | wt | wt | wt |
| 322 | wt | wt | wt | wt | wt | wt | wt | wt | wt |
| 323 | wt | wt | wt | wt | wt | wt | wt | wt | wt |
| 325 | wt | wt | wt | wt | ++ | wt | wt | wt | wt |
| 330 | wt | wt | wt | wt | wt | wt | wt | wt | wt |
| 331 | wt | wt | wt | wt | wt | wt | wt | wt | wt |
| 332 | wt | wt | wt | wt | wt | wt | wt | wt | wt |
| 336 | wt | wt | wt | wt | wt | wt | wt | wt | wt |
| 338 | wt | wt | wt | wt | + | wt | wt | wt | wt |
| 340 | wt | wt | wt | wt | wt | wt | wt | wt | wt |
| 347 | wt | wt | wt | wt | wt | wt | wt | wt | + |
| 348 | wt | wt | wt | wt | wt | wt | wt | wt | + |

Potential Applications

The morphological phenotype induced by G3399 indicates that the gene could be used to modify traits such as organ size and flowering time. This study also identified a specific region of the G3399 protein that might be modified in order to optimize the acquisition of desirable phenotypes. In cases where the increased size conferred by G3399 overexpression would be undesirable, the morphological changes caused by G3440 overexpression may optimized by the use of, for example, inducible or tissue specific promoters.

The results of the heat germination and chilling assays confirm that G1073 and its related sequences, including the rice G3399 sequence, are excellent candidates for improving abiotic stress tolerance in plants.

Rice G3429 (SEQ ID NO: 2945 and 2946)

G3429 from *Oryza sativa* is a gene related to G481. From our phylogenetic analysis, G3429 appears to be more distantly related to G481 than the other non-Arabidopsis genes in this study (FIG. 3). The gene encodes a protein corresponding to OsNF-YB1 and has been shown to form a ternary complex with a MADS protein OsMADS18 (Masiero et al. (2002) *J. Biol. Chem.* 277: 26429-26435). G3429 and closely-related clade member sequences each comprise a conserved CCAAT box-binding conserved domain that is expected to function in a similar manner in each of these related sequences, that is, by playing a central role in transcriptional regulation and in the conferring of shared traits.

Experimental Observations

The aim of this project was to assess the role of G3429 in drought stress-related tolerance, and compare the effects with those of the G481 related genes.

Out of twenty 35S::G3429 T1 plants examined, six were notably late flowering and had narrow leaves compared to wild-type or non-transformed plants.

Six of ten G3429-overexpressing lines were more tolerant to high salt conditions than wild-type or non-transformed plants.

TABLE 36

G3429 35S, Direct promoter-fusion

| Line | Germ. in high NaCl | Germ. in high mannitol | Sucrose | ABA | Germ. in heat | Germ. in cold | Growth in heat | Drought | Chilling |
|---|---|---|---|---|---|---|---|---|---|
| 301 | wt | wt | wt | wt | wt | wt | wt | wt | wt |
| 302 | + | wt | wt | wt | − | wt | wt | wt | wt |
| 304 | + | wt | wt | wt | wt | wt | wt | wt | wt |
| 305 | + | wt | wt | wt | wt | wt | wt | wt | wt |
| 308 | wt | wt | wt | wt | wt | wt | wt | wt | wt |
| 310 | wt | wt | wt | wt | wt | wt | wt | wt | wt |
| 311 | wt | wt | wt | wt | wt | wt | wt | wt | wt |
| 312 | + | wt | wt | wt | wt | wt | wt | wt | wt |
| 313 | + | wt | wt | wt | wt | wt | wt | wt | wt |
| 319 | + | wt | wt | wt | wt | wt | wt | wt | wt |

Potential Applications

The results of the heat germination and chilling assays confirm that G481 and its related sequences, including the rice G3429 sequence, are excellent candidates for improving abiotic stress tolerance in plants.

Corn G3431 (SEQ ID NO: 1089, 556 and 2922)

G3431 is a maize gene that was identified as being a putative ortholog of G682. G3431 and closely-related clade member sequences each comprise a conserved Myb-related domain that is expected to function in a similar manner in each of these related sequences, that is, by playing a central role in transcriptional regulation and in the conferring of shared traits.

The aim of this project was to determine whether G3431 has an equivalent function to the G682-related genes from Arabidopsis via the analysis of 35S::G3431 Arabidopsis lines. We have now generated 35S::G3431 lines; these plants showed comparable morphological effects to 35S::G682 lines and exhibited a glabrous phenotype combined with a reduction in overall size. These similarities in phenotypes suggest that the genes have similar functions. Interestingly, some of the 35S::G3431 lines also produced pale yellow seed, which likely indicated a reduction in anthocyanin levels in the seed coat. Such an effect was not observed 35S::G682 seed, but G682 and its paralogs were found during earlier genomics studies to inhibit anthocyanin production. Relative to control plants, G3431 overexpressing plants were shown to be more tolerant to sucrose, germination in heat, and chilling temperatures.

ondary metabolites and in other instances are thought to provide protection against predation. The lighter coloration of 35S::G3431 plants could indicate that G3431 might be used to regulate the production of flavonoid related compounds, which contribute to the nutritional value of foodstuffs.

Corn G3434 (SEQ ID NO: 806, and 2913)

G3434 is an ortholog of G481 and G482 from *Zea mays*, and is a member of the HAP3 subgroup of the CCAAT box-binding transcription factor family. Among the *Arabidopsis* paralogs in the G481/G482 study group, G3434 is phylogenetically most closely related to G481. G3434 and closely-related clade member sequences each comprise a conserved CCAAT box-binding domain that is expected to function in a similar manner in each of these related sequences, that is, by playing a central role in transcriptional regulation and in the conferring of shared traits.

TABLE 37

G3431 35S, Direct promoter-fusion

| Line | Germ in high NaCl | Germ. in high mannitol | Sucrose | ABA | Germ in heat | Germ in cold | Heat growth | Drought | Chilling | G682-like root morph. |
|---|---|---|---|---|---|---|---|---|---|---|
| 303 | wt | wt | wt | wt | + | wt | wt | wt | ++ | + |
| 306 | wt | wt | wt | wt | + | wt | wt | wt | wt | − |
| 321 | wt | wt | + | wt | wt | wt | wt | wt | + | + |
| 322 | wt | wt | wt | wt | wt | wt | wt | wt | + | + |
| 325 | wt | wt | + | wt | wt | wt | wt | wt | + | + |
| 327 | wt | wt | + | wt | wt | wt | wt | wt | wt | + |
| 328 | wt | wt | + | wt | wt | wt | wt | wt | + | + |
| 331 | wt | wt | wt | wt | wt | wt | wt | wt | wt | wt |
| 333 | wt | wt | wt | wt | wt | wt | wt | wt | wt | wt |
| 340 | wt | wt | wt | wt | wt | wt | wt | wt | wt | + |

Potential Applications

The results of these abiotic stress assays confirm that G682 and its related sequences, including the corn G3431 sequence, are excellent candidates for improving abiotic stress tolerance in plants.

The effect of G3431 on epidermal patterning indicates that the gene could be applied to manipulate trichome development; in some species trichomes accumulate valuable sec- Experimental Observations The aim of this study is to assess the role of G3434 in drought stress-related tolerance via overexpression, and compare the effect with that of the other G481/G482 orthologs and paralogs. As seen in Table 38, 35S::G3434 lines showed enhanced salt tolerance and improved sugar sensing as compared to wild-type or non-transformed plants. Two of eight lines were more tolerant to drought in soil-based assays relative to control plants.

TABLE 38

G3434 35S, Direct promoter-fusion

| Line | Germ. in high NaCl | Germ. in high mannitol | Sucrose | ABA | Germ. in heat | Germ. in cold | Growth in heat | Drought | Chilling |
|---|---|---|---|---|---|---|---|---|---|
| 421 | wt | wt | wt | wt | wt | wt | wt | ++ | wt |
| 422 | + | wt | wt | wt | wt | wt | wt | wt | wt |
| 423 | wt | wt | wt | wt | wt | wt | wt | + | wt |
| 424 | wt | wt | wt | wt | wt | wt | wt | wt | wt |
| 426 | wt | wt | wt | wt | wt | wt | wt | wt | wt |
| 429 | + | + | + | wt | wt | wt | wt | wt | wt |
| 432 | wt | wt | wt | wt | wt | wt | wt | wt | wt |
| 434 | + | + | + | wt | wt | wt | wt | wt | wt |
| 435 | wt | wt | wt | wt | wt | wt | wt | wt | wt |
| 436 | wt | wt | wt | wt | wt | + | wt | + | wt |
| 448 | + | wt | wt | wt | wt | + | wt | + | wt |
| 441 | wt | wt | wt | wt | wt | wt | wt | wt | wt |
| 449 | + | + | wt | + | wt | + | + | wt | wt |
| 445 | wt | wt | wt | wt | wt | wt | wt | wt | wt |
| 446 | + | + | wt | wt | wt | wt | wt | + | wt |
| 443 | + | wt | + | + | wt | wt | wt | wt | wt |
| 442 | + | + | + | wt | wt | wt | wt | + | wt |
| 447 | wt | + | wt | wt | wt | wt | wt | wt | wt |
| 444 | + | wt | wt | wt | wt | wt | wt | + | wt |

Potential Applications

The results of these salt, mannitol and sucrose stress assays confirm that G481 and its related sequences, including the corn G3434 sequence, are excellent candidates for improving abiotic stress tolerance in plants.

Corn G3436 (SEQ ID NO: 805 and 2914)

G3436 from *Zea mays* is a putative ortholog of G481, and is a member of the HAP3 subgroup of the CCAAT box-binding transcription factor family. Among the *Arabidopsis* paralogs in the G481 study group, this gene is phylogenetically most closely related to G485. G3436 and closely-related clade member sequences each comprise a conserved CCAAT box-binding domain that is expected to function in a similar manner in each of these related sequences, that is, by playing a central role in transcriptional regulation and in the conferring of shared traits.

Experimental Observations

The aim of this study was to assess the role of G3436 in drought stress-related tolerance via overexpression, and compare the effects with that of the other G481 orthologs and paralogs.

Twenty lines of 35S::G3436 plants showed accelerated flowering time by about 1 week compared to wild-type or non-transformed plants. This same phenotype was also noted for the most closely related *Arabidopsis* gene, G485. Many of these early flowering lines also were smaller than controls.

As seen in Table 39, G3436 overexpressors performed better than controls in a significant number of assay conditions, including high salt, heat germination, cold germination, and growth in cold.

TABLE 39

G3436 35S, Direct promoter-fusion

| Line | Germ. in high NaCl | Germ. in high mannitol | Sucrose | ABA | Germ. in heat | Germ. in cold | Growth in heat | Drought | Chilling |
|---|---|---|---|---|---|---|---|---|---|
| 301 | wt | wt | wt | wt | + | + | wt | wt | + |
| 302 | wt | wt | wt | wt | wt | wt | wt | wt | wt |
| 304 | wt | wt | wt | + | wt | wt | wt | wt | + |
| 305 | wt | wt | wt | wt | + | wt | wt | wt | wt |
| 308 | wt | wt | wt | wt | wt | wt | wt | wt | wt |
| 309 | wt | wt | wt | wt | + | + | wt | wt | wt |
| 312 | wt | wt | wt | wt | + | wt | wt | wt | wt |
| 313 | wt | wt | wt | wt | wt | wt | wt | wt | wt |
| 314 | + | wt | wt | wt | wt | wt | wt | wt | wt |
| 315 | wt | wt | wt | wt | + | wt | wt | wt | wt |

Potential Applications

The results of the salt, heat, cold germination and chilling assays confirm that G481 and its related sequences, including the corn G3436 sequence, are excellent candidates for improving abiotic stress tolerance in plants.

Corn G3440 (SEQ ID NO: 1246, 1213 and 2936)

G3440 is a maize gene that was identified as being a putative ortholog of G912. G3440 and closely-related clade member sequences each comprise a conserved AP2 domain that is expected to function in a similar manner in each of these related sequences, that is, by playing a central role in transcriptional regulation and in the conferring of shared traits.

The aim of this project was to determine whether G3440 has an equivalent function to G912 via the analysis of 35S::G3440 *Arabidopsis* lines. 35S::G3440 lines were small, dark in coloration, and flowered later than control lines. These effects were very similar to those produced by overexpression of G912 in *Arabidopsis*.

TABLE 40

G3440 35S, Direct promoter-fusion

| Line | Germ. in high NaCl | Germ. in high mannitol | Sucrose | ABA | Germ. in heat | Germ. in cold | Growth in heat | Drought | Chilling |
|---|---|---|---|---|---|---|---|---|---|
| 302 | wt | wt | wt | wt | wt | wt | wt | wt | wt |
| 306 | wt | wt | wt | wt | wt | wt | wt | wt | wt |
| 308 | wt | wt | wt | wt | wt | wt | wt | wt | + |
| 309 | wt | wt | wt | wt | wt | wt | wt | wt | wt |
| 310 | wt | wt | wt | wt | wt | wt | wt | wt | wt |
| 311 | wt | wt | wt | wt | wt | wt | wt | wt | wt |
| 312 | wt | wt | wt | wt | wt | wt | wt | wt | wt |
| 314 | wt | wt | wt | wt | wt | wt | wt | wt | wt |
| 317 | wt | wt | wt | wt | wt | wt | wt | wt | wt |
| 320 | wt | wt | wt | wt | wt | wt | wt | wt | wt |

Potential Applications

Given the comparable morphological effects of G3440 and G912 overexpression, it is probable that the genes have comparable roles. The developmental changes caused by G3440 overexpression suggest that the gene would benefit from optimization with, for example, the use of inducible or tissue specific promoters.

The results of the chilling assay confirm that G912 and its related sequences, including the corn G3440 sequence, are excellent candidates for improving abiotic stress tolerance in plants.

Soy G3445 (SEQ ID NO: 1083 and 2915)

G3445 is a soy gene that was identified as a putative ortholog of G682. G3445 and closely-related clade member sequences each comprise a conserved Myb-related domain that is expected to function in a similar manner in each of these related sequences, that is, by playing a central role in transcriptional regulation and in the conferring of shared traits.

We have now generated 35S::G3445 lines; these plants showed comparable morphological effects to 35S::G682 lines and exhibited a glabrous phenotype combined with a slight reduction in overall size. These similarities in phenotypes suggest that the genes have similar functions.

TABLE 41

G3445 35S, Direct promoter-fusion

| Line | Germ in high NaCl | Germ. in high mannitol | Sucrose | ABA | Germ in heat | Germ in cold | Heat growth | Drought | Chilling | G682-like root morph. |
|---|---|---|---|---|---|---|---|---|---|---|
| 301 | wt | wt | wt | + | wt | wt | wt | wt | wt | wt |
| 302 | wt | wt | wt | + | wt | wt | wt | wt | wt | + |
| 303 | wt | wt | wt | + | wt | wt | wt | wt | wt | wt |
| 321 | wt | wt | wt | wt | wt | wt | wt | wt | wt | − |
| 323 | wt | wt | wt | + | wt | wt | wt | wt | wt | wt |
| 341 | wt | wt | wt | wt | wt | wt | wt | wt | wt | + |
| 342 | wt | wt | wt | wt | wt | wt | wt | + | wt | wt |
| 344 | wt | wt | wt | wt | wt | wt | wt | wt | wt | + |
| 345 | wt | wt | wt | wt | wt | wt | wt | wt | wt | wt |
| 347 | wt | wt | wt | wt | wt | wt | wt | + | wt | wt |

Potential Applications

The results of the ABA and drought assays, confirm that G682 and its related sequences, including the soy G3445 sequence, are excellent candidates for improving abiotic stress tolerance in plants.

The effect of G3445 on epidermal patterning indicates that the gene could be applied to manipulate trichome development; in some species trichomes accumulate valuable secondary metabolites and in other instances are thought to provide protection against predation.

Soy G3448 (SEQ ID NO: 1087, 553 and 2917)

G3448 is a soy gene that was identified as being a putative ortholog of G682. G3448 and closely-related clade member sequences each comprise a conserved Myb-related domain that is expected to function in a similar manner in each of these related sequences, that is, by playing a central role in transcriptional regulation and in the conferring of shared traits.

The aim of this project was to determine whether G3448 has an equivalent function to the G682-related genes from Arabidopsis via the analysis of 35S::G3448 Arabidopsis lines. We have now generated 35S::G3448 lines; these plants showed comparable morphological effects to 35S::G682 lines and exhibited a glabrous phenotype combined with a reduction in overall size. These similarities in phenotypes suggest that the genes have similar functions. Additionally the 35S::G3448 lines showed a somewhat lighter coloration than controls, perhaps indicating that levels of pigments such as anthocyanins were reduced in leaf tissue.

The effect of G3448 on epidermal patterning indicates that the gene could be applied to manipulate trichome development; in some species trichomes accumulate valuable secondary metabolites and in other instances are thought to provide protection against predation. The lighter coloration of 35S::G3448 plants could indicate that G3448 might be used to regulate the production of flavonoid related compounds, which contribute to the nutritional value of foodstuffs.

Soy G3449 (SEQ ID NO: 1088, 554 and 2918)

G3449 is a soy gene that was identified as being a putative ortholog of G682. G3449 and closely-related clade member sequences each comprise a conserved Myb-related domain that is expected to function in a similar manner in each of these related sequences, that is, by playing a central role in transcriptional regulation and in the conferring of shared traits.

The aim of this project was to determine whether G3449 has an equivalent function to the G682-related genes from Arabidopsis via the analysis of 35S::G3449 Arabidopsis lines. We have now generated 35S::G3449 lines; these plants showed comparable morphological effects to 35S::G682 lines and exhibited a glabrous phenotype combined with a slight reduction in overall size. These similarities in phenotypes suggest that the genes have similar functions. Additionally, 35S::G3449 transformants were distinctly paler than wild-type at the seedling stage, perhaps indicating a reduction

TABLE 42

G3448 35S, Direct promoter-fusion

| Line | Germ in high NaCl | Germ. in high mannitol | Sucrose | ABA | Germ in heat | Germ in cold | Heat growth | Drought | Chilling | G682-like root morph. |
|---|---|---|---|---|---|---|---|---|---|---|
| 302 | wt | wt | wt | wt | wt | wt | wt | wt | + | + |
| 303 | wt | wt | wt | wt | wt | wt | wt | wt | wt | + |
| 305 | wt | wt | wt | wt | wt | wt | wt | wt | + | + |
| 308 | wt | wt | wt | wt | wt | wt | wt | + | wt | + |
| 309 | wt | wt | wt | wt | wt | wt | wt | wt | wt | + |
| 310 | wt | wt | wt | wt | wt | wt | wt | wt | wt | + |
| 313 | wt | wt | wt | wt | wt | wt | wt | wt | wt | + |
| 314 | wt | wt | wt | wt | wt | wt | wt | wt | wt | + |
| 315 | wt | wt | wt | wt | wt | wt | wt | wt | + | + |
| 317 | wt | wt | wt | wt | wt | wt | wt | wt | wt | + |

Potential Applications

The results of these drought and chilling stress assays confirm that G682 and its related sequences, including the soy G3448 sequence, are excellent candidates for improving abiotic stress tolerance in plants.

in the levels of pigments such as anthocyanins. Relative to control plants, 35S::G3440 transformants were more tolerant to salt, germination in heat and cold, and chilling temperatures.

TABLE 43

G3449 35S, Direct promoter-fusion

| Line | Germ in high NaCl | Germ. in high mannitol | Sucrose | ABA | Germ in heat | Germ in cold | Heat growth | Drought | Chilling | G682-like root morph. |
|---|---|---|---|---|---|---|---|---|---|---|
| 303 | wt | wt | wt | wt | + | + | wt | wt | wt | + |
| 304 | wt | wt | wt | wt | wt | wt | wt | wt | wt | wt |
| 305 | wt | wt | wt | wt | wt | + | wt | wt | wt | + |
| 306 | wt | wt | wt | wt | wt | wt | wt | wt | wt | + |
| 307 | wt | wt | wt | wt | wt | wt | wt | wt | wt | + |
| 309 | wt | wt | wt | wt | wt | wt | wt | wt | wt | + |
| 310 | wt | wt | wt | wt | wt | wt | wt | wt | wt | + |
| 311 | wt | wt | wt | wt | wt | + | wt | wt | + | + |
| 312 | wt | wt | wt | wt | wt | wt | wt | wt | wt | + |
| 313 | + | wt | wt | wt | wt | wt | wt | wt | wt | + |

Potential Applications

The results of the salt and cold germination assay confirm that G682 and its related sequences, including the soy G3449 sequence, are excellent candidates for improving abiotic stress tolerance in plants.

The effect of G3449 on epidermal patterning indicates that the gene could be applied to manipulate trichome development; in some species trichomes accumulate valuable secondary metabolites and in other instances are thought to provide protection against predation. The lighter coloration of 35S::G3449 plants could indicate that G3449 might be used to regulate the production of flavonoid related compounds, which contribute to the nutritional value of foodstuffs.

Soy G3450 (SEQ ID NO: 1084, 550, 1076 and 2919)

G3450 is a soy gene that was identified as being a putative ortholog of G682. Based on a phylogenetic tree built using conserved MYB domains, the G3450 protein appears to be more closely related to the G682-clade of *Arabidopsis* genes than any of the other putative orthologs included the study. G3450 and closely-related clade member sequences each comprise a conserved Myb-related domain that is expected to function in a similar manner in each of these related sequences, that is, by playing a central role in transcriptional regulation and in the conferring of shared traits.

The aim of this project was to determine whether G3450 has an equivalent function to the G682-related genes from *Arabidopsis* via the analysis of 35S::G3450 *Arabidopsis* lines. We have now generated 35S::G3450 lines; these plants showed comparable morphological effects to 35S::G682 lines and exhibited a glabrous phenotype combined with a slight reduction in overall size. These similarities in phenotypes suggest that the genes have similar functions. Interestingly, 35S::G3450 lines were slightly pale and some of the lines produced pale yellow seed, which likely indicated a reduction in anthocyanin levels in the seed coat. Such an effect was not observed in 35S::G682 seed, but G682 and its paralogs were found during our genomics studies to inhibit anthocyanin production.

35S::G3450 lines have recently been tested in drought related assays; all of these lines exhibited an increase in root hair density, and relative to control plants, seven of the ten lines showed an enhanced performance in one or more of the plate-based drought related stress assays.

The comparable morphological and physiological effects obtained in 35S::G3450 lines versus overexpression lines for the G682-related *Arabidopsis* genes, indicates that the G3450 protein has a very similar or equivalent activity to the *Arabidopsis* proteins. Relative to control plants, three of four lines tested were more tolerant to drought in soil based assays.

TABLE 44

G3450 35S, Direct promoter-fusion

| Line | Germ in high NaCl | Germ. in high mannitol | Sucrose | ABA | Germ in heat | Germ in cold | Heat growth | Drought | Chilling | G682-like root morph. |
|---|---|---|---|---|---|---|---|---|---|---|
| 301 | wt | wt | wt | wt | wt | wt | wt | wt | wt | + |
| 302 | wt | wt | wt | wt | + | + | wt | wt | wt | + |
| 303 | wt | wt | wt | wt | wt | + | wt | wt | + | + |
| 304 | wt | wt | wt | wt | wt | + | + | wt | wt | + |
| 305 | wt | wt | wt | wt | wt | wt | wt | wt | wt | + |
| 306 | wt | wt | wt | wt | wt | wt | wt | + | wt | + |
| 307 | wt | wt | wt | wt | wt | + | + | wt | + | + |
| 313 | wt | wt | wt | wt | wt | wt | wt | wt | + | + |
| 315 | + | wt | wt | wt | wt | + | + | + | + | + |
| 317 | + | wt | wt | wt | wt | + | wt | wt | + | + |

Potential Applications

The results of the cold, heat cold and salt germination and growth assays confirm that G682 and its related sequences, including the soy G3450 sequence, are excellent candidates for improving abiotic stress tolerance in plants.

The effect of G3450 on epidermal patterning indicates that the gene could be applied to manipulate trichome development; in some species trichomes accumulate valuable secondary metabolites and in other instances are thought to provide protection against predation. The lighter coloration of 35S::G3450 plants could indicate that G3450 might be used to regulate the production of flavonoid related compounds, which contribute to the nutritional value of foodstuffs.

Soy G3452 (SEQ ID NO: 1183, 1162 and 2924)

G3452 is a soy gene that was identified as being a putative ortholog of G867. G3452 and closely-related clade member sequences each comprise a conserved AP2 domain that is expected to function in a similar manner in each of these related sequences, that is, by playing a central role in transcriptional regulation and in the conferring of shared traits.

The aim of this project was to determine whether G3452 has an equivalent function to G867 via the analysis of 35S::G3452 Arabidopsis lines. 35S::G3452 lines displayed a number of morphological similarities, such as reduced size and alterations in coloration, to those seen in earlier studies with 35S::G867 lines. A number of the 35S::G3452 lines were also slightly early flowering. Relative to control plants, G3453 lines were more tolerant to a number of abiotic stresses, as shown in the table below.

TABLE 45

G3452 35S, Direct promoter-fusion

| Line | Germ. in high NaCl | Germ. in high mannitol | Sucrose | ABA | Germ. in heat | Germ. in cold | Growth in heat | Drought | Chilling |
|---|---|---|---|---|---|---|---|---|---|
| 304 | + | + | + | wt | wt | + | + | + | wt |
| 305 | + | wt | + | wt | wt | + | wt | wt | wt |
| 310 | wt | wt | wt | wt | wt | wt | wt | wt | + |
| 314 | + | wt | + | wt | wt | wt | wt | wt | + |
| 316 | + | wt | + | wt | wt | wt | wt | wt | + |
| 318 | wt | wt | + | wt | wt | wt | wt | wt | + |

Potential Applications

The results of these abiotic stress assays confirm that G867 and its related sequences, including the soy G3452 sequence, are excellent candidates for improving abiotic stress tolerance in plants.

The accelerated flowering seen in 35S::G3452 plants indicate that the gene could be used to manipulate flowering time.

In particular, shortening generation times would also help speed-up breeding programs, particularly in species such as trees, which typically grow for many years before flowering. Conversely, it might be possible to modify the activity of G3452 (or its orthologs) to delay flowering in order to achieve an increase in biomass and yield.

Soy G3465 (SEQ ID NO: 1206 and 1242)

G3465 is a soy gene that was identified as being a putative ortholog of G912. On a phylogenetic tree, this gene appears to be more closely related to G912 and CBF1-3, than to the two related Arabidopsis genes, G2107 and G2513. G3465 and closely-related clade member sequences each comprise a conserved AP2 domain that is expected to function in a similar manner in each of these related sequences, that is, by playing a central role in transcriptional regulation and in the conferring of shared traits.

The aim of this project was to determine whether G3465 has an equivalent function to G912 via the analysis of 35S::G3465 Arabidopsis lines. Overexpression of G3465 produced deleterious effects in Arabidopsis; 35S::G3465 lines were small, dark in coloration and slow growing. Such features were comparable to, and possibly even more severe than those shown by 35S::G912 lines, indicating that the two genes likely have a similar function. Relative to control plants, one overexpressing line was shown to have increased germination in high mannitol relative to wild-type control plants, and another line was insensitive to ABA. Two lines were more tolerant to germination in cold conditions relative to control plants.

TABLE 46

G3465 35S, Direct promoter-fusion

| Line | Germ. in high NaCl | Germ. in high mannitol | Sucrose | ABA | Germ. in heat | Germ. in cold | Growth in heat | Drought | Chilling |
|---|---|---|---|---|---|---|---|---|---|
| 321 | wt | wt | wt | wt | wt | wt | wt | wt | wt |
| 322 | wt | wt | wt | wt | wt | wt | wt | wt | wt |
| 323 | wt | wt | wt | wt | wt | wt | wt | wt | wt |
| 324 | wt | wt | wt | wt | wt | wt | wt | wt | wt |
| 341 | wt | wt | wt | wt | wt | wt | wt | wt | wt |
| 343 | wt | wt | wt | wt | wt | wt | wt | wt | wt |
| 344 | wt | wt | wt | wt | wt | wt | wt | wt | wt |
| 346 | wt | + | wt | wt | wt | wt | wt | wt | wt |
| 347 | wt | wt | wt | wt | wt | + | wt | wt | wt |
| 348 | wt | wt | wt | + | wt | + | wt | wt | wt |

Potential Applications

Given the similar morphological effects of G3465 and G912 overexpression, it is probable that the genes have comparable roles. The morphological effects that were apparent in these lines suggest that the utilization of G3465 might benefit from optimization by use of different promoters or protein modifications.

The results of the mannitol and ABA germination assays confirm that G912 and its related sequences, including the soy G3465 sequence, are excellent candidates for improving abiotic stress tolerance in plants.

Soy G3469 (SEQ ID NO: 1210 and 1237)

G3469 is a soy gene that was identified as being a putative ortholog of G912. G3469 and closely-related clade member sequences each comprise a conserved AP2 domain that is expected to function in a similar manner in each of these related sequences, that is, by playing a central role in transcriptional regulation and in the conferring of shared traits.

Morphologically, the overexpressors of G3469 ranged from being somewhat small in size to plants with no consistent differences to control.

Results of plate based assays show that G3469 is, like its ortholog G912, is able to confer abiotic stress tolerance in plants, as indicated by the greater tolerance than wild type control plants of G3469 overexpressors to chilling conditions and germination in high salt relative to control plants.

TABLE 47

G3469 35S, Direct promoter-fusion

| Line | Germ. in high NaCl | Germ. in high mannitol | Sucrose | ABA | Germ. in heat | Germ. in cold | Growth in heat | Drought | Chilling |
|------|--------------------|------------------------|---------|-----|---------------|---------------|----------------|---------|----------|
| 302  | wt | wt | wt | wt | wt | wt | wt | wt | wt |
| 303  | +  | wt | wt | wt | wt | wt | wt | wt | wt |
| 305  | +  | wt | wt | wt | wt | wt | wt | wt | wt |
| 309  | wt | wt | wt | wt | wt | wt | wt | wt | wt |
| 310  | +  | wt | wt | wt | wt | wt | wt | wt | wt |
| 311  | +  | wt | wt | wt | wt | wt | wt | wt | wt |
| 312  | +  | wt | wt | wt | wt | wt | wt | wt | wt |
| 314  | wt | wt | wt | wt | wt | wt | wt | wt | wt |
| 315  | wt | wt | wt | wt | wt | wt | wt | wt | +  |
| 319  | +  | wt | wt | wt | wt | wt | −  | wt | +  |
| 304  | wt | wt | wt | wt | wt | wt | wt | wt | +  |
| 307  | wt | wt | wt | wt | wt | wt | wt | wt | +  |
| 317  | wt | wt | wt | wt | wt | wt | wt | wt | +  |
| 318  | wt | wt | wt | wt | wt | wt | wt | +  | wt |

Potential Applications

The results of the salt, drought and chilling assays confirm that G912 and its related sequences, including the soy G3469 sequence, are excellent candidates for improving abiotic stress tolerance in plants.

Soy G3470 (SEQ ID NO: 2947 and 2948)

G3470 is ortholog of G481 and G482 from *Glycine max*. Among the *Arabidopsis* paralogs in the G481 study group, G3470 is phylogenetically most closely related to G481 itself. G3470 and closely-related clade member sequences each comprise a conserved CCAAT box-binding domain that is expected to function in a similar manner in each of these related sequences, that is, by playing a central role in transcriptional regulation and in the conferring of shared traits.

Experimental Observations

The aim of this study was to assess the role of G3470 in drought stress-related tolerance via overexpression, and compare the effects with that of the other G481 orthologs and paralogs.

Twenty 35S::G3470 lines were examined. Half of the transformants exhibited a marked delay in flowering, of about 1 week, and had rather dark narrowed leaves compared to wild-type or non-transformed controls. This same phenotype was noted for G481 and some of its other putative orthologs.

35S::G3470 lines have now been tested in plate based physiology assays; relative to control plants, seven of ten lines showed enhanced germination, relative to wild type, when tested in NaCl germination assays. Additionally, two 35S::G3470 lines showed an enhanced performance in a heat growth assay relative to controls.

Line 326 was more tolerant to drought in a soil-based assay.

TABLE 48

G3470 35S, Direct promoter-fusion

| Line | Germ. in high NaCl | Germ. in high mannitol | Sucrose | ABA | Germ. in heat | Germ. in cold | Growth in heat | Drought | Chilling |
|------|--------------------|------------------------|---------|-----|---------------|---------------|----------------|---------|----------|
| 301 | wt | wt | wt | wt | wt | wt | +  | wt | wt |
| 302 | +  | wt | wt | wt | wt | wt | wt | wt | wt |
| 303 | +  | wt | wt | wt | wt | wt | +  | wt | +  |
| 305 | +  | wt | wt | wt | wt | wt | wt | +  | wt |
| 306 | wt | wt | wt | +  | wt | wt | wt | +  | wt |
| 309 | +  | wt | wt | wt | wt | wt | wt | wt | wt |
| 310 | +  | wt | wt | wt | wt | wt | wt | wt | wt |
| 316 | +  | wt | wt | wt | wt | wt | wt | +  | wt |
| 317 | wt | wt | wt | wt | wt | wt | wt | +  | wt |
| 318 | +  | wt | wt | wt | wt | wt | wt | wt | +  |
| 324 | +  | wt | +  | wt | wt | +  | +  | +  | wt |
| 321 | wt | wt | wt | wt | +  | +  | wt | +  | +  |
| 326 | wt | +  | +  | wt | wt | +  | +  | +  | +  |
| 331 | +  | +  | +  | +  | wt | wt | +  | wt | wt |
| 322 | wt | wt | wt | wt | wt | +  | +  | +  | +  |
| 329 | +  | wt | +  | wt | +  | +  | +  | +  | wt |
| 330 | +  | +  | +  | +  | wt | wt | +  | +  | wt |
| 327 | wt | +  | +  | +  | wt | +  | wt | +  | wt |
| 325 | wt | wt | wt | wt | wt | +  | +  | +  | +  |
| 323 | wt | wt | wt | wt | wt | +  | wt | +  | wt |

Potential Applications

The results of the salt germination assay confirm that G481 and its related sequences, including the soy G3470 sequence, are excellent candidates for improving abiotic stress tolerance in plants.

Soy G3471 (SEQ ID NO: 2949 and 2950)

G3471 from *Glycine max* is an ortholog of G481 and G482. Among the *Arabidopsis* paralogs in the G481 study group, G3471 is phylogenetically most closely related to G481. G3471 and closely-related clade member sequences each comprise a conserved CCAAT box-binding domain that is expected to function in a similar manner in each of these related sequences, that is, by playing a central role in transcriptional regulation and in the conferring of shared traits.

Experimental Observations

The aim of this study was to assess the role of G3471 in drought stress-related tolerance via overexpression, and compare the effects with that of the other G481 orthologs and paralogs.

Changes in flowering time were seen among the 35S::G3471 lines. A number of lines appeared late flowering, while others showed a marginal acceleration of flowering. Some of the 35S::G3471 lines also showed alterations in leaf shape.

Relative to control plants, several lines performed better than controls in abiotic stress assays, including germination in heat, growth in cold conditions, and better drought tolerance in a plate-based assay. Three of seven lines tested were more tolerant to drought than controls in a soil based drought assay.

Potential Applications

The results of the salt germination assay confirm that G481 and its related sequences, including the soy G3472 sequence, are excellent candidates for improving abiotic stress tolerance in plants.

Potential Applications

The results of the salt germination assay confirm that G481 and its related sequences, including the soy G3472 sequence, are excellent candidates for improving abiotic stress tolerance in plants.

Soy G3472 (SEQ ID NO: 801 and 2907)

G3472 is an ortholog of G481 and G482 from *Glycine max*, and is a member of the HAP3 subgroup of the CCAAT box-binding transcription factor family. Among the *Arabidopsis* paralogs in the G481 study group, this gene is phylogenetically most closely related to G485. G3472 and closely-related clade member sequences each comprise a conserved CCAAT box-binding domain that is expected to function in a similar manner in each of these related sequences, that is, by playing a central role in transcriptional regulation and in the conferring of shared traits.

Experimental Observations

The aim of this study was to assess the role of G3472 in drought stress-related tolerance via overexpression. 35S::G3472 lines showed no consistent differences in morphology to wild-type or non-transformed controls. G3472 did not produce accelerated flowering in the same manner as did other G485 related genes such as G3474, G3475 and G3476.

TABLE 49

G3471 35S, Direct promoter-fusion

| Line | Germ. in high NaCl | Germ. in high mannitol | Sucrose | ABA | Germ. in heat | Germ. in cold | Growth in heat | Drought | Chilling |
|---|---|---|---|---|---|---|---|---|---|
| 303 | wt | wt | wt | wt | + | wt | wt | wt | + |
| 306 | wt | wt | wt | wt | wt | wt | wt | wt | wt |
| 307 | wt | wt | wt | wt | + | wt | wt | wt | wt |
| 308 | wt | wt | wt | wt | wt | wt | wt | + | wt |
| 312 | wt | wt | wt | wt | + | wt | wt | wt | wt |
| 328 | wt | wt | wt | wt | wt | wt | wt | wt | wt |
| 329 | wt | wt | wt | wt | wt | wt | wt | wt | wt |
| 330 | wt | wt | wt | wt | wt | wt | wt | wt | wt |
| 337 | wt | wt | wt | wt | wt | wt | wt | wt | wt |
| 338 | wt | wt | wt | wt | wt | wt | wt | wt | wt |
| 341 | wt | wt | + | + | wt | wt | wt | + | + |
| 344 | wt | wt | + | wt | wt | wt | wt | + | wt |
| 346 | wt | wt | wt | wt | wt | wt | wt | wt | wt |
| 347 | wt | wt | wt | + | wt | wt | wt | wt | wt |
| 358 | wt | wt | wt | wt | wt | wt | wt | + | wt |
| 353 | wt | wt | wt | + | wt | + | wt | + | wt |
| 350 | wt | wt | wt | wt | wt | wt | wt | + | wt |
| 355 | wt | wt | wt | wt | wt | wt | wt | wt | wt |
| 356 | wt | wt | wt | wt | wt | wt | wt | wt | wt |
| 342 | wt | wt | + | wt | wt | wt | wt | + | wt |

Three 35S::G3472 lines were more salt tolerant than wild-type or non-transformed controls in a plate-based assay.

TABLE 50

G3472 35S, Direct promoter-fusion

| Line | Germ. in high NaCl | Germ. in high mannitol | Sucrose | ABA | Germ. in heat | Germ. in cold | Growth in heat | Drought | Chilling |
|------|------|------|------|------|------|------|------|------|------|
| 303 | wt | wt | wt | wt | wt | wt | wt | wt | wt |
| 304 | wt | wt | wt | wt | wt | wt | wt | wt | wt |
| 305 | wt | wt | wt | wt | wt | wt | wt | wt | wt |
| 306 | wt | wt | wt | wt | wt | wt | wt | wt | wt |
| 307 | wt | wt | wt | wt | wt | wt | wt | wt | wt |
| 308 | + | wt | wt | wt | wt | wt | wt | wt | wt |
| 311 | + | wt | wt | wt | wt | wt | wt | wt | wt |
| 313 | wt | wt | wt | wt | wt | wt | wt | wt | wt |
| 314 | wt | wt | wt | wt | wt | wt | wt | wt | wt |
| 318 | + | wt | wt | wt | wt | wt | wt | wt | − |

Potential Applications

The results of the salt germination assay confirm that G481 and its related sequences, including the soy G3472 sequence, are excellent candidates for improving abiotic stress tolerance in plants.

Soy G3475 (SEQ ID NO: 800 and 2908)

G3475 is from *Glycine max* and is a putative ortholog of G481, and is a member of the HAP3 subgroup of the CCAAT box-binding transcription factor family. Among the *Arabidopsis* paralogs in the G481 study group, this gene is phylogenetically most closely related to G485. G3475 and closely-related clade member sequences each comprise a conserved CCAAT box-binding domain that is expected to function in a similar manner in each of these related sequences, that is, by playing a central role in transcriptional regulation and in the conferring of shared traits.

Experimental Observations

35S::G3475 lines showed accelerated flowering by about one to two weeks compared to wild-type or non-transformed controls. This same phenotype was also noted for the most closely related *Arabidopsis* gene, G485. Many of these early flowering lines also were smaller than controls.

Growth of four 35S::G3475 lines was more tolerant to cold conditions than wild-type or non-transformed controls.

TABLE 51

G3475 35S, Direct promoter-fusion

| Line | Germ. in high NaCl | Germ. in high mannitol | Sucrose | ABA | Germ. in heat | Germ. in cold | Growth in heat | Drought | Chilling |
|------|------|------|------|------|------|------|------|------|------|
| 301 | wt | wt | wt | wt | wt | wt | wt | wt | wt |
| 302 | wt | wt | wt | wt | wt | wt | wt | wt | + |
| 303 | wt | wt | wt | wt | wt | wt | wt | wt | wt |
| 304 | wt | wt | wt | wt | wt | wt | wt | wt | + |
| 306 | wt | wt | wt | wt | wt | wt | wt | wt | + |
| 307 | wt | wt | wt | wt | wt | wt | wt | wt | + |
| 308 | wt | wt | wt | wt | wt | wt | wt | wt | wt |
| 309 | wt | wt | wt | wt | wt | wt | wt | wt | wt |
| 310 | wt | wt | wt | wt | wt | wt | wt | wt | wt |
| 311 | wt | wt | wt | wt | wt | wt | wt | wt | wt |

Potential Applications

The results of the chilling assay confirm that G481 and its related sequences, including the soy G3475 sequence, are excellent candidates for improving abiotic stress tolerance in plants.

Example XIV

Transformation of Cereal Plants with an Expression Vector

Cereal plants such as, but not limited to, corn, wheat, rice, sorghum, or barley, may also be transformed with the present polynucleotide sequences in pMEN20 or pMEN65 expression vectors for the purpose of modifying plant traits. For example, pMEN020 may be modified to replace the NptII coding region with the BAR gene of *Streptomyces hygroscopicus* that confers resistance to phosphinothricin. The KpnI and BglII sites of the Bar gene are removed by site-directed mutagenesis with silent codon changes.

The cloning vector may be introduced into a variety of cereal plants by means well known in the art such as, for example, direct DNA transfer or *Agrobacterium tumefaciens*-mediated transformation. It is now routine to produce transgenic plants of most cereal crops (Vasil (1994) *Plant Mol. Biol.* 25: 925-937) such as corn, wheat, rice, sorghum (Cassas et al. (1993) *Proc. Natl. Acad. Sci.* 90: 11212-11216, and barley (Wan and Lemeaux (1994) *Plant Physiol.* 104:37-48. DNA transfer methods such as the microprojectile can be used for corn (Fromm et al. (1990) *Bio/Technol.* 8: 833-839); Gordon-Kamm et al. (1990) *Plant Cell* 2: 603-618; Ishida (1990) *Nature Biotechnol.* 14:745-750), wheat (Vasil et al. (1992) *Bio/Technol.* 10:667-674; Vasil et al. (1993) *Bio/Technol.* 11:1553-1558; Weeks et al. (1993) *Plant Physiol.* 102: 1077-1084), rice (Christou (1991) *Bio/Technol.* 9:957-962; Hiei et al. (1994) *Plant J.* 6:271-282; Aldemita and Hodges (1996) *Planta* 199:612-617; and Hiei et al. (1997) *Plant Mol. Biol.* 35:205-218). For most cereal plants, embryogenic cells derived from immature scutellum tissues are the preferred cellular targets for transformation (Hiei et al. (1997) *Plant Mol. Biol.* 35:205-218; Vasil (1994) *Plant Mol. Biol.* 25: 925-937).

Vectors according to the present invention may be transformed into corn embryogenic cells derived from immature scutellar tissue by using microprojectile bombardment, with the A188XB73 genotype as the preferred genotype (Fromm et al. (1990) *Bio/Technol.* 8: 833-839; Gordon-Kamm et al. (1990) *Plant Cell* 2: 603-618). After microprojectile bombardment the tissues are selected on phosphinothricin to identify the transgenic embryogenic cells (Gordon-Kamm et al. (1990) *Plant Cell* 2: 603-618). Transgenic plants are regenerated by standard corn regeneration techniques (Fromm et al. (1990) *Bio/Technol.* 8: 833-839; Gordon-Kamm et al. (1990) *Plant Cell* 2: 603-618).

The plasmids prepared as described above can also be used to produce transgenic wheat and rice plants (Christou (1991) *Bio/Technol.* 9:957-962; Hiei et al. (1994) *Plant J.* 6:271-282; Aldemita and Hodges (1996) *Planta* 199:612-617; and Hiei et al. (1997) *Plant Mol. Biol.* 35:205-218) that coordinately express genes of interest by following standard transformation protocols known to those skilled in the art for rice and wheat (Vasil et al. (1992) *Bio/Technol.* 10:667-674; Vasil et al. (1993) *Bio/Technol.* 11:1553-1558; and Weeks et al. (1993) *Plant Physiol.* 102:1077-1084), where the bar gene is used as the selectable marker.

Example XV

Transformation of Canola with a Plasmid Containing CBF1, CBF2, or CBF3

After identifying homologous genes to CBF1, canola was transformed with a plasmid containing the *Arabidopsis* CBF1, CBF2, or CBF3 genes cloned into the vector pGA643 (An (1987) *Methods Enzymol.* 253: 292). In these constructs the CBF genes were expressed constitutively under the CaMV 35S promoter. In addition, the CBF1 gene was cloned under the control of the *Arabidopsis* COR15 promoter in the same vector pGA643. Each construct was transformed into *Agrobacterium* strain GV3101. Transformed *Agrobacteria* were grown for 2 days in minimal AB medium containing appropriate antibiotics.

Spring canola (*B. napus* cv. Westar) was transformed using the protocol of Moloney et al. (1989) *Plant Cell Reports* 8: 238, with some modifications as described. Briefly, seeds were sterilized and plated on half strength MS medium, containing 1% sucrose. Plates were incubated at 24° C. under 60-80 µE/m$^2$s light using a 16 hour light/8 hour dark photoperiod. Cotyledons from 4-5 day old seedlings were collected, the petioles cut and dipped into the *Agrobacterium* solution. The dipped cotyledons were placed on co-cultivation medium at a density of 20 cotyledons/plate and incubated as described above for 3 days. Explants were transferred to the same media, but containing 300 mg/l timentin (SmithKline Beecham, Pa.) and thinned to 10 cotyledons/plate. After 7 days explants were transferred to Selection/Regeneration medium. Transfers were continued every 2-3 weeks (2 or 3 times) until shoots had developed. Shoots were transferred to Shoot-Elongation medium every 2-3 weeks. Healthy looking shoots were transferred to rooting medium. Once good roots had developed, the plants were placed into moist potting soil.

The transformed plants were then analyzed for the presence of the NPTII gene/kanamycin resistance by ELISA, using the ELISA NPTII kit from 5Prime-3Prime Inc. (Boulder, Colo.). Approximately 70% of the screened plants were NPTII positive. Only those plants were further analyzed.

From Northern blot analysis of the plants that were transformed with the constitutively expressing constructs, showed expression of the CBF genes and all CBF genes were capable of inducing the *Brassica napus* cold-regulated gene BN115 (homolog of the *Arabidopsis* COR15 gene). Most of the transgenic plants appear to exhibit a normal growth phenotype. As expected, the transgenic plants are more freezing tolerant than the wild-type plants. Using the electrolyte leakage of leaves test, the control showed a 50% leakage at −2 to −3° C. Spring canola transformed with either CBF1 or CBF2 showed a 50% leakage at −6° to −7° C. Spring canola transformed with CBF3 shows a 50% leakage at about −10 to −15° C. Winter canola transformed with CBF3 may show a 50% leakage at about −16° to −20° C. Furthermore, if the spring or winter canola are cold acclimated the transformed plants may exhibit a further increase in freezing tolerance of at least ±2° C.

To test salinity tolerance of the transformed plants, plants were watered with 150 mM NaCl. Plants overexpressing CBF1, CBF2 or CBF3 grew better compared with plants that had not been transformed with CBF1, CBF2 or CBF3.

These results demonstrate that equivalogs of *Arabidopsis* transcription factors can be identified and shown to confer similar functions in non-Arabidopsis plant species.

Example XVI

Cloning of Transcription Factor Promoters

Promoters are isolated from transcription factor genes that have gene expression patterns useful for a range of applications, as determined by methods well known in the art (including transcript profile analysis with cDNA or oligonucleotide microarrays, Northern blot analysis, semi-quantitative or quantitative RT-PCR). Interesting gene expression profiles are revealed by determining transcript abundance for a selected transcription factor gene after exposure of plants to a range of different experimental conditions, and in a range of different tissue or organ types, or developmental stages. Experimental conditions to which plants are exposed for this purpose includes cold, heat, drought, osmotic challenge, varied hormone concentrations (ABA, GA, auxin, cytokinin, salicylic acid, brassinosteroid), pathogen and pest challenge. The tissue types and developmental stages include stem, root, flower, rosette leaves, cauline leaves, siliques, germinating seed, and meristematic tissue. The set of expression levels provides a pattern that is determined by the regulatory elements of the gene promoter.

Transcription factor promoters for the genes disclosed herein are obtained by cloning 1.5 kb to 2.0 kb of genomic sequence immediately upstream of the translation start codon for the coding sequence of the encoded transcription factor protein. This region includes the 5'-UTR of the transcription factor gene, which can comprise regulatory elements. The 1.5 kb to 2.0 kb region is cloned through PCR methods, using primers that include one in the 3' direction located at the translation start codon (including appropriate adaptor sequence), and one in the 5' direction located from 1.5 kb to 2.0 kb upstream of the translation start codon (including appropriate adaptor sequence). The desired fragments are PCR-amplified from *Arabidopsis* Col-0 genomic DNA using high-fidelity Taq DNA polymerase to minimize the incorporation of point mutation(s). The cloning primers incorporate two rare restriction sites, such as NotI and SfiI, found at low frequency throughout the *Arabidopsis* genome. Additional restriction sites are used in the instances where a NotI or SfiI restriction site is present within the promoter.

The 1.5-2.0 kb fragment upstream from the translation start codon, including the 5'-untranslated region of the transcription factor, is cloned in a binary transformation vector immediately upstream of a suitable reporter gene, or a transactivator gene that is capable of programming expression of a reporter gene in a second gene construct. Reporter genes used include green fluorescent protein (and related fluorescent protein color variants), beta-glucuronidase, and luciferase. Suitable transactivator genes include LexA-GAL4, along with a transactivatable reporter in a second binary plasmid (as disclosed in U.S. patent application Ser. No. 09/958,131, incorporated herein by reference). The binary plasmid(s) is transferred into *Agrobacterium* and the structure of the plasmid confirmed by PCR. These strains are introduced into *Arabidopsis* plants as described in other examples, and gene expression patterns determined according to standard methods know to one skilled in the art for monitoring GFP fluorescence, beta-glucuronidase activity, or luminescence.

All publications and patent applications mentioned in this specification are herein incorporated by reference to the same extent as if each individual publication or patent application was specifically and individually indicated to be incorporated by reference.

The present invention is not limited by the specific embodiments described herein. The invention now being fully described, it will be apparent to one of ordinary skill in the art that many changes and modifications can be made thereto without departing from the spirit or scope of the appended claims. Modifications that become apparent from the foregoing description and accompanying figures fall within the scope of the claims.

SEQUENCE LISTING (2961 sequences)

SEQ ID NO: 1 - DNA, 1713 bp, Arabidopsis thaliana
  G8
aaaaaaaaatatccgtctcactctctcgccgccggtaacatttcccggcgacaaaacttctctactctcaccattcctccatcgtaatctctaaattcttctccattctcttcttcctcccgatcatctcgagctcttcgtgagagattatgtgattatgtaatcgttgttgctgtagaagacgatctctaacaactgattccttcatcatcaccttcgctagatttgtaattttcagagcttgagatgttggatcttaacctcaacgctgattctcccgagtcgactcagtacggtggtgactcatacttagatcggcagacatcagacaactccgccgggaatcgagtggaagagtccggtacatcgacgtcgtcagttatcaatgccgatggagacgaagactcttgctctactcgagctttcactctcagtttcgatattttaaaagtcggaagtagtagcggcggagacgaaagccccgccgcttcagcttccgttactaaagagttttttccggtgagtggagactgtggacatctacgagatgttgaaggatcatcaagctctagaaactggatagatctttcttttgaccgtattggtgacggagaaacgaaattggtaactccggttccgactccggctccggttccggctcaggttaaaaagagtcggagaggaccaaggtctagaagttcacagtatagaggagttactttttatagaagaactggtcgatgggagtcacatatttgggattgtgggaaacaagtttatttaggtggtttcgacactgctcatgctgcagctagagcttatgatcgagctgctattaaatttagaggtgttgatgctgatatcaactttactcttggtgattatgaggaagatatgaaacaggtacaaaacttgagtaaggaagagtttgtgcatatactgcgtagacagagcacggggttttcgcgggggagttcgaagtatcgaggggttacgttacacaaatgtggtagatgggaagctaggatggggcagtttcttggtaaaaaggcttatgacaaggctgcaatcaacactaatggtagagaagcagtcacgaacttcgagatgagttcataccaaaatgagattaactctgagagcaataactctgagattgacctcaacttgggaatctctttatcgaccggtaatgcgccaaagcaaaatgggaggctctttcacttcccttctaatacttatgaaactcagcgtggagttagcttgaggatagataacgaatacatgggaaagccggtgaatacacctcttccttatggatcctcggatcatcgcctttactggaacggagcatgcccgagttataataatcccgccgagggaagagcaacagaaaagagaagtgaagctgaagggatgatgagtaactggggatggcagagaccggggcaaacaagcgccgtgagaccgcagccaccgggaccacaaccaccaccattgttctcagttgcagcagcatcatcaggattctcacatttccggccacaacctcccaatgacaatgcaacacgtggttacttttatccacacccttaacttgtaaggggacatatgagagtttttttaccatctctctctctctcaacactctagtcccctttcaaaaatgtcatttgggttttagatttttcacatacaatgatcaatttttcc

SEQ ID NO: 2 - protein, 449 aa, Arabidopsis thaliana
  G8  (conserved domain in AA coordinates: 151-217, 243-296)
MLDLNLNADSPESTQYGGDSYLDRQTSDNSAGNRVEESGTSTSSVINADGDEDSCSTRAFTLSFDILKVGSSSGGDESPAASASVTKEFFPVSGDCGHLRDVEGSSSSRNWIDLSFDRIGDGETKLVTPVPTPAPVPAQVKKSRRGPRSRSSQYRGVTFYRRTGRWESHIWDCGKQVYLGGFDTAHAAARAYDRAAIKFRGVDADINFTLGDYEEDMKQVQNLSKEEFVHILRRQSTGFSRGSSKYRGVTLHKCGRWEARMGQFLGKKAYDKAAINTNGREAVTNFEMSSYQNEINSESNNSEIDLNLGISLSTGNAPKQNGRLFHFPSNTYETQRGVSLRIDNEYMGKPVNTPLPYGSSDHRLYWNGACPSYNNPAEGRATEKRSEAEGMMSNWGWQRPGQTSAVRPQPPGPQPPPLFSVAAASSGFSHFRPQPPNDNATRGYFYPHP

SEQ ID NO: 3 - DNA, 1055 bp, Arabidopsis thaliana
  G19
ataaaggcatttcagctccaccgtaggaaactttctcttgaaagaaacccacagcaacaaacagagaaaatgtgtggcggtgctattatttccgattatgcccctctcgtcaccaaggccaagggccgtaaactcacggctgaggaactctggtcagagctcgatgcttccgccgccgacgacttctggggtttctattccacctccaaactccatcccaccaaccaagttaacgtgaaagaggaggcagtgaagaaggagcaggcaacagagccggggaaacggaggaagaggaagaatgtttatagagggatacgtaagcgtccatggggaaaatgggcggctgagattcgagatccacgaaaaggtgttagagtttggcttggtacgttcaacacggcggaggaagctgccatggcttatgatgttgcggccaagcagatccgtggtgataaagccaagctcaacttcccagatctgcaccatcctcctcctcctaattatactcctccgccgtcatcgccacgatcaaccgatcagcctccggcgaagaaggtctgcgttgtctctcagagtgagagcgagttaagtcagccgagtttcccggtggagtgtataggatttggaaatggggacgagtttcagaacctgagttacggatttgagccggattatgatctgaaacagcagatatcgagcttggaatcgttccttgagctggacggtaacacggcggagcaaccgagtcagcttgatgagtccgtttccgaggtggatatgtggatgcttgatgatgtcattgcgtcgtatgagtaaaagaaaaaaaataagtttaaaaaaagttaaataaagtctgtaatatatatgtaaccgccgttacttttaaaaggtttttaccgtcgcattggactgctgatgatgtctgttgtgtaatgtgtagaatgtgaccaaatggacgttatattacggtttgtggtattattagtttcttagatggaaaaacttacatgtgtaaataagatttgtaatgtaagacgaagtacttataacttctt

SEQ ID NO: 4 - protein, 248 aa, Arabidopsis thaliana
  G19  (conserved domain in AA coordinates: 76-145)
MCGGAIISDYAPLVTKAKGRKLTAEELWSELDASAADDFWGFYSTSKLHPTNQVNVKEEAVKKEQATEPGKRRKRKNVYRGIRKRPWGKWAAEIRDPRKGVRVWLGTFNTAEEAAMAYDVAAKQIRGDKAKLNFPDLHHPPPPNYTPPPSSPRSTDQPPAKKVCVVSQSESELSQPSFPVECIGFGNGDEFQNLSYGFEPDYDLKQQISSLESFLELDGNTAEQPSQLDESVSEVDMWMLDDVIASYE

SEQ ID NO: 5 - DNA, 913 bp, Arabidopsis thaliana
  G22
agaaaacatctctcactctctaaaatacacactctcatcaaaaaccttctcttcggttcagaagcattcaagaatccattatgagctcatctgattccgttaataacggcgttaactcacggatgtacttccgtaacccgagtttcagcaacgttatcttaaacgataactggagcgacttgccgttaagtgtcgacgattctcaagacatggctatttacaacactctccgtgatgccgttagctccggctggacaccctccgttcctcccgttacctctccggcggaggaaaataagcctccggcgacgaaggcgagtggctcacacgcgccgaggcagaaggggatgcagtacagaggagtgaggaggaggccgtgggggaaattcgcggcggagattagggatccgaagaagaacggagctagggtttggctcgggacttacgagacgccggaggacgcggcggtggcgtacgaccgagcggcgtttcagctcagaggatcgaaagctaagctgaattttccgcatttgattggttcttgtaagtatgagccggttaggattaggcctcgccgtcgctcgccggaaccgtcagtctccgatcagttaacgtcggagcagaagagggaaagccacgtggatgacggcgagtctagtttggttgtaccggagttggatttcacggtggatcagttttacttcgatggtagtttattaatggaccaatcagaatgttcttattctgataatcggatataattagttttaagattaagcaaaatttgtccaacgagttttgctgtatgaaatatctatcgatgactcaacaggttttgatcatgatcatatgtaatgtgatggaaattaaatattgacgtttgtttttttgttgtaaaaaaaaaaaaaaaaaa

SEQ ID NO: 6 - protein, 226 aa, Arabidopsis thaliana
  G22  (conserved domain in AA coordinates: 89-157)
MSSSDSVNNGVNSRMYFRNPSFSNVILNDNWSDLPLSVDDSQDMAIYNTLRDAVSSGWTPSVPPVTSPAEENKPPATKASGSHAPRQKGMQYRGVRRRPWGKFAAEIRDPKKNGARVWLGTYETPEDAAVAYDRAAFQLRGSKAKLNFPHLIGSCKYEPVRIRPRRRSPEPSVSDQLTSEQKRESHVDDGESSLVVPELDFTVDQFYFDGSLLMDQSECSYSDNRI

SEQ ID NO: 7 - DNA, 957 bp, Arabidopsis thaliana
  G24
cggacgcgtgggcaaatattaaaataaaaagtgtcggtgaattctcaatctttgtcttctttcgtcgtctctttaaaactcctccgtccctccttattatgtaaccgtctcgccgtcaaattttcaaaatctctccctccgttcataaacccagatcgaaatttatggttttgtaatttttttaccggcggttatggagacggaagcggcggtgacagcgacggttacggcggcgacgatggggattgggacgaggaagagagatctgaaaccgtataaaggaatacgaatgaggaaatgggggaaatgggtggcggagatacgggaaccgaataagagatcaaggatctggttaggttcttatgcgacgcctgaagcggcggcgagagcttacgacactgctgttttttacctccgtggtccttcagcgaggcttaattttccggagcttttggctggacttactgtttctaacggcggaggaagaggtggtgatttatcggcggcgtatattaggagaaaagcggcggaggttggtgctcaggttgatgcgcttggagcgacggtggttgtgaataccggcggcgagaatcgcggtgattacgagaagattgagaattgtcgtaagagcggtaacgggtcattggaacgggtcgatttgaataaattacccgacccggaaaattcggatggtgatgatgacgaatgtgtgaaaagaagatagaaaaaataaaaagtagttgtagaaggagagacgagaatgtttgtctttaagatgcgctgttgccgctaacatgcgctttcgattttagtgttaaacatgcgcctccattgtttttgggttttgttttcgtcgtcgataatcaaagattttaaaacacaattctcaaatttttcacttgttacaaactagatttgcatgatctttgtattaacgaataacgattaagtcctaaa

SEQ ID NO: 8 - protein, 176 aa, Arabidopsis thaliana
  G24  (conserved domain in AA coordinates: 25-93)
METEAAVTATVTAATMGIGTRKRDLKPYKGIRMRKWGKWVAEIREPNKRSRIWLGSYATPEAAARAYDTAVFYLRGPSARLNFPELLAGLTVSNGGGRGGDLSAAYIRRKAAEVGAQVDALGATVVVNTGGENRGDYEKIENCRKSGNGSLERVDLNKLPDPENSDGDDDECVKRR

SEQ ID NO: 9 - DNA, 964 bp, Arabidopsis thaliana
  G28
gaaatctcaacaagaaccaaaccaaacaacaaaaaaacattcttaataattatctttctgttatgtcgatgacggcggattctcaatctgattatgcttttcttgagtccatacgacgacacttactaggagaatcggagccgatactcagtgagtcgacagcgagttcggttactcaatcttgtgtaaccggtcagagcattaaaccggtgtacggacgaaaccctagctttagcaaactgtatccttgcttcaccgagagctggggagatttgccgttgaaagaaaacgattctgaggatatgttagtttacggtatcctcaacgacgcctttcacggcggttgggagccgtcttcttcgtcttccgacgaagatcgtagctctttcccgagtgttaagatcgagactccggagagtttcgcggcggtggattctgttccggtcaagaaggagaagacgagtcctgtttcggcggcggtgacggcggcgaagggaaagcattatagaggagtgagacaaaggccgtgggggaaatttgcggcggagattagagatccggcgaagaacggagctagggtttggttaggaacgtttgagacggcggaggacgcggcgttggcttacgacagagctgctttcaggatgcgtggttcccgcgctttgttgaattttccgttgagagttaattcaggagaacccgacccggttcgaatcaagtccaagagatcttctttttcttcttctaacgagaacggagctccgaagaagaggagaacggtggccgccggtggtggaatggataagggattgacggtgaagtgcgaggttgttgaagtggcacgtggcgatcgtttattggttttataattttgatttttctttgttggatgattatatgattcttcaaaaaagaagaacgttaataaaaaaattcgtttattattaaaaaaaaaaaaaaaaaa

SEQ ID NO: 10 - protein, 268 aa, Arabidopsis thaliana
  G28  (conserved domain in AA coordinates: 145-213)
MSMTADSQSDYAFLESIRRHLLGESEPILSESTASSVTQSCVTGQSIKPVYGRNPSFSKLYPCFTESWGDLPLKENDSEDMLVYGILNDAFHGGWEPSSSSSDEDRSSFPSVKIETPESFAAVDSVPVKKEKTSPVSAAVTAAKGKHYRGVRQRPWGKFAAEIRDPAKNGARVWLGTFETAEDAALAYDRAAFRMRGSRALLNFPLRVNSGEPDPVRIKSKRSSFSSSNENGAPKKRRTVAAGGGMDKGLTVKCEVVEVARGDRLLVL

SEQ ID NO: 11 - DNA, 785 bp, Arabidopsis thaliana
  G47
cttcttcttcacatcgatcatcatacaacaacaaaaaatggattacagagaatccaccggtgaaagtcagtcaaagtacaaaggaatccgtcgtcggaaatggggcaaatgggtatcagagattagagttccgggaactcgtgaccgtctctggttaggttcattctcaacagcagaaggtgccgccgtagcacacgacgttgctttcttctgtttacaccaacctgattctttagaatctctcaatttccctcatttgcttaatccttcactcgtttccagaacttctccgagatctatccagcaagctgcttctaacgccggcatggccattgacgccggaatcgtccacagtaccagcgtgaactctggatgcggagatacgacgacgtattacgagaatggagctgatcaagtggagccgttgaatatttcagtgtatgattatctgggcggccacgatcacgtttgatttatctcgacggtcatgatcacgtttgatcttcttttgagtaagattttgtaccataatcaaaacaggtgtggtgctaaaatcttactcaaaacaagattaggtaccacagagaaacaatcaaatggttgtgaatatacattataaggttttgattaatgtttgtttcactgatttagtgaagtttggtccattgtatacaaatctattcaagaaacctagcgcgagatcatgtttcgtgattgaagattgagatttttaagtattcgtaatatttttgtaaaatacaaataaaaaaaaaaaaaaaaaaaaa

SEQ ID NO: 12 - protein, 144 aa, Arabidopsis thaliana
  G47  (conserved domain in AA coordinates:11-80)
MDYRESTGESQSKYKGIRRRKWGKWVSEIRVPGTRDRLWLGSFSTAEGAAVAHDVAFFCLHQPDSLESLNFPHLLNPSLVSRTSPRSIQQAASNAGMAIDAGIVHSTSVNSGCGDTTTYYENGADQVEPLNISVYDYLGGHDHV

SEQ ID NO: 13 - DNA, 947 bp, Arabidopsis thaliana
  G156
  misc_feature (924)..(925): n is a, c, g, or t
  misc_feature (929)..(929): n is a, c, g, or t
  misc_feature (932)..(933): n is a, c, g, or t
aggaagagggagccactcataagaggaagaagagagagatgggtagagggaagatagagataaagaagatagagaatcagacggcgaggcaagtgaccttctccaagagaagaactggtcttataaagaagactcgtgagctctctattctctgtgacgctcacatcggtctcatcgtcttctcagccaccggaaagctttccgagttctgctccgaacagaacaggatgcctcaactcattgaccgatacttgcataccaacggattgcgacttcctgatcatcatgacgaccaggagcaattgcaccatgagatggaactactaagaagagagacatgtaaccttgagcttcgtctgcgtccattccatggacatgacttagcctccattcctcctaatgagcttgacggactcgagagacagctagaacattctgtcctcaaagtccgtgagcgtaagaggaggatgctagaagaagataacaacaacatgtaccgttggcttcatgagcatcgtgcagcgatggagtttcaacaagctgggatagataccaaaccaggggagtatcaacagtttatagagcagcttcagtgctataaaccaggggagtatcagcagtttctagagcagcagcaacaacaaccaaacagcgttcttcagcttgctacacttccttctgagattgatcctacttacaatctccagcttgctcagcctaatcttcaaaacgatccaacggcccagaatgattaatacaattctcaatagatatctactctttctttatggagacagattcatgaacttttattacctatattttgataagccagtgtcttcttttgtgtggctatggaaaccttgtttaaagcacaatgcacttgagttcttggttatataattaatcatcattattacatannaaanaannaaaaaaaaaaaaaa

SEQ ID NO: 14 - protein, 238 aa, Arabidopsis thaliana
  G156  (conserved domain in AA coordinates: 2-57)
MGRGKIEIKKIENQTARQVTFSKRRTGLIKKTRELSILCDAHIGLIVFSATGKLSEFCSEQNRMPQLIDRYLHTNGLRLPDHHDDQEQLHHEMELLRRETCNLELRLRPFHGHDLASIPPNELDGLERQLEHSVLKVRERKRRMLEEDNNNMYRWLHEHRAAMEFQQAGIDTKPGEYQQFIEQLQCYKPGEYQQFLEQQQQQPNSVLQLATLPSEIDPTYNLQLAQPNLQNDPTAQND

SEQ ID NO: 15 - DNA, 883 bp, Arabidopsis thaliana
  G157
gggcataacccttatcggagatttgaagccatgggaagaagaaaaatcgagatcaagcgaatcgagaacaaaagcagtcgacaagtcactttctccaaacgacgcaatggtctcatcgacaaagctcgacaactttcgattctctgtgaatcctccgtcgctgttgtcgtcgtatctgcctccggaaaactctatgactcttcctccggtgacgacatttccaagatcattgatcgttatgaaatacaacatgctgatgaacttagagccttagatcttgaagaaaaaattcagaattatcttccacacaaggagttactagaaacagtccaaagcaagcttgaagaaccaaatgtcgataatgtaagtgtagattctctaatttctctggaggaacaacttgagactgctctgtccgtaagtagagctaggaaggcagaactgatgatggagtatatcgagtcccttaaagaaaaggagaaattgctgagagaagagaaccaggttctggctagccagatgggaaagaatacgttgctggcaacagatgatgagagaggaatgtttccgggaagtagctccggcaacaaaataccggagactctcccgctgctcaattagccaccatcatcaacggctgagttttcaccttaaactcaaagcctgattcataattaagagaataaatttgtatattataaaaagctgtgtaatctcaaaccttttatcttcctctagtgtggaatttaaggtcaaaaagaaaacgagaaagtatggatcagtgttgtacctccttcggagacaagatcagagtttgtgtgtttgtgtctgaatgtacggattggatttttaaagttgtgctttctttcttcaaaaaaaaaaa

SEQ ID NO: 16 - protein, 196 aa, Arabidopsis thaliana
  G157  (conserved domain in AA coordinates: 2-57)
MGRRKIEIKRIENKSSRQVTFSKRRNGLIDKARQLSILCESSVAVVVVSASGKLYDSSSGDDISKIIDRYEIQHADELRALDLEEKIQNYLPHKELLETVQSKLEEPNVDNVSVDSLISLEEQLETALSVSRARKAELMMEYIESLKEKEKLLREENQVLASQMGKNTLLATDDERGMFPGSSSGNKIPETLPLLN

SEQ ID NO: 17 - DNA, 826 bp, Arabidopsis thaliana
  G162
agacatacaacaccaaaatcttcttcttcaccaacatattcactttcacagcaaaaaaaaacgagaggttctctcttattcgtaccgttttagcaaacaaatgggtcggagaaagatcaagatggagatggttcaggacatgaacacacgacaggttaccttttcaaaacggaggactggtttgttcaagaaggcgagcgagttagccacgctctgcaacgctgagttgggcatcgttgtcttttcaccaggaggcaagcctttctcctacgggaaaccgaatcttgattctgttgcagagcgattcatgagagaatatgatgattcagacagtggcgatgaagaaaaaagtggtaattacaggcctaaactgaagaggctgagtgaacgtctcgatttgctcaaccaagaggttgaagctgagaaggaacgaggcgagaagagtcaggagaagcttgaatctgctggggatgagagattcaaggagtccattgagacgcttaccctcgatgaactcaatgaatacaaagataggcttcagacagtccatggtaggattgaaggtcaagtcaatcacttgcaggcttcgtcttgcctcatgcttctctccagaaaatagctagaccgacttgttagagttacattctattttttgtatcagcctacagaacttaccaacacatgaaagttattgctggtgtagaattttctgtcatctatggggtgtgactttctatttgacatcaaatgaaaatgtacctggaaatttgtctgtattaatctcaagtgtacttgctaaacttgatcagctttttcgcaaaaaaaa

SEQ ID NO: 18 - protein, 172 aa, Arabidopsis thaliana
  G162  (conserved domain in AA coordinates: 2-57)
MGRRKIKMEMVQDMNTRQVTFSKRRTGLFKKASELATLCNAELGIVVFSPGGKPFSYGKPNLDSVAERFMREYDDSDSGDEEKSGNYRPKLKRLSERLDLLNQEVEAEKERGEKSQEKLESAGDERFKESIETLTLDELNEYKDRLQTVHGRIEGQVNHLQASSCLMLLSRK

SEQ ID NO: 19 - DNA, 2217 bp, Arabidopsis thaliana
  G175
  misc_feature (2192)..(2192): n is a, c, g, or t
atttctaaaaatagttaaactgttggtgatttttgtggaactgattaattaacacaattggagaaaacaaattgaaacttttttgtttgttagagagttaaggagaaattttatctaaccaagctgtgtaaatctcttgtagtttttctgccgatatacattttcattgtgttgagggtaaacgataatcaagaacgagagagagagagagcaagagcaagagatttctactacagaagatttattatattgatcattttgtgtgatcaacccataaaaacagagagacatagacaagtccatgtttcgatgtttcgatctctcttactgtctaaacggcgaaataaaaagtctgatgggtgtcacttattgcatgtatattagtaaatcagcttgagcccaagttaaagctgaaacttgggtttgcaatggctggtattgataataaagctgctgtaatgggagaatggttcgactgtagtactactaaccacaggaagagatcgaaagcggaacttggtagagagttttctttaaattacatcaagaatgaggattctttgcaaaccacctttcaagaaagttcacgaggagctcttcgtgaaaggattgctgcgagatccgggtttaatgcaccgtggttaaacactgaggatattcttcagtcgaaatctttaaccatctcttctcctggtcttagtcctgcaactctgttagagtctcctgttttcctctcaaaccctttgctatctccaacaaccgggaagctctcatcagtaccttctgataaggctaaagctgagttatttgacgacattaccacatccttagccttccaaaccatttcaggaagtggccttgatcctactaacatcgctttagaacccgatgattcccaagactatgaagaaagacagctcggcggtttaggagactcgatggcttgttgtgcacctgcagatgatggatacaactggagaaaatatggacaaaagctagttaaaggaagtgagtatccgcggagctattacaagtgcacgcacccgaattgtgaggccaagaagaaggttgaacggtctcgggaaggtcatattatagagatcatatacacaggagatcatatacacagcaaacctccacctaaccgccggtcagggattggatcatccggtactggccaagacatgcaaatagatgcaaccgaatacgaaggttttgctggaaccaatgagaacatagaatggacatcacctgtatctgcagagctcgaatacggaagccattcaggatcaatgcaggttcaaaacgggactcatcagttcgggtatggtgatgcagcagctgatgccttatatagagatgaaaacgaagatgatcgcacgtcccacatgagtgtttccctgacttacgatggagaggtagaagagtccgaatcaaagagaaggaaactagaagcttatgcaacagaaacgagtggatcaaccagagccagccgtgagccaagagttgtggtgcagaccacaagtgacattgacatcctcgatgatggttatcgctggcgcaagtatgggcaaaaagtcgttaaaggaaacccgaatccaaggagctactataaatgcacagctaatggatgtaccgtaacgaagcatgtagagagagcctctgatgacttcaagagcgtactaacaacttatataggcaagcacacccacgttgtaccagcagcacgcaacagcagccacgtcggtgcaggcagttcagggactctccaaggcagtttagcgactcagacccacaaccacaatgtgcactatccaatgccacacagtagatctgagggactggccacagccaactcatctctatttgacttccagtcacacctgaggcatcctacaggtttctccgtttacataggccaatctgagctttctgatctttcaatgcctggtctaactattgggcaagagaagcttaccagcctgcaggcgcctgacattggggatccaactggcctaatgttgcagttagcagcacagccgaaggtggaaccagtgtcaccacaacagggacttgatttgtcagcgagctcattgatatgcagagagatgttgagtagattacgacagatatgaaacaaatctctttgttcactgattgctcaaatttttgaataaatgaaaaattgaganaaaaaaaaaaaaaaaaaaaaaaaaa

SEQ ID NO: 20 - protein, 568 aa, Arabidopsis thaliana
  G175  (conserved domain in AA coordinates: 178-234, 372-428)
MAGIDNKAAVMGEWFDCSTTNHRKRSKAELGREFSLNYIKNEDSLQTTFQESSRGALRERIAARSGFNAPWLNTEDILQSKSLTISSPGLSPATLLESPVFLSNPLLSPTTGKLSSVPSDKAKAELFDDITTSLAFQTISGSGLDPTNIALEPDDSQDYEERQLGGLGDSMACCAPADDGYNWRKYGQKLVKGSEYPRSYYKCTHPNCEAKKKVERSREGHIIEIIYTGDHIHSKPPPNRRSGIGSSGTGQDMQIDATEYEGFAGTNENIEWTSPVSAELEYGSHSGSMQVQNGTHQFGYGDAAADALYRDENEDDRTSHMSVSLTYDGEVEESESKRRKLEAYATETSGSTRASREPRVVVQTTSDIDILDDGYRWRKYGQKVVKGNPNPRSYYKCTANGCTVTKHVERASDDFKSVLTTYIGKHTHVVPAARNSSHVGAGSSGTLQGSLATQTHNHNVHYPMPHSRSEGLATANSSLFDFQSHLRHPTGFSVYIGQSELSDLSMPGLTIGQEKLTSLQAPDIGDPTGLMLQLAAQPKVEPVSPQQGLDLSASSLICREMLSRLRQI

SEQ ID NO: 21 - DNA, 837 bp, Arabidopsis thaliana
  G180
gtaattacgatctacaacaagtgacatcgtcgtcgacgacgattcaagagaatatgaacttcctcgttccttttgaagaaaccaatgtcttaacctttttctcttcttcttcttcctcttctctttcttctccttctttccccattcacaactcttcctccactactactactcatgcacctctagggttttctaataatcttcagggtggaggacccttgggatcaaaggtggttaatgatgatcaggagaattttggaggtggaactaacaatgatgctcattctaattcttggtggagatcaaatagtggaagtggagatatgaagaacaaagtgaagataaggaggaaactaagagagccaagattctgtttccaaaccaaaagcgatgttgatgttcttgacgatggctacaaatggcgtaaatatggtcagaaagtcgtcaagaacagccttcaccccaggagttattacagatgcacacacaacaactgtagggtgaaaaagagagtggagcgactatcggaagattgtagaatggtgattactacttacgaaggtcgtcacaaccacattccctctgatgactccacttctcctgaccatgattgtctctcttccttttaacatctctttctatatatctatatatagacagttatatgtgcacatatagatgtgtgatatattgcatatttgatattgcatgtgtttttcaagagtatgtcatcagatgttatgcatatattcttgacttgttgcttatagtatacatatgtaataatatatattgacattggtagttcatttctgttcaaacaaaaaaaaaaaaaaa

SEQ ID NO: 22 - protein, 191 aa, Arabidopsis thaliana
  G180  (conserved domain in AA coordinates: 118-174)
MNFLVPFEETNVLTFFSSSSSSSLSSPSFPIHNSSSTTTTHAPLGFSNNLQGGGPLGSKVVNDDQENFGGGTNNDAHSNSWWRSNSGSGDMKNKVKIRRKLREPRFCFQTKSDVDVLDDGYKWRKYGQKVVKNSLHPRSYYRCTHNNCRVKKRVERLSEDCRMVITTYEGRHNHIPSDDSTSPDHDCLSSF

SEQ ID NO: 23 - DNA, 1458 bp, Arabidopsis thaliana
  G183
atgagtgattttgatgaaaacttcatcgaaatgacgtcgtattgggctccaccatccagtcctagcccaagaacgatattggcaatgctggagcaaaccgacaatggtctgaatccaatcagtgagatcttccctcaagaaagcttgccaagagatcatactgatcaatctggacaaagatctggtcttcgtgagagactggctgcaagagtaggattcaatcttccaacactcaatacagaagaaaacatgagtcctttggatgcatttttcaggagctcgaatgttcctaattctcctgtcgttgcaatctctccaggattcagtccatcagcactattgcatactcccaatatggtcagtgattcttcccagattatccctccgtcttcagccaccaattacggacctctagagatggtggaaacttccggtgaagacaatgcagcgatgatgatgttcaacaacgatcttccttatcagccgtacaatgttgatctgccttctctagaagtctttgatgatattgcaacggaagagtccttttatatcccatcttatgaacctcatgttgacccaattggaactcctttagtcacatcctttgaatctgaactcgttgacgatgcccataccgacatcatctccattgaggacagtgagagcgaggatggaaacaaagatgatgacgacgaggacttccaatacgaagacgaagacgaagaccaatacgaccaagatcaagatgtagatgaagatgaagaggaagaaaaagatgaagacaatgttgcattagatgatcctcaacctccacctccaaagagaaggagatatgaggtatcaaacatgattggagccacaagaacaagcaagacacaaaggatcatacttcagatggaaagcgacgaagacaatcctaacgatggttatcgctggagaaaatacggtcagaaagtcgtcaaaggaaatcctaatccgaggagttacttcaagtgcacaaacatcgagtgcagagtgaaaaaacatgtggagagaggagcagacaatatcaagttggttgtgactacatacgatgggatacacaaccatccttcaccacctgcacgtagaagcaattccagttcaaggaaccggtctgcaggggcaacaatacctcaaaatcagaatgatcgaaccagtcggttaggtagggctcctcctactcctactcctcctactcctcctccttcgtcttacacacctgaggagatgaggcctttctcttcgttggctacagaaattgatctgacagaggtttatatgaccggaatctctatgctgccgaatataccggtttacgagaattcgggttttatgtaccagaatgatgaaccgacgatgaatgcgatgccggatggttcagatgtgtacgatgggatcatggaacgcctgtattttaagtttggtgtcgacatgtag

SEQ ID NO: 24 - protein, 485 aa, Arabidopsis thaliana
  G183  (conserved domain in AA coordinates: 307-363)
MSDFDENFIEMTSYWAPPSSPSPRTILAMLEQTDNGLNPISEIFPQESLPRDHTDQSGQRSGLRERLAARVGFNLPTLNTEENMSPLDAFFRSSNVPNSPVVAISPGFSPSALLHTPNMVSDSSQIIPPSSATNYGPLEMVETSGEDNAAMMMFNNDLPYQPYNVDLPSLEVFDDIATEESFYIPSYEPHVDPIGTPLVTSFESELVDDAHTDIISIEDSESEDGNKDDDDEDFQYEDEDEDQYDQDQDVDEDEEEEKDEDNVALDDPQPPPPKRRRYEVSNMIGATRTSKTQRIILQMESDEDNPNDGYRWRKYGQKVVKGNPNPRSYFKCTNIECRVKKHVERGADNIKLVVTTYDGIHNHPSPPARRSNSSSRNRSAGATIPQNQNDRTSRLGRAPPTPTPPTPPPSSYTPEEMRPFSSLATEIDLTEVYMTGISMLPNIPVYENSGFMYQNDEPTMNAMPDGSDVYDGIMERLYFKFGVDM

SEQ ID NO: 25 - DNA, 1191 bp, Arabidopsis thaliana
  G188
ctctcaccaacataatcaaagaagctttcctcacgaattcaagatcgccatgtcctccgaggattgggatctcttcgccgtcgtcagaagctgcagctcttctgtttccaccaccaattcttgtgctggtcatgaagacgacataggaaactgtaaacaacaacaagatcctcctcctcctcctctgtttcaagcttcttcttcttgcaacgagttacaagattcttgcaaaccatttttacccgttactactactactactactacttggtctcctcctcctctacttcctcctcctaaagcctcatcaccatctcccaatatcttactaaaacaagaacaagtacttctcgaatcacaagatcaaaaacctcctcttagtgttagggttttcccaccatccacttcttcttctgtctttgtttttagaggtcaacgcgaccagcttcttcaacaacaatcccaacctccccttcgatctagaaaaagaaagaatcagcaaaaaagaaccatatgtcatgtaacgcaagagaatctttcttctgatttgtgggcttggcgtaaatacggtcaaaaacccatcaaaggctctccttatccaaggaattattacagatgtagtagctcaaaaggatgtttagcacgaaaacaagttgaaagaagtaatttagatcctaatatcttcatcgttacttacaccggagaacacactcatccacgtcctactcaccggaactctctcgccggaagtactcgtaacaaatctcagcccgttaacccggttcctaaaccggacacatctcctttatcggatacagtaaaagaagagattcatctttctccgacgacaccgttgaaaggaaacgatgacgttcaagaaacgaatggagatgaagatatggttggtcaagaagtcaacatggaagaggaagaggaggaagaagaagtggaagaagatgatgaagaagaagaagatgatgatgacgtggatgatcttttgataccaaatttagcggtgagagatcgagatgatttgttcttcgctggaagttttccatcttggtccgccggatccgccggtgacggtggtggatgatgaaaacgaataaaatctcaatttacaatttacaaaaagaaaaaagtcagtttttaattattatttttgtttgttaaaacttgacatttattgtg

SEQ ID NO: 26 - protein, 348 aa, Arabidopsis thaliana
  G188  (conserved domain in AA coordinates: 175-222)
MSSEDWDLFAVVRSCSSSVSTTNSCAGHEDDIGNCKQQQDPPPPPLFQASSSCNELQDSCKPFLPVTTTTTTTWSPPPLLPPPKASSPSPNILLKQEQVLLESQDQKPPLSVRVFPPSTSSSVFVFRGQRDQLLQQQSQPPLRSRKRKNQQKRTICHVTQENLSSDLWAWRKYGQKPIKGSPYPRNYYRCSSSKGCLARKQVERSNLDPNIFIVTYTGEHTHPRPTHRNSLAGSTRNKSQPVNPVPKPDTSPLSDTVKEEIHLSPTTPLKGNDDVQETNGDEDMVGQEVNMEEEEEEEEVEEDDEEEEDDDDVDDLLIPNLAVRDRDDLFFAGSFPSWSAGSAGDGGG

SEQ ID NO: 27 - DNA, 1115 bp, Arabidopsis thaliana
  G189
ccacaactctctccttgtagagagagagattttatggcggtggagctcatgactcggaattacatctccggcgtcggagctgatagcttcgccgttcaagaagcagctgcttcaggactcaaaagtatcgaaaatttcatcggtttaatgtctcgtgatagctttaactctgatcagccatcttcttcttccgcctccgcctccgcctccgccgccgcagatcttgaatcagctcgtaacacaacggcggacgcggctgtttcaaagtttaaaagagtcatatctctcttagatcgaactcgaaccggacacgcccggtttagacgtgctccggttcatgttatttctccggttcttttacaagaagaaccaaaaacgacgccgtttcagtctcctcttcctcctccgccgcaaatgatccgaaaaggttcgttttcttcatcgatgaaaacgattgatttctcatctctctcctctgtaacaacggaatcagacaaccagaagaagattcatcatcatcaacgtccctctgaaacggcgccgtttgcgtctcaaactcaaagcctctccacgacggtctcgtctttctcaaaatcaacaaagagaaaatgtaactctgagaatcttctcaccggaaaatgcgcttccgcttcttcctccggtcgttgtcattgctcgaagaaaagaaagataaaacagaggagaataattagggttccggcgataagtgcaaaaatgtccgatgtaccaccggacgattattcatggaggaaatacggacaaaaaccaattaaaggatctccacatccaagaggatattataagtgtagtagcgtaagaggttgtccagcacgtaaacatgttgagagagcagctgatgattcgtccatgttgattgttacttatgaaggagatcataatcattctctctccgccgctgatctcgccggagccgccgttgctgatcttattttggaatcgtcttgaaaagaacaaatctttatttaaggcttttataatataaatttagatccttacttagtgaagtactcaaactatgaatgaaatcaatgtaatcaaaatcaaaaagcttttgctaaaaaaaaaaaaaaaaa

SEQ ID NO: 28 - protein, 317 aa, Arabidopsis thaliana
  G189  (conserved domain in AA coordinates: 240-297)
MAVELMTRNYISGVGADSFAVQEAAASGLKSIENFIGLMSRDSFNSDQPSSSSASASASAAADLESARNTTADAAVSKFKRVISLLDRTRTGHARFRRAPVHVISPVLLQEEPKTTPFQSPLPPPPQMIRKGSFSSSMKTIDFSSLSSVTTESDNQKKIHHHQRPSETAPFASQTQSLSTTVSSFSKSTKRKCNSENLLTGKCASASSSGRCHCSKKRKIKQRRIIRVPAISAKMSDVPPDDYSWRKYGQKPIKGSPHPRGYYKCSSVRGCPARKHVERAADDSSMLIVTYEGDHNHSLSAADLAGAAVADLILESS

SEQ ID NO: 29 - DNA, 1171 bp, Arabidopsis thaliana
  G192
cttttttctcttctctcctcagagattcgaagctttttgtctcccctgagtaaccaaattcaatggccgacgattgggatctccacgccgtagtcagaggctgctcagccgtaagctcatcagctactaccaccgtatattcccccggcgtttcatctcacacaaaccctatattcaccgtcggacgacaaagtaatgccgtctccttcggagagattcgagatctctacacaccgttcacacaagaatctgtcgtctcttcgttttcttgtataaactacccagaagaacctagaaagccacagaaccagaaacgtcctctttctctctctgcttcttccggtagcgtcactagcaaacccagtggctccaatacctctagatctaaaagaagaaagatacagcataagaaagtgtgccatgtagcagcagaagctttaaactccgatgtctgggcatggcgaaagtacggacagaaacccatcaaaggttcaccatatccaagaggatactacagatgtagtacatcaaaaggttgtttagcccgtaaacaagtggagcgaaatagatccgacccgaagatgtttatcgtcacttacacggcggagcataatcatccagctccgacacaccgtaattctctcgccggaagcacacgtcagaaaccatccgatcaacagacgagtaaatctccgacgaccactattgctacttattcatcgtctccggtgacttcagccgacgaatttgttttgcctgttgaggatcatctagcggtgggagatcttgacggagaagaagatctgttatctttgtcggatacggtggttagcgatgatttcttcgatgggttagaggaattcgcagccggagatagcttttccgggaactcggctccggcgagttttgatctctcttgggttgtgaacagtgccgccactaccaccggaggaatatgattagattacgacggcttagaatactcttattaggacagatttataggattaaggaattattctcggagcatatgtaaaaataggataaaagaaaatgttctttgttactttttttcgggttttcttcctattgtttctaaacatcttagaaaaaatttaattgtatattccttaagctcgatacatcttgttttaaaaaaaaaaaaaaaaaa

SEQ ID NO: 30 - protein, 298 aa, Arabidopsis thaliana
  G192  (conserved domain in AA coordinates: 128-185)
MADDWDLHAVVRGCSAVSSSATTTVYSPGVSSHTNPIFTVGRQSNAVSFGEIRDLYTPFTQESVVSSFSCINYPEEPRKPQNQKRPLSLSASSGSVTSKPSGSNTSRSKRRKIQHKKVCHVAAEALNSDVWAWRKYGQKPIKGSPYPRGYYRCSTSKGCLARKQVERNRSDPKMFIVTYTAEHNHPAPTHRNSLAGSTRQKPSDQQTSKSPTTTIATYSSSPVTSADEFVLPVEDHLAVGDLDGEEDLLSLSDTVVSDDFFDGLEEFAAGDSFSGNSAPASFDLSWVVNSAATTTGGI

SEQ ID NO: 31 - DNA, 1501 bp, Arabidopsis thaliana
  G196
tcgacatcagatttctctcacggattcctaatcatttttattatatttggatatttgctaattcttcccgtgtataaatctcatataaacacgcatcatacatatatattatgtgcagcgtctttgagtttcaagacatggacaacttccaaggagatctaacagacgtcgtacgaggaataggatcaggccacgtgtcaccatctcctggaccaccggaaggtccatctccgagcagcatgtctccgccgccaacatcagatctccacgtggaattcccctccgccgctacttctgccagctgtctcgcaaatcccttcggagacccgttcgtaagcatgaaggatcctctcatccacctcccggccagctacatctccggcgccggtgataataaaagcaacaaaagttttgcaatctttccaaagatttttgaggatgatcatattaagagtcaatgcagtgtcttcccaagaattaagatctcgcaaagtaacaatatccacgatgcctccacgtgtaattctccggccataaccgtctcctctgccgccgtagcagcttcgccgtggggcatgatcaacgttaataccactaacagtccaagaaactgtttacttgtcgataataataacaacacgtcatcatgctcacaggttcagatctcttcttcccctcggaatctcggaattaagagaaggaagagccaggcaaagaaagtggtgtgcataccggctccagccgctatgaacagccggtccagtggagaagttgttccgtctgatctatgggcttggcgaaagtacggtcaaaaacctatcaaaggttctccttatccaaggggttactacagatgtagcagctcaaaaggttgttcagctaggaaacaagtcgaacgtagccgcactgatccaaacatgttagtcattacttacacctctgagcataaccacccatggcctactcaacgcaacgctctcgcaggttccactcgttcctcttcctcctcctctttaaacccttcttccaaatcctcaaccgcagccgccactacttctccctcatccagagttttccaaaacaacagcagcaaagacgaacccaataactccaacttgccttcctcttccactcatcctccttttgacgccgccgcaattaaggaggagaacgtggaagagcgtcaggaaaagatggagttcgattataatgacgttgaaaatacctatagaccggagttgttgcaagagtttcaacatcagccggaggatttctttgccgatctcgacgagcttgagggagattctttgactatgttgctctctcacagtagcggcggaggcaacatggaaaacaaaacgacgattccagacgtttttagtgatttctttgacgacgacgagtcctcaaggtcgttataaatattgttgttaatgtatacatagaaatgaaattattcatgtaattcgttttgtgttaaatgacggtatttgcctttgca

SEQ ID NO: 32 - protein, 436 aa, Arabidopsis thaliana
  G196  (conserved domain in AA coordinates:223-283)
MCSVFEFQDMDNFQGDLTDVVRGIGSGHVSPSPGPPEGPSPSSMSPPPTSDLHVEFPSAATSASCLANPFGDPFVSMKDPLIHLPASYISGAGDNKSNKSFAIFPKIFEDDHIKSQCSVFPRIKISQSNNIHDASTCNSPAITVSSAAVAASPWGMINVNTTNSPRNCLLVDNNNNTSSCSQVQISSSPRNLGIKRRKSQAKKVVCIPAPAAMNSRSSGEVVPSDLWAWRKYGQKPIKGSPYPRGYYRCSSSKGCSARKQVERSRTDPNMLVITYTSEHNHPWPTQRNALAGSTRSSSSSSLNPSSKSSTAAATTSPSSRVFQNNSSKDEPNNSNLPSSSTHPPFDAAAIKEENVEERQEKMEFDYNDVENTYRPELLQEFQHQPEDFFADLDELEGDSLTMLLSHSSGGGNMENKTTIPDVFSDFFDDDESSRSL

SEQ ID NO: 33 - DNA, 750 bp, Arabidopsis thaliana
  G211
atgatgtcatgtggtgggaagaagccagtgtctaagaaaacaacgccgtgttgcacgaagatggggatgaagagaggaccatggacggtggaggaagacgagattcttgtgagcttcattaagaaagaaggtgaaggacggtggcgatcgcttcctaagagagctggtttactcagatgtggaaagagctgtcgtctacggtggatgaactatctccgaccctcggttaaacgtggaggaattacgtcggacgaggaagatctcatcctccgtcttcaccgcctcctcggcaacaggtggtcattgatcgcgggaaggataccgggaaggactgataatgaaattaagaactattggaacactcatcttcgtaagaaacttttaaggcaaggaattgatcctcaaacccacaagcctcttgatgcaaacaacatccataaaccagaagaagaagtttccggtggacaaaagtaccctctagagcctatttctagttctcatactgatgataccactgttaatggcggggatggagatagcaagaacagtatcaatgtctttggtggtgaacacggctacgaagactttggtttctgctacgacgacaagttctcatcgtttcttaattcgctcatcaacgatgttggtgatccttttggtaatattatcccaatatctcaacctttgcagatggatgattgtaaggatgggattgttggagcgtcgtcttctagcttaggacatgactag

SEQ ID NO: 34 - protein, 249 aa, Arabidopsis thaliana
  G211  (conserved domain in AA coordinates:24-137)
MMSCGGKKPVSKKTTPCCTKMGMKRGPWTVEEDEILVSFIKKEGEGRWRSLPKRAGLLRCGKSCRLRWMNYLRPSVKRGGITSDEEDLILRLHRLLGNRWSLIAGRIPGRTDNEIKNYWNTHLRKKLLRQGIDPQTHKPLDANNIHKPEEEVSGGQKYPLEPISSSHTDDTTVNGGDGDSKNSINVFGGEHGYEDFGFCYDDKFSSFLNSLINDVGDPFGNIIPISQPLQMDDCKDGIVGASSSSLGHD

SEQ ID NO: 35 - DNA, 2240 bp, Arabidopsis thaliana
  G214
tgagatttctccatttccgtagcttctggtctcttttctttgtttcattgatcaaaagcaaatcacttcttcttcttcttcttctcgatttcttactgttttcttatccaacgaaatctggaattaaaaatggaatctttatcgaatccaagctgattttgtttctttcattgaatcatctctctaaagtggaattttgtaaagagaagatctgaagttgtgtagaggagcttagtgatggagacaaattcgtctggagaagatctggttattaagactcggaagccatatacgataacaaagcaacgtgaaaggtggactgaggaagaacataatagattcattgaagctttgaggctttatggtagagcatggcagaagattgaagaacatgtagcaacaaaaactgctgtccagataagaagtcacgctcagaaatttttctccaaggtagagaaagaggctgaagctaaaggtgtagctatgggtcaagcgctagacatagctattcctcctccacggcctaagcgtaaaccaaacaatccttatcctcgaaagacgggaagtggaacgatccttatgtcaaaaacgggtgtgaatgatggaaaagagtcccttggatcagaaaaagtgtcgcatcctgagatggccaatgaagatcgacaacaatcaaagcctgaagagaaaactctgcaggaagacaactgttcagattgtttcactcatcagtatctctctgctgcatcctccatgaataaaagttgtatagagacatcaaacgcaagcactttccgcgagttcttgccttcacgggaagagggaagtcagaataacagggtaagaaaggagtcaaactcagatttgaatgcaaaatctctggaaaacggtaatgagcaaggacctcagacttatccgatgcatatccctgtgctagtgccattggggagctcaataacaagttctctatcacatcctccttcagagccagatagtcatccccacacagttgcaggagattatcagtcgtttcctaatcatataatgtcaacccttttacaaacaccggctctttatactgccgcaactttcgcctcatcattttggcctcccgattctagtggtggctcacctgttccagggaactcacctccgaatctggctgccatggccgcagccactgttgcagctgctagtgcttggtgggctgccaatggattattacctttatgtgctcctcttagttcaggtggtttcactagtcatcctccatctacttttggaccatcatgtgatgtagagtacacaaaagcaagcactttacaacatggttctgtgcagagccgagagcaagaacactccgaggcatcaaaggctcgatcttcactggactcagaggatgttgaaaataagagtaaaccagtttgtcatgagcagccttctgcaacacctgagagtgatgcaaagggttcagatggagcaggagacagaaaacaagttgaccggtcctcgtgtggctcaaacactccgtcgagtagtgatgatgttgaggcggatgcatcagaaaggcaagaggatggcaccaatggtgaggtgaaagaaacgaatgaagacactaataaacctcaaacttcagagtccaatgcacgccgcagtagaatcagctccaatataaccgatccatggaagtctgtgtctgacgagggtcgaattgccttccaagctctcttctccagagaggtattgccgcaaagttttacatatcgagaagaacacagagaggaagaacaacaacaacaagaacaaagatatccaatggcacttgatcttaacttcacagctcagttaacaccagttgatgatcaagaggagaagagaaacacaggatttcttggaatcggattagatgcttcaaagctaatgagtagaggaagaacaggttttaaaccatacaaaagatgttccatggaagccaaagaaagtagaatcctcaacaacaatcctatcattcatgtggaacagaaagatcccaaacggatgcggttggaaactcaagcttccacatgagactctattttcatctgatctgttgtttgtactctgtttttaagttttcaagaccactgctacattttctttttcttttgaggcctttgtatttgtttccttgtccatagtcttcctgtaacatttgactctgtattattcaacaaatcataaactgtttaatctttttttttcca

SEQ ID NO: 36 - protein, 608 aa, Arabidopsis thaliana
  G214  (conserved domain in AA coordinates: 22-71)
METNSSGEDLVIKTRKPYTITKQRERWTEEEHNRFIEALRLYGRAWQKIEEHVATKTAVQIRSHAQKFFSKVEKEAEAKGVAMGQALDIAIPPPRPKRKPNNPYPRKTGSGTILMSKTGVNDGKESLGSEKVSHPEMANEDRQQSKPEEKTLQEDNCSDCFTHQYLSAASSMNKSCIETSNASTFREFLPSREEGSQNNRVRKESNSDLNAKSLENGNEQGPQTYPMHIPVLVPLGSSITSSLSHPPSEPDSHPHTVAGDYQSFPNHIMSTLLQTPALYTAATFASSFWPPDSSGGSPVPGNSPPNLAAMAAATVAAASAWWAANGLLPLCAPLSSGGFTSHPPSTFGPSCDVEYTKASTLQHGSVQSREQEHSEASKARSSLDSEDVENKSKPVCHEQPSATPESDAKGSDGAGDRKQVDRSSCGSNTPSSSDDVEADASERQEDGTNGEVKETNEDTNKPQTSESNARRSRISSNITDPWKSVSDEGRIAFQALFSREVLPQSFTYREEHREEEQQQQEQRYPMALDLNFTAQLTPVDDQEEKRNTGFLGIGLDASKLMSRGRTGFKPYKRCSMEAKESRILNNNPIIHVEQKDPKRMRLETQAST

SEQ ID NO: 37 - DNA, 407 bp, Arabidopsis thaliana
  G226
ccagtagttatggataataccaaccgtcttcgtcttcgtcgcggtcccagtcttaggcaaactaagttcactcgatcccgatatgactctgaagaagtgagtagcatcgaatgggagtttatcagtatgaccgaacaagaagaagatctcatctctcgaatgtacagacttgtcggtaataggtgggatttaatagcaggaagagtcgtaggaagaaaggcaaatgagattgagagatactggattatgagaaactctgactatttttctcacaaacgacgacgtcttaataattctccctttttttctacttctcctcttaatctccaagaaaatctaaaattgtaaagaaatcaaaataaaagctttcaatcataaaagtagaacaaatcttgaatgtcttctca

SEQ ID NO: 38 - protein, 112 aa, Arabidopsis thaliana
  G226  (conserved domain in AA coordinates: 28-78)
MDNTNRLRLRRGPSLRQTKFTRSRYDSEEVSSIEWEFISMTEQEEDLISRMYRLVGNRWDLIAGRVVGRKANEIERYWIMRNSDYFSHKRRRLNNSPFFSTSPLNLQENLKL

SEQ ID NO: 39 - DNA, 1046 bp, Arabidopsis thaliana
  G241
gaaaaacatttcaacttcttttatcagcaatcacaaatcaaagagatgggaagagctccatgctgtgagaagatggggttgaagagaggaccatggacacctgaagaagatcaaatcttggtctcttttatcctcaaccatggacatagtaactggcgagccctccctaagcaagctggtcttttgagatgtggaaaaagctgtagacttaggtggatgaactatttaaagcctgatattaaacgtggcaatttcaccaaagaagaggaagatgctatcatcagcttacaccaaatacttggcaatagatggtcagcgattgcagcaaaactgcctggaagaaccgataacgagatcaagaacgtatggcacactcacttgaagaagagactcgaagattatcaaccagctaaacctaagaccagcaacaaaaagaagggtactaaaccaaaatctgaatccgtaataacgagctcgaacagtactagaagcgaatcggagctagcagattcatcaaacccttctggagaaagcttattttcgacatcgccttcgacaagtgaggtttcttcgatgacactcataagccacgacggctatagcaacgagattaatatggataacaaaccgggagatatcagtactatcgatcaagaatgtgtttctttcgaaacttttggtgcggatatcgatgaaagcttctggaaagagacactgtatagccaagatgaacacaactacgtatcgaatgacctagaagtcgctggtttagttgagatacaacaagagtttcaaaacttgggctccgctaataatgagatgatttttgacagtgagatggaacttctggttcgatgtattggctagaaccggcggggaacaagatctcttagccgggctctagttaacatgtttgaggagtaaagtgaaatggtgcaaattagttaaggctaagaaattcaaaagcttttgtttaccgagaaaaaaacacactctaactcttgatgtgatgtagttagtgtattaattagaggctgcgttttcaa

SEQ ID NO: 40 - protein, 273 aa, Arabidopsis thaliana
  G241  (conserved domain in AA coordinates: 14-114)
MGRAPCCEKMGLKRGPWTPEEDQILVSFILNHGHSNWRALPKQAGLLRCGKSCRLRWMNYLKPDIKRGNFTKEEEDAIISLHQILGNRWSAIAAKLPGRTDNEIKNVWHTHLKKRLEDYQPAKPKTSNKKKGTKPKSESVITSSNSTRSESELADSSNPSGESLFSTSPSTSEVSSMTLISHDGYSNEINMDNKPGDISTIDQECVSFETFGADIDESFWKETLYSQDEHNYVSNDLEVAGLVEIQQEFQNLGSANNEMIFDSEMELLVRCIG

SEQ ID NO: 41 - DNA, 1317 bp, Arabidopsis thaliana
  G248
tcgacagttggtgtttaaatggaattctcattgatctccgatgaaaatttcatcttaaacgatgctcatcgatgtcctgttaatgatgatgcatcgcatataccaaaaaataatcttaactttttcaatgacaatttaggtcaatcttctcgtactggatggtctttttcaccagatctgactgatatctctaatcagcaccaccaaaatcttatacctttgatcccaaattatgattctcaaaatcagaatttggatactaatcaaaaccatttggtttacaactcttcctcctatgaaattccatcaaactacccattcatgagtatcaaatcctactcaaatattgatactcttgagcaatctatgaataacatagtcaacaacggaaaaatccatatgatcgataatcccccaatttttgcaaaccctaagggtatattcgaaaattttcatgatttgcaggaatacactatagggaatgagattgtacacaatgaagaactgactaataagggttatgagccaactcttgataaggtaatgggtgaacctcaattatttgatgtgccagtgctagaaggtatcaaaaatacaaccaacgaaatcatgaatcaacttgaagatgataagatgaaaaaaacttatgagaataaaaaggaggcgagcacaagcaaatatttgaagaaaagtgacatcaccaaaaaaagatggacagaatctgaggacataaaattgaaagagatggtggcacttgaacccaaaaaatggacaaaggtcgcaaaacattttgaaggacgaacaccaaaacaatgcagagagaggtggcataaccatgctcgtcctaacgttaagaaaactacttggagtgaagaagaagatcaaatactaattgaagtacacaaagtaattggtgccaaatggatccagatctcagagcaacttccggggaggagctataacaatgttaagaaccattggaataccacaaagcgtcgggtgcaaaataaaagtggtcgaactgtcaaccgtgtcggcaataacatccttgaaaactacataaggagtatcacaatcaacaacgatgatgaatctgatggtgaaccgacaaacattgagaattatcatgatgactctgaagatatgttatatggggagatgaatttgagtccagaggctataacgcagaccaccaaaccattgaccgatgcttctacaatatcaccttatattccgatgccaaaagaaaactatactctggaggtttgtgaatcactggaggactatctagagctgctgcgttggtgggattaatgc

SEQ ID NO: 42 - protein, 431 aa, Arabidopsis thaliana
  G248  (conserved domain in AA coordinates: 264-332)
MEFSLISDENFILNDAHRCPVNDDASHIPKNNLNFFNDNLGQSSRTGWSFSPDLTDISNQHHQNLIPLIPNYDSQNQNLDTNQNHLVYNSSSYEIPSNYPFMSIKSYSNIDTLEQSMNNIVNNGKIHMIDNPPIFANPKGIFENFHDLQEYTIGNEIVHNEELTNKGYEPTLDKVMGEPQLFDVPVLEGIKNTTNEIMNQLEDDKMKKTYENKKEASTSKYLKKSDITKKRWTESEDIKLKEMVALEPKKWTKVAKHFEGRTPKQCRERWHNHARPNVKKTTWSEEEDQILIEVHKVIGAKWIQISEQLPGRSYNNVKNHWNTTKRRVQNKSGRTVNRVGNNILENYIRSITINNDDESDGEPTNIENYHDDSEDMLYGEMNLSPEAITQTTKPLTDASTISPYIPMPKENYTLEVCESLEDYLELLRWWD

SEQ ID NO: 43 - DNA, 1391 bp, Arabidopsis thaliana
  G254
cgatttcgagctctatggtgtccgtaaaccctagacctaagggttttccagttttcgattcctcgaatatgagtttaccaagctccgatggatttggttcgattccggccacgggacggaccagtacggtgtcgttttctgaggatccgacgacgaagattcggaagccgtacacaatcaagaagtcgagagagaattggacagatcaagagcacgataaatttctagaagctcttcacttattcgatagggattggaagaaaatagaagcctttgttggatcaaaaacagtagttcagatacgaagccacgctcagaaatactttctcaaagttcagaagagtggtgctaacgaacatcttccacttcctcgacctaagaggaaagcgagtcatccttatcctataaaggctcctaaaaatgttgcttatacctctctcccgtcttcgagtacattaccgttgcttgagcctggttatttgtatagctctgattcgaagtcattgatgggaaaccaggctgtttgtgcatctacctcttcttcgtggaatcatgaatcgacaaatctgccaaaaccggtgattgaagaggaaccgggagtctcggccacggctcctctcccaaataatcgctgcagacaggaagatacagagagggtacgagcagtgacaaagccaaataacgaagaaagttgtgaaaagccacatagagtgatgccgaattttgctgaagtttacagcttcattggaagtgtcttcgatcccaacacatcaggccacctccagagattaaagcagatggatccaataaatatggaaacggttcttttactgatgcaaaacctgtctgtaaatctgacaagtcccgagtttgcagagcaaaggaggttgatatcatcatacagcgctaaagctttgaaatagagatagaataaaacaataatgtaccttatgtgagatcaagagacaatcatccaaggtctgtatgcattgcttggatttaggcctcgtgttctcactacaggagcagaaccaatcgcaaagactcttagatggctactgagttgtggtttttatgtctctgtaagtcgcggtggagcacacgtgtttgtcctgtcttgtgtatgtgtgtatagataatacaaggttttgcagagtaaggtcacagttagctgcaagtgagtttggatcaatcttaagattaaaaccctgagagtgagtgtccaaagagactgtgtaatattggtttggcggtcagcagaagagttttgaagtgcacatccagttagtgataacacggttgaagaaaaggtaaggttacaagtttagttttgaataattgtatactcaaaaaatatgaatgtataaagaataatcacttgagtcgcctta

SEQ ID NO: 44 - protein, 302 aa, Arabidopsis thaliana
  G254  (conserved domain in AA coordinates: 62-106)
MVSVNPRPKGFPVFDSSNMSLPSSDGFGSIPATGRTSTVSFSEDPTTKIRKPYTIKKSRENWTDQEHDKFLEALHLFDRDWKKIEAFVGSKTVVQIRSHAQKYFLKVQKSGANEHLPLPRPKRKASHPYPIKAPKNVAYTSLPSSSTLPLLEPGYLYSSDSKSLMGNQAVCASTSSSWNHESTNLPKPVIEEEPGVSATAPLPNNRCRQEDTERVRAVTKPNNEESCEKPHRVMPNFAEVYSFIGSVFDPNTSGHLQRLKQMDPINMETVLLLMQNLSVNLTSPEFAEQRRLISSYSAKALK

SEQ ID NO: 45 - DNA, 1547 bp, Arabidopsis thaliana
  G256
tcgtgagcgttgtgtttctcctcaacattcaaagtctttagtgaaacctctcttgtaagaagccaaaaaaataaagagaaagattcaaagaaggaaagaaattgaggatgactatttcaagtccaaagagagattttgagtagaccctcttcacaaaaatccaatcttagagtcttactagttactatctagcttacatacacagagacactataccaaaaatccaatcttattagagtacttactatatagcttacacatacacacacacgaagtactatttcaacgatcaagagcgtgtgcgtgaggatatgggtagaccaccttgttgcgagaagattgaggtgaagaaaggaccatggactcccgaagaagacataatcttggtctcttatatccaacaacacggccctggaaattggagatctgtccctgcaaacaccggtttgctaaggtgtagcaagagttgcagacttagatggactaattaccttcgtcccgggatcaaacgaggaaatttcactcaaccggaagagaagatgatcatccaccttcaagctcttttgggaaatagatgggcagctatagcatcatatctacctcagaggaccgacaatgatatcaagaactactggaacactcatcttaaaaagaaactagtgatgatgaagtttcaaaatggtatcatcaacgaaaacaaaaccaatctggcaacagatatttcgtcttgtaataataacaacaatggatgtaatcacaacaaaaggaccaccaacaaaggccaatgggagaaaaaacttcaaacagacatcaacatggccaaacaagccttattccaagccttgtcacttgaccaaccatcttcattgatccctcccgatcctgactcaccaaaacctcatcatcattctaccaccacttatgcctcaagcacagataacatctctaaattactccagaactggacaagctcatcatcgtcaaagcctaacacttcatcagtctccaacaaccggagctcaagccccggtgaaggaggactttttgatcatcactctttgttctcatcgaattcagaatctggatcagttgatgagaagctgaatttgatgtccgagacaagcatgttcaaaggtgagagcaagccagacatagacatggaagctacacctactactactactactactactgatgatcaaggctcgttgtcattgatcgagaaatggttgtttgatgatcaaggcttggttcagtgtgatgatagtcaagaagatctcatcgacgtgtctttagaggagttaaaataatgataacaacagtcaagatttgttctataagaaaataaaacgtatagaacaacgataaagctagctaggtttattaatttttctttcttttgtcttttctctatgatctttagttacattttattttactgtgtggcttgcttgtggtcaagtcgatgaagatcaaactgtgatatactatttatatgtaaagtactataaagttaagagtagttgaataaaaaaaaaaaaaaaaaa

SEQ ID NO: 46 - protein, 332 aa, Arabidopsis thaliana
  G256  (conserved domain in AA coordinates: 13-115)
MGRPPCCEKIEVKKGPWTPEEDIILVSYIQQHGPGNWRSVPANTGLLRCSKSCRLRWTNYLRPGIKRGNFTQPEEKMIIHLQALLGNRWAAIASYLPQRTDNDIKNYWNTHLKKKLVMMKFQNGIINENKTNLATDISSCNNNNNGCNHNKRTTNKGQWEKKLQTDINMAKQALFQALSLDQPSSLIPPDPDSPKPHHHSTTTYASSTDNISKLLQNWTSSSSSKPNTSSVSNNRSSSPGEGGLFDHHSLFSSNSESGSVDEKLNLMSETSMFKGESKPDIDMEATPTTTTTTTDDQGSLSLIEKWLFDDQGLVQCDDSQEDLIDVSLEELK

SEQ ID NO: 47 - DNA, 2104 bp, Arabidopsis thaliana
  G278
tcgatctttaaccaaatccagttgataaggtctcttcgttgattagcagagatctctttaatttgtgaatttcaattcatcggaacctgttgatggacaccaccattgatggattcgccgattcttatgaaatcagcagcactagtttcgtcgctaccgataacaccgactcctctattgtttatctggccgccgaacaagtactcaccggacctgatgtatctgctctgcaattgctctccaacagcttcgaatccgtctttgactcgccggatgatttctacagcgacgctaagcttgttctctccgacggccgggaagtttctttccaccggtgcgttttgtcagcgagaagctctttcttcaagagcgctttagccgccgctaagaaggagaaagactccaacaacaccgccgccgtgaagctcgagcttaaggagattgccaaggattacgaagtcggtttcgattcggttgtgactgttttggcttatgtttacagcagcagagtgagaccgccgcctaaaggagtttctgaatgcgcagacgagaattgctgccacgtggcttgccggccggcggtggatttcatgttggaggttctctatttggctttcatcttcaagatccctgaattaattactctctatcagaggcacttattggacgttgtagacaaagttgttatagaggacacattggttatactcaagcttgctaatatatgtggtaaagcttgtatgaagctattggatagatgtaaagagattattgtcaagtctaatgtagatatggttagtcttgaaaagtcattgccggaagagcttgttaaagagataattgatagacgtaaagagcttggtttggaggtacctaaagtaaagaaacatgtctcgaatgtacataaggcacttgactcggatgatattgagttagtcaagttgcttttgaaagaggatcacaccaatctagatgatgcgtgtgctcttcatttcgctgttgcatattgcaatgtgaagaccgcaacagatcttttaaaacttgatcttgccgatgtcaaccataggaatccgaggggatatacggtgcttcatgttgctgcgatgcggaaggagccacaattgatactatctctattggaaaaaggtgcaagtgcatcagaagcaactttggaaggtagaaccgcactcatgatcgcaaaacaagccactatggcggttgaatgtaataatatcccggagcaatgcaagcattctctcaaaggccgactatgtgtagaaatactagagcaagaagacaaacgagaacaaattcctagagatgttcctccctcttttgcagtggcggccgatgaattgaagatgacgctgctcgatcttgaaaatagagttgcacttgctcaacgtctttttccaacggaagcacaagctgcaatggagatcgccgaaatgaagggaacatgtgagttcatagtgactagcctcgagcctgaccgtctcactggtacgaagagaacatcaccgggtgtaaagatagcacctttcagaatcctagaagagcatcaaagtagactaaaagcgctttctaaaaccgtggaactcgggaaacgattcttcccgcgctgttcggcagtgctcgaccagattatgaactgtgaggacttgactcaactggcttgcggagaagacgacactgctgagaaacgactacaaaagaagcaaaggtacatggaaatacaagagacactaaagaaggcctttagtgaggacaatttggaattaggaaattcgtccctgacagattcgacttcttccacatcgaaatcaaccggtggaaagaggtctaaccgtaaactctctcatcgtcgtcggtgagactcttgcctcttagtgtaatttttgctgtaccatataattctgttttcatgatgactgtaactgtttatgtctatcgttggcgtcatatagtttcgctcttcgttttgcatcctgtgtattattgctgcaggtgtgcttcaaacaaatgttgtaacaatttgaaccaatggtatacagatttgtaatatatatttatgtacatcaacaataaaaaaaaaaaaaaaaaa

SEQ ID NO: 48 - protein, 593 aa, Arabidopsis thaliana
  G278  (conserved domain in AA coordinates: 2-593)
MDTTIDGFADSYEISSTSFVATDNTDSSIVYLAAEQVLTGPDVSALQLLSNSFESVFDSPDDFYSDAKLVLSDGREVSFHRCVLSARSSFFKSALAAAKKEKDSNNTAAVKLELKEIAKDYEVGFDSVVTVLAYVYSSRVRPPPKGVSECADENCCHVACRPAVDFMLEVLYLAFIFKIPELITLYQRHLLDVVDKVVIEDTLVILKLANICGKACMKLLDRCKEIIVKSNVDMVSLEKSLPEELVKEIIDRRKELGLEVPKVKKHVSNVHKALDSDDIELVKLLLKEDHTNLDDACALHFAVAYCNVKTATDLLKLDLADVNHRNPRGYTVLHVAAMRKEPQLILSLLEKGASASEATLEGRTALMIAKQATMAVECNNIPEQCKHSLKGRLCVEILEQEDKREQIPRDVPPSFAVAADELKMTLLDLENRVALAQRLFPTEAQAAMEIAEMKGTCEFIVTSLEPDRLTGTKRTSPGVKIAPFRILEEHQSRLKALSKTVELGKRFFPRCSAVLDQIMNCEDLTQLACGEDDTAEKRLQKKQRYMEIQETLKKAFSEDNLELGNSSLTDSTSSTSKSTGGKRSNRKLSHRRR

SEQ ID NO: 49 - DNA, 1350 bp, Arabidopsis thaliana
  G291
caagaacccaaagatctctctctatttgtttgccttcttctttctttctgactcaaaccctcaaatcaattctcgcgattaagcaaaaccctagatttattctactcttcgaagtcgatttcaatggaaggttcctcgtcagccatcgcgaggaagacatgggagctagagaacaacattctcccagtggaaccaaccgattcagcctccgacagtatattccactacgacgacgcttcacaagccaaaatccagcaggagaagccatgggcctccgatcctaactacttcaagcgcgttcacatctcagcccttgctcttctcaagatggtggttcacgctcgctccggtggcacaatcgagatcatgggtcttatgcagggtaaaaccgagggtgatacaatcatcgttatggatgcttttgctttgcctgttgaaggtactgagactagggttaatgctcagtctgatgcctatgagtatatggttgaatactctcagaccagcaagctggctgggaggttggagaacgttgttggatggtatcactctcaccctgggtatggatgttggctctcgggtattgatgtttcgacacagatgcttaaccaacagtatcaggagccattcttagctgttgttattgatccaacaaggactgtttcggctggtaaggttgagattggggcattcagaacatatccagagggacataagatctcggatgatcatgtttctgagtatcagactatccctcttaacaagattgaggactttggtgtacattgcaaacagtactactcattggacatcacttatttcaagtcatctctcgatagtcaccttctggatctcctttggaacaagtactgggtgaacactctttcttcttccccactgttgggcaatggagactatgttgccgggcaaatatcagacttggctgagaagctcgagcaagcggagagtcagctcgctaactcccggtatggaggaattgcgccagccggtcaccaaaggaggaaagaggatgagcctcaactcgcgaagataactcgggatagtgcaaagataactgtcgagcaggtccatggactaatgtcacaggttatcaaagacatcttgttcaattccgctcgtcagtccaagaagtctgctgacgactcatcagatccagagcccatgattacatcgtgaagttggtctattcttttgttttttggctgcggaaattgactatcggtttgacccggtttatgaggcaatgcccattgttccctatatctctagtgtagtatctgcttcagacaaagatctttgggttattaaatgacattaacataaaaaaaa

SEQ ID NO: 50 - protein, 357 aa, Arabidopsis thaliana
  G291  (conserved domain in AA coordinates: 132-160)
MEGSSSAIARKTWELENNILPVEPTDSASDSIFHYDDASQAKIQQEKPWASDPNYFKRVHISALALLKMVVHARSGGTIEIMGLMQGKTEGDTIIVMDAFALPVEGTETRVNAQSDAYEYMVEYSQTSKLAGRLENVVGWYHSHPGYGCWLSGIDVSTQMLNQQYQEPFLAVVIDPTRTVSAGKVEIGAFRTYPEGHKISDDHVSEYQTIPLNKIEDFGVHCKQYYSLDITYFKSSLDSHLLDLLWNKYWVNTLSSSPLLGNGDYVAGQISDLAEKLEQAESQLANSRYGGIAPAGHQRRKEDEPQLAKITRDSAKITVEQVHGLMSQVIKDILFNSARQSKKSADDSSDPEPMITS

SEQ ID NO: 51 - DNA, 1072 bp, Arabidopsis thaliana
  G303
aaaagataacgtagccattaacttttatgcattaactccttcatttctttttgtgctcgtttggttgagagagagagaggctatatatgatgttccaacaagattaccctcatggcttttcactcgtggaaacatccttaagttacgaaatgttggattactttcaaaacatcgtcgtttcgaactctgaagacgtggcgtcacagcaaaattccatttcgtcctcttcttattcatcagcgacactctcctgctccataacagagcaaaaatctcacttaactgaaaagttatctcctctacgagaaagatatggttgcggtgactttctgtcgcggaagaggagaaggagaagtgaaaaaacgattgtagataaagagaatcaaaggatgaatcacattgccgtcgagcgtaaccggagaaaacagatgaatcattttctgtctatcctcaagtctatgatgcctctctcttattctcaacctaatgaccaagcatcaatcatagaagggaccattagctatctgaagaagctagaacaacgtctccaatctctcgaagcccaattaaaagctactaaactcaatcaatcaccaaatatattttccgacttcttcatgttccctcaatactccaccgccactgccactgccaccgccactgcctcctcatcctcctcgagccaccaccatcacaagcgactagaggtggttgctgacgtggaggttacaatggtagaaagacatgccaacattaaagtgttaacgaagacacagccaagattgctcttcaagattatcaatgagtttaactctttaggtttaagtactcttcatctcaacctcacaacttccaaagacatgtctctcttcacttttagcgtcaaggtagaggcagattgtcaattgacgccttctggtaatgaggtcgcaaatacggtgcatgaagtcgttagaagagttcacaaggaacgttgaattttgtttacatactagctaactttgaaattctattttattgtataaacaatctcttatgtgtgtaatttacatatatacaattaattaacatt

SEQ ID NO: 52 - protein, 296 aa, Arabidopsis thaliana
  G303  (conserved domain in AA coordinates: 92-161)
MMFQQDYPHGFSLVETSLSYEMLDYFQNIVVSNSEDVASQQNSISSSSYSSATLSCSITEQKSHLTEKLSPLRERYGCGDFLSRKRRRRSEKTIVDKENQRMNHIAVERNRRKQMNHFLSILKSMMPLSYSQPNDQASIIEGTISYLKKLEQRLQSLEAQLKATKLNQSPNIFSDFFMFPQYSTATATATATASSSSSSHHHHKRLEVVADVEVTMVERHANIKVLTKTQPRLLFKIINEFNSLGLSTLHLNLTTSKDMSLFTFSVKVEADCQLTPSGNEVANTVHEVVRRVHKER

SEQ ID NO: 53 - DNA, 1755 bp, Arabidopsis thaliana
  G312
atggcttacatgtgcactgatagtggcaatctaatggctattgctcaacaagtcatcaaacagaagcagcaacaagaacaacaacagcagcaacatcatcaagaccatcagatttttggtattaatcctttgtctcttaacccatggcccaatacttccctcgggtttgggctttcaggttcggcttttcccgacccgtttcaagttaccggcggcggagattccaacgatcctggctttccttttcctaacttagaccaccaccacgccacaaccaccggcggtgggttcaggttatctgatttcggcggtggaaccggcggcggcgagtttgagtccgacgagtggatggagactcttatcagcggtggagactccgttgcagacggtcctgattgtgacacctggcatgataatcccgattacgtaatctacggtcctgatccattcgatacttacccgagtcgactcagtgtccaaccgtcagatctaaaccgagtcattgacacgtcgagtccgcttcctccgccgaccttgtggcctccttcttcgccattatcgattcctccgcttactcatgagtcaccaaccaaagaagatccagagactaacgactccgaagacgatgacttcgacctagaaccacctctcctcaaagctatatacgactgtgcacggatctcagactctgaccctaacgaagcttccaagacgcttcttcagatccgagaatctgtatcggagctaggtgatccgacggagcgagttgcattttacttcacggaagctctctccaacagactgtctcctaattcgccggcgacgtcgtcttcttcttcatctacggaggatttaatcttatcttataaaaccctaaacgacgcttgtccttactccaaattcgcacatttgacggcgaatcaagcgattctagaagcgacggagaagtcgaacaagattcacatcgtcgattttggaatcgttcaaggtatacaatggcctgctcttcttcaagctctagctactcgtacttctggtaaacccactcaaatccgggtctcgggtatacccgctccatctctcggtgaatctccggaaccgtcgttaatcgccaccggaaaccgcctccgtgatttcgccaaggttctggatctgaatttcgatttcatcccaattctcactcccatacatttacttaacgggtcaagtttccgggtcgacccggatgaagtactggccgtgaatttcatgctccagctctacaaattactcgacgagacgccgacgatagttgacaccgcactacggctcgccaaatcgttgaacccgagggtcgtcactctcggagaatacgaagtgagcttaaaccgggtcggtttcgctaaccgggtaaagaacgcgcttcaattctattccgcggttttcgaatcccttgaaccgaacttggggcgtgattcggaggagagagtgagagttgagcgagagttgttcggccggagaatctcgggtttgattggaccggagaaaaccggaattcatagagaaagaatggaagagaaagagcaatggcgggtattaatggagaatgccggttttgaatcggttaagctgagtaattacgcagtgagccaagcgaagattctattgtggaattacaattacagcaatttgtattcaattgttgaatctaagcctggcttcatctctttggcctggaacgatttacctctcctcactctttcttcctggcgataa

SEQ ID NO: 54 - protein, 584 aa, Arabidopsis thaliana
  G312  (conserved domain in AA coordinates: 320-336)
MAYMCTDSGNLMAIAQQVIKQKQQQEQQQQQHHQDHQIFGINPLSLNPWPNTSLGFGLSGSAFPDPFQVTGGGDSNDPGFPFPNLDHHHATTTGGGFRLSDFGGGTGGGEFESDEWMETLISGGDSVADGPDCDTWHDNPDYVIYGPDPFDTYPSRLSVQPSDLNRVIDTSSPLPPPTLWPPSSPLSIPPLTHESPTKEDPETNDSEDDDFDLEPPLLKAIYDCARISDSDPNEASKTLLQIRESVSELGDPTERVAFYFTEALSNRLSPNSPATSSSSSSTEDLILSYKTLNDACPYSKFAHLTANQAILEATEKSNKIHIVDFGIVQGIQWPALLQALATRTSGKPTQIRVSGIPAPSLGESPEPSLIATGNRLRDFAKVLDLNFDFIPILTPIHLLNGSSFRVDPDEVLAVNFMLQLYKLLDETPTIVDTALRLAKSLNPRVVTLGEYEVSLNRVGFANRVKNALQFYSAVFESLEPNLGRDSEERVRVERELFGRRISGLIGPEKTGIHRERMEEKEQWRVLMENAGFESVKLSNYAVSQAKILLWNYNYSNLYSIVESKPGFISLAWNDLPLLTLSSWR

SEQ ID NO: 55 - DNA, 876 bp, Arabidopsis thaliana
  G325
atggaggctcgatgtgacttttgtggaaccgaaaaagcattaatctactgcaaatctgattcggctaaactttgtttaaactgtgacgttaatgtacactcagcgaatcctctgtctcaaagacacacgcgatctctactctgcgagaaatgttccttacaacccacggcagtacactgtatgaacgaaaatgtttctctttgccaaggatgtcagtggaccgctagtaactgcactggtttaggacacagacttcagagtctgaacccttactctgattgtccttctccatcagatttcggcaagatctggtcttcaactttagaaccttctgtcacaagtttggtctctccattttctgataccctgctccaggaattagacgattggaatggttcatcaacttccgtggttacacaaactcagaaccttaaagactattcttctttctttcctatggaatctaatcttccaaaagtgatagaagaggaatgttctggtttggatctatgcgaagggataaacttagatgatgcgccgttgaatttcaacgcaagcaatgatataatcggatgttcatcacttgacaataccaaatgttacgagtacgaggattcttttaaggaagagaataacattggccttccttcattactgcttcctactttatccgggaacgttgtaccgaacatgtcactttcgatgtctaacctcacaggagaaagcaatgcgactgattaccaagattgcggaatttcaccagggtttctcataggagattcgccatgggaatcgaatgttgaagttagttttaatccaaaattaagggatgaggctaaaaagagatacaaacaaaagaaatcaaagcgcatgtaa

SEQ ID NO: 56 - protein, 291 aa, Arabidopsis thaliana
  G325  (conserved domain in AA coordinates:5-28, 48-71)
MEARCDFCGTEKALIYCKSDSAKLCLNCDVNVHSANPLSQRHTRSLLCEKCSLQPTAVHCMNENVSLCQGCQWTASNCTGLGHRLQSLNPYSDCPSPSDFGKIWSSTLEPSVTSLVSPFSDTLLQELDDWNGSSTSVVTQTQNLKDYSSFFPMESNLPKVIEEECSGLDLCEGINLDDAPLNFNASNDIIGCSSLDNTKCYEYEDSFKEENNIGLPSLLLPTLSGNVVPNMSLSMSNLTGESNATDYQDCGISPGFLIGDSPWESNVEVSFNPKLRDEAKKRYKQKKSKRM

SEQ ID NO: 57 - DNA, 795 bp, Arabidopsis thaliana
  G343
atggacgtctatggcttatcttcaccagacttacttcgaatcgacgaccttcttgatttctccaacgaagacatcttctccgcttcttcttccggtggttccaccgccgctacttcctcttcttctttccctcctcctcaaaaccctagtttccaccaccaccatctcccttcctccgccgatcatcactccttcctccacgacatttgcgttcccagtgatgacgcagctcatcttgaatggctttcgcaattcgtggacgattctttcgctgattttccggcgaatccattaggaggaactatgacttctgtcaaaactgaaacttcctttccggggaaaccaagaagcaaacgatcaagagctcctgctcctttcgccggaacatggtctccgatgccactggaatccgagcatcagcagcttcactccgccgccaaattcaagccaaagaaagaacaatccggcggaggaggaggaggaggaggaagacatcagtcatcgtcatcggagactacggaaggaggaggaatgaggagatgtactcactgtgcatcggagaaaacgccacagtggaggacaggaccacttggacctaaaacactatgtaacgcttgtggagtccggtttaaatccggtagacttgtaccggaatatagaccggcttcgagtcctacttttgttttgactcagcattcaaactctcaccggaaagtgatggagcttcgacggcagaaagaagttatgagacaaccacaacaagttcaacttcatcaccaccaccacccgttttag

SEQ ID NO: 58 - protein, 264 aa, Arabidopsis thaliana
  G343  (conserved domain in AA coordinates: 178-214)
MDVYGLSSPDLLRIDDLLDFSNEDIFSASSSGGSTAATSSSSFPPPQNPSFHHHHLPSSADHHSFLHDICVPSDDAAHLEWLSQFVDDSFADFPANPLGGTMTSVKTETSFPGKPRSKRSRAPAPFAGTWSPMPLESEHQQLHSAAKFKPKKEQSGGGGGGGGRHQSSSSETTEGGGMRRCTHCASEKTPQWRTGPLGPKTLCNACGVRFKSGRLVPEYRPASSPTFVLTQHSNSHRKVMELRRQKEVMRQPQQVQLHHHHHPF

SEQ ID NO: 59 - DNA, 727 bp, Arabidopsis thaliana
  G353
accaaactcaaaaaacacaaaccacaagaggatcatttcattttttattgtttcgttttaatcatcatcatcagaagaaaaatggttgcgatatcggagatcaagtcgacggtggatgtcacggcggcgaattgtttgatgcttttatctagagttggacaagaaaacgttgacggtggcgatcaaaaacgcgttttcacatgtaaaacgtgtttgaagcagtttcattcgttccaagccttaggaggtcaccgtgcgagtcacaagaagcctaacaacgacgctttgtcgtctggattgatgaagaaggtgaaaacgtcgtcgcatccttgtcccatatgtggagtggagtttccgatgggacaagctttgggaggacacatgaggagacacaggaacgagagtggggctgctggtggcgcgttggttacacgcgctttgttgccggagcccacggtgactacgttgaagaaatctagcagtgggaagagagtggcttgtttggatctgagtctagggatggtggacaatttgaatctcaagttggagcttggaagaacagtttattgattttatttattttccttaaattttctgaatatatttgtttctctcattctttgaatttttcttaatattctagattatacatacatccgcagatttaggaaactttcatagagtgtaatcttttctttctgtaaaaatatattttacttgtagcaaa

SEQ ID NO: 60 - protein, 162 aa, Arabidopsis thaliana
  G353  (conserved domain in aa coordinates: 41-61, 84-104)
MVAISEIKSTVDVTAANCLMLLSRVGQENVDGGDQKRVFTCKTCLKQFHSFQALGGHRASHKKPNNDALSSGLMKKVKTSSHPCPICGVEFPMGQALGGHMRRHRNESGAAGGALVTRALLPEPTVTTLKKSSSGKRVACLDLSLGMVDNLNLKLELGRTVY

SEQ ID NO: 61 - DNA, 628 bp, Arabidopsis thaliana
  G354
cctagaagtcactaagtcgattcaaaatggttgcgagaagtgaggaaattgtgatagtggaagaagatacgactgcgaaatgtttgatgttgttatcaagagtcggagaatgcggcggcggctgcgggggagatgaacgtgttttccgatgcaagacttgtcttaaagagttctcatcgtttcaagctttgggaggtcatcgtgcaagccacaagaaacttatcaacagtgacaatccatcacttcttggatccttgtccaacaagaaaactaaaacgtctcatccttgtccgatatgtggagtgaagtttccgatgggacaagctcttggtggtcacatgaggagacataggaacgagaaagtctcaggctcgttggttacacgttcttttctaccggagacgacgacggtgacggctttgaagaaatttagtagtgggaagagagtggcttgtttggatttggacttagattcgatggagagtttggtcaattggaagttggagttgggaagaacgatttcttggagttaagtttttgggttgtatacagtttcacatgattttgtaatctttgttgatccaattatcgtaccgatcgatgtgaatattattttgatacaataaaa

SEQ ID NO: 62 - protein, 168 aa, Arabidopsis thaliana
  G354  (conserved domain in aa coordinates: 42-62, 88-109)
MVARSEEIVIVEEDTTAKCLMLLSRVGECGGGCGGDERVFRCKTCLKEFSSFQALGGHRASHKKLINSDNPSLLGSLSNKKTKTSHPCPICGVKFPMGQALGGHMRRHRNEKVSGSLVTRSFLPETTTVTALKKFSSGKRVACLDLDLDSMESLVNWKLELGRTISWS

SEQ ID NO: 63 - DNA, 922 bp, Arabidopsis thaliana
  G361
tctgtctctctctctctctttgtaaatatacatatatagataagctcacatatatggcgactgaaacatcttctttgaagctcttcggtataaacctacttgaaacgacgtcggttcaaaaccagtcatcggaaccaagacccggatccggatcaggatccgagtcacgtaagtacgagtgtcaatactgttgtagagagtttgctaactctcaagctcttggtggtcaccaaaacgctcacaagaaagagcgtcagcttcttaaacgtgcacagatgttagctactcgtggtttgccacgtcatcataattttcaccctcataccaatccgcttctctccgccttcgcgccgctgcctcacctcctctctcagccgcatcctccgccgcatatgatgctctctccttcttcttcgagttctaagtggctttacggtgaacacatgtcgtcacaaaacgccgttgggtactttcatggtggaaggggactttacggaggtggcatggagtctatggccggagaagtaaagactcatggtggttctttgccggagatgaggaggttcgccggagatagtgatcggagtagcggaattaagttagagaatggtattgggctggacctccatttaagccttgggccatgaatgattataattttggcccagtaaagatctgtaaaatactactaggatttcatttttatagagtatgtttttttccttaatttcggttgaaattggtgaatatttttatctcttacttaccaaatctcatatttctatgtatgcgtttgctttcactttttttttttatataattcttcttgtaaaaaatgcaatgtgagttttcttccctatcattctgtcaagctttggttcaattatttagtaatcgaataatataggaatagtgttgaaag

SEQ ID NO: 64 - protein, 197 aa, Arabidopsis thaliana
  G361  (conserved domain in AA coordinates: 43-63)
MATETSSLKLFGINLLETTSVQNQSSEPRPGSGSGSESRKYECQYCCREFANSQALGGHQNAHKKERQLLKRAQMLATRGLPRHHNFHPHTNPLLSAFAPLPHLLSQPHPPPHMMLSPSSSSSKWLYGEHMSSQNAVGYFHGGRGLYGGGMESMAGEVKTHGGSLPEMRRFAGDSDRSSGIKLENGIGLDLHLSLGP

SEQ ID NO: 65 - DNA, 977 bp, Arabidopsis thaliana
  G362
ataaaaaacccttcatacaatataaaatttctttagacatacaatatattatactattacagatgcaatgcatcattagttacaaactattaaactaaatatcccccgtctctctcttgctatataaagaagatcatttacacatctccttaagcaaattaaacccatcgataaacacatacgttcacacatatatgtctataaatccgacaatgtctcgtactggcgaaagttcttcaggttcgtcctccgacaagacgataaagctattcggcttcgaactcatcagcggcagtcgtacgccggaaatcacgacggcggaaagcgtgagctcgtccacaaacacgacgtcgttaacagtgatgaaaagacacgagtgccaatactgcggtaaagagtttgcaaattctcaagccttaggaggtcaccaaaacgctcacaagaaggagaggttgaagaagaagaggcttcagcttcaagctcggcgagccagcatcggctattatctcaccaaccaccaacaacccataacgacgtcatttcagagacaatacaaaacgccgtcgtattgtgcattctcctccatgcacgtgaataatgatcagatgggtgtgtacaacgaagattggtcgtcgaggtcgtcgcagattaacttcggtaataatgacacgtgccaagatcttaatgaacaaagcggtgagatgggtaagctgtacggtgttcgaccgaacatgattcagttccagagagatctgagttctcgttctgatcagatgagaagtattaactcgctggatcttcatctaggttttgccggagatgcggcataacaaattaaagagagatatatgattaagattatatgtactatagtggcgtatttcattgggatcatgaaggggaaaaaacgagacatatagtattcttgatgcaatttgagttttgtaatttatttaggtttatgtatgttttcgaag

SEQ ID NO: 66 - protein, 211 aa, Arabidopsis thaliana
  G362  (conserved domain in AA coordinates: 62-82)
MSINPTMSRTGESSSGSSSDKTIKLFGFELISGSRTPEITTAESVSSSTNTTSLTVMKRHECQYCGKEFANSQALGGHQNAHKKERLKKKRLQLQARRASIGYYLTNHQQPITTSFQRQYKTPSYCAFSSMHVNNDQMGVYNEDWSSRSSQINFGNNDTCQDLNEQSGEMGKLYGVRPNMIQFQRDLSSRSDQMRSINSLDLHLGFAGDAA

SEQ ID NO: 67 - DNA, 582 bp, Arabidopsis thaliana
  G371
atggagattgagaaggatgaggacgacacaacattggttgattctggaggagacttcgactgcaacatatgtttggatcaggttcgagacccggtcgtgactttatgtggccacctgttttgttggccctgcattcacaagtggacttatgcgtccaacaattcaagacaacgagtcgatcaatacgatcataagagggaaccaccaaaatgtccggtatgcaaatctgatgtctccgaggctacgcttgtcccgatctacggacgaggacagaaagctccccagtccggttcaaatgtaccgagcagaccaactggtccggtttatgacttaagaggagttggtcaacgtttaggagaaggggagagtcaacgttacatgtatagaatgcctgatccggtgatgggtgtggtatgcgaaatggtataccggagactatttggagagtcttcgagcaacatggcaccttaccgcgatatgaatgtccggtctaggcgacgggcaatgcaggctgaggagtcattaagcagagtctacttgtttctactttgcttcatgtttatgtgtctatttctcttctaa

SEQ ID NO: 68 - protein, 193 aa, Arabidopsis thaliana
  G371  (conserved domain in aa coordinates: 21-74)
MEIEKDEDDTTLVDSGGDFDCNICLDQVRDPVVTLCGHLFCWPCIHKWTYASNNSRQRVDQYDHKREPPKCPVCKSDVSEATLVPIYGRGQKAPQSGSNVPSRPTGPVYDLRGVGQRLGEGESQRYMYRMPDPVMGVVCEMVYRRLFGESSSNMAPYRDMNVRSRRRAMQAEESLSRVYLFLLCFMFMCLFLF

SEQ ID NO: 69 - DNA, 2526 bp, Arabidopsis thaliana
  G390
atgatggctcatcactccatggacgatagagactctcctgataaaggatttgattccggcaagtacgttagatacacgccggaacaagttgaagctcttgagagagtttatgctgagtgtcctaaacctagctctctgagaagacaacagcttattcgtgaatgtcccattctctgtaacatcgagcctcgacagatcaaagtttggttccagaatcgcagatgtcgagagaagcagaggaaagagtcagctcgtcttcagacagtgaacaggaagctgagtgctatgaacaagcttttgatggaagagaatgatcgtttgcagaagcaagtctccaacttggtttatgagaatggattcatgaaacatcgaatccacactgcttctgggacgaccacagacaacagctgtgagtctgtggtcgtgagtggtcagcaacgtcagcagcaaaacccaacacatcagcatcctcagcgtgatgttaacaacccagctaatcttctctcgattgcggaggagaccttggcggagttcctttgcaaggctacaggaactgctgtcgactgggtccagatgattgggatgaagcctggtccggattctattggtatcgtagctgtttcacgcaactgcagtggaatagcagcacgtgcctgtggcctcgtgagtttagaacccatgaaggtcgctgaaatcctcaaagatcgtccatcttggttccgtgactgtcgatgtgtcgagactctgaatgttatacccactggaaatggtggtactatcgagcttgtcaacactcagatttatgctcctacaacattagcagcagctcgtgacttttggacgctgagatatagtacaagtctagaagatggaagctatgtggtctgtgagagatcactcacttctgcaactggtggccccaatggtccactttcttcaagcttcgtgagagccaaaatgctgtcaagcgggtttcttatccgtccttgtgatggtggtggttccattattcacatcgttgatcatgtggacttggatgtctcaagtgttcctgaagtcctcaggcctctttatgagtcttccaaaatccttgctcaaaaaatgactgtcgctgctctgagacatgtgcgccaaattgctcaagagactagtggagaagtccagtatagtggtggacgccagcctgcagttttaaggactttcagccagagactctgccggggtttcaatgatgctgtaaatggttttgtcgatgatggatggtctccaatgagtagtgatggaggagaggatattacgatcatgattaactcttcctctgctaaatttgctggctcccaatacggtagctcatttcttccaagttttggaagtggtgtcctctgtgccaaagcttctatgctgttgcagaatgttccaccccttgtattgattcggttcctgagagaacaccgagctgaatgggcagactatggtgtcgatgcctattctgctgcatctctcagagcaactccatatgctgttccatgcgtcagaaccggtgggttcccgagtaaccaagtcattcttcctctcgcacagacactcgaacatgaagagtttctcgaagtggttagacttggaggtcatgcttactcacctgaagacatgggcttatcccgggatatgtatttactgcagctttgtagcggcgttgatgaaaatgtggttggaggttgtgctcagcttgtctttgccccaatcgatgaatcatttgctgatgatgcacctttgcttccttctggtttccgtgtcataccactcgaccaaaaaacaaatccgaatgatcatcaatctgcaagtcgaacacgggatctagcatcgtccctagatggttccaccaaaaccgattcggaaacaaactctagattggtcttaacaatagccttccagttcacgtttgataaccattccagagacaatgttgctacaatggcgagacagtatgtgaggaacgttgttggttcgattcagagagtggctctagccattacgcctcgtcctggctcaatgcaacttcccacttcccctgaagctctcactcttgtccgttggatcacccgtagttacagtattcatacaggtgcagatctgtttggagctgattctcagtcctgtggaggagacacattgcttaagcaactctgggaccatagtgatgccatattgtgctgctccctgaaaactaatgcctcaccggtattcacatttgcaaaccaagctggtttagacatgcttgaaactacacttgtggcacttcaggatataatgctcgacaaaacacttgatgactctggtcgtagagctctttgctccgagttcgccaagatcatgcagcagggatatgcgaatcttccggcaggaatatgtgtgtcgagcatgggcagaccggtttcgtatgagcaagcgacggtgtggaaagttgttgatgacaacgaatcaaaccactgcttggcttttaccctcgttagttggtcgtttgtttga

SEQ ID NO: 70 - protein, 841 aa, Arabidopsis thaliana
  G390  (conserved domain in AA coordinates: 18-81)
MMAHHSMDDRDSPDKGFDSGKYVRYTPEQVEALERVYAECPKPSSLRRQQLIRECPILCNIEPRQIKVWFQNRRCREKQRKESARLQTVNRKLSAMNKLLMEENDRLQKQVSNLVYENGFMKHRIHTASGTTTDNSCESVVVSGQQRQQQNPTHQHPQRDVNNPANLLSIAEETLAEFLCKATGTAVDWVQMIGMKPGPDSIGIVAVSRNCSGIAARACGLVSLEPMKVAEILKDRPSWFRDCRCVETLNVIPTGNGGTIELVNTQIYAPTTLAAARDFWTLRYSTSLEDGSYVVCERSLTSATGGPNGPLSSSFVRAKMLSSGFLIRPCDGGGSIIHIVDHVDLDVSSVPEVLRPLYESSKILAQKMTVAALRHVRQIAQETSGEVQYSGGRQPAVLRTFSQRLCRGFNDAVNGFVDDGWSPMSSDGGEDITIMINSSSAKFAGSQYGSSFLPSFGSGVLCAKASMLLQNVPPLVLIRFLREHRAEWADYGVDAYSAASLRATPYAVPCVRTGGFPSNQVILPLAQTLEHEEFLEVVRLGGHAYSPEDMGLSRDMYLLQLCSGVDENVVGGCAQLVFAPIDESFADDAPLLPSGFRVIPLDQKTNPNDHQSASRTRDLASSLDGSTKTDSETNSRLVLTIAFQFTFDNHSRDNVATMARQYVRNVVGSIQRVALAITPRPGSMQLPTSPEALTLVRWITRSYSIHTGADLFGADSQSCGGDTLLKQLWDHSDAILCCSLKTNASPVFTFANQAGLDMLETTLVALQDIMLDKTLDDSGRRALCSEFAKIMQQGYANLPAGICVSSMGRPVSYEQATVWKVVDDNESNHCLAFTLVSWSFV

SEQ ID NO: 71 - DNA, 2559 bp, Arabidopsis thaliana
  G391
atgatgatggtccattcgatgagcagagatatgatgaacagagagtcgccggataaagggttagattccggcaagtatgtgaggtacacgccggagcaagtggaagctctcgagagagtttacactgagtgtcctaagccaagttctctaagaagacaacaactcatacgtgaatgtccgattctctctaacatcgagcctaagcagatcaaagtttggtttcagaaccgcagatgtcgtgagaagcagaggaaagaagctgctcgtcttcaaacagtgaacagaaaactcaatgccatgaacaaactcttgatggaagagaatgatcgtttgcagaagcaagtttctaacttggtctatgagaatggccacatgaaacatcaacttcacactgcttctgggacgaccacagacaacagctgtgagtctgtggtcgtgagtggtcagcaacatcaacagcaaaacccaaatcctcagcatcagcaacgtgatgctaacaacccagcaggactcctttctatagcagaggaggccctagcagagttcctttccaaggctacaggaactgctgttgactgggttcagatgattgggatgaagcctggtccggattctattggcatagtcgctatttcgcgcaactgcagcggaattgcagcacgtgcctgcggcctcgtgagtttagaacccatgaaggttgctgaaattctcaaagatcgtccatcttggctccgagattgtcgaagtgtggatactctgagtgtgatacctgctggaaacggtgggacgatcgagcttatttacacgcagatgtatgctcctacgactttagcagcagctcgtgacttttggacgctgagatatagcacatgtttggaagatggaagctatgtggtttgtgaaaggtcgcttacttctgcaactggtggccccactgggccaccttcttcaaactttgtgagagctgaaatgaaaccaagcgggtttctcatccgtccttgcgatggtggtggttccattctccacattgttgatcatgttgatctggatgcctggagtgtccctgaagtcatgaggcctctctatgaatcatcgaagattcttgctcagaaaatgactgttgctgctttgagacatgtaagacaaattgcacaagaaacaagtggagaagttcagtatggtggagggcgccaacctgcggttttaagaaccttcagtcaaagactctgtcggggtttcaatgatgctgttaatggttttgtggatgatggatggtcaccaatgggtagcgatggtgcagaggatgttactgtaatgataaacttgtcccctgggaagtttggtgggtctcagtacggtaattcattccttccaagctttggtagtggcgtgctttgtgccaaggcatctatgttgcttcagaacgttccacccgctgtgctggttcgattccttagagaacaccgatctgaatgggctgattatggcgtggatgcttatgctgctgcatcgctcagagcaagtccttttgctgttccttgtgctagagctggggggttcccaagtaaccaagtcattcttcctcttgcgcagacagttgaacatgaagagtcacttgaggtggttagacttgaaggtcacgcttactcacccgaagacatgggtttagctcgggatatgtatttgctacagctttgtagcggtgttgatgaaaatgtggttggaggttgtgcacagcttgtatttgcccctatcgatgaatcatttgctgatgatgcacctttgcttccttccggtttccgcatcatacctcttgaacagaaatctactccgaacggtgcatctgcaaaccgtaccctggatttagcctcagctttagaaggatccacacgtcaagctggtgaagccgacccaaatggctgtaactttaggtcggtactaaccatagcattccagttcacatttgataaccattcaagagacagtgttgcttcaatggcacgtcagtacgtgcgaagcatagtaggatcgattcagagggttgctctagccattgctcctcgtcctggctccaatatcagtccaatatctgttcccacttcccctgaagctctcactctggtccgttggatctcccggagttacagccttcacactggtgcagatctctttggatctgattctcaaaccagtggtgacacgttgctgcatcaactctggaatcactctgatgcaatcttgtgctgctccctcaaaacaaacgcttcaccggttttcacattcgcaaaccaaaccggtttagacatgctggaaacgactcttgtagcccttcaagacataatgctagacaagacccttgacgaacctggtcgtaaagctctttgctctgagttccccaagatcatgcaacagggctatgctcatctgccggcaggagtatgtgcgtcaagcatgggaaggatggtatcttacgagcaggcaacggtgtggaaagttcttgaagacgatgaatcaaaccactgcttagctttcatgttcgtgaattggtcgttcgtttga

SEQ ID NO: 72 - protein, 852 aa, Arabidopsis thaliana
  G391  (conserved domain in AA coordinates: 25-85)
MMMVHSMSRDMMNRESPDKGLDSGKYVRYTPEQVEALERVYTECPKPSSLRRQQLIRECPILSNIEPKQIKVWFQNRRCREKQRKEAARLQTVNRKLNAMNKLLMEENDRLQKQVSNLVYENGHMKHQLHTASGTTTDNSCESVVVSGQQHQQQNPNPQHQQRDANNPAGLLSIAEEALAEFLSKATGTAVDWVQMIGMKPGPDSIGIVAISRNCSGIAARACGLVSLEPMKVAEILKDRPSWLRDCRSVDTLSVIPAGNGGTIELIYTQMYAPTTLAAARDFWTLRYSTCLEDGSYVVCERSLTSATGGPTGPPSSNFVRAEMKPSGFLIRPCDGGGSILHIVDHVDLDAWSVPEVMRPLYESSKILAQKMTVAALRHVRQIAQETSGEVQYGGGRQPAVLRTFSQRLCRGFNDAVNGFVDDGWSPMGSDGAEDVTVMINLSPGKFGGSQYGNSFLPSFGSGVLCAKASMLLQNVPPAVLVRFLREHRSEWADYGVDAYAAASLRASPFAVPCARAGGFPSNQVILPLAQTVEHEESLEVVRLEGHAYSPEDMGLARDMYLLQLCSGVDENVVGGCAQLVFAPIDESFADDAPLLPSGFRIIPLEQKSTPNGASANRTLDLASALEGSTRQAGEADPNGCNFRSVLTIAFQFTFDNHSRDSVASMARQYVRSIVGSIQRVALAIAPRPGSNISPISVPTSPEALTLVRWISRSYSLHTGADLFGSDSQTSGDTLLHQLWNHSDAILCCSLKTNASPVFTFANQTGLDMLETTLVALQDIMLDKTLDEPGRKALCSEFPKIMQQGYAHLPAGVCASSMGRMVSYEQATVWKVLEDDESNHCLAFMFVNWSFV

SEQ ID NO: 73 - DNA, 1302 bp, Arabidopsis thaliana
  G409
tgtctctctctctggctctctttctcttaacgtgatcataacgtgattcgaaaattggatatagataggtttcttgttggatcttgatccctctggaaaaggaggggagaatagcagttcatgatgggattttgtatctgcccgttggagtcacctgcgagattactatggagtacaagcttcttccgccataagatcatgatcttctaatccttcctacttcttcccatctttttaatcatcttctcgctatctctgcttcctctttctctctgtttcctctttctcagaactcagaagtagttgttgttttatttctgttgatcaaaaatggaatccaattcgtttttcttcgatccatctgcttcacacggcaacagcatgttcttccttgggaatctcaatcccgtcgtccaaggaggaggagcaagatcgatgatgaacatggaggaaacttcgaagcgaaggcccttctttagctcccctgaggatctctacgacgatgacttttacgacgaccagttgcctgaaaagaagcgtcgcctcactaccgaacaagtgcatctgctggagaaaagcttcgagacagagaacaagctagagcctgaacgcaagactcagcttgccaagaagcttggtctacagccaaggcaagtggctgtctggtttcagaatcgccgagctcgttggaaaacaaaacagcttgagagagactacgatcttctcaagtccacttacgaccaacttctttctaactacgactccatcgtcatggacaacgataagctcagatccgaggttacttccctgaccgaaaagcttcagggcaaacaagagacagctaatgaaccacctggtcaagtgcccgaaccaaaccaacttgatccggtttacattaatgcggcagcaatcaaaaccgaggaccggttaagttcagggagcgttgggagcgcggtactagacgacgacgcacctcaactactagacagctgtgactcttacttcccaagcatcgtacccatccaagacaacagcaacgccagtgatcatgacaatgaccggagctgtttcgccgacgtctttgtgcccaccacttcaccgtcgcacgatcatcacggtgaatcattggctttctggggatggccttagaaaaccactctgataataaatgtgtgtttatttaagttcaagagtcatcttcttgttgtttccatgttgacgataattgttgactcgtggaataattccgctgttcaacggtatttttatcagttgcattatatgcttttatgaaaaaaaaaa

SEQ ID NO: 74 - protein, 272 aa, Arabidopsis thaliana
  G409  (conserved domain in AA coordinates: 64-124)
MESNSFFFDPSASHGNSMFFLGNLNPVVQGGGARSMMNMEETSKRRPFFSSPEDLYDDDFYDDQLPEKKRRLTTEQVHLLEKSFETENKLEPERKTQLAKKLGLQPRQVAVWFQNRRARWKTKQLERDYDLLKSTYDQLLSNYDSIVMDNDKLRSEVTSLTEKLQGKQETANEPPGQVPEPNQLDPVYINAAAIKTEDRLSSGSVGSAVLDDDAPQLLDSCDSYFPSIVPIQDNSNASDHDNDRSCFADVFVPTTSPSHDHHGESLAFWGWP

SEQ ID NO: 75 - DNA, 1501 bp, Arabidopsis thaliana
  G427
tttccctctccgaaacagaaattcaaaaacaaattcaacacgaaaacgatggcgtttcataacaatcactttaatcatttcaccgaccaacaacaacatcagcctcctcctccgccgcaacagcagcagcaacaacattttcaagaatcagcaccccctaattggctcctccgctccgacaacaacttcctcaatctccacacagctgccacagccgccgctacaagctccgattctccttcttccgccgccgctaaccagtggctctcacgatcctcatccttcctccaacgaggcaacaccgcaaacaacaacaacaacgaaacatccggtgacgtcatcgaagacgttcccggcggagaggagtcaatgatcggagagaagaaggaggcggagaggtggcagaatgcgagacacaaggcggagatactgtctcatccactatacgagcaacttttgtcggcacacgtggcgtgcctgaggatcgcaacgccggtggatcagcttccgaggatagacgcacagcttgctcagtctcaaaacgtcgtggctaagtactcaactttagaagccgctcaaggactcctcgccggcgatgacaaggagcttgaccacttcatgacgcattatgtactattgctttgctctttcaaagaacaactgcaacagcatgttcgtgttcatgcaatggaagctgttatggcctgttgggagattgaacagtcgcttcaaagttttacaggagtatctcctggtgaaggcacaggagcaacaatgtctgaggatgaagatgagcaagtagagagtgatgctcatttgtttgatggaagcttagatgggttagggtttggtcctctagttcccactgagagcgagagatctttgatggaacgagtcagacaagaactcaaacatgaactcaagcagggttacaaggagaaaattgtggacataagagaggagatactgaggaagagaagagctggaaaattaccaggagacaccacctctgttctcaaatcatggtggcaatctcattctaagtggccttaccctactgaggaagataaggcgaggttggtgcaggagacgggtttgcagctcaaacagataaacaattggttcatcaatcaaagaaagaggaattggcatagcaatccatcttcttctaccgtctcaaagaataaacgccgaagcaatgcaggtgaaaacagcggaagagaccgttgagatcaagcttgcatgtagagatccaaaagctttatagaaaggtggaggcatgaagacaaagaattcttacacaacaaacgtaggacgtaattttgtgccagtacatggtatggctttcatatttggtaatgattagggccacacaaaattaaaccccaaagcatgatttgtaatatgaggttttagatggactttatgataggatcgtcagtcttcactgccatctccattctccaccatcaatccatcattatatcttgtgaaaaaaaaa

SEQ ID NO: 76 - protein, 393 aa, Arabidopsis thaliana
  G427  (conserved domain in AA coordinates: 307-370)
MAFHNNHFNHFTDQQQHQPPPPPQQQQQQHFQESAPPNWLLRSDNNFLNLHTAATAAATSSDSPSSAAANQWLSRSSSFLQRGNTANNNNNETSGDVIEDVPGGEESMIGEKKEAERWQNARHKAEILSHPLYEQLLSAHVACLRIATPVDQLPRIDAQLAQSQNVVAKYSTLEAAQGLLAGDDKELDHFMTHYVLLLCSFKEQLQQHVRVHAMEAVMACWEIEQSLQSFTGVSPGEGTGATMSEDEDEQVESDAHLFDGSLDGLGFGPLVPTESERSLMERVRQELKHELKQGYKEKIVDIREEILRKRRAGKLPGDTTSVLKSWWQSHSKWPYPTEEDKARLVQETGLQLKQINNWFINQRKRNWHSNPSSSTVSKNKRRSNAGENSGRDR

SEQ ID NO: 77 - DNA, 2821 bp, Arabidopsis thaliana
  G438
cggggtacccaagccacgaccgtagaatcttcttttgtctgaaaagaattacaatttacgtttctcttacgatacgacggactttccgaagaaattaatttaaagagaaaagaagaagaagccaaagaagaagaagaagctagaagaaacagtaaagtttgagactttttttgagggtcgagctaaaatggagatggcggtggctaaccaccgtgagagaagcagtgacagtatgaatagacatttagatagtagcggtaagtacgttaggtacacagctgagcaagtcgaggctcttgagcgtgtctacgctgagtgtcctaagcctagctctctccgtcgacaacaattgatccgtgaatgttccattttggccaatattgagcctaagcagatcaaagtctggtttcagaaccgcaggtgtcgagataagcagaggaaagaggcgtcgaggctccagagcgtaaaccggaagctctctgcgatgaataaactgttgatggaggagaatgataggttgcagaagcaggtttctcagcttgtctgcgaaaatggatatatgaaacagcagctaactactgttgttaacgatccaagctgtgaatctgtggtcacaactcctcagcattcgcttagagatgcgaatagtcctgctggattgctctcaatcgcagaggagactttggcagagttcctatccaaggctacaggaactgctgttgattgggttcagatgcctgggatgaagcctggtccggattcggttggcatctttgccatttcgcaaagatgcaatggagtggcagctcgagcctgtggtcttgttagcttagaacctatgaagattgcagagatcctcaaagatcggccatcttggttccgtgactgtaggagccttgaagttttcactatgttcccggctggtaatggtggcacaatcgagcttgtttatatgcagacgtatgcaccaacgactctggctcctgcccgcgatttctggaccctgagatacacaacgagcctcgacaatgggagttttgtggtttgtgagaggtcgctatctggctctggagctgggcctaatgctgcttcagcttctcagtttgtgagagcagaaatgctttctagtgggtatttaataaggccttgtgatggtggtggttctattattcacattgtcgatcaccttaatcttgaggcttggagtgttccggatgtgcttcgacccctttatgagtcatccaaagtcgttgcacaaaaaatgaccatttccgcgttgcggtatatcaggcaattagcccaagagtctaatggtgaagtagtgtatggattaggaaggcagcctgctgttcttagaacctttagccaaagattaagcaggggcttcaatgatgcggttaatgggtttggtgacgacgggtggtctacgatgcattgtgatggagcggaagatattatcgttgctattaactctacaaagcatttgaataatatttctaattctctttcgttccttggaggcgtgctctgtgccaaggcttcaatgcttctccaaaatgttcctcctgcggttttgatccggttccttagagagcatcgatctgagtgggctgatttcaatgttgatgcatattccgctgctacacttaaagctggtagctttgcttatccgggaatgagaccaacaagattcactgggagtcagatcataatgccactaggacatacaattgaacacgaagaaatgctagaagttgttagactggaaggtcattctcttgctcaagaagatgcatttatgtcacgggatgtccatctccttcagatttgtaccgggattgacgagaatgccgttggagcttgttctgaactgatatttgctccgattaatgagatgttcccggatgatgctccacttgttccctctggattccgagtcatacccgttgatgctaaaacgggagatgtacaagatctgttaaccgctaatcaccgtacactagacttaacttctagccttgaagtcggtccatcacctgagaatgcttctggaaactctttttctagctcaagctcgagatgtattctcactatcgcgtttcaattcccttttgaaaacaacttgcaagaaaatgttgctggtatggcttgtcagtatgtgaggagcgtgatctcatcagttcaacgtgttgcaatggcgatctcaccgtctgggataagcccgagtctgggctccaaattgtccccaggatctcctgaagctgttactcttgctcagtggatctctcaaagttacagtcatcacttaggctcggagttgctgacgattgattcacttggaagcgacgactcggtactaaaacttctatgggatcaccaagatgccatcctgtgttgctcattaaagccacagccagtgttcatgtttgcgaaccaagctggtctagacatgctagagacaacacttgtagccttacaagatataacactcgaaaagatattcgatgaatcgggtcgtaaggctatctgttcggacttcgccaagctaatgcaacagggatttgcttgcttgccttcaggaatctgtgtgtcaacgatgggaagacatgtgagttatgaacaagctgttgcttggaaagtgtttgctgcatctgaagaaaacaacaacaatctgcattgtcttgccttctcctttgtaaactggtcttttgtgtgattcgattgacagaaaaagactaatttaaatttacgttagagaactcaaatttttggttgttgtttaggtgtctctgttttgttttttaaaattattttgatcaaa

SEQ ID NO: 78 - protein, 842 aa, Arabidopsis thaliana
  G438  (conserved domain in AA coordinates: 22-85)
MEMAVANHRERSSDSMNRHLDSSGKYVRYTAEQVEALERVYAECPKPSSLRRQQLIRECSILANIEPKQIKVWFQNRRCRDKQRKEASRLQSVNRKLSAMNKLLMEENDRLQKQVSQLVCENGYMKQQLTTVVNDPSCESVVTTPQHSLRDANSPAGLLSIAEETLAEFLSKATGTAVDWVQMPGMKPGPDSVGIFAISQRCNGVAARACGLVSLEPMKIAEILKDRPSWFRDCRSLEVFTMFPAGNGGTIELVYMQTYAPTTLAPARDFWTLRYTTSLDNGSFVVCERSLSGSGAGPNAASASQFVRAEMLSSGYLIRPCDGGGSIIHIVDHLNLEAWSVPDVLRPLYESSKVVAQKMTISALRYIRQLAQESNGEVVYGLGRQPAVLRTFSQRLSRGFNDAVNGFGDDGWSTMHCDGAEDIIVAINSTKHLNNISNSLSFLGGVLCAKASMLLQNVPPAVLIRFLREHRSEWADFNVDAYSAATLKAGSFAYPGMRPTRFTGSQIIMPLGHTIEHEEMLEVVRLEGHSLAQEDAFMSRDVHLLQICTGIDENAVGACSELIFAPINEMFPDDAPLVPSGFRVIPVDAKTGDVQDLLTANHRTLDLTSSLEVGPSPENASGNSFSSSSSRCILTIAFQFPFENNLQENVAGMACQYVRSVISSVQRVAMAISPSGISPSLGSKLSPGSPEAVTLAQWISQSYSHHLGSELLTIDSLGSDDSVLKLLWDHQDAILCCSLKPQPVFMFANQAGLDMLETTLVALQDITLEKIFDESGRKAICSDFAKLMQQGFACLPSGICVSTMGRHVSYEQAVAWKVFAASEENNNNLHCLAFSFVNWSFV

SEQ ID NO: 79 - DNA, 988 bp, Arabidopsis thaliana
  G450
gagttatcgagagagagagaaaacatattctgatttaagacatatatagacagcaagaagagatatgaaccttaaggagacggagctttgtcttggcctccccggaggcactgaaaccgttgaaagtccggccaagtcgggtgttgggaacaagagaggcttctccgagaccgttgatctcaaacttaatcttcaatctaacaaacaaggacatgtggatctcaacactaatggagctcccaaggagaagaccttccttaaagacccttctaagcctcctgctaaagcacaagtggtgggttggccaccggtgaggaactaccggaaaaatgttatggctaatcagaagagcggcgaagcagaggaggcaatgagtagtggtggaggaaccgtcgcctttgtgaaggtttccatggatggagctccttatcttcggaaggttgacctcaagatgtacaccagctacaaggatctctctgatgccttggccaaaatgttcagctcctttaccatggggagttatggagcacaagggatgatagatttcatgaacgagagtaaagtgatggatctgttgaacagttctgagtatgttccaagctacgaggacaaagatggtgactggatgctcgttggtgatgtcccctggccgatgtttgtcgagtcatgcaaacgtttgcgcataatgaaaggatccgaagcaattggacttgctccaagagcaatggagaagttcaagaacagatcatgaacaaaaaaaaaagaggacaatatgcattgatttttttttttttggtattgttatgatcatgtgttttaatttaaaatataggaaggatataggaaaatataattgtttacaaaaaaataactttaaatatgtcttttttttttttttgaaattagtctgtgtttttgttttcatctcttaattagtagaaatcattttttaatatgtaattgtgatagtaaatctatagagttcgta

SEQ ID NO: 80 - protein, 228 aa, Arabidopsis thaliana
  G450  (conserved domain in aa coordinates: 6-14, 78-89, 112-128, 180-217)
MNLKETELCLGLPGGTETVESPAKSGVGNKRGFSETVDLKLNLQSNKQGHVDLNTNGAPKEKTFLKDPSKPPAKAQVVGWPPVRNYRKNVMANQKSGEAEEAMSSGGGTVAFVKVSMDGAPYLRKVDLKMYTSYKDLSDALAKMFSSFTMGSYGAQGMIDFMNESKVMDLLNSSEYVPSYEDKDGDWMLVGDVPWPMFVESCKRLRIMKGSEAIGLAPRAMEKFKNRS

SEQ ID NO: 81 - DNA, 992 bp, Arabidopsis thaliana
  G464
ctctgctggtatcattggagtctagggttttgttattgacatgcgtggtgtgtcagaattggaggtggggaagagtaatcttccggcggagagtgagctggaattgggattagggctcagcctcggtggtggcgcgtggaaagagcgtgggaggattcttactgctaaggattttccttccgttgggtctaaacgctctgctgaatcttcctctcaccaaggagcttctcctcctcgttcaagtcaagtggtaggatggccaccaattgggttacacaggatgaacagtttggttaataaccaagctatgaaggcagcaagagcggaagaaggagacggggagaagaaagttgtgaagaatgatgagctcaaagatgtgtcaatgaaggtgaatccgaaagttcagggcttagggtttgttaaggtgaatatggatggagttggtataggcagaaaagtggatatgagagctcattcgtcttacgaaaacttggctcagacgcttgaggaaatgttctttggaatgacaggtactacttgtcgagaaaaggttaaacctttaaggcttttagatggatcatcagactttgtactcacttatgaagataaggaaggggattggatgcttgttggagatgttccatggagaatgtttatcaactcggtgaaaaggcttcggatcatgggaacctcagaagctagtggactagctccaagacgtcaagagcagaaggatagacaaagaaacaaccctgtttagcttcccttccaaagctggcattgtttatgtattgtttgaggtttgcaatttactcgatactttttgaagaaagtattttggagaatatggataaaagcatgcagaagcttagatatgatttgaatccggttttcggatatggttttgcttaggtcattcaattcgtagttttccagtttgtttcttctttggctgtgtaccaattatctatgttctgtgagagaaagctctt

SEQ ID NO: 82 - protein, 239 aa, Arabidopsis thaliana
  G464  (conserved domain in AA coordinates: 20-28, 71-82, 126-142, 187-224)
MRGVSELEVGKSNLPAESELELGLGLSLGGGAWKERGRILTAKDFPSVGSKRSAESSSHQGASPPRSSQVVGWPPIGLHRMNSLVNNQAMKAARAEEGDGEKKVVKNDELKDVSMKVNPKVQGLGFVKVNMDGVGIGRKVDMRAHSSYENLAQTLEEMFFGMTGTTCREKVKPLRLLDGSSDFVLTYEDKEGDWMLVGDVPWRMFINSVKRLRIMGTSEASGLAPRRQEQKDRQRNNPV

SEQ ID NO: 83 - DNA, 2580 bp, Arabidopsis thaliana
  G470
atggcgagttcggaggtttcaatgaaaggtaatcgtggaggagataacttctcctcctctggttttagtgaccctaaggagactagaaatgtctccgtcgccggcgaggggcaaaaaagtaattctacccgatccgctgcggctgagcgtgctttggaccctgaggctgctctttacagagagctatggcacgcttgtgctggtccgcttgtgacggttcctagacaagacgaccgagtcttctattttcctcaaggacacatcgagcaggtggaggcttcgacgaaccaggcggcagaacaacagatgcctctctatgatcttccgtcaaagcttctctgtcgagttattaatgtagatttaaaggcagaggcagatacagatgaagtttatgcgcagattactcttcttcctgaggctaatcaagacgagaatgcaattgagaaagaagcgcctcttcctccacctccgaggttccaggtgcattcgttctgcaaaaccttgactgcatccgacacaagtacacatggtggattttctgttcttaggcgacatgcggatgaatgtctcccacctctggatatgtctcgacagcctcccactcaagagttagttgcaaaggatttgcatgcaaatgagtggcgattcagacatatattccggggtcaaccacggaggcatttgctacagagtgggtggagtgtgtttgttagctccaaaaggctagttgcaggcgatgcgtttatatttctaaggggcgagaatggagaattaagagttggtgtaaggcgtgcgatgcgacaacaaggaaacgtgccgtcttctgttatatctagccatagcatgcatcttggagtactggccaccgcatggcatgccatttcaacagggactatgtttacagtctactacaaacccaggacgagcccatctgagtttattgttccgttcgatcagtatatggagtctgttaagaataactactctattggcatgagattcaaaatgagatttgaaggcgaagaggctcctgagcagaggtttactggcacaatcgttgggattgaagagtctgatcctactaggtggccaaaatcaaagtggagatccctcaaggtgagatgggatgagacttctagtattcctcgacctgatagagtatctccgtggaaagtagagccagctcttgctcctcctgctttgagtcctgttccaatgcctaggcctaagaggcccagatcaaatatagcaccttcatctcctgactcttcgatgcttaccagagaaggtacaactaaggcaaacatggaccctttaccagcaagcggactttcaagggtcttgcaaggtcaagaatactcgaccttgaggacgaaacatactgagagtgtagagtgtgatgctcctgagaattctgttgtctggcaatcttcagcggatgatgataaggttgacgtggtttcgggttctagaagatatggatctgagaactggatgtcctcagccaggcatgaacctacttacacagatttgctctccggctttgggactaacatagatccatcccatggtcagcggatacctttttatgaccattcatcatcaccttctatgcctgcaaagagaatcttgagtgattcagaaggcaagttcgattatcttgctaaccagtggcagatgatacactctggtctctccctgaagttacatgaatctcctaaggtacctgcagcaactgatgcgtctctccaagggcgatgcaatgttaaatacagcgaatatcctgttcttaatggtctatcgactgagaatgctggtggtaactggccaatacgtccacgtgctttgaattattatgaggaagtggtcaatgctcaagcgcaagctcaggctagggagcaagtaacaaaacaacccttcacgatacaagaggagacagcaaagtcaagagaagggaactgcaggctctttggcattcctctgaccaacaacatgaatgggacagactcaaccatgtctcagagaaacaacttgaatgatgctgcggggcttacacagatagcatcaccaaaggttcaggacctttcagatcagtcaaaagggtcaaaatcaacaaacgatcatcgtgaacagggaagaccattccagactaataatcctcatccgaaggatgctcaaacgaaaaccaactcaagtaggagttgcacaaaggttcacaagcagggaattgcacttggccgttcagtggatctttcaaagttccaaaactatgaggagttagtcgctgagctggacaggctgtttgagttcaatggagagttgatggctcctaagaaagattggttgatagtttacacagatgaagagaatgatatgatgcttgttggtgacgatccttggcaggagttttgttgcatggttcgcaaaatcttcatatacacgaaagaggaagtgaggaagatgaacccggggactttaagctgtaggagcgaggaagaagcagttgttggggaaggatcagatgcaaaggacgccaagtctgcatcaaatccttcattgtccagcgctgggaactcttaa

SEQ ID NO: 84 - protein, 859 aa, Arabidopsis thaliana
  G470  (conserved domain in AA coordinates: 61-393)
MASSEVSMKGNRGGDNFSSSGFSDPKETRNVSVAGEGQKSNSTRSAAAERALDPEAALYRELWHACAGPLVTVPRQDDRVFYFPQGHIEQVEASTNQAAEQQMPLYDLPSKLLCRVINVDLKAEADTDEVYAQITLLPEANQDENAIEKEAPLPPPPRFQVHSFCKTLTASDTSTHGGFSVLRRHADECLPPLDMSRQPPTQELVAKDLHANEWRFRHIFRGQPRRHLLQSGWSVFVSSKRLVAGDAFIFLRGENGELRVGVRRAMRQQGNVPSSVISSHSMHLGVLATAWHAISTGTMFTVYYKPRTSPSEFIVPFDQYMESVKNNYSIGMRFKMRFEGEEAPEQRFTGTIVGIEESDPTRWPKSKWRSLKVRWDETSSIPRPDRVSPWKVEPALAPPALSPVPMPRPKRPRSNIAPSSPDSSMLTREGTTKANMDPLPASGLSRVLQGQEYSTLRTKHTESVECDAPENSVVWQSSADDDKVDVVSGSRRYGSENWMSSARHEPTYTDLLSGFGTNIDPSHGQRIPFYDHSSSPSMPAKRILSDSEGKFDYLANQWQMIHSGLSLKLHESPKVPAATDASLQGRCNVKYSEYPVLNGLSTENAGGNWPIRPRALNYYEEVVNAQAQAQAREQVTKQPFTIQEETAKSREGNCRLFGIPLTNNMNGTDSTMSQRNNLNDAAGLTQIASPKVQDLSDQSKGSKSTNDHREQGRPFQTNNPHPKDAQTKTNSSRSCTKVHKQGIALGRSVDLSKFQNYEELVAELDRLFEFNGELMAPKKDWLIVYTDEENDMMLVGDDPWQEFCCMVRKIFIYTKEEVRKMNPGTLSCRSEEEAVVGEGSDAKDAKSASNPSLSSAGNS

SEQ ID NO: 85 - DNA, 1218 bp, Arabidopsis thaliana
  G477
atggattcttggagctacgggagaagcgttttcatgtcaaatgaaactcttttaccttgtgatacttttgctaagaatagaagatttgaacagagactctctaataatgatgatgtgttgatttctgacatggctggtaactccaatggattcagtgctgtttctattactaaagttgttcctgaagaggaagatgaggagaacatatcttcttcttcaaagttctctagtcaggaattgaataggatagatttcaaacttaggagctttttggatttaggaaatgatgatgatgatacatcctctagaggttttgctctgccatctaaaaagtctcgagcttcaaacttgtgctctcagaatcccttgtgtcaagtttatgggtgtagtaaggatctgagctcttcgaaagattaccacaaaaggcatagagtttgcgaggctcattcgaaaacttctgtggtcatagttaatggtcttgaacagaggttttgtcaacagtgcagcaggtttcatttcctctcagagtttgatgatggcaaaagaagttgcagaaggcgattagccggtcacaatgaacgaagaaggaaacctgcattctatttcctaccgggtaagcgccataagcttcttcgcacctctcaagatgtagtaggcaacaagtttctggagaattcatcattggtattgccagagtcatttcctggtagtctcttatacagagtaatagatgaagacgaccaccgtacaagtagactcgtgagtttcaaagatgaacctacttgttccatgtttcctactaatgagcaaaacagcagcagaacttatgaatctaaaccagcaatttattccacggaagtatcctccatttgggacttacatgagacggcggcatcacgctctactcgtgctctctctcttctgtcagctcagtcccaacaacacttgtctaagtttccaaacacaacgttctcaatcacccaacccaaccaaaatctcaatcactcatcatcaactgactatcatcagatggaacaaccgttgtggatcgatcctggcaagaccaattctgctggttctagttcttgtaaaggaaaaggaacatccacggttgatctactgcaactgtcatcacatcttcaaagaatcgagcaacagaggaattacactggtgatgtgaagcaggaatataatgagctttatttccctggctcctaa

SEQ ID NO: 86 - protein, 405 aa, Arabidopsis thaliana
  G477  (conserved domain in AA coordinates: 108-233)
MDSWSYGRSVFMSNETLLPCDTFAKNRRFEQRLSNNDDVLISDMAGNSNGFSAVSITKVVPEEEDEENISSSSKFSSQELNRIDFKLRSFLDLGNDDDDTSSRGFALPSKKSRASNLCSQNPLCQVYGCSKDLSSSKDYHKRHRVCEAHSKTSVVIVNGLEQRFCQQCSRFHFLSEFDDGKRSCRRRLAGHNERRRKPAFYFLPGKRHKLLRTSQDVVGNKFLENSSLVLPESFPGSLLYRVIDEDDHRTSRLVSFKDEPTCSMFPTNEQNSSRTYESKPAIYSTEVSSIWDLHETAASRSTRALSLLSAQSQQHLSKFPNTTFSITQPNQNLNHSSSTDYHQMEQPLWIDPGKTNSAGSSSCKGKGTSTVDLLQLSSHLQRIEQQRNYTGDVKQEYNELYFPGS

SEQ ID NO: 87 - DNA, 832 bp, Arabidopsis thaliana
  G481
gagcgtttcgtagaaaaattcgatttctctaaagccctaaaactaaaacgactatccccaattccaagttctagggtttccatcttccccaatctagtataaatggcggatacgccttcgagcccagctggagatggcggagaaagcggcggttccgttagggagcaggatcgataccttcctatagctaatatcagcaggatcatgaagaaagcgttgcctcctaatggtaagattggaaaagatgctaaggatacagttcaggaatgcgtctctgagttcatcagcttcatcactagcgaggccagtgataagtgtcaaaaagagaaaaggaaaactgtgaatggtgatgatttgttgtgggcaatggcaacattaggatttgaggattacctggaacctctaaagatatacctagcgaggtacagggagttggagggtgataataagggatcaggaaagagtggagatggatcaaatagagatgctggtggcggtgtttctggtgaagaaatgccgagctggtaaaagaagttgcaagtagtgattaagaacaatcgccaaatgatcaagggaaattagagatcagtgagttgtttatagttgagctgatcgacaactatttcgggtttactctcaatttcggttatgttagtttgaacgtttggtttattgtttccggtttagttggttgtatttaaagatttctctgttagatgttgagaacacttgaatgaaggaaaaatttgtccacatcctgttgttattttcgattcactttcggaatttcatagctaatttattctcatttaataccaaatccttaaattaa

SEQ ID NO: 88 - protein, 141 aa, Arabidopsis thaliana
  G481  (conserved domain in AA coordinates: 20-109)
MADTPSSPAGDGGESGGSVREQDRYLPIANISRIMKKALPPNGKIGKDAKDTVQECVSEFISFITSEASDKCQKEKRKTVNGDDLLWAMATLGFEDYLEPLKIYLARYRELEGDNKGSGKSGDGSNRDAGGGVSGEEMPSW

SEQ ID NO: 89 - DNA, 1065 bp, Arabidopsis thaliana
  G482
tcgacccacgcgtccggacacttaacaattcacaccttctctttttactcttcctaaaaccctaaatttcctcgcttcagtcttcccactcaagtcaaccaccaattgaattcgatttcgaatcattgatggaaatgatttgaaaaaagagtaaagtttatttttttattccttgtaattttcagaaatgggggattccgacagggattccggtggagggcaaaacgggaacaaccagaacggacagtcctccttgtctccaagagagcaagacaggttcttgccgatcgctaacgtcagccggatcatgaagaaggccttgcccgccaacgccaagatctctaaagatgccaaagagacgatgcaggagtgtgtctccgagttcatcagcttcgtcaccggagaagcatctgataagtgtcagaaggagaagaggaagacgatcaacggagacgatttgctctgggctatgactactctaggttttgaggattatgttgagccattgaaagtttacttgcagaggtttagggagatcgaaggggagaggactggactagggaggccacagactggtggtgaggtcggagagcatcagagagatgctgtcggagatggcggtgggttctacggtggtggtggtgggatgcagtatcaccaacatcatcagtttcttcaccagcagaaccatatgtatggagccacaggtggcggtagcgacagtggaggtggagctgcctccggtaggacaaggacttaacaaagattggtgaagtggatctctctctgtatatagatacataaatacatgtatacacatgcctatttttacgacccatataaggtatctatcatgtgatagaacgaacattggtgttggtgatgtaaaatcagatgtgcattaagggtttagattttgaggctgtgtaaaagaagatcaagtgtgctttgttggacaataggattcactaacgaatctgcttcattggatcttgtatgtaactaaagccattgtattgaatgcaaatgttttcatttgggatgctttaaaaaaaaaaaaaaaaa

SEQ ID NO: 90 - protein, 190 aa, Arabidopsis thaliana
  G482  (conserved domain in AA coordinates: 25-116)
MGDSDRDSGGGQNGNNQNGQSSLSPREQDRFLPIANVSRIMKKALPANAKISKDAKETMQECVSEFISFVTGEASDKCQKEKRKTINGDDLLWAMTTLGFEDYVEPLKVYLQRFREIEGERTGLGRPQTGGEVGEHQRDAVGDGGGFYGGGGGMQYHQHHQFLHQQNHMYGATGGGSDSGGGAASGRTRT

SEQ ID NO: 91 - DNA, 922 bp, Arabidopsis thaliana
  G484
attatattccgtacaatccgatcgatttcccggcgccagatctcaccgcgactcgtctactttccgatttggttcgtgttgactcagttacgattaaactatggatccaatggatatagtcggcaaatccaaggaagacgcttctcttccaaaagctacgatgactaaaattataaaggagatgttaccaccagatgttcgtgttgcaagagatgctcaagatcttctcattgaatgttgtgtagagtttataaatcttgtatcttcagaatctaatgatgtttgtaacaaagaggataaacggacgattgctcctgagcatgttctcaaggcattacaggttcttggttttggagaatacattgaagaagtctatgctgcgtatgagcaacataagtatgaaacaatgcaggacacacagaggagcgtgaaatggaaccctggagctcaaatgactgaggaggaagcagcagctgagcaacaacgtatgtttgcagaagcacgtgcaagaatgaatggaggtgtttcggttcctcaacctgaacatccagaaactgaccagagaagtccgcaaagctaactgaaaccgtaagggtaagtgttaggcaagaaaaaacaacatccttttaacattcccttgtaagttgcaaatgcgtatgttctctgtttatatgctcttagtatgatatatgttagttagtgtttcacgatctaaaaacacttgtgattcagatgtaattagtaagcattccttgttttgtgtttactttgtgtcttgactaagcatggtgggtcaggtctacacaaagcatctgattcgatgacttacaggaatcttaatgtttgtagattggataaatttggtgattggtgtaattgtttttccataaacacaatgcaatcattgtttagtgttgttaac

SEQ ID NO: 92 - protein, 159 aa, Arabidopsis thaliana
  G484  (conserved domain in AA coordinates: 11-104)
MDPMDIVGKSKEDASLPKATMTKIIKEMLPPDVRVARDAQDLLIECCVEFINLVSSESNDVCNKEDKRTIAPEHVLKALQVLGFGEYIEEVYAAYEQHKYETMQDTQRSVKWNPGAQMTEEEAAAEQQRMFAEARARMNGGVSVPQPEHPETDQRSPQS

SEQ ID NO: 93 - DNA, 1008 bp, Arabidopsis thaliana
  G489
tggatcaacaagaccatggacagtctggagctatgaactatggcacaaacccataccaaaccaacccgatgagcaccactgctgctactgtagcaggaggtgcggcacaaccaggccagctggcgttccaccagatccatcagcagcagcagcagcaacagctggcacagcagcttcaagcattttgggagaaccaattcaaagagattgagaagactaccgatttcaagaaccacagccttccccttgcgagaatcaagaaaatcatgaaagcggatgaagatgtccgtatgatctcggctgaggcgccggtcgtgtttgcaagggcctgtgagatgttcatcctggagctgacactcaggtcgtggaaccacactgaggagaataagaggcggacgttgcagaagaacgatattgctgctgctgtgactagaaccgatatttttgatttccttgtggatattgttccccgggaggatctccgagatgaagtcttgggaagtattccgaggggcactgtcccggaagctgctgctgctggttacccgtatggatacttgcctgcaggaactgctccaataggaaatccgggaatggttatgggtaatcccggtggtgcgtatccacctaatccttatatgggtcaaccaatgtggcaacaacaggcacctgaccaacctgaccaggaaaattagcaagaaactgtgagtcttccagcttcgcggccgctctagacaggcctcgtaccggatcctctagctagagctttcgttcgtatcatcggtttcgacaacgttcgtcaagttcaatgcatcagtttcattgcgcacacaccagaatcctactgagtttgagtattatggcattgggaaaactgtttttcttgtccatttgttgtgcttgtaatttactgtgttttttattcggttttcgctatcgaactgtgaaatggaaatggatggagaagagttaatgaatgatatggccttttgttcattctcaaattaa

SEQ ID NO: 94 - protein, 220 aa, Arabidopsis thaliana
  G489  (conserved domain in AA coordinates: 57-156)
MNYGTNPYQTNPMSTTAATVAGGAAQPGQLAFHQIHQQQQQQQLAQQLQAFWENQFKEIEKTTDFKNHSLPLARIKKIMKADEDVRMISAEAPVVFARACEMFILELTLRSWNHTEENKRRTLQKNDIAAAVTRTDIFDFLVDIVPREDLRDEVLGSIPRGTVPEAAAAGYPYGYLPAGTAPIGNPGMVMGNPGGAYPPNPYMGQPMWQQQAPDQPDQEN

SEQ ID NO: 95 - DNA, 588 bp, Arabidopsis thaliana
  G490
atgaggaggccaaagtcatctcacgtcaggatggaacctgttgcgcctcgttcacataacacgatgccaatgcttgatcaatttcgatctaatcatcctgaaacaagcaagatcgagggggtctcttcgttggacacagctctgaaggtgttttggaataatcaaagggagcagctaggaaactttgcaggccaaactcatttgccgctatctagggtcagaaagattttgaaatctgatcctgaagtcaagaagataagctgtgatgttcctgctttgttttcgaaagcctgtgaatacttcattctagaggtaacattacgagcttggatgcatactcaatcatgcactcgtgagaccatccggcgttgtgatatcttccaggccgtaaagaactcaggaacttatgatttcctgattgatcgtgtcccttttggaccgcactgtgtcacccatcagggtgtgcaacctcctgctgaaatgattttgccggatatgaatgttccaatcgatatggaccagattgaggaggagaatatgatggaagagcgctctgtcgggtttgacctcaactgtgatctccagtga

SEQ ID NO: 96 - protein, 195 aa, Arabidopsis thaliana
  G490  (conserved domain in AA coordinates: 48-143)
MRRPKSSHVRMEPVAPRSHNTMPMLDQFRSNHPETSKIEGVSSLDTALKVFWNNQREQLGNFAGQTHLPLSRVRKILKSDPEVKKISCDVPALFSKACEYFILEVTLRAWMHTQSCTRETIRRCDIFQAVKNSGTYDFLIDRVPFGPHCVTHQGVQPPAEMILPDMNVPIDMDQIEEENMMEERSVGFDLNCDLQ

SEQ ID NO: 97 - DNA, 1125 bp, Arabidopsis thaliana
  G504
cgtcgacctcttgacgatcatgagactgatttcgtgaaaatatcgtcattatatcaaattagaagttgatggaaaacatgggggattcgagcatagggccgggccatccgcatctccctcccgggtttcggtttcacccgactgatgaggaactagtagttcattacctcaagaagaaagcagattctgttccacttccagtctcaatcatcgcagagattgatctttacaagtttgatccttgggagcttccaagcaaggcgagttttggagagcacgagtggtacttctttagtcctcgggatcggaagtatccaaatggggttaggccaaaccgggcagcaacttccggttattggaaagcaacgggaaccgataaaccgatatttacgtgcaatagtcacaaggttggtgtcaagaaagcgcttgttttttacggtggaaagcctcctaaagggataaaaacagattggatcatgcatgaatatcgcctcactgatggtaaccttagcactgcggctaagccgcctgacttaaccacgacaaggaaaaactcactacggctagacgattgggttctatgtaggatctataagaagaatagttcacaaagaccaacaatggagagagtattacttagagaggatctaatggaaggcatgctctcaaaatcatctgctaattcttcttctacatcagtactagacaacaacgacaacaataataacaataacgaagaacactttttcgacggtatggtcgtttcttcagacaaacgttccttgtgtggtcaataccgaatgggccacgaggcctcaggatcatcttcattcggatctttcttatcgagcaagaggtttcatcatacaggtgatctcaacaatgataactacaatgtctcttttgtttcgatgcttagtgagattcctcagagttcggggtttcatgcaaatggtgttatggatacgacgtcgtctctagctgatcatggggttttaagacaggcgtttcagcttcctaacatgaactggcactcataatctatatagatatatatgtgtgtatcatatatgtatctatgcaggcctaatatagtttacacataaatcatctggggcggccgct

SEQ ID NO: 98 - protein, 323 aa, Arabidopsis thaliana
  G504  (conserved domain in AA coordinates: 19-174)
MENMGDSSIGPGHPHLPPGFRFHPTDEELVVHYLKKKADSVPLPVSIIAEIDLYKFDPWELPSKASFGEHEWYFFSPRDRKYPNGVRPNRAATSGYWKATGTDKPIFTCNSHKVGVKKALVFYGGKPPKGIKTDWIMHEYRLTDGNLSTAAKPPDLTTTRKNSLRLDDWVLCRIYKKNSSQRPTMERVLLREDLMEGMLSKSSANSSSTSVLDNNDNNNNNNEEHFFDGMVVSSDKRSLCGQYRMGHEASGSSSFGSFLSSKRFHHTGDLNNDNYNVSFVSMLSEIPQSSGFHANGVMDTTSSLADHGVLRQAFQLPNMNWHS

SEQ ID NO: 99 - DNA, 1454 bp, Arabidopsis thaliana
  G509
cttcctcctttgctaataaacttttctttgaaccttacacgccttgttgatattactctcttaaatatatattttcgtacattaacacagacatatataaagctaaagatttcttcacgtaatgggtttgaaagatattgggtccaaattgccaccggggtttcgatttcatccaagtgatgaagagttggtttgtcattatctttgcaacaagattagggccaaatctgatcatggtgatgttgatgatgatgatgatgatgttgatgaagctttgaagggttctactgatcttgtggagattgacttgcatatctgtgagccatgggagcttcctgatgtggcaaagttaaacgcaaaggaatggtacttcttcagtttccgtgatcgaaagtatgctactggatatcgcacgaacagagcgacagtaagcggatactggaaagcaacaggaaaagatcgaacggtgatggatccacgtacaaggcaattggtagggatgagaaaaacactagtgttctacagaaacagagcaccaaatgggatcaaaactacttggatcatgcacgagttccgtcttgagtgtcctaacatcccacataaggaagactgggtcttgtgcagagtgttcaacaaaggcagagactcatcgctacaagacaataattattataacaatgataatcagacgcaaaggcttgaagttaatgacgctccggatcttaattacaacaatcagttgccacctttgctatcatcccctcctcataatcatcaacatgagaagatgaaaatccaagtttgtgatcagtgggagcagctaatgaagcagccttcaaggaccaccggccacccctatcatcaccattgtcatcatcaaaccatagcatgtggttgggagcagatgatgatcggttcgctgtcatcaccttcgagtcatggccctgatcacgagtcctttgctaaatttgctttaccgtcgacaataacaacagtgtcaacatcagtggtgatcatcatcagaattatgagaagattttgttgtcatcactagacatgacgagtttggatcacgacaagacatgtatgggatcatcatcggatggtggtatggtctctgatcttcacatggaatgtggtggattgagttttgagaccgaaaatatcctcgctttccaatgaacataattcaaggggttcgccaatttgttgattcgtgaattatacaaacattttatctatagatttatcacattatcaaacatgtaagttgtgtggcatttgggtatagggtttgtgtgattctaggtttttaggacgatgtatgttgttatatttagcgtgtttttaggatttattctcattttaaaattatatgaaaacccattactatgaatacaattagttttctttgttgtaaataatattttagattatcaaaaaaaaaaaaaaaa

SEQ ID NO: 100 - protein, 310 aa, Arabidopsis thaliana
  G509  (conserved domain in AA coordinates: 13-169)
MGLKDIGSKLPPGFRFHPSDEELVCHYLCNKIRAKSDHGDVDDDDDDVDEALKGSTDLVEIDLHICEPWELPDVAKLNAKEWYFFSFRDRKYATGYRTNRATVSGYWKATGKDRTVMDPRTRQLVGMRKTLVFYRNRAPNGIKTTWIMHEFRLECPNIPHKEDWVLCRVFNKGRDSSLQDNNYYNNDNQTQRLEVNDAPDLNYNNQLPPLLSSPPHNHQHEKMKIQVCDQWEQLMKQPSRTTGHPYHHHCHHQTIACGWEQMMIGSLSSPSSHGPDHESFAKFALPSTITTVSTSVVIIIRIMRRFCCHH

SEQ ID NO: 101 - DNA, 1254 bp, Arabidopsis thaliana
  G519
cacaaagatcctccgattcgaaggtttataaaaactcaaaatcgaatcttatccacaagaaaacaacaaggtacttttccaaaaatgaaggcggagttgaatttgccggcgggattccgatttcatccgacggacgaagagcttgtcaagttctatctttgccggagatgtgcgtcagaaccgattaacgttccggttatcgcagagattgacttgtacaaattcaatccatgggagcttccagaaatggcgttgtacggtgagaaagaatggtacttcttctcgcatagagaccggaaatacccaaacgggtcgagaccaaaccgggcagctggaaccggttattggaaagcgactggagctgataaaccgatcggaaaaccgaagacgttagggattaagaaagcactcgtcttctacgcaggaaaagctccgaaagggattaaaacgaattggattatgcacgagtatcgtctcgctaatgtcgatcgatctgcttctaccaacaagaagaacaacttaagacttgatgattgggttttgtgtcggatatacaataagaaaggaacaatggagaagtatttaccggcggcggctgagaaaccgacggaaaagatgagtacgtcggactcaagatgctcaagtcacgtgatttcaccggacgtcacgtgttctgataactgggaggttgagagtgagcccaaatggattaatctggaagacgcgttagaggcatttaatgatgacacgtccatgtttagttccattggtttgttgcaaaatgacgcctttgttcctcagtttcagtaccagtcctccgatttcgtcgattcgtttcaggacccgttcgagcagaaaccgttcttgaattggaattttgctcctcaagggtaaaaataatcggcaaaaagttgaagcttttcagagtcttcgatcaccggcattgtgtcggatcctgacccggagaccaagtcgggtcatacgattacataatcgggttattgagatttccacatttggatttccgagactaaccaacttaacggattctggggtaattggggggttttgcacaggtgaatcacactgagtcagcaagtttcgattttttggttttgttttgtaatgattgattaaatgtctaaagatatcacgaagtagattcagaagaactgtaaaagcaattgtgaccacccgttatgaatcataaatatattcaatgaagcatgagcttattttttttttaaaaaaaaa

SEQ ID NO: 102 - protein, 269 aa, Arabidopsis thaliana
  G519  (conserved domain in AA coordinates: 11-104)
MKAELNLPAGFRFHPTDEELVKFYLCRRCASEPINVPVIAEIDLYKFNPWELPEMALYGEKEWYFFSHRDRKYPNGSRPNRAAGTGYWKATGADKPIGKPKTLGIKKALVFYAGKAPKGIKTNWIMHEYRLANVDRSASTNKKNNLRLDDWVLCRIYNKKGTMEKYLPAAAEKPTEKMSTSDSRCSSHVISPDVTCSDNWEVESEPKWINLEDALEAFNDDTSMFSSIGLLQNDAFVPQFQYQSSDFVDSFQDPFEQKPFLNWNFAPQG

SEQ ID NO: 103 - DNA, 890 bp, Arabidopsis thaliana
  G545
gcaaccttcaaactaaaactcgagagacaagaaatcctcagaatctttaacttaatggcgctcgaggctcttacatcaccaagattagcttctccgattcctcctttgttcgaagattcttcagtcttccatggagtcgagcactggacaaagggtaagcgatctaagagatcaagatccgatttccaccaccaaaacctcactgaggaagagtatctagctttttgcctcatgcttctcgctcgcgacaaccgtcagcctcctcctcctccggcggtggagaagttgagctacaagtgtagcgtctgcgacaagacgttctcttcttaccaagctctcggtggtcacaaggcaagccaccgtaagaacttatcacagactctctccggcggaggagatgatcattcaacctcgtcggcgacaaccacatccgccgtgactactggaagtgggaaatcacacgtttgcaccatctgtaacaagtcttttccttccggtcaagctctcggcggacacaagcggtgccactacgaaggaaacaacaacatcaacactagtagcgtgtccaactccgaaggtgcggggtccactagccacgttagcagtagccaccgtgggtttgacctcaacatccctccgatccctgaattctcgatggtcaacggagacgacgaagtcatgagccctatgccggcgaagaagcctcggtttgactttccggtcaaacttcaactttaaggaaatttacttagacgataagatttcgtttgtatactgttgagagttgtgtaggaatttgttgactgtacataccaaattggactttgactgattccaattcttcttgttctttcattttaaaaattattaaaccgattctttaccacaaa

SEQ ID NO: 104 - protein, 227 aa, Arabidopsis thaliana
  G545  (conserved domain in AA coordinates: 82-102, 136-154)
MALEALTSPRLASPIPPLFEDSSVFHGVEHWTKGKRSKRSRSDFHHQNLTEEEYLAFCLMLLARDNRQPPPPPAVEKLSYKCSVCDKTFSSYQALGGHKASHRKNLSQTLSGGGDDHSTSSATTTSAVTTGSGKSHVCTICNKSFPSGQALGGHKRCHYEGNNNINTSSVSNSEGAGSTSHVSSSHRGFDLNIPPIPEFSMVNGDDEVMSPMPAKKPRFDFPVKLQL

SEQ ID NO: 105 - DNA, 558 bp, Arabidopsis thaliana
  G546
atgactcgaccgtcaagattacttgagacggcggcgccaccaccacaaccgtcggaggagatgatcgcagcggaatccgacatggtggtgatcttgtcggctcttctttgcgctcttatctgcgttgctggtctcgccgccgtcgtacgatgcgcttggctccggcggtttacagccggaggagattcgccgtcaccgaacaaaggcttgaaaaagaaagctcttcagtctcttccaagatccactttcaccgccgcggaatcaacctccggcgccgccgctgaagagggagactcgacggaatgtgctatttgcctcactgacttcgccgacggtgaagaaataagagtgcttcctctttgtggtcattctttccacgtggagtgtattgacaaatggctagtttctaggtcttcttgtccttcttgtcgcaggattcttacgccggtgagatgtgaccggtgtggtcatgcttctacggcggagatgaaagatcaagctcatcgtcatcaacatcaccaacactcttctactaccattcctacgtttcttccttaa

SEQ ID NO: 106 - protein, 185 aa, Arabidopsis thaliana
  G546  (conserved domain in AA coordinates:114-155)
MTRPSRLLETAAPPPQPSEEMIAAESDMVVILSALLCALICVAGLAAVVRCAWLRRFTAGGDSPSPNKGLKKKALQSLPRSTFTAAESTSGAAAEEGDSTECAICLTDFADGEEIRVLPLCGHSFHVECIDKWLVSRSSCPSCRRILTPVRCDRCGHASTAEMKDQAHRHQHHQHSSTTIPTFLP

SEQ ID NO: 107 - DNA, 1413 bp, Arabidopsis thaliana
  G561
aatttgtttttttttcttttgtgggttcaattcgaattgttttccctgagactcaagttactgtgtcattactctgcattgagcaatgggtagcaacgaagaaggaaaccccactaacaactctgataagccatcgcaagctgctgctcctgagcagagtaatgttcatgtgtatcatcatgactgggctgctatgcaggcatattatgggcctagagttggtatacctcaatattacaactcaaatttggcgcctggtcatgctccaccgccttatatgtgggcgtctccatcgccaatgatggctccttatggagcaccatatccaccattttgccctcctggtggagtttatgctcatcctggtgttcaaatgggctcacaaccacaaggtcctgtttctcaatcagcatctggagttacaacccctttgaccattgatgcaccagctaattcagctggaaactcagatcatgggttcatgaaaaagctgaaagagttcgatggacttgcaatgtcaataagcaataacaaagttgggagtgctgaacatagcagcagtgaacataggagttctcagagctccgagaatgatggctctagcaatggtagtgatggtaatacaactgggggagaacaatctaggaggaaaagaaggcaacaaagatcaccaagcactggtgaaagaccctcatctcaaaacagtctgcctcttagaggtgaaaatgagaaacccgatgtgactatggggactcctgttatgcccacagcaatgagtttccaaaactctgctggcatgaacggtgtgccacagccatggaatgaaaaagaggttaaacgagagaagagaaaacagtcaaaccgagaatctgctaggaggtcaagactgaggaagcaggctgaaacagaacaactatctgtcaaagttgacgcattagtagctgagaacatgtctctgaggtctaaactaggccagctaaacaatgagtctgagaaactacggctggagaacgaagctatattggatcaactgaaagcgcaagcaacagggaaaacagagaacctgatctctcgagttgataagaacaactctgtatcaggtagcaaaactgtgcagcatcaactgttaaatgcaagtccgataaccgatcctgtcgcggctagctgaccgtggccgcaacaatgagaacccgatatttcttcctttgggttgtgattgtaacttaaaaggagactttttgtttttattcttagatttgtagctctctgcatagtgagcataaattgatgtaatatggtttaagagattcggtgttctctggtgtgtgctgcaaccacataattggtgatagataggtttagttatataagcaaatgtattagagataaggggagacatatttgatggtcttt

SEQ ID NO: 108 - protein, 360 aa, Arabidopsis thaliana
  G561  (conserved domain in AA coordinates: 248-308)
MGSNEEGNPTNNSDKPSQAAAPEQSNVHVYHHDWAAMQAYYGPRVGIPQYYNSNLAPGHAPPPYMWASPSPMMAPYGAPYPPFCPPGGVYAHPGVQMGSQPQGPVSQSASGVTTPLTIDAPANSAGNSDHGFMKKLKEFDGLAMSISNNKVGSAEHSSSEHRSSQSSENDGSSNGSDGNTTGGEQSRRKRRQQRSPSTGERPSSQNSLPLRGENEKPDVTMGTPVMPTAMSFQNSAGMNGVPQPWNEKEVKREKRKQSNRESARRSRLRKQAETEQLSVKVDALVAENMSLRSKLGQLNNESEKLRLENEAILDQLKAQATGKTENLISRVDKNNSVSGSKTVQHQLLNASPITDPVAAS

SEQ ID NO: 109 - DNA, 1554 bp, Arabidopsis thaliana
  G562
atttgaatttctgggtttctctctgtttaagcttcttcttcttcatcttctgcttacgtttcttcttcaaggagctttcggattcttgtagaaagagtcattgttctcttgagtgggaaaccttgaaaccattcctatgggaaatagcagcgaggaaccaaagcctcctaccaaatcagataaaccatcttcacccccggtggatcaaacaaatgttcatgtctaccctgattgggcagctatgcaggcatattatggtccaagagtagcaatgcctccttattacaattcagctatggctgcatctggtcatcctcctcctccttacatgtggaatcctcagcatatgatgtcaccatctggagcaccctatgctgctgtttatcctcatggaggaggagtttacgctcatcccggtattcccatgggatcactgcctcaaggtcaaaaggatccacctttaacaactccggggacgcttttgagcatcgacactcctactaaatctacagggaacacagacaatggattgatgaagaagctgaaagagtttgatgggcttgctatgtctctaggaaatgggaatcctgaaaatggtgcagatgaacataaacgatcacggaacagctcagaaactgatggttctactgatggaagtgatgggaatacaactggggcagatgaaccgaaacttaaaagaagtcgagagggaactccaacaaaagatgggaaacaattggttcaagctagctcatttcattctgtttctccgtcaagtggtgataccggcgtaaaactcattcaaggatctggagctatactctctcctggtgtaagtgcaaattccaaccccttcatgtcacaatctttagccatggttcctcctgaaacttggcttcagaacgagagagaactgaaacgggagcgaaggaaacagtctaatagagaatctgctagaaggtcaagattaaggaaacaggccgagacagaagaacttgctaggaaagtggaagccttgacagccgaaaacatggcattaagatctgaactaaaccaacttaatgagaaatctgataaactaagaggagcaaatgcaaccttgttggacaaactgaaatgctcggaacccgaaaagagagtccccgcaaatatgttgtctagagttaagaactcaggagctggagataagaacaagaaccaaggagacaatgattctaactctacaagcaaattccatcaactgctcgatacgaagcctcgagctaaagcagtagctgcaggctgaatcgatggtaattcatgtcgatttctacttaatttgtcgacataaacaaagaaaataagtgctactaatttcagaaaaacttgatagatagatagtatagtagagagagagagagagagagaggtgtgatgattattgatctataaattttcggagagagagagggagaaagagaaacttttcctccagatgaaaatttggtgttatggtttgttactgttaatatagagaggcttttctttttttataaaatggcttcctttgttgca

SEQ ID NO: 110 - protein, 382 aa, Arabidopsis thaliana
  G562  (conserved domain in AA coordinates: 253-315)
MGNSSEEPKPPTKSDKPSSPPVDQTNVHVYPDWAAMQAYYGPRVAMPPYYNSAMAASGHPPPPYMWNPQHMMSPSGAPYAAVYPHGGGVYAHPGIPMGSLPQGQKDPPLTTPGTLLSIDTPTKSTGNTDNGLMKKLKEFDGLAMSLGNGNPENGADEHKRSRNSSETDGSTDGSDGNTTGADEPKLKRSREGTPTKDGKQLVQASSFHSVSPSSGDTGVKLIQGSGAILSPGVSANSNPFMSQSLAMVPPETWLQNERELKRERRKQSNRESARRSRLRKQAETEELARKVEALTAENMALRSELNQLNEKSDKLRGANATLLDKLKCSEPEKRVPANMLSRVKNSGAGDKNKNQGDNDSNSTSKFHQLLDTKPRAKAVAAG

SEQ ID NO: 111 - DNA, 1479 bp, Arabidopsis thaliana
  G567
aaaaagaagaatcagaaagtgaaaaagagagcgagcgatgaacagtatcttctccattgacgatttctccgatcctttctgggaaactcctccgattcctctcaatcccgactcttctaagcctgttacggcggatgaagttagccagagtcaaccggaatggactttcgagatgtttctcgaagagatttcttcgtcggcggtgagctctgagccacttggtaacaacaacaacgcgatcgtcggtgtttcttcggcgcaatctcttccttctgtttccggacagaatgatttcgaggatgatagtcgatttcgtgatcgcgattcgggaaatttggattgtgctgctcccatgacgacgaagacggtgaatgttgattccgatgattatcgtcgtgttcttaagaacaagcttgaggctgagtgcgcgactggtgtttctcttcgggttgggtctgtgaagcctgaagattcgactagttctccagaaactcaacttcaaccagttcaatccagtcctcttactcaaggagaacttggtgttacttcttccttaccagctgaggtgaaaaaaactggtgtatcaatgaagcaggttactagtggatcgtcgagagaatattctgatgacgaggaccttgatgaagagaatgaaaccaccggttccttgaagccagaggacgttaaaaaatctagaaggatgctgtcaaatcgtgagtcagctaggcgatctagaaggagaaagcaggagcaaacaagtgacctcgaaacacaggttaatgatctaaaaggtgagcattcatcacttcttaaacaactgagcaacatgaatcacaagtatgacgaggctgctgttggcaatagaatactaaaggctgacattgagacattaagagctaaggtgaaaatggcggaagaaaccgtgaagagagtaacaggaatgaatccgatgcttctcggaagatcaagtggacataacaacaacaacagaatgccaataactggtaacaacaggatggattcttctagcattattccagcttatcaaccacactcaaacctaaaccatatgtcaaaccaaaacatcgggatcccaaccattctacctccaagactcggaaacaatttcgctgctcctccatcccaaaccagctctcccttgcagagaattagaaatgggcaaaatcaccatgttactccaagcgccaacccgtatggctggaataccgaacctcagaacgattcagcatggccgaaaaaatgcgtggactgatcaaacaagaagcgggtttcgcactatattaatgtctatgcatctgtaatttgtaagtgttattaagttacgaatcatgagaaaacatcttgtgaaaatacagtctcatggcttatatatatatataagctctgtcttataacattacaagattcttatttgagaatcgtctttctatttatagctaataaaaaaaaaaaaaaaaa

SEQ ID NO: 112 - protein, 411 aa, Arabidopsis thaliana
  G567  (conserved domain in AA coordinates: 210-270)
MNSIFSIDDFSDPFWETPPIPLNPDSSKPVTADEVSQSQPEWTFEMFLEEISSSAVSSEPLGNNNNAIVGVSSAQSLPSVSGQNDFEDDSRFRDRDSGNLDCAAPMTTKTVNVDSDDYRRVLKNKLEAECATGVSLRVGSVKPEDSTSSPETQLQPVQSSPLTQGELGVTSSLPAEVKKTGVSMKQVTSGSSREYSDDEDLDEENETTGSLKPEDVKKSRRMLSNRESARRSRRRKQEQTSDLETQVNDLKGEHSSLLKQLSNMNHKYDEAAVGNRILKADIETLRAKVKMAEETVKRVTGMNPMLLGRSSGHNNNNRMPITGNNRMDSSSIIPAYQPHSNLNHMSNQNIGIPTILPPRLGNNFAAPPSQTSSPLQRIRNGQNHHVTPSANPYGWNTEPQNDSAWPKKCVD

SEQ ID NO: 113 - DNA, 1294 bp, Arabidopsis thaliana
  G568
gaccggctaaagtcaagaacctctctctgagctctcaccactttctctctctactccctctctgcgtgtaggatactactagacaattgacaaccaaagactaaagctgtgttgttggttcacttctgttctcttttccaatgttgtcatcagctaagcatcagagaaaccatagactctctgctacaaacaagaaccagactctcaccaaagtttcttccatttcatcctcatcaccatcgtcttcttcttcatcatcatcaacctcatcatcatctcctttaccttctcaagactctcaagcccagaagagatctcttgtcaccatggaagaagtttggaatgacatcaaccttgcttccatccaccacctaaaccgacacagccctcatccacaacacaaccacgagccaaggttcaggggccaaaaccaccacaaccaaaaccctaactcaatcttccaagattttctcaaaggatctttgaaccaggaaccagcacccacaagccagaccacgggttctgcgcctaatggcgattccaccacggtcactgttctttacagctctccttttccacctcctgcaactgttctgagcttgaattccggcgctggcttcgagtttctcgataaccaagatcctcttgttacctcaaactctaatcttcatacccaccatcacctctcaaacgctcatgccttcaacacctctttcgaggctctggttccatccagttcttttggtaagaaaagaggccaagattccaatgaaggttcagggaatagaagacataagcgtatgatcaagaacagagaatctgcagctcgttcccgcgctaggaaacaggcttatacaaacgagttagaacttgaagttgctcacttgcaggcagaaaatgcaagactcaagagacaacaagatcaaaaaatggctgcagcaattcagcaacccaaaaagaacacacttcaacggtcttccacagctccattttgagaaatctacaagtccttgtttctcttttggggattgagattgtctcatgaagaagtgaaaaaatggcaaaagtttgtacccttttttattagctataagtataactaagcctaaaattgtagaactaagatattgtaggggaaaaaagaagatgtaaaacaaaagacccggaaagagaaaaggatctttcaatttcctaaggcacaggaacacctgtcctgggtcctctcttaatgttctgtcgttttcctatgcaaacccttttttcacttctgtactaacttatacttgtattcttg

SEQ ID NO: 114 - protein, 284 aa, Arabidopsis thaliana
  G568  (conserved domain in AA coordinates: 215-265)
MLSSAKHQRNHRLSATNKNQTLTKVSSISSSSPSSSSSSSSTSSSSPLPSQDSQAQKRSLVTMEEVWNDINLASIHHLNRHSPHPQHNHEPRFRGQNHHNQNPNSIFQDFLKGSLNQEPAPTSQTTGSAPNGDSTTVTVLYSSPFPPPATVLSLNSGAGFEFLDNQDPLVTSNSNLHTHHHLSNAHAFNTSFEALVPSSSFGKKRGQDSNEGSGNRRHKRMIKNRESAARSRARKQAYTNELELEVAHLQAENARLKRQQDQKMAAAIQQPKKNTLQRSSTAPF

SEQ ID NO: 115 - DNA, 2162 bp, Arabidopsis thaliana
  G584
aaaaagtcttctcttttataactacgtcagagaactgttatgtctccgacgaatgttcaagtaaccgattaccatctcaaccaatcaaaaacggatacaacaaatctctggtcaaccgacgacgatgcatcggtaatggaagctttcatcggcggcggctccgatcattcttctctttttcctccacttcctcctcctcctcttcctcaagtcaacgaagataatctccagcaacgtctccaagctttaatcgaaggagcaaacgagaactggacttacgccgtgttctggcaatcatctcacggtttcgccggagaagacaacaacaacaacaacacagtgttgttaggttggggagatggttattacaaaggagaagaagagaagtctagaaagaagaaatcaaatccagctagtgcagctgaacaagagcatcgtaagagagtgattagagagctcaactctttaatctccggtggtgtaggaggaggagatgaagctggagatgaagaagttacagatactgaatggttcttcttagtttcaatgacacagagctttgtcaagggtactggtttacctggtcaagctttctcaaattcagacacgatttggttatctggttctaatgctttagctggatcaagttgtgagagagctcgtcaaggtcagatttatgggttacaaacaatggtgtgtgtagcgacagagaatggtgtcgttgagcttggttcgtcggagattattcatcaaagttcagatcttgttgataaagttgacacctttttcaattttaacaatggtggtggtgaatttggttcttgggcgtttaatttgaatccagatcaaggagagaatgatccaggtttgtggattagtgaacctaatggtgttgactctggtcttgtagctgctccggtgatgaataatggtggaaatgactcaacttctaattctgattctcaaccaatttctaagctttgtaatggaagctctgttgaaaaccctaaccctaaagttctgaaatcttgtgaaatggtgaatttcaagaatgggattgagaatggtcaagaagaagatagtagtaataagaagagatcaccggtttcgaataatgaagaagggatgctttcttttacctctgttcttccatgtgactcgaatcactctgatcttgaagcttcagtggctaaagaagctgagagtaacagagttgtggttgaaccggagaagaaaccgaggaaacgagggagaaaaccggcgaatggaagagaagagcctttgaatcatgtagaggcagagagacagagaagagagaagttgaatcagagattctattctttaagagctgtggttcctaatgtgtctaagatggataaagcttctctattaggagatgctatttcgtatatcagtgagcttaagtctaagttgcaaaaggctgaatctgataaagaagagttgcagaagcagattgatgtgatgaataaagaagcgggaaatgcgaaaagttcggtaaaagatcgaaaatgtttgaatcaagaatcgagtgtgttgatagagatggaggttgatgtgaagattattggttgggatgcaatgataaggattcaatgtagtaagaggaatcatcctggtgctaagttcatggaagcacttaaggagttggatttggaagtgaatcatgcgagtttatcggtagtgaatgatcttatgatccaacaagcgactgtgaaaatggggaatcagtttttcacgcaagatcaactcaaggttgctctaacggagaaagttggagaatgtccatgaattgaagtcagcatctttagggctaatacaccggagaatactgcgaaaagtcgaaaacaacgatcatagtataagccgcggtaaaaagtgttaaacctttcacacaagtttctctagtgaatgtagttgtaaactctattgtgtaagggtaattttgtagtacccacttgttgctattgaatgcttgttagagaggattcttagtgtagtatatgattaggttggggtttgttgtttcatgagataaataaatgtgtttgatcaatggttaagtctttggtttgttggtgtatgtatgtaaataaggcttttgttagaaataagacaaatgggactgaagttggagtttaaaa

SEQ ID NO: 116 - protein, 589 aa, Arabidopsis thaliana
  G584  (conserved domain in AA coordinates: 401-494)
MSPTNVQVTDYHLNQSKTDTTNLWSTDDDASVMEAFIGGGSDHSSLFPPLPPPPLPQVNEDNLQQRLQALIEGANENWTYAVFWQSSHGFAGEDNNNNNTVLLGWGDGYYKGEEEKSRKKKSNPASAAEQEHRKRVIRELNSLISGGVGGGDEAGDEEVTDTEWFFLVSMTQSFVKGTGLPGQAFSNSDTIWLSGSNALAGSSCERARQGQIYGLQTMVCVATENGVVELGSSEIIHQSSDLVDKVDTFFNFNNGGGEFGSWAFNLNPDQGENDPGLWISEPNGVDSGLVAAPVMNNGGNDSTSNSDSQPISKLCNGSSVENPNPKVLKSCEMVNFKNGIENGQEEDSSNKKRSPVSNNEEGMLSFTSVLPCDSNHSDLEASVAKEAESNRVVVEPEKKPRKRGRKPANGREEPLNHVEAERQRREKLNQRFYSLRAVVPNVSKMDKASLLGDAISYISELKSKLQKAESDKEELQKQIDVMNKEAGNAKSSVKDRKCLNQESSVLIEMEVDVKIIGWDAMIRIQCSKRNHPGAKFMEALKELDLEVNHASLSVVNDLMIQQATVKMGNQFFTQDQLKVALTEKVGECP

SEQ ID NO: 117 - DNA, 2299 bp, Arabidopsis thaliana
  G585
ctctcaaacatttctctgtttgttccggcgaaaacggcaactgtttcatcaaatgacaaacacaaaaaccttaacatctagtttgtatcctctctgatacttcaaaaaaaatggatgaagaaacaatggctaccggacaaaacagaacaactgtgccagagaatctgaagaaacacctcgcagtttcagttcgaaacattcaatggagttatggtatcttttggtctgtctctgcttctcagtctggagttttagaatggggagatggatactataatggagatatcaaaacgaggaagacgattcaagcttcggagatcaaagctgatcagcttggtctacggaggagcgagcagcttagcgagctttacgagtctctctccgtcgctgaatcttcttcttcaggcgttgctgccggatctcaagtcaccagacgagcttccgccgccgcactttcaccggaagatctcgccgacaccgagtggtactatttggtttgtatgtctttcgtcttcaacattggtgaaggaatgcctggacggacgtttgcaaacggtgaaccgatatggttgtgcaacgctcatacggcggatagtaaagtgtttagccgttctcttctagcaaaaagtgctgcggttaagacagtggtttgcttcccgttccttggaggagtcgttgagattggtaccacagaacatattacggaagacatgaatgtaatacaatgcgtgaagacatcattcctcgaagcccctgatccgtacgctacaatattaccagcaagatccgattatcacatcgacaacgttcttgatccgcaacagattctaggcgacgagatttacgcgcctatgttcagtacggagccttttccaacagcttctccgagcagaactaccaacggtttcgatcaagaacatgaacaagtagcagatgatcatgattctttcatgaccgaaagaatcactggaggagcttctcaggtgcaaagctggcagctcatggacgacgagcttagtaactgcgttcaccagtcgctaaattccagcgattgcgtctctcaaacgtttgttgaaggggcggctggacgggttgcttacggtgcaagaaagagtagagttcaaagactagggcaaattcaagagcaacagagaaatgtgaagacattgtcatttgatccaagaaacgacgacgttcattaccaaagtgtgatctcaacgatttttaagaccaaccatcagttaattctcggaccgcagtttcgaaactgcgataaacagtcaagcttcactaggtggaagaaatcatcgtcatcatcatcaggaaccgccacggtcacggcaccatcacaaggaatgttaaagaaaattattttcgatgttccgcgagtgcaccagaaagagaagttaatgttggactcaccagaagccagagatgaaactgggaaccatgcggttttagagaagaagcgccgcgagaaattgaacgaacggttcatgaccttgagaaaaatcattccgtcaatcaacaagatcgataaagtatcgattcttgacgatacgatagagtatcttcaagaactcgagagacgggttcaagaactagaatcttgcagagaatcaaccgatacagagactcgtgggacgatgacgatgaagaggaagaaaccatgcgacgcaggagaaagaacatcagctaattgcgcaaataatgaaacaggaaatgggaagaaggtgtcggttaacaatgttggtgaagccgagccagcagataccggttttactggtttaaccgataatttaaggatcggttcgtttggtaatgaggtggttattgagcttagatgtgcttggagagaaggagtattgcttgagataatggatgtgattagtgatctccatttggattctcattcggttcaatcctcgaccggagacggtttgctctgcttaaccgtcaattgcaagcacaaggggtcaaaaatagcgacaccaggaatgatcaaagaagcacttcaaagggttgcatggatctgttgaagactacttagttaaaattgacagcaaagaaaaaacattcccggtttggtttctattctttggttttcttctaaccgggttttaggaattaatgttatgtttatcatttgttttttgttttttttttgtgtctttttttccgttgcttaacgtaggtgaagaggaacatacactatgcgtattttgtttgaggtagattattttaagggtattagtaatagtaatagccagtttagatgattttgtgttcttttgttgtt

SEQ ID NO: 118 - protein, 642 aa, Arabidopsis thaliana
  G585  (conserved domain in AA coordinates:436-501)
MDEETMATGQNRTTVPENLKKHLAVSVRNIQWSYGIFWSVSASQSGVLEWGDGYYNGDIKTRKTIQASEIKADQLGLRRSEQLSELYESLSVAESSSSGVAAGSQVTRRASAAALSPEDLADTEWYYLVCMSFVFNIGEGMPGRTFANGEPIWLCNAHTADSKVFSRSLLAKSAAVKTVVCFPFLGGVVEIGTTEHITEDMNVIQCVKTSFLEAPDPYATILPARSDYHIDNVLDPQQILGDEIYAPMFSTEPFPTASPSRTTNGFDQEHEQVADDHDSFMTERITGGASQVQSWQLMDDELSNCVHQSLNSSDCVSQTFVEGAAGRVAYGARKSRVQRLGQIQEQQRNVKTLSFDPRNDDVHYQSVISTIFKTNHQLILGPQFRNCDKQSSFTRWKKSSSSSSGTATVTAPSQGMLKKIIFDVPRVHQKEKLMLDSPEARDETGNHAVLEKKRREKLNERFMTLRKIIPSINKIDKVSILDDTIEYLQELERRVQELESCRESTDTETRGTMTMKRKKPCDAGERTSANCANNETGNGKKVSVNNVGEAEPADTGFTGLTDNLRIGSFGNEVVIELRCAWREGVLLEIMDVISDLHLDSHSVQSSTGDGLLCLTVNCKHKGSKIATPGMIKEALQRVAWIC

SEQ ID NO: 119 - DNA, 1292 bp, Arabidopsis thaliana
  G590
tcgacagacactctccctctctccatgcccataaaatctcaaagactgtttaaaaaaaaaaatgttttagctttaactgctttttttttgttgttggtgtaatgatatcacagagagaagaaagagaagagaagaagcagagagtgatgggagataagaaattgatttcatcttcttcttcttcctcggtttacgatactcgtatcaatcatcatcttcatcatcctccgtcttcttccgacgaaatctctcagtttctccggcatattttcgaccgttcttctcctttaccttcttactactccccggcgacgactacaacgacggcgtctttgattggtgtgcacgggagcggtgacccacatgcagataactcgagaagtctcgtttctcatcatccaccgtcagattctgtgcttatgtcgaaacgtgtcggagatttctctgaggttttaatcggcggaggatcaggctcagccgccgcgtgttttggtttctccggtggtggtaataataacaacgttcaaggaaatagctctgggactcgagtatcgtcttcttccgttggagctagtggcaacgagacagatgagtatgactgtgaaagcgaggaaggaggagaagctgtagttgatgaagctccctcttccaagtcaggtccttcttctcgtagttcatctaaaagatgcagagctgctgaagttcataatctctctgagaagaggaggagaagtagaattaatgaaaaaatgaaagctttacaaagtctcatccctaattcaaataagacggataaggcttcaatgcttgatgaagccattgagtatctgaaacagcttcagctccaagttcagatgttgactatgagaaatggaataaacttgcatcctttgtgtttacctggaactacattacacccattgcaactctctcagattcgaccccctgaagcaaccaatgatcctctgcttaatcataccaatcagtttgcttcgacttctaatgcaccggaaatgatcaatactgtggcttcttcatacgctttggaaccttctattcgcagtcactttggacctttccctctccttacttcacccgtggagatgagtcgggaaggtgggttaactcatccaaggttgaacattggtcattccaacgcaaacataaccggggaacaagctctgtttgatggacaacctgacctaaaagatcgaattacttgaacagtgtcccaacttcgggatctctatgtgttcttgtttcttagaacgcaagccataaagctgtctgac

SEQ ID NO: 120 - protein, 373 aa, Arabidopsis thaliana
  G590  (conserved domain in AA coordinates: 202-254)
MISQREEREEKKQRVMGDKKLISSSSSSSVYDTRINHHLHHPPSSSDEISQFLRHIFDRSSPLPSYYSPATTTTTASLIGVHGSGDPHADNSRSLVSHHPPSDSVLMSKRVGDFSEVLIGGGSGSAAACFGFSGGGNNNNVQGNSSGTRVSSSSVGASGNETDEYDCESEEGGEAVVDEAPSSKSGPSSRSSSKRCRAAEVHNLSEKRRRSRINEKMKALQSLIPNSNKTDKASMLDEAIEYLKQLQLQVQMLTMRNGINLHPLCLPGTTLHPLQLSQIRPPEATNDPLLNHTNQFASTSNAPEMINTVASSYALEPSIRSHFGPFPLLTSPVEMSREGGLTHPRLNIGHSNANITGEQALFDGQPDLKDRIT

SEQ ID NO: 121 - DNA, 1292 bp, Arabidopsis thaliana
  G594
agaaaagataagagccttttaaagttttttttttaccttctcttcatggacttgtctgtacttgataggcttaagtggctgcaacagcaacaaatggtttcacctgagtttcttcagatacttggctcagatgggagagaagagctcaaaagagttgagagttacttgggaaacaacaatgatgagctgcagagtttcagacattttcccgaattcggaccggattatgatactactgatggctgcatttctaggacaagtagcttccatatggagccagtgaagaataatggacacagcagagccattaccttgcagaacaagagaaaaccagagggtaagacagaaaagagagagaagaagaagatcaaagcagaggatgaaacagagccaagcatgaaagggaaatcaaacatgagtaacacagagacatcttcagaaattcagaaaccagattacattcatgttagggctagacgaggtgaagccaccgacagacatagcttagcagagagggcaagaagagaaaagataagcaagaagatgaaatgtctacaagatattgttcctggatgcaacaaagttactggaaaagctggtatgcttgatgagatcatcaactatgtccaatctctgcaacaacaagtcgagttcttgtcgatgaaactctctgtcataaatccagaacttgagtgtcatatcgatgatttatccgcaaaacagtttcaggcttacttcacaggtcctccagaaggtgactcgaagcagtcaatcatggcggattttcggtcttttccattacatcagcaaggatctttagattactcagtcataaactcagaccacaccacatctctcggcgctaaagatcatacatcatcaagctgggaaactcactcacagtgtctttacaacagcttgagaaccgattctgtttccaatttcttcagcctcaagtaaaaaaattagggatagcctcattaaaaaaatcgcggttttttgttgttgtcttatccatttatctatcttatctgaaatttgaaccagaaagacagaggaaaccaatccaaagatctttctcaatctattatcttcatacaaatatagtgatttacatatattccaggggatatgtatatgtgtagaagaaagagaaaaaactcttgtggtcatagcaattcctttttttgtacattgtagaatcaaactcttgtggtcgtaacaattatttccttcacaaattacaactacacttgtattaatggagatgccttttggccctgggatcaaca

SEQ ID NO: 122 - protein, 304 aa, Arabidopsis thaliana
  G594  (conserved domain in AA coordinates: 140-204)
MDLSVLDRLKWLQQQQMVSPEFLQILGSDGREELKRVESYLGNNNDELQSFRHFPEFGPDYDTTDGCISRTSSFHMEPVKNNGHSRAITLQNKRKPEGKTEKREKKKIKAEDETEPSMKGKSNMSNTETSSEIQKPDYIHVRARRGEATDRHSLAERARREKISKKMKCLQDIVPGCNKVTGKAGMLDEIINYVQSLQQQVEFLSMKLSVINPELECHIDDLSAKQFQAYFTGPPEGDSKQSIMADFRSFPLHQQGSLDYSVINSDHTTSLGAKDHTSSSWETHSQCLYNSLRTDSVSNFFSLK

SEQ ID NO: 123 - DNA, 1538 bp, Arabidopsis thaliana
  G597
aaaattctcctgtaaaatttaatattataaaagtggtttctttttcatttatgtttatataattttcatctttaatcttaaattctggtaaccttaatgcgcgatccgcttttctaaagttttgtgagagagaagagatctaaaaaaatccacaattttgttcaaatcttggagttaaatgctgaattttaggccttgttgcttagatttatggcttaaagtttcaaacttttcattggatatgtgagaagaaaatgtcaggatctgagacgggtttaatggcggcgaccagagaatcaatgcaatttacaatggctctccaccagcagcagcaacacagtcaagctcaacctcagcagtctcagaacaggccattgtcattcggtggagacgacggaactgctctttacaagcagccgatgagatcagtatcaccaccgcagcagtaccaacccaactcagctggtgagaattctgtcttgaacatgaacttgcccggaggtgagtctggaggcatgactggaactggaagtgagccagtgaaaaagaggagaggtagaccgaggaaatatgggcctgatagtggtgaaatgtcacttggtttgaatcctggagctccttctttcactgtcagccaacctagtagcggcggcgatggaggagagaagaagagaggaagacctcctggttcttctagcaaaaggctcaagcttcaagctttaggctcgactggaatcggatttacgcctcatgtacttaccgtgctggctggagaggatgtatcatccaagataatggcgttaactcataatggaccccgtgctgtgtgtgtcttgtctgcaaatggagccatctccaatgtgactctccgccagtctgccacatccggtggaactgttacatatgaggggagatttgagattctgtctttatcgggatctttccatttgctggagaacaatggtcaaagaagcaggacgggaggtctaagcgtgtcattatcaagtccggatggtaatgtcctcggtggcagtgtagctggtcttcttatagcagcatcacctgttcagattgttgttgggagtttcttaccagacggagaaaaagaaccaaaacagcatgtgggacaaatgggactgtcgtcacccgtattaccgcgtgtggccccaacgcaggtgctgatgactccaagtagcccacaatctcgaggcacaatgagtgagtcatcttgtggaggaggacatggaagccctattcatcagagcactggaggaccttacaataacaccattaacatgccctggaagtagccaagtgatctgtgtcggcttaaaaccaacaacttcccgttattagagtgatttatttctacatttggtttagactttctagttctgatggttatttctacagttggtttagactttctagttctgttcagacaaaaggagtttgataaattgaccgacctattttgtgtgtttgaggtactttcagaaccataggtgttcagaaattagaatgttctgtttaaaaaa

SEQ ID NO: 124 - protein, 351 aa, Arabidopsis thaliana
  G597  (conserved domain in AA coordinates: 97-104,137-144)
MSGSETGLMAATRESMQFTMALHQQQQHSQAQPQQSQNRPLSFGGDDGTALYKQPMRSVSPPQQYQPNSAGENSVLNMNLPGGESGGMTGTGSEPVKKRRGRPRKYGPDSGEMSLGLNPGAPSFTVSQPSSGGDGGEKKRGRPPGSSSKRLKLQALGSTGIGFTPHVLTVLAGEDVSSKIMALTHNGPRAVCVLSANGAISNVTLRQSATSGGTVTYEGRFEILSLSGSFHLLENNGQRSRTGGLSVSLSSPDGNVLGGSVAGLLIAASPVQIVVGSFLPDGEKEPKQHVGQMGLSSPVLPRVAPTQVLMTPSSPQSRGTMSESSCGGGHGSPIHQSTGGPYNNTINMPWK

SEQ ID NO: 125 - DNA, 1226 bp, Arabidopsis thaliana
  G598
gtccgttgtcatattttaaatttatcaccttcttgagaattccacatttttatcctttttgtcatgtagtgtatattttttcctctaacctaattaaaatcaaaacaaaatcctttgacccaattagcttcgcgatatatcagaagagatcaaactactttgatcagaccatgatcttcttcttcttcttcttcttcttcttcttctttttagacgatcacaattcctaaaccctatttctcagattatgctgactctttaccatcaagaaaggtcaccggacgccacaagtaatgatcgcgatgagacgccagagactgtggttagagaagtccacgcgctaactccagcgccggaggataattcccggacgatgacggcgacgctacctccaccgcctgctttccgaggctatttttctcctccaaggtcagcgacgacgatgagcgaaggagagaacttcacaactataagcagagagttcaacgctctagtcatcgccggatcctccatggagaacaacgaactaatgactcgtgacgtcacgcagcgtgaagatgagagacaagacgagttgatgagaatccacgaggacacggatcatgaagaggaaacgaatcctttagcaatcgtgccggatcagtatcctggttcgggtttggatcctggaagtgataatgggccgggtcagagtcgggttgggtcgacggtgcaaagagttaagagggaagaggtggaagcgaagataacggcgtggcagacggcaaaactggctaagattaataacaggtttaagagggaagacgccgttattaacggttggtttaatgaacaagttaacaaggccaactcttggatgaagaaaattgagtataatgtaggttcattcaacaatcgtctaaatgaggaagctagaggagagaaaagcaaaagcgatggagaaaacgcaaaacaatgtggcgaaagcgcagaggaaagcggaggagagaagagcgacggcagaggcaaagagagggacagaggttgcaaaagtagttgaagttgctaatctcatgagagcccttggacgtcctcctgccaaacgctccttcttctctttctcctaatttttagttatatcaaaccattaaattaaacagtactcgttatatatctagttagtaaacaaaggggcagttttatagctcatgtacacataattgagagtgtagtactgttgtgtcaaa

SEQ ID NO: 126 - protein, 263 aa, Arabidopsis thaliana
  G598  (conserved domain in AA coordinates: 205-263)
MLTLYHQERSPDATSNDRDETPETVVREVHALTPAPEDNSRTMTATLPPPPAFRGYFSPPRSATTMSEGENFTTISREFNALVIAGSSMENNELMTRDVTQREDERQDELMRIHEDTDHEEETNPLAIVPDQYPGSGLDPGSDNGPGQSRVGSTVQRVKREEVEAKITAWQTAKLAKINNRFKREDAVINGWFNEQVNKANSWMKKIEYNVGSFNNRLNEEARGEKSKSDGENAKQCGESAEESGGEKSDGRGKERDRGCKSS

SEQ ID NO: 127 - DNA, 798 bp, Arabidopsis thaliana
  G634
atggagcaaggaggaggtggtggtggtaatgaagttgtggaggaagcttcacctattagttcaagacctcctgctaacaacttagaagagcttatgagattctcagccgccgcggatgacggtggattaggaggtggaggtggaggaggaggaggaggaagtgcttcttcttcatcgggaaatcgatggccgagagaagaaactttagctcttcttcggatccgatccgatatggattctacttttcgtgatgctactctcaaagctcctctttgggaacatgtttccaggaagctattggagttaggttacaaacgaagttcaaagaaatgcaaagagaaattcgaaaacgttcagaaatattacaaacgtactaaagaaactcgcggtggtcgtcatgatggtaaagcttacaagttcttctctcagcttgaagctctcaacactactcctcctcctcctccttctcatcctcacgctcatcaaccagaacagaaacaacaacaacaaccacaacaagagatggtcatgagctcggaacaatcatcattaccatcatcatcaagatggccaaaggcagagattctagcgcttataaacctgagaagtggaatggaaccaaggtaccaagataatgtacctaaaggacttctatgggaagagatctcaacttcaatgaagagaatgggatacaacagaaacgctaagagatgtaaagagaaatgggaaaacataaacaaatactacaagaaagttaaagaaagcaacaacagcaactacaacaacaagaatcaatga

SEQ ID NO: 128 - protein, 265 aa, Arabidopsis thaliana
  G634  (conserved domain in aa coordinates: 62-147, 189-245)
MEQGGGGGGNEVVEEASPISSRPPANNLEELMRFSAAADDGGLGGGGGGGGGGSASSSSGNRWPREETLALLRIRSDMDSTFRDATLKAPLWEHVSRKLLELGYKRSSKKCKEKFENVQKYYKRTKETRGGRHDGKAYKFFSQLEALNTTPPPPPSHPHAHQPEQKQQQQPQQEMVMSSEQSSLPSSSRWPKAEILALINLRSGMEPRYQDNVPKGLLWEEISTSMKRMGYNRNAKRCKEKWENINKYYKKVKESNNSNYNNKNQ

SEQ ID NO: 129 - DNA, 993 bp, Arabidopsis thaliana
  G635
atggagatcatgcgtccaggggtctcagaaaacactttgaaaggaaaaataagaatcacaacgcggtgcatgtggcttgacaaaggaagacttttagatgcacttcacaaagcagctcatgctgctctatcaagttgtcctgtgacatgtcccttgtctcacatggaaagaacagtctccgaagtcctgaggaagattgtaaggaagtacagtggtaaaaggcctgaagtcatcgctatagccactgagaatccaatggctgtccgagctgatgaggtcagtgcgagactgtctggtgatccaagtgttggttctggagttgcagctttaaggaaagttgttgaaggaaatgacaaaagaagtcgggcgaagaaagcaccttcacaagaagcttcccccaaagaagtagatcgcactttggaagatgatatcattgatagtgcaagactactggctgaagaagaaactgcggcatcaacatacacggaagaagttgatacgcccgttgggagttcttcagaagagtcagacgatttttggaaatcattcatcaatccatcatcgtcaccttcaccgagtgaaacagaaaatatgaataaggtagctgatacggagcctaaagcagagggtaaggaaaacagcagagacgacgatgaattagctgatgcttcagattctgaaaccaagtcatcaccaaaacgtgtgaggaagaacaaatggaaaccggaggagataaagaaggtaatcagaatgcgaggagagctgcacagtagatttcaagtggtgaaaggtagaatggcattgtgggaagagatctcttcaaatctatcagctgaaggaatcaatcgaagcccgggacaatgcaaatctctctgggcatcacttattcagaaatacgaggagagcaaggctgatgagagaagcaagacgagttggccacattttgaggatatgaacaacattttgtcagagctaggcacacctgcgtcttaa

SEQ ID NO: 130 - protein, 330 aa, Arabidopsis thaliana
  G635  (conserved domain in AA coordinates: 239-323)
MEIMRPGVSENTLKGKIRITTRCMWLDKGRLLDALHKAAHAALSSCPVTCPLSHMERTVSEVLRKIVRKYSGKRPEVIAIATENPMAVRADEVSARLSGDPSVGSGVAALRKVVEGNDKRSRAKKAPSQEASPKEVDRTLEDDIIDSARLLAEEETAASTYTEEVDTPVGSSSEESDDFWKSFINPSSSPSPSETENMNKVADTEPKAEGKENSRDDDELADASDSETKSSPKRVRKNKWKPEEIKKVIRMRGELHSRFQVVKGRMALWEEISSNLSAEGINRSPGQCKSLWASLIQKYEESKADERSKTSWPHFEDMNNILSELGTPAS

SEQ ID NO: 131 - DNA, 1913 bp, Arabidopsis thaliana
  G636
cgatgatgcaactgggtggtggtactccgaccactacagcggcggctacaaccgtcacaactgctacagcaccaccgccacaatcaaacaacaacgattcagcggcaacagaagcagcggcagcagcggttggggcgtttgaggtgtcggaagagatgcacgaccgtgggtttggaggaaatcgttggccgcggcaggaaacgctagcgttgttgaaaatacgatctgacatgggaatagcgtttcgagacgctagcgttaaaggtcccttatgggaagaggtttctaggaaaatggcggagcatggttacataagaaacgcaaagaaatgcaaagagaaattcgagaacgtttacaaataccacaaacgaaccaaagaaggtcgtaccggaaaatccgaaggcaaaacttatcgcttctttgatcaattagaagctctcgagtctcaatctacaacctcactccaccatcatcaacaacaaacgcctcttcgaccacagcaaaacaacaacaacaacaacaacaacaacaacaacagctccatattttcaactcctcctccggtaacgacagttatgccgacgcttccttcttcatcaattcctccgtatactcagcagattaatgtaccttcgtttccaaacatctccggtgattttctatcggataattctacatcgtcttcgtcttcttattcgacttcttctgacatggagatgggtggtggaactgcgactacaaggaagaaaaggaagaggaaatggaaggtgtttttcgagcggttgatgaaacaagtagttgataaacaggaagagcttcaacgcacattcttggaagctgttgaaaagcgagaacacaagagattggttagagaagagtcttggagagttcaagagattgccagaatcaaccgcgagcacgagatcttagctcaagaacgctctatgtccgctgcaaaagacgctgctgttatggcctttcttcaaaaactgtcagagaaacaaccgaatcagccacaaccgcagcctcagccgcaacaagttcgaccatcaatgcagcttaataacaacaatcagcagcaaccgcctcaacggtctcctccaccgcaacctcctgctccgcttccgcagccaattcaagcggttgtgtcgacgttagacacaacgaaaacgcacaatcgtggtgatcagaatatgactcctgcagcttcagcgagctcgtcgcggtggccgaaagtggagatagaagcattgataaagctgaggacgaatcttgattcgaaatatcaagaaaacggaccaaaaggaccattgtgggaagagatatcagcgggaatgagaaggttaggattcaacaggaactcaaagagatgcaaagagaaatgggaaaacataaacaaatacttcaagaaagtcaaagagagcaacaagaaacgtcccgaagattccaagacttgcccttactttcaccagcttgatgctttatatagagagaggaacaaattccacagcaacaacaacattgcagcttcttcttcatcttccggtcttgttaaaccggataattctgttcccttgatggtccaaccagagcagcaatggcctccggctgtaacgactgcgacaactactcccgcagcggctcagcctgatcagcaatctcagccgtcggagcagaactttgatgatgaagaaggtacagatgaagagtacgacgatgaagatgaggaagaggagaatgaagaagaggaaggaggtgagttcgagcttgtgcctagcaataacaacaacaacaagacgacgaataatctgtaatgatgatgattcgagttcgaaccggtttggtggtgaaagattagtaatctttttttaagttttgatacagaacatgagaatttaaatattggagggttt

SEQ ID NO: 132 - protein, 602 aa, Arabidopsis thaliana
  G636  (conserved domain in AA coordinates: 55-145, 405-498)
MQLGGGTPTTTAAATTVTTATAPPPQSNNNDSAATEAAAAAVGAFEVSEEMHDRGFGGNRWPRQETLALLKIRSDMGIAFRDASVKGPLWEEVSRKMAEHGYIRNAKKCKEKFENVYKYHKRTKEGRTGKSEGKTYRFFDQLEALESQSTTSLHHHQQQTPLRPQQNNNNNNNNNNNSSIFSTPPPVTTVMPTLPSSSIPPYTQQINVPSFPNISGDFLSDNSTSSSSSYSTSSDMEMGGGTATTRKKRKRKWKVFFERLMKQVVDKQEELQRTFLEAVEKREHKRLVREESWRVQEIARINREHEILAQERSMSAAKDAAVMAFLQKLSEKQPNQPQPQPQPQQVRPSMQLNNNNQQQPPQRSPPPQPPAPLPQPIQAVVSTLDTTKTHNRGDQNMTPAASASSSRWPKVEIEALIKLRTNLDSKYQENGPKGPLWEEISAGMRRLGFNRNSKRCKEKWENINKYFKKVKESNKKRPEDSKTCPYFHQLDALYRERNKFHSNNNIAASSSSSGLVKPDNSVPLMVQPEQQWPPAVTTATTTPAAAQPDQQSQPSEQNFDDEEGTDEEYDDEDEEEENEEEEGGEFELVPSNNNNNKTTNNL

SEQ ID NO: 133 - DNA, 2136 bp, Arabidopsis thaliana
  G638
gaattaaaaggtttaacctttacctttttttcccttcactatcgataattgatcttctctttcggctgaatataaatctgaaaaaatggatcaagatcagcatcctcagtacggtataccggagctccggcagctcatgaaaggcggaggaaggacgactactacaacaccgtctacttcttctcattttccctctgatttcttcggttttaaccttgctccggtgcagccaccgccacaccgtcttcatcagttcactactgatcaagatatgggtttcttgccacgtggcatacatggattgggtggaggttcttcaacggctggaaataacagtaacttaaacgcgagtactagtggtggaggagttgggtttagtgggtttcttgacggtggtggtttcggcagcggagtaggaggagacggtggaggaactggaaggtggccgagacaagaaaccctaactctgttggaaattagatctcgtcttgatcataaattcaaagaagctaatcataaaggacctctttgggatgaagtttctaggattatgtccgaggaacatggataccaaaggagtgggaagaaatgcagagagaagtttgagaatctgtacaaatactatagtaagactaaagaaggcgaagccggaagacaagacggaaaacatcacagatttttccgccagctccaagcgctatacggggattctaataacttggtttcttgtcccaatcataacacgcagttcatgagcagtgctcttcatggtttccatactcaaaaccctatgaacgttgctacaacaacgtccaacatccataacgttgatagtgttcatggttttcatcaaagccttagtctttctaacaactacaactcctccgagcttgagctgatgacttcctcttcggaagggaatgattctagtagtagaaggaaaaagaggagttggaaagcgaagataaaggagttcattgatacgaacatgaaaaggttgatagagaggcaagatgtttggcttgagaagttgacaaaggttattgaagacaaagaggaacaacggatgatgaaagaagaggaatggaggaagattgaagctgcaaggattgataaagagcatttgttttgggctaaagagagggcgaggatggaagctagggatgttgcggtgattgaggcattgcaatacttgacaggaaagccattgataaagccgctgtgttcatccccggaagagaggacaaatggtaataatgagatccgaaacaatagtgagacacagaatgagaatggaagcgatcaaacgatgactaacaatgtttgtgttaaaggaagtagtagctgctggggtgagcaagagattttaaagcttatggagataagaacgagcatggactcgacctttcaagagatattaggagggtgctcggatgagtttctatgggaggaaatcgcagcgaagttgattcagttagggtttgatcagagaagtgccttattatgcaaggaaaagtgggaatggataagcaatggaatgaggaaagaaaagaagcaaatcaacaagaaaagaaaggataattcgtccagctgcggcgtgtactacccgagaaacgaagaaaatccaatctacaataatcgagaaagtggatataatgataatgatccgcatcaaatcaacgaacaaggcaatgtaggttcttcaacatcaaacgcaaacgcaaacgcaaacgtaaccactggaaatccgagcggtgcaatggctgctagtacaaactgcttcccgttcttcatgggagatggagatcagaatttgtgggagagttatggtttgaggctcagtaaagaagagaatcagtaagtaatttctcttaatgaagaagaagaaggtaatcatgtggttaactaattcttttgagttagctatatatgagataaaccttgacttagctattatatgtcacatgctgcttagaattaagaaatatttgttggggcttaacgaattatatatcagcatatataagatgagagtctaagaattatatcaaattaggctttaaccaacgtacgattatatattatgttttcatgtatttattctgtaagactttttaatatcaatctttctctaaa

SEQ ID NO: 134 - protein, 591 aa, Arabidopsis thaliana
  G638  (conserved domain in AA coordinates: 119-206)
MDQDQHPQYGIPELRQLMKGGGRTTTTTPSTSSHFPSDFFGFNLAPVQPPPHRLHQFTTDQDMGFLPRGIHGLGGGSSTAGNNSNLNASTSGGGVGFSGFLDGGGFGSGVGGDGGGTGRWPRQETLTLLEIRSRLDHKFKEANHKGPLWDEVSRIMSEEHGYQRSGKKCREKFENLYKYYSKTKEGEAGRQDGKHHRFFRQLQALYGDSNNLVSCPNHNTQFMSSALHGFHTQNPMNVATTTSNIHNVDSVHGFHQSLSLSNNYNSSELELMTSSSEGNDSSSRRKKRSWKAKIKEFIDTNMKRLIERQDVWLEKLTKVIEDKEEQRMMKEEEWRKIEAARIDKEHLFWAKERARMEARDVAVIEALQYLTGKPLIKPLCSSPEERTNGNNEIRNNSETQNENGSDQTMTNNVCVKGSSSCWGEQEILKLMEIRTSMDSTFQEILGGCSDEFLWEEIAAKLIQLGFDQRSALLCKEKWEWISNGMRKEKKQINKKRKDNSSSCGVYYPRNEENPIYNNRESGYNDNDPHQINEQGNVGSSTSNANANANVTTGNPSGAMAASTNCFPFFMGDGDQNLWESYGLRLSKEENQ

SEQ ID NO: 135 - DNA, 606 bp, Arabidopsis thaliana
  G652
atgagcggaggaggagacgtgaacatgagtggtggagacagacgcaagggaacggtgaagtggtttgatacacagaaggggtttggtttcatcacacctagcgacggtggtgacgatctcttcgttcaccagtcttccatcagatctgaaggatttcgtagcctcgcagctgaggaatctgttgagttcgacgttgaggttgacaactccggccgtcccaaggctattgaagtgtctggacccgacggtgctcccgttcagggtaacagcggtggtggtggttcatctggtggacgcggtggttttggcggcggtggtggaagaggagggggacgtggtggaggaagctacggaggaggttatggtggaagaggaagcggtggccgtggaggaggtggtggtgataattcttgctttaagtgcggtgaaccaggtcacatggcgagagaatgctctcaaggtggtggaggatacagcggaggcgggggtggtggaaggtacgggtctggcggcggcggaggaggaggtggtggtggcttaagctgctacagctgtggagagtctgggcactttgcaagggattgcactagcggtggtgctcgttga

SEQ ID NO: 136 - protein, 201 aa, Arabidopsis thaliana
  G652  (conserved domain in AA coordinates:28-49, 137-151, 182-196)
MSGGGDVNMSGGDRRKGTVKWFDTQKGFGFITPSDGGDDLFVHQSSIRSEGFRSLAAEESVEFDVEVDNSGRPKAIEVSGPDGAPVQGNSGGGGSSGGRGGFGGGGGRGGGRGGGSYGGGYGGRGSGGRGGGGGDNSCFKCGEPGHMARECSQGGGGYSGGGGGGRYGSGGGGGGGGGGLSCYSCGESGHFARDCTSGGAR

SEQ ID NO: 137 - DNA, 1033 bp, Arabidopsis thaliana
  G663
gtcgacccacgcgtccgtgggaagccacaataaccccctattcctcggccttttttaaaaaagttttagaataatccgataaaatacttttatattaatttttctttggtccatggagggttcgtccaaagggttgaggaaaggtgcatggactgctgaagaagatagtctcttgaggctatgtattgataagtatggagaaggcaaatggcatcaagttcctttgagagctgggctaaatcgatgcagaaagagttgtagactaagatggttgaactatttgaagccaagtatcaagagaggaagacttagcaatgatgaagttgatcttcttcttcgccttcataagcttctaggaaataggtggtccttgattgctggtcgattgcctggtcggaccgctaatgatgtcaaaaattactggaacacccatctgagtaaaaaacatgagtcttcgtgttgtaagtctaaaatgaaaaagaaaaacattatttcccctcctacaacaccggtccaaaaaatcggtgtttttaagcctcgacctcgatccttctctgttaacaatggttgcagccatctcaatggtctgccagaagttgatttaattccttcatgccttggactcaagaaaaataatgtttgtgaaaatagtatcacatgtaacaaagatgatgagaaagatgattttgtgaataatctaatgaatggagataatatgtggttggagaatttactgggggaaaaccaagaagctgatgcgattgttcctgaagcgacgacagctgaacatggggccactttggcgtttgacgttgagcaactttggagtctgtttgatggagagactgttgaacttgattagtgtttctcaccgtttgtttaagattgtgggtggcttttctttcgtattttagtaatgtatttttctgtatgaagtaaagaatttcagcattttaagaaaaatggttatgtttctacgtaataaaaaaaaacgttatttataaaaaaaaaaaaaaaaaaaaaaaaaaaaaaa

SEQ ID NO: 138 - protein, 249 aa, Arabidopsis thaliana
  G663  (conserved domain in AA coordinates: 9-111)
MEGSSKGLRKGAWTAEEDSLLRLCIDKYGEGKWHQVPLRAGLNRCRKSCRLRWLNYLKPSIKRGRLSNDEVDLLLRLHKLLGNRWSLIAGRLPGRTANDVKNYWNTHLSKKHESSCCKSKMKKKNIISPPTTPVQKIGVFKPRPRSFSVNNGCSHLNGLPEVDLIPSCLGLKKNNVCENSITCNKDDEKDDFVNNLMNGDNMWLENLLGENQEADAIVPEATTAEHGATLAFDVEQLWSLFDGETVELD

SEQ ID NO: 139 - DNA, 1087 bp, Arabidopsis thaliana
  G664
caatccctcaatataaaataacaagtagaattgatctgcctatatataagattttgagacgaaataagatctaaaccacaagaaagaaagtaaacataaaagtatgggaaggtcaccgtgctgtgagaaagctcacacaaacaaaggagcatggacgaaagaagaggacgagaggctcgtcgcctacattaaagctcatggagaaggctgctggagatctctccccaaagccgccggacttcttcgctgtggcaagagctgccgtctccggtggatcaactatctccggcctgaccttaagcgtggaaacttcaccgaggaagaagacgaactcatcatcaagctccatagccttcttggcaacaaatggtcgcttattgccgggagattaccgggaagaacagataacgagataaagaactattggaacacgcatatacgaagaaagcttataaacagagggattgatccaacgagtcatagaccaatccaagaatcatcagcttctcaagattctaaacctacacaactagaaccagttacgagtaataccattaatatctcattcacttctgctccaaaggtcgaaacgttccatgaaagtataagctttccgggaaaatcagagaaaatctcaatgcttacgttcaaagaagaaaaagatgagtgcccagttcaagaaaagttcccagatttgaatcttgagctcagaatcagtcttcctgatgatgttgatcgtcttcaagggcatggaaagtcaacaacgccacgttgtttcaagtgcagcttagggatgataaacggcatggagtgcagatgcggaagaatgagatgcgatgtagtcggaggtagcagcaaggggagtgacatgagcaatggatttgattttttagggttggcaaagaaagagaccacttctcttttgggctttcgaagcttggagatgaaataatattgtcaaattttaggcgtaactgtacaaaacttttgcctagataatttgaaagtatatcttcaacttgtatgagaaatttaactggtgaattataatatatagaatttgttttttaaaaaaaaaaaaaaaaaa

SEQ ID NO: 140 - protein, 282 aa, Arabidopsis thaliana
  G664  (conserved domain in AA coordinates: 13-116)
MGRSPCCEKAHTNKGAWTKEEDERLVAYIKAHGEGCWRSLPKAAGLLRCGKSCRLRWINYLRPDLKRGNFTEEEDELIIKLHSLLGNKWSLIAGRLPGRTDNEIKNYWNTHIRRKLINRGIDPTSHRPIQESSASQDSKPTQLEPVTSNTINISFTSAPKVETFHESISFPGKSEKISMLTFKEEKDECPVQEKFPDLNLELRISLPDDVDRLQGHGKSTTPRCFKCSLGMINGMECRCGRMRCDVVGGSSKGSDMSNGFDFLGLAKKETTSLLGFRSLEMK

SEQ ID NO: 141 - DNA, 786 bp, Arabidopsis thaliana
  G674
atggtgtttaaatcagaaaaatcaaaccgggaaatgaaatcaaaggagaagcaaaggaagggattatggtcacccgaggaagatgagaagcttaggagtcatgtcctcaaatatggccatggatgctggagtactattcctcttcaagctggattgcagaggaatgggaagagttgtagattaaggtgggttaattatttaagacctggacttaagaagtctttattcactaaacaagaggaaactatacttctttcacttcattccatgttgggtaacaaatggtctcagatatcgaaattcttaccaggaagaaccgacaacgagatcaaaaactattggcattctaatctaaagaagggtgtaactttgaaacaacatgaaaccacaaaaaaacatcaaacacctttaatcacaaactcacttgaggccttgcagagttcaactgaaagatcttcttcatctatcaatgtcggagaaacgtctaatgctcaaacctcaagcttttcgccaaatctcgtgttctcggaatggttagatcatagtttgcttatggatcagtcacctcaaaagtctagctatgttcaaaatcttgttttaccggaagagagaggattcattggaccatgtggccctcgttatttgggaaacgactctttgcctgatttcgtgccaaattcagaatttttgttggatgatgagatatcatctgagatcgagttctgtacttcattttcagacaactttttgttcgatggtctcatcaacgagctacgaccaatgtaa

SEQ ID NO: 142 - protein, 261 aa, Arabidopsis thaliana
  G674  (conserved domain in AA coordinates: 20-120)
MVFKSEKSNREMKSKEKQRKGLWSPEEDEKLRSHVLKYGHGCWSTIPLQAGLQRNGKSCRLRWVNYLRPGLKKSLFTKQEETILLSLHSMLGNKWSQISKFLPGRTDNEIKNYWHSNLKKGVTLKQHETTKKHQTPLITNSLEALQSSTERSSSSINVGETSNAQTSSFSPNLVFSEWLDHSLLMDQSPQKSSYVQNLVLPEERGFIGPCGPRYLGNDSLPDFVPNSEFLLDDEISSEIEFCTSFSDNFLFDGLINELRPM

SEQ ID NO: 143 - DNA, 612 bp, Arabidopsis thaliana
  G676
atgagaaagaaagtaagtagtagtggtgacgaaggaaacaatgagtacaagaaaggtttgtggacagtagaagaagacaaaatcctcatggattatgtcaaagctcatggcaaaggtcactggaatcgtattgccaaaaagactggtttaaagagatgtggaaagagttgtagattgaggtggatgaattatctcagccctaatgtgaaaagaggcaatttcaccgagcaagaagaggatcttatcattaggctccacaagttgcttggtaataggtggtctttaattgctaaaagagtgccgggtcgaacggataatcaagtgaagaactattggaacacgcatcttagtaagaaactcggaatcaaagatcagaaaaccaaacagagcaatggtgatattgtttatcaaatcaatctcccgaatcctaccgaaacatcagaagaaacgaaaatctcgaatattgtcgataacaataatatcctcggagatgaaattcaagaagatcatcaaggaagtaactacttgagttcactttgggttcatgaggatgagtttgagcttagcacactcaccaacatgatggactttatagatggacactgtttttga

SEQ ID NO: 144 - protein, 203 aa, Arabidopsis thaliana
  G676  (conserved domain in AA coordinates: 17-119)
MRKKVSSSGDEGNNEYKKGLWTVEEDKILMDYVKAHGKGHWNRIAKKTGLKRCGKSCRLRWMNYLSPNVKRGNFTEQEEDLIIRLHKLLGNRWSLIAKRVPGRTDNQVKNYWNTHLSKKLGIKDQKTKQSNGDIVYQINLPNPTETSEETKISNIVDNNNILGDEIQEDHQGSNYLSSLWVHEDEFELSTLTNMMDFIDGHCF

SEQ ID NO: 145 - DNA, 2526 bp, Arabidopsis thaliana
  G680
cagttatcttcttccttcttctctctgttttttaaatttatttttagagaattttttttgttttgcttccgatttgattatttccgggaacgatgacttctccggggagttcccggtgagatgataagtcagattgcatacttgtctcctccatggctactctcaagggttttggctgcggtggattcgtttggtttctctagaatctaaagaggttatcacaacggctttgcaatttgaaaactttcatgtttggggagatcaaagatggtttcttttttatactttacttgttagagaggatttgaagcagcgaatagctgcaaccggtcctgttatggatactaatacatctggagaagaattattagctaaggcaagaaagccatatacaataacaaagcagcgagagcgatggactgaggatgagcatgagaggtttctagaagccttgaggctttatggaagagcttggcaacgaattgaagaacatattgggacaaagactgctgttcagatcagaagtcatgcacaaaagttcttcacaaagttggagaaagaggctgaagttaaaggcatccctgtttgccaagctttggacatagaaattccgcctcctcgtcctaaacgaaaacccaatactccttatcctcgaaaacctgggaacaacggtacatcttcctctcaagtatcatcagcaaaagatgcaaaacttgtttcatcggcctcttcttcacagttgaatcaggcgttcttggatttggaaaaaatgccgttctctgagaaaacatcaactggaaaagaaaatcaagatgagaattgctcgggtgtttctactgtgaacaagtatcccttaccaacgaaacaggtaagtggcgacattgaaacaagtaagacctcaactgtggacaacgcggttcaagatgttcccaagaagaacaaagacaaagatggtaacgatggtactactgtgcacagcatgcaaaactacccttggcatttccacgcagatattgtgaacgggaatatagcaaaatgccctcaaaatcatccctcaggtatggtatctcaagacttcatgtttcatcctatgagagaagaaactcacgggcacgcaaatcttcaagctacaacagcatctgctactactacagcttctcatcaagcgtttccagcttgtcattcacaggatgattaccgttcgtttctccagatatcatctactttctccaatcttattatgtcaactctcctacagaatcctgcagctcatgctgcagctacattcgctgcttcggtctggccttatgcgagtgtcgggaattctggtgattcatcaaccccaatgagctcttctcctccaagtataactgccattgccgctgctacagtagctgctgcaactgcttggtgggcttctcatggacttcttcctgtatgcgctccagctccaataacatgtgttccattctcaactgttgcagttccaactccagcaatgactgaaatggataccgttgaaaatactcaaccgtttgagaaacaaaacacagctctgcaagatcaaaccttggcttcgaaatctccagcttcatcatctgatgattcagatgagactggagtaaccaagctaaatgccgactcaaaaaccaatgatgataaaattgaggaggttgttgttactgccgctgtgcatgactcaaacactgcccagaagaaaaatcttgtggaccgctcatcgtgtggctcaaatacaccttcagggagtgacgcagaaactgatgcattagataaaatggagaaagataaagaggatgtgaaggagacagatgagaatcagccagatgttattgagttaaataaccgtaagattaaaatgagagacaacaacagcaacaacaatgcaactactgattcgtggaaggaagtctccgaagagggtcgtatagcgtttcaggctctctttgcaagagaaagattgcctcaaagcttttcgcctcctcaagtggcagagaatgtgaatagaaaacaaagtgacacgtcaatgccattggctcctaatttcaaaagccaggattcttgtgctgcagaccaagaaggagtagtaatgatcggtgttggaacatgcaagagtcttaaaacgagacagacaggatttaagccatacaagagatgttcaatggaagtgaaagagagccaagttgggaacataaacaatcaaagtgatgaaaaagtctgcaaaaggcttcgattggaaggagaagcttctacatgacagacttggaggtaaaaaaaaaacatccacatttttatcaatatctttaaatctagtgttagtagtttgcttctccaatctttatgaaagagacttttaattttccttccgaacatttctttggtcatgtcaggttctgtaccatattaccccatgtcttgtctcttgtctctgtttgtgtatgctacttgtggtctatatgtcatctgctactactgttaattaaccattaagcaatggatttgtcttta

SEQ ID NO: 146 - protein, 645 aa, Arabidopsis thaliana
  G680  (conserved domain in AA coordinates: 24-70)
MDTNTSGEELLAKARKPYTITKQRERWTEDEHERFLEALRLYGRAWQRIEEHIGTKTAVQIRSHAQKFFTKLEKEAEVKGIPVCQALDIEIPPPRPKRKPNTPYPRKPGNNGTSSSQVSSAKDAKLVSSASSSQLNQAFLDLEKMPFSEKTSTGKENQDENCSGVSTVNKYPLPTKQVSGDIETSKTSTVDNAVQDVPKKNKDKDGNDGTTVHSMQNYPWHFHADIVNGNIAKCPQNHPSGMVSQDFMFHPMREETHGHANLQATTASATTTASHQAFPACHSQDDYRSFLQISSTFSNLIMSTLLQNPAAHAAATFAASVWPYASVGNSGDSSTPMSSSPPSITAIAAATVAAATAWWASHGLLPVCAPAPITCVPFSTVAVPTPAMTEMDTVENTQPFEKQNTALQDQTLASKSPASSSDDSDETGVTKLNADSKTNDDKIEEVVVTAAVHDSNTAQKKNLVDRSSCGSNTPSGSDAETDALDKMEKDKEDVKETDENQPDVIELNNRKIKMRDNNSNNNATTDSWKEVSEEGRIAFQALFARERLPQSFSPPQVAENVNRKQSDTSMPLAPNFKSQDSCAADQEGVVMIGVGTCKSLKTRQTGFKPYKRCSMEVKESQVGNINNQSDEKVCKRLRLEGEAST

SEQ ID NO: 147 - DNA, 228 bp, Arabidopsis thaliana
  G682
atggataaccatcgcaggactaagcaacccaagaccaactccatcgttacttcttcttctgaagaagtgagtagtcttgagtgggaagttgtgaacatgagtcaagaagaagaagatttggtctctcgaatgcataagcttgtcggtgacaggtgggaactgatagctgggaggatcccaggaagaaccgctggagaaattgagaggttttgggtcatgaaaaattga

SEQ ID NO: 148 - protein, 75 aa, Arabidopsis thaliana
  G682  (conserved domain in AA coordinates: 27-63)
MDNHRRTKQPKTNSIVTSSSEEVSSLEWEVVNMSQEEEDLVSRMHKLVGDRWELIAGRIPGRTAGEIERFWVMKN

SEQ ID NO: 149 - DNA, 705 bp, Arabidopsis thaliana
  G715
atggataccaacaaccagcaaccacctccctccgccgccggaatccctcctccaccacctggaaccaccatctccgccgcaggaggaggagcttcttaccaccaccttctccaacaacaacaacaacagctccaactattctggacctaccaacgccaagagatcgaacaagttaacgatttcaaaaaccatcagcttccactagctaggataaaaaagatcatgaaagccgatgaagatgttcgtatgatctccgcagaagcaccgattctcttcgcgaaagcttgtgagcttttcattctcgagctcacgatcagatcttggcttcacgctgaggagaataaacgtcgtacgcttcagaaaaacgatatcgctgctgcgattactaggactgatatcttcgatttccttgttgatattgttcctagagatgagattaaggacgaagccgcagtcctcggtggtggaatggtggtggctcctaccgcgagcggcgtgccttactattatccgccgatgggacaaccagctggtcctggagggatgatgattgggagaccagctatggatccgaatggtgtttatgtccagcctccgtctcaggcgtggcagagtgtttggcagacttcgacggggacgggagatgatgtctcttatggtagtggtggaagttccggtcaagggaatctcgacggccaagggtaa

SEQ ID NO: 150 - protein, 234 aa, Arabidopsis thaliana
  G715  (conserved domain in AA coordinates: 60-132)
MDTNNQQPPPSAAGIPPPPPGTTISAAGGGASYHHLLQQQQQQLQLFWTYQRQEIEQVNDFKNHQLPLARIKKIMKADEDVRMISAEAPILFAKACELFILELTIRSWLHAEENKRRTLQKNDIAAAITRTDIFDFLVDIVPRDEIKDEAAVLGGGMVVAPTASGVPYYYPPMGQPAGPGGMMIGRPAMDPNGVYVQPPSQAWQSVWQTSTGTGDDVSYGSGGSSGQGNLDGQG

SEQ ID NO: 151 - DNA, 2209 bp, Arabidopsis thaliana
  G720
ctttgaatgtgactcaggatagagagagggcgagacagataaagagagcttgaggaaggatttaagcagatctgcaagaaacactctctcagtgtttactttttttccgtagaatcaaaccggcggcgacagtgacggcggcgaaaagcggcggtgttggccgcaaaaacgatgcaaaaccagctatggtcattaccgctaacgatttatcaaaatgggaaaattttcctaaaggacttaaggttcttcttctcctcaacggctgtgacagcgacggagatggctcctcagccgccgagactcgatcagagctcgaatcaatggactatatcgttactacattcaccgatgaaactgaagcactctctgcggttgtcaagaacccggagagcttccacattgccatcgtcgaggtgaatatgagcgctgagagtgagagtttcaagtttcttgaggctgccaaagacgttcttcctactataatgatttcaaccgatcattgcatcactactacaatgaaatgcatagcgcttggtgcagttgagttcctacaaaaaccgctctcaccggagaaattaaagaacatttggcagcatgttgttcataaggcattcaatgatggtggaagtaatgtttcgatatcacttaagccagtgaaagaatccgttgtctcgatgcttcatcttgagaccgacatgacaatcgaggagaaagatccagcgccatcaacaccgcaattgaaacaagattcacggttactagacggtgattgccaagagaacataaatttctcgatggaaaatgtaaattcctcgaccgagaaagataacatggaagatcatcaagacatcggtgaatctaaatcagtcgacactacaaaccgcaaattagatgacgacaaagtggttgtcaaagaagagagaggagacagtgaaaaagaagaagaaggtgaaaccggagatctcataagcgagaagacagattcagttgatattcataagaaagaagatgagactaaaccgattaataaatcatccgggatcaagaacgtgtctggtaacaaaactagtcgaaagaaggtggattggacaccagagctgcacaagaagtttgtgcaagcagttgagcaactcggcgttgatcaagcgataccctcgcggattcttgagttgatgaaagtaggcaccttaacaagacacaatgtagctagtcaccttcagaaatttcggcagcataggaagaatattcttccaaaggatgatcataaccatagatggatacaatctagagagaaccatagaccaaatcaacgtaattataacgtttttcaacagcaacaccgtcccgtgatggcttatcccgtttggggtcttcccggtgtttatccgccaggagcgattccacctttgtggccaccgccgctgcagtccattggtcaaccacctccgtggcattggaaaccaccttatccaacggtgagcggtaatgcatggggttgtccggttggaccgcctgtgaccggatcatatattactccttcgaatactaccgccggcggatttcaatatcccaacggagctgaaaccggcttcaaaataatgccggcgagtcagccggacgaggaaatgttagatcaagtggttaaagaagcgataagcaaaccgtggctgccgctaccgctcgggctaaaaccgccgtccgcggagagcgttttggctgagctaacgcgtcaaggcatctcagccgtcccttcttcttcttgtctaatcaacggctctcatcgtctccgctgacgtgtccatgatgaaacagaacccgcagatatgatgacgtcatgcgtggcgtacttgtccgtgtctgacgatccgaagcgggaactgattcggatcctgagagttgttttttaattgttgtttttaattttttgttgtcataaaaacatttgtctctattggtattattaaagaagatcggacggtggagatagaggcaacgatgttagtctgaggaccacaagtggactctgcggctgtaagtagatctcggacacgggattttgacaagtcggaatctgacgtgtgtgcgtactcgcttttgtgggttgtcgagaatttaatagttgacactgttttaggtggatatgagatatgatgatgataataataaaaaggtacaactcaaagattccgtgatgaaaaaaaaaaaaaaa

SEQ ID NO: 152 - protein, 535 aa, Arabidopsis thaliana
  G720  (conserved domain in AA coordinates: 301-349)
MVITANDLSKWENFPKGLKVLLLLNGCDSDGDGSSAAETRSELESMDYIVTTFTDETEALSAVVKNPESFHIAIVEVNMSAESESFKFLEAAKDVLPTIMISTDHCITTTMKCIALGAVEFLQKPLSPEKLKNIWQHVVHKAFNDGGSNVSISLKPVKESVVSMLHLETDMTIEEKDPAPSTPQLKQDSRLLDGDCQENINFSMENVNSSTEKDNMEDHQDIGESKSVDTTNRKLDDDKVVVKEERGDSEKEEEGETGDLISEKTDSVDIHKKEDETKPINKSSGIKNVSGNKTSRKKVDWTPELHKKFVQAVEQLGVDQAIPSRILELMKVGTLTRHNVASHLQKFRQHRKNILPKDDHNHRWIQSRENHRPNQRNYNVFQQQHRPVMAYPVWGLPGVYPPGAIPPLWPPPLQSIGQPPPWHWKPPYPTVSGNAWGCPVGPPVTGSYITPSNTTAGGFQYPNGAETGFKIMPASQPDEEMLDQVVKEAISKPWLPLPLGLKPPSAESVLAELTRQGISAVPSSSCLINGSHRLR

SEQ ID NO: 153 - DNA, 513 bp, Arabidopsis thaliana
  G736
atggcgactcaagattctcaagggattaaactctttggcaaaactattgcatttaacactcgaacaataaaaaatgaagaagagacacacccgccggagcaagaagccacaatagccgttagatcatcatcatcatcggatctgacggccgagaagcgtccggataagatcatagcatgtccaagatgcaagagcatggagacaaagttctgttacttcaacaactacaacggtaatcagcctcgacacttttgtaaaggctgccaccgttactggaccgccggtggtgcactccggaacgttcccgtcggcgccggtcgtcggaagtccaaaccacctggtcgtgtcgtggttggtatgcttggagatggaaatggtgttcgccaagtcgagcttataaatggcttgctcgttgaggagtggcagcatgccgcagccgcagctcacggtagtttccggcatgattttcccatgaagcggctccggtgttactccgacggtcaatcgtgctga

SEQ ID NO: 154 - protein, 170 aa, Arabidopsis thaliana
  G736  (conserved domain in AA coordinates: 54-111)
MATQDSQGIKLFGKTIAFNTRTIKNEEETHPPEQEATIAVRSSSSSDLTAEKRPDKIIACPRCKSMETKFCYFNNYNGNQPRHFCKGCHRYWTAGGALRNVPVGAGRRKSKPPGRVVVGMLGDGNGVRQVELINGLLVEEWQHAAAAAHGSFRHDFPMKRLRCYSDGQSC

SEQ ID NO: 155 - DNA, 1707 bp, Arabidopsis thaliana
  G748
ccacgcgtccgcactctcccaaatctctcttctttaacaacaaaaaaaaaatcacagagacatagagagaagaagacggaacagaggctccaaaaaaatgatgatggagactagagatccagctattaagcttttcggtatgaaaatcccttttccgtcggtttttgaatcggcagttacggtggaggatgacgaagaagatgactggagcggcggagatgacaaatcaccagagaaggtaactccagagttatcagataagaacaacaacaactgtaacgacaacagttttaacaattcgaaacccgaaaccttggacaaagaggaagcgacatcaactgatcagatagagagtagtgacacgcctgaggataatcagcagacgacacctgatggtaaaaccctaaagaaaccgactaagattctaccgtgtccgagatgcaaaagcatggagaccaagttctgttattacaacaactacaacataaaccagcctcgtcatttctgcaaggcttgtcagagatattggactgctggagggactatgaggaatgttcctgtgggggcaggacgtcgtaagaacaaaagctcatcttctcattaccgtcacatcactatttccgaggctcttgaggctgcgaggcttgacccgggcttacaggcaaacacaagggtcttgagttttggtctcgaagctcagcagcagcacgttgctgctcccatgacacctgttatgaagctacaagaagatcaaaaggtctcaaacggtgctaggaacaggtttcacgggttagcggatcaacggcttgtagctcgggtagagaatggagatgattgctcaagcggatcctctgtgaccacctctaacaatcactcagtggatgaatcaagagcacaaagcggcagtgttgttgaagcacaaatgaacaacaacaacaacaataacatgaatggttatgcttgcatcccaggtgttccatggccttacacgtggaatccagcgatgcctccaccaggtttttacccgcctccagggtatccaatgccgttttacccttactggaccatcccaatgctaccaccgcatcaatcctcatcgcctataagccaaaagtgttcaaatacaaactctccgactctcggaaagcatccgagagatgaaggatcatcgaaaaaggacaatgagacagagcgaaaacagaaggccgggtgcgttctggtcccgaaaacgttgagaatagatgatcctaacgaagcagcaaagagctcgatatggacaacattgggaatcaagaacgaggcgatgtgcaaagccggtggtatgttcaaagggtttgatcataagacaaagatgtataacaacgacaaagctgagaactcccctgttctttctgctaaccctgctgctctatcaagatcacacaatttccatgaacagatttagagttacatatgtatatgtatatatgtatgattgattgtatgtatagatgatactggagaatgatgagtttttgagaatcaaactcttttcttctttctagtgattgcctttattcctttacatgttttggttctctgtacactatttgatttaccttttttactttctttcttcatttgtcaggaaatgttggaagataacattaatggtaaaaagttggtgtggaccgttgttgcgttggcatttcaaaaaaaaaaaaaaaa

SEQ ID NO: 156 - protein, 448 aa, Arabidopsis thaliana
  G748  (conserved domain in AA coordinates: 112-140)
MMMETRDPAIKLFGMKIPFPSVFESAVTVEDDEEDDWSGGDDKSPEKVTPELSDKNNNNCNDNSFNNSKPETLDKEEATSTDQIESSDTPEDNQQTTPDGKTLKKPTKILPCPRCKSMETKFCYYNNYNINQPRHFCKACQRYWTAGGTMRNVPVGAGRRKNKSSSSHYRHITISEALEAARLDPGLQANTRVLSFGLEAQQQHVAAPMTPVMKLQEDQKVSNGARNRFHGLADQRLVARVENGDDCSSGSSVTTSNNHSVDESRAQSGSVVEAQMNNNNNNNMNGYACIPGVPWPYTWNPAMPPPGFYPPPGYPMPFYPYWTIPMLPPHQSSSPISQKCSNTNSPTLGKHPRDEGSSKKDNETERKQKAGCVLVPKTLRIDDPNEAAKSSIWTTLGIKNEAMCKAGGMFKGFDHKTKMYNNDKAENSPVLSANPAALSRSHNFHEQI

SEQ ID NO: 157 - DNA, 766 bp, Arabidopsis thaliana
  G779
gacatgcatgtaagcattcggttaattaatcgagtcaaagatatatatcagtaaatacatatgtgtatatttctggaaaaagaatatatatattgagaaataagaaaagatgaaaatggaaaatggtatgtataaaaagaaaggagtgtgcgactcttgtgtctcgtccaaaagcagatccaaccacagccccaaaagaagcatgatggagcctcagcctcaccatctcctcatggattggaacaaagctaatgatcttctcacacaagaacacgcagcttttctcaatgatcctcaccatctcatgttagatccacctcccgaaaccctaattcacttggacgaagacgaagagtacgatgaagacatggatgcgatgaaggagatgcagtacatgatcgccgtcatgcagcccgtagacatcgaccctgccacggtccctaagccgaaccgccgtaacgtaaggataagcgacgatcctcagacggtggttgctcgtcggcgtcgggaaaggatcagcgagaagatccgaattctcaagaggatcgtgcctggtggtgcgaagatggacacagcttccatgctcgacgaagccatacgttacaccaagttcttgaaacggcaggtgaggattcttcagcctcactctcagattggagctcctatggctaacccctcttacctttgttattaccacaactcccaaccctgatgaactacacagaagctcgctagctagacatttggtgtcatcctctcaaccttt

SEQ ID NO: 158 - protein, 200 aa, Arabidopsis thaliana
  G779  (conserved domain in AA coordinates: 126-182)
MKMENGMYKKKGVCDSCVSSKSRSNHSPKRSMMEPQPHHLLMDWNKANDLLTQEHAAFLNDPHHLMLDPPPETLIHLDEDEEYDEDMDAMKEMQYMIAVMQPVDIDPATVPKPNRRNVRISDDPQTVVARRRRERISEKIRILKRIVPGGAKMDTASMLDEAIRYTKFLKRQVRILQPHSQIGAPMANPSYLCYYHNSQP

SEQ ID NO: 159 - DNA, 1913 bp, Arabidopsis thaliana
  G789
ggcaagaagaaccttagcctctctttcttctttctctctctctctctctgtggtactgttctgtttcaactttactccctcagtttcagaacaattccctatctagaagagagataaaaccgagaaggttttggagatagaatcttttgttcttcttttgtccctccttgctcgatttttgttacgtgtgaagcaataaaaaaaaactgatatagctaaatcttccatccattcagaggcttctaaatctgatctgacatggaacaagtgtttgctgattggaattttgaagataattttcacatgtccactaataaaagatcaatcagaccagaagatgaattagtggagctattgtggagagatggtcaagtggttttacaaagccaagctcgtagagaaccgtcagtccaagtccaaacccacaaacaagaaaccctaagaaaacccaacaatatttttcttgacaaccaagaaacagtacaaaagcctaactacgctgctctagatgatcaagaaaccgtctcctggatacaataccctccggatgacgtcatcgaccctttcgaatccgagttctcctctcatttcttctcttcgatcgatcacctcggaggtcctgagaagccacgaacgatcgaagagacagttaagcatgaggctcaagccatggctcctcctaagtttagatcctcggttataacagtcggaccgagtcattgcggcagcaaccagtcaacaaatattcatcaggccactacacttccggtttctatgagtgatagaagcaagaacgtcgaagaaagacttgacacttcgtcaggtggctcctccggttgcagctatggaaggaacaacaaagaaaccgttagtggaacaagtgtaaccattgaccgtaaaagaaaacatgttatggatgctgatcaagaatctgtgtctcaatcagatataggtttgacctcaaccgatgatcaaaccatgggtaacaaatcgagccaacggtcaggatctactcgaagaagccgtgcagctgaagttcataatctctcagaaaggaggaggagagatcggatcaatgaaagaatgaaagctcttcaagaactcatacctcactgcagcagaacagataaagcttcgatattggatgaagcaattgattacttaaaatcacttcaaatgcaactccaagtgatgtggatgggaagtggaatggcggcggcggcagcagcagcagcaagtccgatgatgtttcccggggtacaatcatctccatacattaatcagatggctatgcaaagtcagatgcaattgtctcaattcccggttatgaaccggtccgctccgcagaaccatcccggtttagtatgtcaaaacccggtacagttgcagctccaagcacagaaccaaatcttatcggagcagctcgctaggtacatgggcgggattccccagatgccgccggcgggaaatcagatgcagaccgtgcaacaacaaccagcggacatgttgggatttggatctccggcgggaccgcaaagtcaactgtcggcaccggcgaccaccgacagtcttcatatgggtaaaataggctgacttggcatatagttttcctccgaaattattcttcttacagttggtgattgttatttatttttggtcgcctaagcaagcataaaagctaagtcaaatgtattatagagatctaataagttagtctcatacttataacttatttttaaacagttgaattatagtatcaatcaagtgttgggaacctaaagatcatacatgtgtcaatacttttatatttgttctcaaggttcatcagaaaaacaaaataaaaaggatagactaggcctgcatttgacattatcatgggcttttttgggtctatgaatatgaacattaacccc

SEQ ID NO: 160 - protein, 444 aa, Arabidopsis thaliana
  G789  (conserved domain in AA coordinates: 253-313)
MEQVFADWNFEDNFHMSTNKRSIRPEDELVELLWRDGQVVLQSQARREPSVQVQTHKQETLRKPNNIFLDNQETVQKPNYAALDDQETVSWIQYPPDDVIDPFESEFSSHFFSSIDHLGGPEKPRTIEETVKHEAQAMAPPKFRSSVITVGPSHCGSNQSTNIHQATTLPVSMSDRSKNVEERLDTSSGGSSGCSYGRNNKETVSGTSVTIDRKRKHVMDADQESVSQSDIGLTSTDDQTMGNKSSQRSGSTRRSRAAEVHNLSERRRRDRINERMKALQELIPHCSRTDKASILDEAIDYLKSLQMQLQVMWMGSGMAAAAAAAASPMMFPGVQSSPYINQMAMQSQMQLSQFPVMNRSAPQNHPGLVCQNPVQLQLQAQNQILSEQLARYMGGIPQMPPAGNQMQTVQQQPADMLGFGSPAGPQSQLSAPATTDSLHMGKIG

SEQ ID NO: 161 - DNA, 1009 bp, Arabidopsis thaliana
  G801
gatagtgataacgaaatcctaattccatggccgacaacgacggagcagtgagtaacggcatcatagtcgagcagacgtcaaacaaaggacctcttaacgccgttaagaaaccaccgtctaaagatcgacacagcaaagttgacggaagaggaagaaggattcgtatgccaatcatttgcgcagctcgagtttttcaattgaccagagagttaggtcacaagtccgatggtcaaaccatagagtggcttctccgtcaagctgagccttctatcatagccgccactggaactggcactactccggcgagtttctccactgcttctctctccacttcttctccgtttactctcgggaaacgtgtcgtcagagcggaggaaggagaatccggcggcggaggaggaggagggttaacagtgggacacacaatggggacttcgttaatgggtggtggtggttctggtgggttttgggctgttccggcgaggccggatttcggacaagtctggagctttgcaaccggagctccaccggaaatggtttttgcgcagcagcagcaaccagctacactcttcgtccgccaccagcagcaacagcaagcttccgccgccgcagcagctgcaatgggtgaggcttcagcagctagagttgggaattatcttccgggtcatcatctcaatttgcttgcttctttgtctggtggagctaacgggtcgggtcggagggaagacgaccacgaaccacgttgagaaatggtattgtctttttggtaatgtatagaaaaattcctatgttttatgtcatcgaaagtgtttagaaagtacctctaatttgcggtttcttttgctccttttttacttaatttaagcttattgcttgtttgattagggttttagggtttaagaatatttggtctcgttaatttgtttcggagagtgatagaaagagagagagattgattgattgttgtacctaaaacgctataaaagctctgtttttactagcgaaaaaa

SEQ ID NO: 162 - protein, 239 aa, Arabidopsis thaliana
  G801  (conserved domain in AA coordinates: 32-93)
MADNDGAVSNGIIVEQTSNKGPLNAVKKPPSKDRHSKVDGRGRRIRMPIICAARVFQLTRELGHKSDGQTIEWLLRQAEPSIIAATGTGTTPASFSTASLSTSSPFTLGKRVVRAEEGESGGGGGGGLTVGHTMGTSLMGGGGSGGFWAVPARPDFGQVWSFATGAPPEMVFAQQQQPATLFVRHQQQQQASAAAAAAMGEASAARVGNYLPGHHLNLLASLSGGANGSGRREDDHEPR

SEQ ID NO: 163 - DNA, 2214 bp, Arabidopsis thaliana
  G849
aactcgagaattcttcatttcttttaaatcttagaatctcgagtttttgtataaatcgattctaatttttcctttgtacattgttttatatatacataaaacacacaaatcgggtatgggggaatttgggttttaagatagcgtgatctgtaataataagtggttcgcgatcgtgatcaagaaactggtggctgatagtgatatgcatatttgagagatggtgttcaagagaaagttagattgcctttccgtgggatttgattttcccaacattcccagagctcctcgttcatgcaggaggaaggttctaaacaagaggattgatcatgatgatgataacactcagatctgtgcaattgacttactagctttggctggaaagattctacaggaaagcgagagttcctctgcgtcttctaatgcatttgaagaaattaagcaagagaaagtagaaaattgcaagactattaaatctgagtcttctgaccaaggaaactctgtgtcaaagcctacttatgatatctctactgagaagtgtgtggtgaacagttgtttttcatttccggatagtgacggcgttttggagcggactccgatgtctgattacaagaagattcatggtttgatggatgtagggtgtgaaaacaagaatgtaaataatgggttcgagcaaggagaagcaaccgatcgcgtgggtgatggaggcttagtcactgatacttgcaacttagaggatgcaactgcgttaggtctgcagtttccgaaatcagtctgtgtgggtggtgatttaaaatcaccatccaccttggatatgacccctaatggttcctatgctagacatgggaaccatactaacctaggtagaaaagatgatgatgaaaaattctatagttaccataaacttagcaataaatttaagtcgtataggtctccaacaattcgaagaataagaaagtccatgtcgtccaaatactggaaacaagttccaaaagattttggatacagtagagctgatgtgggtgtgaagactctttatcgcaaaagaaaatcatgttatggttacaacgcatggcagcgtgagatcatttataagagaagaagatcacctgacagaagctcggtcgtaacttctgatggaggactcagtagtggaagtgtttccaagttacccaagaagggagatacagtaaagctaagcattaagtcctttaggattccagagctttttattgaagttccagaaactgcaacagtaggatcactaaagaggactgtgatggaggctgtcagtgttttactcagcggaggaatacgtgttggggtgttaatgcatgggaagaaggttagagatgaaaggaaaactctgtcccagactgggatctcatgtgatgaaaatctagacaaccttgggttcaccttggagcctagtcccagcaaagttcccctacctttgtgttctgaagatcctgctgtgccaaccgaccctacaagtttgtctgaacggtctgcggcgtctcctatgctagattctggaattccacatgcagatgacgtgattgattcaagaaatattgtggacagtaacctcgaattagttccatatcagggtgacatatctgttgatgaaccttcatcagattcaaaagagcttgtcccacttccagagttggaagtcaaggcgcttgccatagttccgttgaaccagaaacctaagcgtactgagctagcccagaggagaactaggagacccttctctgtgacagaggtagaagctcttgtacaagcagttgaggaactcgggactggaagatggcgtgatgtaaaattgcgtgctttcgaggatgcagatcatcggacttacgtggacttgaaggacaaatggaagacgctagttcacacagcaagtatatccccacagcaacgaagaggagagccggtgccacaagaactgctagacagagtcttgagggcatacgggtattggtcgcagcaccaaggaaaacatcaggcgagaggagcgtccaaagatccagacatgaacagaggtggagcttttgaatcaggtgtttcagtgtaaaaaaggaggtacgcattggtgggtgggtgtacagaagcaaacaacacaataaatggacaactcaatttctgcaaagtttaattgtctttatttctcgtttttttttttttttctcctacatacacttttttttttct

SEQ ID NO: 164 - protein, 619 aa, Arabidopsis thaliana
  G849  (conserved domain in AA coordinates: 324-413, 504-583)
MVFKRKLDCLSVGFDFPNIPRAPRSCRRKVLNKRIDHDDDNTQICAIDLLALAGKILQESESSSASSNAFEEIKQEKVENCKTIKSESSDQGNSVSKPTYDISTEKCVVNSCFSFPDSDGVLERTPMSDYKKIHGLMDVGCENKNVNNGFEQGEATDRVGDGGLVTDTCNLEDATALGLQFPKSVCVGGDLKSPSTLDMTPNGSYARHGNHTNLGRKDDDEKFYSYHKLSNKFKSYRSPTIRRIRKSMSSKYWKQVPKDFGYSRADVGVKTLYRKRKSCYGYNAWQREIIYKRRRSPDRSSVVTSDGGLSSGSVSKLPKKGDTVKLSIKSFRIPELFIEVPETATVGSLKRTVMEAVSVLLSGGIRVGVLMHGKKVRDERKTLSQTGISCDENLDNLGFTLEPSPSKVPLPLCSEDPAVPTDPTSLSERSAASPMLDSGIPHADDVIDSRNIVDSNLELVPYQGDISVDEPSSDSKELVPLPELEVKALAIVPLNQKPKRTELAQRRTRRPFSVTEVEALVQAVEELGTGRWRDVKLRAFEDADHRTYVDLKDKWKTLVHTASISPQQRRGEPVPQELLDRVLRAYGYWSQHQGKHQARGASKDPDMNRGGAFESGVSV

SEQ ID NO: 165 - DNA, 1036 bp, Arabidopsis thaliana
  G859
  misc_feature (1012)..(1012): n is a, c, g, or t
gatttgtcattttttgtctagccaaaaaaaaaaaaaaaaaaggagagagagagagagagagagagagagagaaacgaagaaaaaaaaagaagcaaaaaacattgtgggtctccggtgattaggatcaaattagggcaccagccttatcggaggaagaagccatgggtagaaaaaaagtcgagatcaagcgaatcgagaacaaaagtagtcgacaagtcactttctccaaacgacgcaatggtctcatcgagaaagctcgacaactttcaattctctgtgaatcttccatcgctgttctcgtcgtctccggctccggaaaactctacaagtctgcctccggtgacaacatgtcaaagatcattgatcgttacgaaatacatcatgctgatgaacttgaagccttagatcttgcagaaaaaactcggaattatctgccactcaaagagttactagaaatagtccaaagcaagcttgaagaatcaaatgtcgataatgcaagtgtggatactttaatttctctggaggaacagctcgagactgctctgtccgtaactagagctaggaagacagaactaatgatgggggaagtgaagtcccttcaaaaaacggagaacttgctgagagaagagaaccagactttggctagccaggtggggaagaagacgtttctggttatagaaggtgacagaggaatgtcatgggaaaatggctccggcaacaaagtacgggagactcttccgctgctcaagtaatcaccatcatcaacggctgagctttcaccttaaacttacagcctgattcagaagtttttacaaatttgtaaattataaaaagcttcataataatctcaacctttttatcttcctcgcgccaatgtggaaattaaggttaaaaataaaataaaacagaagctcatgcgaaagaattgtaaaactaagataaagctatagtagatctttattgtaccttcgtagacgatataagatttattcgtgtgtttgtcttcccctcnaaaaaaaaaaaaaaaaaaaaaaaa

SEQ ID NO: 166 - protein, 196 aa, Arabidopsis thaliana
  G859  (conserved domain in AA coordinates: 1-57)
MGRKKVEIKRIENKSSRQVTFSKRRNGLIEKARQLSILCESSIAVLVVSGSGKLYKSASGDNMSKIIDRYEIHHADELEALDLAEKTRNYLPLKELLEIVQSKLEESNVDNASVDTLISLEEQLETALSVTRARKTELMMGEVKSLQKTENLLREENQTLASQVGKKTFLVIEGDRGMSWENGSGNKVRETLPLLK

SEQ ID NO: 167 - DNA, 1747 bp, Arabidopsis thaliana
  G864
tgcaaaaacattttcttgtctctcctctgcccaaattttttttctttccaggaatatttcctagaaaaacccaagcaaagctttaaccccttcctcctccaaaagtagcatcttcctctttttctatttctcctttcctcttcttatctctctctcgtttgtgaacgattccttaagaatataaccaaaagcccttttctcctttcttcaactttccgggaaaaatcttcacgcagcaaggtttctctctcggctctcgcagtgtttttcgggccttttgttctttctataaaaaaaaaattcgcgtcctttaagaaaactttttccacctagagaagaagaagagtatcactcttgttgttcaagtttctctctttaataaaaaatccatctttattctttgtcttctttcctttttgctttccctaatctctatgttataaacacacagagagaaacaaagtcacagtctcgagtcaaaaacagagaatacgaaagaaaaatggaagcggagaagaaaatggttctaccgagaatcaaattcacagagcacaaaaccaacacgacaacaatcgtatcggagttaaccaacactcaccaaaccaggattcttcgtatctcagtcactgacccagacgctactgattcctccagtgacgacgaagaagaagaacatcaacgctttgtctctaaacgccgtcgtgttaagaagtttgtcaacgaagtctatctcgattccggtgctgttgttactggtagttgtggtcaaatggagtcgaagaagagacaaaagagagcggttaaatcggagtctactgtttctccggttgtttcagcgacgacgactacgacgggagagaagaagttccgaggagtgagacagcgtccatggggaaaatgggcggcggagataagagatccgttgaaacgtgtacggctctggttaggtacttacaacacggcggaagaagctgctatggtttacgataacgccgctattcagcttcgtggtcccgacgctctgactaatttctcagtcactccgacaacagcgacggagaagaaagccccaccaccgtctccggtgaagaagaagaagaagaaaaacaacaaaagcaaaaaatccgttactgcttcttcctccatcagcagaagcagcagcaacgattgtctctgctctccggtgtctgttctccgatctcctttcgccgtcgacgaattctccggcatttcttcatcaccagtcgcggccgttgtagtcaaggaagagccatccatgacaacggtatctgaaactttctctgatttctcggcgcccttgttctcagatgatgacgtgttcgatttccggagctcagtggttcccgactatctcggcggcgatttatttggggaagatctattcacggcggatatgtgtacggatatgaacttcggattcgatttcggatccggattatccagctggcacatggaggaccattttcaagatatcggggatctattcgggtcggatcctcttttagctgtttaataatattttaaataaataaatagttataccggccgttactaaacggaaccggagaaagttttgtataccggtgacataaaatctcggttatgttcgtaatctttttttctttgttatatataaaaatatgaatgaaactgaattaatgtaagttaatggtgataattattaacgttttaagttttgaaaaaaaaaaaaaaaaaaaaaaaaaaa

SEQ ID NO: 168 - protein, 343 aa, Arabidopsis thaliana
  G864  (conserved domain in AA coordinates: 119-186)
MEAEKKMVLPRIKFTEHKTNTTTIVSELTNTHQTRILRISVTDPDATDSSSDDEEEEHQRFVSKRRRVKKFVNEVYLDSGAVVTGSCGQMESKKRQKRAVKSESTVSPVVSATTTTTGEKKFRGVRQRPWGKWAAEIRDPLKRVRLWLGTYNTAEEAAMVYDNAAIQLRGPDALTNFSVTPTTATEKKAPPPSPVKKKKKKNNKSKKSVTASSSISRSSSNDCLCSPVSVLRSPFAVDEFSGISSSPVAAVVVKEEPSMTTVSETFSDFSAPLFSDDDVFDFRSSVVPDYLGGDLFGEDLFTADMCTDMNFGFDFGSGLSSWHMEDHFQDIGDLFGSDPLLAV

SEQ ID NO: 169 - DNA, 1281 bp, Arabidopsis thaliana
  G867
cacaacacaaacacatttctgttttctccattgtttcaaaccataaaaaaaaacacagattaaatggaatcgagtagcgttgatgagagtactacaagtacaggttccatctgtgaaaccccggcgataactccggcgaaaaagtcgtcggtaggtaacttatacaggatgggaagcggatcaagcgttgtgttagattcagagaacggcgtagaagctgaatctaggaagcttccgtcgtcaaaatacaaaggtgtggtgccacaaccaaacggaagatggggagctcagatttacgagaaacaccagcgcgtgtggctcgggacattcaacgaagaagacgaagccgctcgtgcctacgacgtcgcggttcacaggttccgtcgccgtgacgccgtcacaaatttcaaagacgtgaagatggacgaagacgaggtcgatttcttgaattctcattcgaaatctgagatcgttgatatgttgaggaaacatacttataacgaagagttagagcagagtaaacggcgtcgtaatggtaacggaaacatgactaggacgttgttaacgtcggggttgagtaatgatggtgtttctacgacggggtttagatcggcggaggcactgtttgagaaagcggtaacgccaagcgacgttgggaagctaaaccgtttggttataccgaaacatcacgcagagaaacattttccgttaccgtcaagtaacgtttccgtgaaaggagtgttgttgaactttgaggacgttaacgggaaagtgtggaggttccgttactcgtattggaacagtagtcagagttatgttttgactaaaggttggagcaggttcgttaaggagaagaatctacgtgctggtgacgtggttagtttcagtagatctaacggtcaggatcaacagttgtacattgggtggaagtcgagatccgggtcagatttagatgcgggtcgggttttgagattgttcggagttaacatttcaccggagagttcaagaaacgacgtcgtaggaaacaaaagagtgaacgatactgagatgttatcgttggtgtgtagcaagaagcaacgcatctttcacgcctcgtaacaactcttcttctttttttttcttttgttgttttaataatttttaaaaactccattttcgttttctttatttgcatcggtttctttcttcttgtttaccaaaggttcatgagttgtttttgttgtattgatgaactgtaaattttatttataggataaattttaaaaaaaaaaaaaaaaaaaa

SEQ ID NO: 170 - protein, 344 aa, Arabidopsis thaliana
  G867  (conserved domain in AA coordinates: 59-124)
MESSSVDESTTSTGSICETPAITPAKKSSVGNLYRMGSGSSVVLDSENGVEAESRKLPSSKYKGVVPQPNGRWGAQIYEKHQRVWLGTFNEEDEAARAYDVAVHRFRRRDAVTNFKDVKMDEDEVDFLNSHSKSEIVDMLRKHTYNEELEQSKRRRNGNGNMTRTLLTSGLSNDGVSTTGFRSAEALFEKAVTPSDVGKLNRLVIPKHHAEKHFPLPSSNVSVKGVLLNFEDVNGKVWRFRYSYWNSSQSYVLTKGWSRFVKEKNLRAGDVVSFSRSNGQDQQLYIGWKSRSGSDLDAGRVLRLFGVNISPESSRNDVVGNKRVNDTEMLSLVCSKKQRIFHAS

SEQ ID NO: 171 - DNA, 1571 bp, Arabidopsis thaliana
  G869
aggaacagtgaaaggttcggttttttgggtttcgatctgataatcaacaagaaaaaagggtttgatttatgtcggctgggtttgaatcgactgtgattttgtctttgattcatatctcttctccgatttcatcatcatcttccccatcatcgtcgtctttgaaatcttgtcttctcaacgctcttcacttctgctgtaataagcagaggcttgttctggagactccttctctttccatgcgcttaagacccaaaaggacttgttctagtgttgaagtctttgggggttttcacataaagcagcaaaagttttcttttttcatagttcgctgagagttttgagttttgataccaaaaaagttttgaccttttagagtgattttttgttctttctgttttctgggtatttttgaggagtgggtttaacaatggttgcgattagaaaggaacagtctttgagtggtgttagtagcgagattaagaagagagctaagagaaacactctatcgtcccttcctcaagaaacccaacctttgaggaaagtccgtattattgtgaatgatccttatgctactgatgattcctctagtgatgaggaagagcttaaggttcctaagccaaggaaaatgaaacgtatcgttcgtgagattaactttccttctatggaagtttctgaacagccttctgagagttcttctcaggacagtactaaaactgatggcaagatagctgtgtcagcttctcctgctgttcctaggaagaagcctgttggtgttaggcaaaggaaatgggggaaatgggctgctgagattagagatcctattaagaaaactaggacttggttgggtacttttgatactcttgaagaagctgctaaagcttatgatgctaagaagcttgagtttgatgctattgttgctggaaatgtgtccactactaaacgtgatgtttcttcatctgagactagccaatgctctcgttcttcacctgttgttcctgttgagcaagatgacacttctgcatcagctctcacttgtgtcaacaaccctgatgacgtctcgaccgttgctccaactgctccaactccaaatgttcctgctggtggaaacaaggaaacgttgttcgatttcgactttactaatctacagatccctgattttggtttcttggcagaggagcaacaagacctagacttcgattgtttcctcgcggatgatcagtttgatgatttcggcttgcttgatgacattcaaggattcgaagataacggtccaagtgcgttaccagatttcgactttgcggatgttgaagatcttcagctagctgactctagtttcggtttccttgatcaacttgctcctatcaacatctcttgcccattaaaaagttttgcagcttcataggatcttgcttagtaatgttaagtgagaagagtgttttgttttttcgtttatgctttagtaatttaagacatacaaaagtgtgtgttccggattgtagtaagatcttaagacataaagccgggttttgcaattaggaatcgagttttaatgaagttttagtttatgtttg

SEQ ID NO: 172 - protein, 324 aa, Arabidopsis thaliana
  G869  (conserved domain in AA coordinates: 109-177)
MVAIRKEQSLSGVSSEIKKRAKRNTLSSLPQETQPLRKVRIIVNDPYATDDSSSDEEELKVPKPRKMKRIVREINFPSMEVSEQPSESSSQDSTKTDGKIAVSASPAVPRKKPVGVRQRKWGKWAAEIRDPIKKTRTWLGTFDTLEEAAKAYDAKKLEFDAIVAGNVSTTKRDVSSSETSQCSRSSPVVPVEQDDTSASALTCVNNPDDVSTVAPTAPTPNVPAGGNKETLFDFDFTNLQIPDFGFLAEEQQDLDFDCFLADDQFDDFGLLDDIQGFEDNGPSALPDFDFADVEDLQLADSSFGFLDQLAPINISCPLKSFAAS

SEQ ID NO: 173 - DNA, 2603 bp, Arabidopsis thaliana
  G877
caaagattagactaatccgactgtgtttttaatcaatcatcattttatttaggggagagaagttgtaaagttttgatttttttttctgggttttttctgtgagacccagaagaagaacagagagaggaagaaggagaagaaaaaaatatctctttctctccggctttcaacaaaatctctcttttttccttcatcagtgttaaattcggatccgggtcgggtgggttttcggtttttggtgttcggatcagagcacagttggatgttagcgacggaactgaggatttcagtttgcggctgcggcggctgtgacggtgtttgtgtgtcgtcttcttttatcaatcaggagtttcatcacagtttgatcagagattcagccaaattcttggatactaaatggctggttttgatgaaaatgttgctgtgatgggagaatgggtgcctcgtagtcctagtcccgggacacttttctcctctgctattggagaagagaagagctcgaaacgtgttcttgaaagagagttatctttgaatcatggtcaagttattggtttagaagaagacactagtagtaatcataacaaggattcttcacaaagcaatgtttttcgaggtggtctcagtgaaagaattgctgcaagagctggatttaatgctccaaggttgaacactgagaatatccgcaccaacaccgacttttccattgactctaaccttcgatctccttgcttaaccatctcttctcctggccttagccctgcaacactcttggaatctcctgttttcctttctaacccattggctcaaccttctccaactaccgggaaatttccatttcttcctggtgttaatggtaatgcattgtcttctgagaaagcgaaagacgagttctttgatgatattggagcatcattcagcttccatcctgtttcaagatcatcttcctctttcttccaaggcacaacagagatgatgtcagttgattatggtaactacaacaatagatcttcttctcatcaatccgcagaagaagtaaaacctggctctgaaaacatagaaagctccaatctttatgggattgaaactgacaatcaaaacgggcagaacaagacatctgatgtcactacaaacaccagtcttgaaaccgtggatcatcaagaggaagaagaagagcaaagacgcggtgattcgatggctggtggtgcgcctgcagaggatggatataactggaggaaatacggacaaaagttggtcaaaggaagtgagtatccgcgaagctattacaagtgcacaaacccgaattgtcaggtgaagaagaaagttgagagatcaagggaaggtcacatcacagagattatatacaaaggagctcataatcatcttaaacctccacctaatcgccgctcagggatgcaagtagatggaactgaacaagttgaacaacaacaacaacagagagattctgctgcaacgtgggttagttgtaataacactcaacaacaaggtggaagcaatgagaacaatgtcgaagagggatctacgagattcgagtatggaaaccaatctggatcaattcaagctcaaaccggaggtcaatacgagtcaggtgatcctgtggttgtggttgatgcttcttcaacattctctaatgatgaagatgaagatgatcgagggacacatggaagtgtttctttgggttacgatggaggaggaggaggtgggggaggagaaggagatgaatcagagtcgaaaagaaggaaactagaagcttttgcagcagagatgagtggatcaacaagagccatacgtgagccaagagttgttgtgcagacaacgagtgatgttgacattcttgatgatggttatcgctggcgaaaatatggtcagaaagttgtcaaaggcaatccaaatccaaggagttattacaaatgcacagctccaggatgtacagtgaggaaacatgttgaaagagcttctcatgatctcaaatccgttataacaacttacgaaggcaaacataaccatgacgtccccgctgcacgcaacagcagccacggaggcggtggtgatagtggtaacggtaacagcggcggttcagccgcagtttctcaccattaccacaacggtcatcactcagagccgccacgtgggagattcgacagacaagtcacaactaacaatcagtctccttttagccgtccctttagctttcagccacatttgggtcctccttctggtttctccttcggtttaggacaaaccggtttggttaatctttcaatgcctggtttagcgtatggtcaagggaaaatgccgggtttgcctcacccgtatatgacacaaccggttgggatgagtgaagcaatgatgcagagagggatggaaccaaaggttgaaccggtttcagattcaggacaatcggtatataaccagatcatgagtagattacctcagatttgaaatttactcttcttcttcttcttctgcatttggtcactccttataataacttttaatttctgcttcttcttcttctttcatttattggtttcaaactttggggaaggtaaaggctgttttattgttaaaaaaaaaaaaaaaaa

SEQ ID NO: 174 - protein, 687 aa, Arabidopsis thaliana
  G877  (conserved domain in AA coordinates: 272-328, 487-603)
MAGFDENVAVMGEWVPRSPSPGTLFSSAIGEEKSSKRVLERELSLNHGQVIGLEEDTSSNHNKDSSQSNVFRGGLSERIAARAGFNAPRLNTENIRTNTDFSIDSNLRSPCLTISSPGLSPATLLESPVFLSNPLAQPSPTTGKFPFLPGVNGNALSSEKAKDEFFDDIGASFSFHPVSRSSSSFFQGTTEMMSVDYGNYNNRSSSHQSAEEVKPGSENIESSNLYGIETDNQNGQNKTSDVTTNTSLETVDHQEEEEEQRRGDSMAGGAPAEDGYNWRKYGQKLVKGSEYPRSYYKCTNPNCQVKKKVERSREGHITEIIYKGAHNHLKPPPNRRSGMQVDGTEQVEQQQQQRDSAATWVSCNNTQQQGGSNENNVEEGSTRFEYGNQSGSIQAQTGGQYESGDPVVVVDASSTFSNDEDEDDRGTHGSVSLGYDGGGGGGGGEGDESESKRRKLEAFAAEMSGSTRAIREPRVVVQTTSDVDILDDGYRWRKYGQKVVKGNPNPRSYYKCTAPGCTVRKHVERASHDLKSVITTYEGKHNHDVPAARNSSHGGGGDSGNGNSGGSAAVSHHYHNGHHSEPPRGRFDRQVTTNNQSPFSRPFSFQPHLGPPSGFSFGLGQTGLVNLSMPGLAYGQGKMPGLPHPYMTQPVGMSEAMMQRGMEPKVEPVSDSGQSVYNQIMSRLPQI

SEQ ID NO: 175 - DNA, 1152 bp, Arabidopsis thaliana
  G881
gtgaccgaagaaagcaaattgagactacgcaccaactagtcctttggtttgtatcttaagataaaggtttcttttatggacggttcttcgtttctcgacatctctctcgatctcaacaccaatcctttctccgcaaaacttccgaagaaggaggtctcagttttggcttctactcacttaaagaggaaatggttggagcaagacgagagcgcaagtgagttacgagaggagctaaacagagttaattcagagaacaagaagctaacagagatgttagctagagtctgtgagagctacaacgaactacataatcatttggagaagcttcagagtcgccagagccctgaaatcgagcagaccgatataccgataaagaaaagaaaacaagacccggatgagttcttaggctttcctattggactcagtagtggaaaaactgagaacagctccagcaacgaagatcatcatcatcatcatcagcaacatgagcagaaaaatcagcttctttcatgtaaaagaccagtcactgatagcttcaacaaagcaaaagtttcgactgtctacgtgcctactgaaacatcggacacaagcttgacagttaaagatggatttcaatggaggaaatacggacaaaaggttacaagagacaacccgtcacctagagcttactttagatgctcgtttgcaccgtcttgtccagtaaaaaagaaggtacaacgcagcgcagaggatccatctttacttgtagcgacatacgaagggacgcataaccacttgggtccaaatgcttctgaaggggatgctacaagccagggtgggtcaagcacagtgactttggatctggttaatggctgtcatagactagcgttggagaaaaacgaaagggataatacgatgcaagaggttctgattcaacaaatggcgtcatcgttaacaaaagattcgaaatttacagctgctcttgctgctgctatatctgggaggttaatggagcaatctagaacatgaacgtttttagtgaatgtattgtttttgtttgtttagaatgattcttcgttttcgaattgtgtctttcgattaggagataaaagatgtatataaatattataagtagatgaagaaatcgtataagtaaaaaaaaaaaaaaaaaaa

SEQ ID NO: 176 - protein, 310 aa, Arabidopsis thaliana
  G881  (conserved domain in AA coordinates: 176-233)
MDGSSFLDISLDLNTNPFSAKLPKKEVSVLASTHLKRKWLEQDESASELREELNRVNSENKKLTEMLARVCESYNELHNHLEKLQSRQSPEIEQTDIPIKKRKQDPDEFLGFPIGLSSGKTENSSSNEDHHHHHQQHEQKNQLLSCKRPVTDSFNKAKVSTVYVPTETSDTSLTVKDGFQWRKYGQKVTRDNPSPRAYFRCSFAPSCPVKKKVQRSAEDPSLLVATYEGTHNHLGPNASEGDATSQGGSSTVTLDLVNGCHRLALEKNERDNTMQEVLIQQMASSLTKDSKFTAALAAAISGRLMEQSRT

SEQ ID NO: 177 - DNA, 1137 bp, Arabidopsis thaliana
  G892
tataacaattccttccaacaatgtcattgagtcagccaataacacggaccgatagtgcacccaatggagcatttaggacttttggtctctactggtgctaccattgtgatcgtatggtcagaattgcatcctctaacccatcagagatcgcctgtcctcgatgtttgaggcaatttgtcgttgagattgaaacgagacaacggcctcggtttactttcaaccatgctactccgccttttgatgcttctcctgaggctcgtcttctcgaagctctctcgctcatgtttgagcctgcaaccataggtaggtttggtgcagacccatttcttagggcaagatccagaaacatcttggaacctgaatcaagaccccgaccgcaacatcgaagacgacacagccttgacaatgttaacaatggtggtttacctctaccaagaagaacatatgttattctccggcccaataatccgactagtccactcggaaacataattgcgccaccaaatcaagcaccaccacggcatgtgaactcacatgattactttactggagcatcaagcttagagcagctgattgaacaactaacacaagacgataggcctggaccaccacctgcgtcagaacccaccattaattccctaccatctgtgaaaataacaccacaacatctaactaacgacatgtcccaatgcacagtgtgcatggaagaattcattgttggtggggacgcaacggaattaccatgtaaacatatttaccataaagattgtatagtcccgtggcttaggcttaacaattcttgccctatctgccgccgtgacctgccacttgtcaacaccgttgctgaatctcgagaaaggagcaatcctattagacaagacatgcctgaaagaaggcgtccaaggtggatgcaactcggtaacatttggccatttagagcaagataccaaagggttagtccagaagaaacagcaaaccagaatcctcgagataacaggagctaactctgaatattccatgggaaataaaaatcgtgactatctatatgtatagactctatgagacattgtctatttgaatgtgcatgtatatctcagaaataaactcaagcgaaacatatttaacgactaaaaaaaa

SEQ ID NO: 178 - protein, 327 aa, Arabidopsis thaliana
  G892  (conserved domain in AA coordinates: 177-270)
MSLSQPITRTDSAPNGAFRTFGLYWCYHCDRMVRIASSNPSEIACPRCLRQFVVEIETRQRPRFTFNHATPPFDASPEARLLEALSLMFEPATIGRFGADPFLRARSRNILEPESRPRPQHRRRHSLDNVNNGGLPLPRRTYVILRPNNPTSPLGNIIAPPNQAPPRHVNSHDYFTGASSLEQLIEQLTQDDRPGPPPASEPTINSLPSVKITPQHLTNDMSQCTVCMEEFIVGGDATELPCKHIYHKDCIVPWLRLNNSCPICRRDLPLVNTVAESRERSNPIRQDMPERRRPRWMQLGNIWPFRARYQRVSPEETANQNPRDNRS

SEQ ID NO: 179 - DNA, 1276 bp, Arabidopsis thaliana
  G896
taatccgattcgtcttcatctgattccctcccttccgagaataataatgtacccgccacctccctcaagcatctacgctcctccgatgctggtgaattgctccggttgccggacgcctctccagctcccatccggcgcccgatctattcgctgcgctctctgccaggctgttactcatatcgccgaccctcgcaccgcccctcctccgcaaccttcctccgccccttctccgcctccccaaatccacgcgcctcccggtcagctgcctcacccccatggcaggaagagggccgtgatctgtggcatctcgtatcgtttctctcgccacgagctcaaaggctgcatcaacgacgccaagtgcatgcgtcaccttctcatcaacaaattcaaattctccccagattcaattctcatgcttaccgaggaagaaactgatccatatcgtatcccgaccaagcaaaacatgaggatggcattgtattggctcgtacagggatgcacagcaggcgactcacttgtcttccactactctggtcatggttcgcgtcaaagaaactacaacggtgatgaagttgatggctatgatgaaacactctgtcctctggattttgaaactcaggggatgattgtagacgatgagatcaacgcaaccattgtacgccctcttccacatggtgtcaagctccattcaattatcgatgcttgccatagtggtaccgttctggatttacccttcctatgcagaatgaacagagctgggcagtatgtgtgggaggatcatcggcctaggtcaggtttgtggaaaggaactgctggtggagaagccatttcaattagtggatgtgatgatgatcagacttcggccgacacatcagcgctgtcgaagatcacgtctacgggtgctatgactttctgttttattcaagcaattgaacgcagcgcacaaggcacaacctatggaagccttctgaattctatgcgcaccacaataaggaatacagggaatgatggtggtggtagtggtggagttgtgacgactgtgctgagcatgcttctgacagggggaagtgcgattgggggattaagacaggagcctcaactgactgcttgccaaacattcgatgtctatgcaaagcctttcactctctagtaaaggacaagtcactttttatgtatagcgagtgtgatttgagaatccgtccatataaccaccttttgtttcttatttttatttttctttcaaaagaataaaggaaaacattgatttggtgattcg

SEQ ID NO: 180 - protein, 367 aa, Arabidopsis thaliana
  G896  (conserved domain in AA coordinates: 18-39)
MYPPPPSSIYAPPMLVNCSGCRTPLQLPSGARSIRCALCQAVTHIADPRTAPPPQPSSAPSPPPQIHAPPGQLPHPHGRKRAVICGISYRFSRHELKGCINDAKCMRHLLINKFKFSPDSILMLTEEETDPYRIPTKQNMRMALYWLVQGCTAGDSLVFHYSGHGSRQRNYNGDEVDGYDETLCPLDFETQGMIVDDEINATIVRPLPHGVKLHSIIDACHSGTVLDLPFLCRMNRAGQYVWEDHRPRSGLWKGTAGGEAISISGCDDDQTSADTSALSKITSTGAMTFCFIQAIERSAQGTTYGSLLNSMRTTIRNTGNDGGGSGGVVTTVLSMLLTGGSAIGGLRQEPQLTACQTFDVYAKPFTL

SEQ ID NO: 181 - DNA, 1071 bp, Arabidopsis thaliana
  G910
atgttatgtataataataattgagaatatggaaagagtatgtgagttttgtaaagcgtatagagcagtggtttattgtatagctgatacagcaaatctttgtttaacatgtgatgcaaaggttcattcagctaattcactctcgggacggcatttacgtacggttttatgtgattctggtaagaatcagccttgtgttgtccgatgttttgaccataaaatgtttctttgccatggatgtaatgataagtttcatggtggtggctcttctgagcatcgtagaagggatttgaggtgttatacgggttgtcctcctgctaaagatttcgcggttatgtggggttttcgagttatggatgacgatgatgatgtttcgttagagcaatcttttcgaatggttaaacctaaggtgcaaagagaaggtggttttatcttggaacagattcttgaattggagaaggttcagctcagggaagagaatggtagttcttccttgacagaacgaggtgatccatctccattggagcttcctaagaaacccgaagaacagttaatcgatcttccgcagaccggaaaagagctggttgttgatttttcacacttgtcctcatcttccacacttggtgattccttttgggaatgcaaaagtccatacaataagaacaatcagttgtggcatcaaaatatacaagacattggagtatgtgaagatacaatctgcagtgacgatgacttccaaatacctgacattgatctcactttccggaactttgaagagcaatttggagctgatcctgagccaattgcagatagtaacaacgtgttctttgtttcttcccttgacaaatcacatgagatgaagacattttcttcttcattcaataatcccatatttgcacctaaaccagcttcatcaactatctcattctcaagcagtgaaaccgataacccttatagtcactcagaggaagtaatctcattttgtccctccctctctaacaatacacgtcaaaaggtcatcacaaggctcaaggagaagaagagagcaagagtggaggagaaaaaagcttaa

SEQ ID NO: 182 - protein, 356 aa, Arabidopsis thaliana
  G910  (conserved domain in AA coordinates:14-37, 77-103)
MLCIIIIENMERVCEFCKAYRAVVYCIADTANLCLTCDAKVHSANSLSGRHLRTVLCDSGKNQPCVVRCFDHKMFLCHGCNDKFHGGGSSEHRRRDLRCYTGCPPAKDFAVMWGFRVMDDDDDVSLEQSFRMVKPKVQREGGFILEQILELEKVQLREENGSSSLTERGDPSPLELPKKPEEQLIDLPQTGKELVVDFSHLSSSSTLGDSFWECKSPYNKNNQLWHQNIQDIGVCEDTICSDDDFQIPDIDLTFRNFEEQFGADPEPIADSNNVFFVSSLDKSHEMKTFSSSFNNPIFAPKPASSTISFSSSETDNPYSHSEEVISFCPSLSNNTRQKVITRLKEKKRARVEEKKA

SEQ ID NO: 183 - DNA, 480 bp, Arabidopsis thaliana
  G911
atgggtcttcctgaagatttcatcaccgagcttcagattccaggttacatattaaagatactttacgtcatcggtttctttagagacatggtcgatgctctttgtccttacattggtctacctagttttctagaccacaacgagacctctggacccgatccgacccgacacgctctctctacgtcagcgagtcttgctaacgagttgatcccggtggttcggttctcggatcttccgaccgatccggaagattgttgtacggtttgtttgtcagattttgagtccgacgataaggttaggcagctacccaagtgtggacacgtgtttcatcatcattgtttagaccgttggatcgttgactacaacaagatgaaatgtccggtttgtcggcaccggttcttaccgaaagaaaagtacacgcaatgtgattggggttctggttcagattggtttagtgatgaagtggaaagtaccaactaa

SEQ ID NO: 184 - protein, 159 aa, Arabidopsis thaliana
  G911  (conserved domain in AA coordinates: 86-129)
MGLPEDFITELQIPGYILKILYVIGFFRDMVDALCPYIGLPSFLDHNETSGPDPTRHALSTSASLANELIPVVRFSDLPTDPEDCCTVCLSDFESDDKVRQLPKCGHVFHHHCLDRWIVDYNKMKCPVCRHRFLPKEKYTQCDWGSGSDWFSDEVESTN

SEQ ID NO: 185 - DNA, 724 bp, Arabidopsis thaliana
  G912
catcttatccaaagaaaaaatgaatccattttactctacattcccagactcgtttctctcaatctccgatcatagatctccggtttcagacagtagtgagtgttcaccaaagttagcttcaagttgtccaaagaaacgagctgggaggaagaagtttcgtgagacacgtcatccgatttacagaggagttcgtcagaggaattctggtaaatgggtttgtgaagttagagagcctaataagaaatctaggatttggttaggtacttttccgacggttgaaatggctgctcgtgctcatgatgttgctgctttagctcttcgtggtcgctctgcttgtctcaatttcgctgattctgcttggcggcttcgtattcctgagactacttgtcctaaggagattcagaaagctgcgtctgaagctgcaatggcgtttcagaatgagactacgacggagggatctaaaactgcggcggaggcagaggaggcggcaggggagggggtgagggagggggagaggagggcggaggagcagaatggtggtgtgttttatatggatgatgaggcgcttttggggatgcccaacttttttgagaatatggcggaggggatgcttttgccgccgccggaagttggctggaatcataacgactttgacggagtgggtgacgtgtcactctggagttttgacgagtaattttttggctctttttctggataataagtt

SEQ ID NO: 186 - protein, 224 aa, Arabidopsis thaliana
  G912  (conserved domain in AA coordinates:51-118)
MNPFYSTFPDSFLSISDHRSPVSDSSECSPKLASSCPKKRAGRKKFRETRHPIYRGVRQRNSGKWVCEVREPNKKSRIWLGTFPTVEMAARAHDVAALALRGRSACLNFADSAWRLRIPETTCPKEIQKAASEAAMAFQNETTTEGSKTAAEAEEAAGEGVREGERRAEEQNGGVFYMDDEALLGMPNFFENMAEGMLLPPPEVGWNHNDFDGVGDVSLWSFDE

SEQ ID NO: 187 - DNA, 890 bp, Arabidopsis thaliana
  G913
cattcaaaaacatcatatatatacacaaacacactttgatacaacaaaaaaaaacagaacacaaacaaaaacacattgtaacattagtttaagcattaagcttctttatgtcgaataataataattctccgaccaccgtgaatcaagaaacgacgacgtctcgtgaagtctcaatcacattgcctactgatcaatctcctcaaacctcaccaggatcatcttcttctccttcaccgagaccttccggtggatcaccggcgagaagaacggcgactggattatccggcaagcactctattttcagggggattcgactacgtaacggaaaatgggtatcggagattagagagccacgtaaaacgacaagaatttggctcgggacttatccggtaccggagatggctgccgccgcttacgacgtggctgcgttagctttaaaaggacccgacgccgttttgaattttcctggtttagctttgacttacgtggctccggtttcaaactctgctgcggatataagagcggctgctagtagagcagcggagatgaagcaaccggatcagggtggggatgagaaggtattggaaccggttcaacccggcaaagaggaagaattagaagaagtgtcgtgtaactcgtgttcgttggagtttatggatgaggaagcgatgttgaatatgccgactttgttgacggagatggctgaagggatgttgatgagtccaccgagaatgatgatacatccgacgatggaagatgattcgccggagaatcatgaaggagataatctttggagttataaatgaatccattgaagctgctctcttttttattgttttccggtcgaatgagattttccccctttttttttttctttttgggtcgctgtt

SEQ ID NO: 188 - protein, 232 aa, Arabidopsis thaliana
  G913  (conserved domain in AA coordinates: 62-128)
MSNNNNSPTTVNQETTTSREVSITLPTDQSPQTSPGSSSSPSPRPSGGSPARRTATGLSGKHSIFRGIRLRNGKWVSEIREPRKTTRIWLGTYPVPEMAAAAYDVAALALKGPDAVLNFPGLALTYVAPVSNSAADIRAAASRAAEMKQPDQGGDEKVLEPVQPGKEEELEEVSCNSCSLEFMDEEAMLNMPTLLTEMAEGMLMSPPRMMIHPTMEDDSPENHEGDNLWSYK

SEQ ID NO: 189 - DNA, 1449 bp, Arabidopsis thaliana
  G922
atggtggctatgtttcaagaagataatggaacatcttctgtagcttcatcaccacttcaagtcttctcaactatgtcactcaacagaccgactctcctcgcttcttcatctccgtttcattgtctcaaagatctcaaaccagaggagcgtggtctctacttaatccacctcttgctaacttgtgccaaccacgtggcttcaggtagcctccaaaacgctaacgcagcgctcgagcagctctctcacctcgcttctcctgacggcgacacgatgcagcgaatcgctgcttacttcaccgaagcgcttgctaacagaatccttaagtcctggcctggtctttacaaggctcttaacgcaactcagacaagaactaacaatgtctctgaggagattcatgttagaagactcttctttgagatgttcccgatactcaaagtctcttacttgctcactaatcgagctatactcgaggctatggaaggagagaagatggttcatgtgattgatctcgatgcttctgagccagctcaatggcttgctttgcttcaagcttttaactctaggcctgaaggtccacctcatttgagaatcactggtgttcatcaccagaaggaagtgcttgaacaaatggctcatagactcattgaggaagcagagaaactcgatatcccgtttcagtttaatcccgttgtgagtaggttagactgtttaaatgtagaacagttgcgggttaaaacaggagaggccttagccgttagctcggttcttcaattgcataccttcttggcctctgatgatgatctcatgagaaagaactgcgctttacggtttcagaacaaccctagtggagttgacttgcagagagttctaatgatgagccatggctctgcagctgaggcacgtgagaatgatatgagtaacaacaatgggtatagccctagcggtgactcggcctcatctttgcctttaccaagttcaggaaggactgatagcttcctcaatgctatttggggtttgtctccaaaggtcatggtggtcactgagcaagactcagaccacaacggctccacactaatggagaggctattagaatcactttacacctacgcagcattgtttgattgcttggaaacaaaagttccaagaacgtctcaagataggatcaaagtggagaagatgctcttcggggaggagatcaagaacatcatatcctgcgagggatttgagagaagagaaagacacgagaagcttgagaaatggagccagaggatcgatttggctggttttgggaatgttcctcttagctattatgcgatgttgcaggctaggagattgcttcaagggtgcggttttgatgggtatagaatcaaggaagagagcgggtgcgcagtaatttgctggcaagatcgacctctatactcggtatcagcttggagatgcaggaagtga

SEQ ID NO: 190 - protein, 482 aa, Arabidopsis thaliana
  G922  (conserved domain in AA coordinates:225-242)
MVAMFQEDNGTSSVASSPLQVFSTMSLNRPTLLASSSPFHCLKDLKPEERGLYLIHLLLTCANHVASGSLQNANAALEQLSHLASPDGDTMQRIAAYFTEALANRILKSWPGLYKALNATQTRTNNVSEEIHVRRLFFEMFPILKVSYLLTNRAILEAMEGEKMVHVIDLDASEPAQWLALLQAFNSRPEGPPHLRITGVHHQKEVLEQMAHRLIEEAEKLDIPFQFNPVVSRLDCLNVEQLRVKTGEALAVSSVLQLHTFLASDDDLMRKNCALRFQNNPSGVDLQRVLMMSHGSAAEARENDMSNNNGYSPSGDSASSLPLPSSGRTDSFLNAIWGLSPKVMVVTEQDSDHNGSTLMERLLESLYTYAALFDCLETKVPRTSQDRIKVEKMLFGEEIKNIISCEGFERRERHEKLEKWSQRIDLAGFGNVPLSYYAMLQARRLLQGCGFDGYRIKEESGCAVICWQDRPLYSVSAWRCRK

SEQ ID NO: 191 - DNA, 1388 bp, Arabidopsis thaliana
  G926
ccaaaatctagggttttcttctcgcccaatttcacttttcttctacgaaattctccattcctgccggctgtcgggttttctgaatcgattctccttcaccaacttcttctctggttctgttcgattctgattttttttcaaggtcaattttttcttctctttaaactctgcaaaatcgtgatcgattaaattcacctcagggttttttgatttctgaaagaagttaatcttcttcgaaggcgattgcaaaagagtgctctgctgtgaatttccactgagatgcaatcaaaaccgggaagagaaaacgaagaggaagtcaataatcaccatgctgttcagcagccgatgatgtatgcagagccctggtggaaaaacaactcctttggtgttgtacctcaagcgagaccttctggaattccatcaaattcctcttctttggattgccccaatggttccgagtcaaacgatgttcattcagcatctgaagacggtgcgttgaatggtgaaaacgatggcacttggaaggattcacaagctgcaacttcctctcgttcagataatcacggaatggaaggaaatgacccagcgctctctatccgtaacatgcatgatcagccacttgtacaaccaccagagcttgttggacactatatcgcttgtgtcccaaacccatatcaggatccatattatgggggattgatgggagcatatggtcatcagcaattgggttttcgtccatatcttggaatgcctcgtgaaagaacagctctgccacttgacatggcacaagagcccgtttatgtgaatgcaaagcagtacgagggaattctaaggcgaagaaaagcacgtgccaaggcagagctagagaggaaagtcatccgggacagaaagccatatcttcacgagtcaagacacaagcatgcaatgagaagggcacgagcgagtggaggccggtttgcgaagaaaagtgaggtagaagcgggagaggatgcaggagggagagacagagaaaggggttcagcaaccaactcatcaggctctgaacaagttgagacagactctaatgagaccctgaattcttctggtgcaccataataaaaaaagccaaagctctgagaggagagagagacacacactttggctaatataatccattgcctcaaaccggcaaatcattcttggctttttcgtttttgtgtttgctagttgttcttgtcagagtctcatattgtgtgggtttaacagttatgatgaatgtacaaagagcgagttatgttaggtgttagattttggagacaagagacaaaggaatagcaagtaggtcttgtttttattctttgaccttttttttctcttttgcaaaattgaaaaatacgtttgcttaaaaa

SEQ ID NO: 192 - protein, 271 aa, Arabidopsis thaliana
  G926  (conserved domain in AA coordinates: 174-226)
MQSKPGRENEEEVNNHHAVQQPMMYAEPWWKNNSFGVVPQARPSGIPSNSSSLDCPNGSESNDVHSASEDGALNGENDGTWKDSQAATSSRSDNHGMEGNDPALSIRNMHDQPLVQPPELVGHYIACVPNPYQDPYYGGLMGAYGHQQLGFRPYLGMPRERTALPLDMAQEPVYVNAKQYEGILRRRKARAKAELERKVIRDRKPYLHESRHKHAMRRARASGGRFAKKSEVEAGEDAGGRDRERGSATNSSGSEQVETDSNETLNSSGAP

SEQ ID NO: 193 - DNA, 1200 bp, Arabidopsis thaliana
  G961
atgtcaaaatctatgagcatatcagtgaacggacaatctcaagtgcctcctgggtttaggtttcatccgaccgaggaagagctgttgcagtattatctccggaagaaagttaatagcatcgagatcgatcttgatgtcattcgcgacgttgatctcaacaagctcgagccttgggacattcaagagatgtgtaaaataggaacaacgccacaaaacgactggtatttctttagccacaaggacaaaaaatatccgacgggaacgagaactaacagagccactgcggctggattttggaaagcaactggccgcgacaagatcatatatagcaatggccgtagaattgggatgagaaagactcttgttttctacaaaggccgagctcctcacggccaaaaatctgattggatcatgcatgaatatagactcgatgacaacattatttcccccgaggatgtcaccgttcatgaggtcgtgagtattataggggaagcatcacaagacgaaggatgggtggtgtgtcgtattttcaagaagaagaatcttcacaaaaccctaaacagtcccgtcggaggagcttccctgagcggcggcggagatacgccgaagacgacatcatctcagatcttcaacgaggatactctcgaccaatttcttgaacttatggggagatcttgtaaagaagagctaaatcttgaccctttcatgaaactcccaaacctcgaaagccctaacagtcaggcaatcaacaactgccacgtaagctctcccgacactaatcataatatccacgtcagcaacgtggtcgacactagctttgttactagctgggcggctttagaccgcctcgtggcctcgcagcttaacggacccacatcatattcaattacagccgtcaatgagagccacgtgggccatgatcatctcgctttgccttccgtccgatctccgtaccccagcctaaaccggtccgcttcgtaccacgccggtttaacacaggaatatacaccggagatggagctatggaatacgacgacgtcgtctctatcgtcatcgcctggcccattttgtcacgtgtcgaatgttttgctgcttgtttgtctccttcgtctgcagcttcagttctggccgttccaaccatggcagaggcaggttcatttcgatctttcatcgcctcagatgcagatctctctccattga

SEQ ID NO: 194 - protein, 399 aa, Arabidopsis thaliana
  G961  (conserved domain in AA coordinates: 15-140)
MSKSMSISVNGQSQVPPGFRFHPTEEELLQYYLRKKVNSIEIDLDVIRDVDLNKLEPWDIQEMCKIGTTPQNDWYFFSHKDKKYPTGTRTNRATAAGFWKATGRDKIIYSNGRRIGMRKTLVFYKGRAPHGQKSDWIMHEYRLDDNIISPEDVTVHEVVSIIGEASQDEGWVVCRIFKKKNLHKTLNSPVGGASLSGGGDTPKTTSSQIFNEDTLDQFLELMGRSCKEELNLDPFMKLPNLESPNSQAINNCHVSSPDTNHNIHVSNVVDTSFVTSWAALDRLVASQLNGPTSYSITAVNESHVGHDHLALPSVRSPYPSLNRSASYHAGLTQEYTPEMELWNTTTSSLSSSPGPFCHVSNVLLLVCLLRLQLQFWPFQPWQRQVHFDLSSPQMQISLH

SEQ ID NO: 195 - DNA, 1303 bp, Arabidopsis thaliana
  G971
ttttttttcttccctcttttagaactctctctctctctcgtttttgacacttatcctctctcttttttctctctccctctctctctggccggaaaaaagaacaacgtcgtttatagctaaagattcgatcatgttggatcttaacctaaagatcttttcttcttataacgaagatcaagatcggaaagtaccattaatgatctcaaccaccggtgaagaagaatctaactcatcttcctcctccacaacagactctgcagcgagagatgctttcatcgcttttggaattctcaaacgcgacgatgaccttgttcctcctcctcctcctcctcctcataaagaaacaggagatctctttccggtggtggctgatgctcgtcggaatatagaattctccgtggaagacagtcactggttgaatctttcttctttacaaagaaatacacagaaaatggtgaagaagagcagaagaggaccaaggtctcgtagctcccaatatcgtggcgtcactttttaccgtcgcaccggtcgttgggaatctcatatttgggattgtggaaagcaagtttatttgggcgggtttgatactgcttacgcagcagcaagggcttacgaccgagctgctatcaaattccgtggtctcgatgcagacatcaatttcgtcgtggatgattataggcatgacatcgataagatgaagaatttaaataaggtggagttcgtgcaaacacttaggcgagagagtgcgagtttcggaagaggaagttccaaatacaaaggcttggctcttcaaaaatgcacccaattcaaaactcatgatcagattcatctcttccaaaacaggggatgggatgcagcagcaataaaatacaatgagttgggaaagggagaaggagccatgaagtttggtgcccatatcaaaggaaatggtcacaatgatcttgaactaagtctcggaatttcatcatcatcggaaagtataaagttgacaacaggcgattactataagggtatcaatcggtccacgatgggtttatacggtaagcaatcatcgatatttttacccatggcaaccatgaaacctctgaagacagttgcagcatcatcaggattcccttttatcagcatgacaagttcctcttcctccatgtccaattgttttgatccataggatcgttctacactctcttaactaatatatatttttactctatctgattattgtatacaaggataaaatttgattctttccttaatgagtgagaaatattggaagtgttaaaaaaaaaaaaaaaaaaaaaaa

SEQ ID NO: 196 - protein, 346 aa, Arabidopsis thaliana
  G971  (conserved domain in aa coordinates: 120-186)
MLDLNLKIFSSYNEDQDRKVPLMISTTGEEESNSSSSSTTDSAARDAFIAFGILKRDDDLVPPPPPPPHKETGDLFPVVADARRNIEFSVEDSHWLNLSSLQRNTQKMVKKSRRGPRSRSSQYRGVTFYRRTGRWESHIWDCGKQVYLGGFDTAYAAARAYDRAAIKFRGLDADINFVVDDYRHDIDKMKNLNKVEFVQTLRRESASFGRGSSKYKGLALQKCTQFKTHDQIHLFQNRGWDAAAIKYNELGKGEGAMKFGAHIKGNGHNDLELSLGISSSSESIKLTTGDYYKGINRSTMGLYGKQSSIFLPMATMKPLKTVAASSGFPFISMTSSSSSMSNCFDP

SEQ ID NO: 197 - DNA, 1430 bp, Arabidopsis thaliana
  G974
aaaaaaaaagttgatatactttctggttttctccttaacttttattctttacaaatccatcccccttagatctgtttatttcccgctactttgattcatttctgttagtaatctgtctttcgtatagaagaaaactgatttcttggtttgtattttcttaaagagatcaatctttttttatttttgatcttcttgtgtttttttttctttgtagaattaatcgtttgtgagggtatttttttaattccctcctctcagaaatctacacagaggttttttattttataaacctctttttcgattttcttgaaaacaaaaaatcctgttctttactttttttacaagaacaagggaaaaaaatttctttttattagaaatgacaacttctatggatttttacagtaacaaaacgtttcaacaatctgatccattcggtggtgaattaatggaagcgcttttaccttttatcaaaagcccttccaacgattcatccgcgtttgcgttctctctacccgctccaatttcatacgggtcggatctccactcattttctcaccatcttagtcctaaaccggtctcaatgaaacaaaccggtacttccgcggctaaaccgacgaagctatacagaggagtgagacaacgtcactggggaaaatgggtggctgagattcgtttaccgaggaatcgaactcgactttggctcggaacattcgacacggcggaggaagctgctttagcttatgacaaggcggcgtataagctccgaggagattttgcgcggcttaatttccctgatctccgtcataacgacgagtatcaacctcttcaatcatcagtcgacgctaagcttgaagctatttgtcaaaacttagctgagacgacgcagaaacaggtgagatcaacgaagaagtcttcttctcggaaacgttcatcaaccgtcgcagtgaaactaccggaggaggactactctagcgccggatcttcgccgctgttaacggagagttatggatctggtggatcttcttcgccgttgtcggagctgacgtttggtgatacggaggaggagattcagccgccgtggaacgagaacgcgttggagaagtatccgtcgtacgagatcgattgggattcgattcttcagtgttcgagtcttgtaaattagatgttgccataggggtattttagggactttagagctctctgcgatggagtttttggtcattgcagagattttattattattaagggggtttgttatgttaatatcaaataagtttatctactttgatgttaattagtgttaatctctgcgtcggtccaagctgtttttttttggcatgcttcgaccgtgtgagatttcttatgtaatttttgtagttccttgattttcttagttcaagttaaattggcacaaaaaaaaaaaaaaaaaa

SEQ ID NO: 198 - protein, 261 aa, Arabidopsis thaliana
  G974  (conserved domain in AA coordinates: 81-140)
MTTSMDFYSNKTFQQSDPFGGELMEALLPFIKSPSNDSSAFAFSLPAPISYGSDLHSFSHHLSPKPVSMKQTGTSAAKPTKLYRGVRQRHWGKWVAEIRLPRNRTRLWLGTFDTAEEAALAYDKAAYKLRGDFARLNFPDLRHNDEYQPLQSSVDAKLEAICQNLAETTQKQVRSTKKSSSRKRSSTVAVKLPEEDYSSAGSSPLLTESYGSGGSSSPLSELTFGDTEEEIQPPWNENALEKYPSYEIDWDSILQCSSLVN

SEQ ID NO: 199 - DNA, 768 bp, Arabidopsis thaliana
  G975
attactcatcatcaagttcctactttctctctgacaaacatcacagagtaagtaagaatggtacagacgaagaagttcagaggtgtcaggcaacgccattggggttcttgggtcgctgagattcgtcatcctctcttgaaacggaggatttggctagggacgttcgagaccgcagaggaggcagcaagagcatacgacgaggccgccgttttaatgagcggccgcaacgccaaaaccaactttcccctcaacaacaacaacaccggagaaacttccgagggcaaaaccgatatttcagcttcgtccacaatgtcatcctcaacatcatcttcatcgctctcttccatcctcagcgccaaactgaggaaatgctgcaagtctccttccccatccctcacctgcctccgtcttgacacagccagctcccatatcggcgtctggcagaaacgggccggttcaaagtctgactccagctgggtcatgacggtggagctaggtcccgcaagctcctcccaagagactactagtaaagcttcacaagacgctattcttgctccgaccactgaagttgaaattggtggcagcagagaagaagtattggatgaggaagaaaaggttgctttgcaaatgatagaggagcttctcaatacaaactaaatcttatttgcttatatatatgtacctattttcattgctgatttacagccaaaataatcaattataccgtgtattttatagatgttttatattaaaaggttgttagatata

SEQ ID NO: 200 - protein, 199 aa, Arabidopsis thaliana
  G975  (conserved domain in AA coordinates: 4-71)
MVQTKKFRGVRQRHWGSWVAEIRHPLLKRRIWLGTFETAEEAARAYDEAAVLMSGRNAKTNFPLNNNNTGETSEGKTDISASSTMSSSTSSSSLSSILSAKLRKCCKSPSPSLTCLRLDTASSHIGVWQKRAGSKSDSSWVMTVELGPASSSQETTSKASQDAILAPTTEVEIGGSREEVLDEEEKVALQMIEELLNTN

SEQ ID NO: 201 - DNA, 1530 bp, Arabidopsis thaliana
  G979
  misc_feature (1499)..(1500): n is a, c, g, or t
  misc_feature (1503)..(1503): n is a, c, g, or t
  misc_feature (1505)..(1505): n is a, c, g, or t
  misc_feature (1507)..(1507): n is a, c, g, or t
  misc_feature (1512)..(1512): n is a, c, g, or t
  misc_feature (1514)..(1514): n is a, c, g, or t
  misc_feature (1518)..(1518): n is a, c, g, or t
cctctgaggaatcaaatcactcacactccaaaaaaaaatctaaactttctcagagtttaatgaagaagcgcttaaccacttccacttgttcttcttctccatcttcctctgtttcttcttctactactacttcctctcctattcagtcggaggctccaaggcctaaacgagccaaaagggctaagaaatcttctccttctggtgataaatctcataacccgacaagccctgcttctacccgacgcagctctatctacagaggagtcactagacatagatggactgggagattcgaggctcatctttgggacaaaagctcttggaattcgattcagaacaagaaaggcaaacaagtttatctgggagcatatgacagtgaagaagcagcagcacatacgtacgatctggctgctctcaagtactggggacccgacaccatcttgaattttccggcagagacgtacacaaaggaattggaagaaatgcagagagtgacaaaggaagaatatttggcttctctccgccgccagagcagtggtttctccagaggcgtctctaaatatcgcggcgtcgctaggcatcaccacaacggaagatgggaggctcggatcggaagagtgtttgggaacaagtacttgtacctcggcacctataatacgcaggaggaagctgctgcagcatatgacatggctgcgattgagtatcgaggcgcaaacgcggttactaatttcgacattagtaattacattgaccggttaaagaagaaaggtgttttcccgttccctgtgaaccaagctaaccatcaagagggtattcttgttgaagccaaacaagaagttgaaacgagagaagcgaaggaagagcctagagaagaagtgaaacaacagtacgtggaagaaccaccgcaagaagaagaagagaaggaagaagagaaagcagagcaacaagaagcagagattgtaggatattcagaagaagcagcagtggtcaattgctgcatagactcttcaaccataatggaaatggatcgttgtggggacaacaatgagctggcttggaacttctgtatgatggatacagggttttctccgtttttgactgatcagaatctcgcgaatgagaatcccatagagtatccggagctattcaatgagttagcatttgaggacaacatcgacttcatgttcgatgatgggaagcacgagtgcttgaacttggaaaatctggattgttgcgtggtgggaagagagagcccaccctcttcttcttcaccattgtcttgcttatctactgactctgcttcatcaacaacaacaacaacaacctcggtttcttgtaactatttggtctgagagagagagctttgccttctagtttgaatttctatttcttccgcttcttcttcttttttttcttttgttgggttctgcttagggtttgtatttcagtttcagggcttgttcgttggttctgaataatcaatgtctttgccccttttnnaangntncaagntnaaanaaaaaaaaaaaa

SEQ ID NO: 202 - protein, 430 aa, Arabidopsis thaliana
  G979  (conserved domain in AA coordinates: 63-139,165-233)
MKKRLTTSTCSSSPSSSVSSSTTTSSPIQSEAPRPKRAKRAKKSSPSGDKSHNPTSPASTRRSSIYRGVTRHRWTGRFEAHLWDKSSWNSIQNKKGKQVYLGAYDSEEAAAHTYDLAALKYWGPDTILNFPAETYTKELEEMQRVTKEEYLASLRRQSSGFSRGVSKYRGVARHHHNGRWEARIGRVFGNKYLYLGTYNTQEEAAAAYDMAAIEYRGANAVTNFDISNYIDRLKKKGVFPFPVNQANHQEGILVEAKQEVETREAKEEPREEVKQQYVEEPPQEEEEKEEEKAEQQEAEIVGYSEEAAVVNCCIDSSTIMEMDRCGDNNELAWNFCMMDTGFSPFLTDQNLANENPIEYPELFNELAFEDNIDFMFDDGKHECLNLENLDCCVVGRESPPSSSSPLSCLSTDSASSTTTTTTSVSCNYLV

SEQ ID NO: 203 - DNA, 4011 bp, Arabidopsis thaliana
  G987
atgggttcttactcagctggcttccctggatccttggactggtttgattttcccggtttaggaaacggatcctatctaaatgatcaacctttgttagatattggatctgttcctcctcctctagacccatatcctcaacagaatcttgcttctgcggatgctgatttctctgattctgttttgaagtacataagccaagttcttatggaagaggacatggaagataagccttgtatgtttcatgatgctttatctcttcaagcagctgagaagtctctctatgaagctctcggcgagaagtacccggttgatgattctgatcagcctctgactactactactagccttgctcaattggttagtagtcctggtggttcttcttatgcttcaagcaccacaaccacttcctctgattcacaatggagttttgattgtttggagaataataggccttcttcttggttgcagacaccgatcccgagtaacttcatttttcagtctacatctactagagccagtagcggtaacgcggttttcgggtcaagttttagcggtgatttggtttctaatatgtttaatgatactgacttggcgttacaattcaagaaagggatggaggaagctagtaaattccttcctaagagctctcagttggttatagataactctgttcctaacagattaaccggaaagaagagccattggcgcgaagaagaacatttgactgaagaaagaagtaagaaacaatctgctatttatgttgatgaaactgatgagcttactgatatgtttgacaatattctgatatttggcgaggctaaggaacaacctgtatgcattcttaacgagagtttccctaaggaacctgcgaaagcttcaacgtttagtaagagtcctaaaggcgaaaaaccggaagctagtggtaacagttatacaaaagagacacctgatttgaggacaatgctggtttcttgtgctcaagctgtttcgattaacgatcgtagaactgctgacgagctgttaagtcggataaggcaacattcttcatcttacggcgatggaacagagagattggctcattattttgctaacagtcttgaagcacgtttggctgggataggtacacaggtttatactgccttgtcttccaagaaaacatctacttctgacatgttgaaagcttatcagacatatatatcagtctgtccgttcaagaaaatcgcaatcatattcgccaaccatagtattatgcggttggcttcaagtgctaatgccaaaaccatccacatcatagattttggaatatctgatggtttccagtggccttctctgattcatcgacttgcttggagacgtggttcatcttgtaagcttcggataaccggtatagagttgcctcaacgtggttttagaccagccgagggagttattgagactggtcgtcgcttggctaagtattgtcagaagttcaatattccgtttgagtacaatgcgattgcgcagaaatgggaatcaatcaagttggaggacttgaagctaaaagaaggcgagtttgttgcggtaaactctttatttcggtttaggaatcttctagatgagacggtggcagtgcatagcccgagagatacggttttgaagctgataaggaagataaagccagacgtgttcatccccgggatcctcagcggatcctacaacgcgcctttctttgtcacgaggtttagagaagttctgtttcattactcatctctgtttgacatgtgtgacacgaatctaacacgggaagatccaatgagggttatgtttgagaaagagttctatgggcgggagatcatgaacgtggtggcgtgtgaggggacggagagagtggagaggccagagagttataagcagtggcaggcgagggcgatgagagccgggtttagacagattccgctggagaaggaactagttcagaaactgaagttgatggtggaaagtggatacaaacccaaagagtttgatgttgatcaagattgtcactggttgcttcagggctggaaaggtagaattgtatacggttcatctatttgggttcctttctttttctatgtgggcagagcaactagggttttgatcatggatccaaacttctctgaatctctaaacggctttgagtattttgatggtaaccctaatttgcttactgatccaatggaagatcagtatccaccaccatctgatactctgttgaaatacgtgagtgagattcttatggaagagagtaatggagattataagcaatctatgttctatgattcattggctttacgaaaaactgaagaaatgttgcagcaagtcattactgattctcaaaatcagtcctttagtcctgctgattcattgattactaattcttgggatgcaagcggaagcatcgatgaatcggcttattcggctgatccgcaacctgtgaatgaaattatggttaagagtatgtttagtgatgcagaatcagctttacagtttaagaaaggggttgaagaagctagtaaattccttcccaatagtgatcaatgggttatcaatctggatatcgagagatccgaaaggcgcgattcggttaaagaagagatgggattggatcagttgagagttaagaagaatcatgaaagggattttgaggaagttaggagtagtaagcaatttgctagtaatgtagaagatagtaaggttacagatatgtttgataaggttttgcttcttgacggtgaatgcgatccgcaaacattgttagacagcgagattcaagcgattcggagtagtaagaacataggagagaaagggaagaagaagaagaagaagaagagtcaagtggttgattttcgtacacttctcactcattgtgcacaagccatttccacaggagataaaaccacggctcttgagtttctgttacagataaggcaacagtcttcgcctctcggtgacgcggggcaaagactagctcattgtttcgctaacgcgcttgaagctcgtctacagggaagtaccggtcctatgatccagacttattacaatgctttaacctcgtcgttgaaggatactgctgcggatacaattagagcgtatcgagtttatctttcttcgtctccgtttgttaccttgatgtatttcttctccatctggatgattcttgatgtggctaaagatgctcctgttcttcatatagttgattttgggattctatacgggtttcaatggccgatgtttattcagtctatatcagatcgaaaagatgtaccgcggaagctgcggattactggtatcgagcttcctcagtgcgggtttcggcccgcggagcgaatagaggagacaggacggagattggctgagtattgtaaacggtttaatgttccgtttgagtacaaagccattgcgtctcagaactgggaaacaatccggatagaagatctcgatatacgaccaaacgaagtcttagcggttaatgctggacttagactcaagaaccttcaagatgaaacaggaagcgaagagaattgcccgagagatgctgtcttgaagctaataagaaacatgaacccggacgttttcatccacgcgattgtcaacggttcattcaacgcacccttctttatctcgcggtttaaagaagcggtttaccattactccgctctcttcgacatgtttgattcgacgttgcctcgggataacaaagagaggattaggttcgagagggagttttacgggagagaggctatgaacgtgatagcgtgcgaggaagctgatcgagtggagaggcctgagacttacaggcaatggcaggttagaatggttagagccgggtttaagcagaaaacgattaagcctgagctggtagagttgtttagaggaaagctgaagaaatggcgttaccataaagactttgtggttgatgaaaatagtaaatggttgttacaaggctggaaaggtcgaactctctatgcttcttcttgttgggttcctgcctag

SEQ ID NO: 204 - protein, 1336 aa, Arabidopsis thaliana
  G987  (conserved domain in AA coordinates: 428-432,704-708)
MGSYSAGFPGSLDWFDFPGLGNGSYLNDQPLLDIGSVPPPLDPYPQQNLASADADFSDSVLKYISQVLMEEDMEDKPCMFHDALSLQAAEKSLYEALGEKYPVDDSDQPLTTTTSLAQLVSSPGGSSYASSTTTTSSDSQWSFDCLENNRPSSWLQTPIPSNFIFQSTSTRASSGNAVFGSSFSGDLVSNMFNDTDLALQFKKGMEEASKFLPKSSQLVIDNSVPNRLTGKKSHWREEEHLTEERSKKQSAIYVDETDELTDMFDNILIFGEAKEQPVCILNESFPKEPAKASTFSKSPKGEKPEASGNSYTKETPDLRTMLVSCAQAVSINDRRTADELLSRIRQHSSSYGDGTERLAHYFANSLEARLAGIGTQVYTALSSKKTSTSDMLKAYQTYISVCPFKKIAIIFANHSIMRLASSANAKTIHIIDFGISDGFQWPSLIHRLAWRRGSSCKLRITGIELPQRGFRPAEGVIETGRRLAKYCQKFNIPFEYNAIAQKWESIKLEDLKLKEGEFVAVNSLFRFRNLLDETVAVHSPRDTVLKLIRKIKPDVFIPGILSGSYNAPFFVTRFREVLFHYSSLFDMCDTNLTREDPMRVMFEKEFYGREIMNVVACEGTERVERPESYKQWQARAMRAGFRQIPLEKELVQKLKLMVESGYKPKEFDVDQDCHWLLQGWKGRIVYGSSIWVPFFFYVGRATRVLIMDPNFSESLNGFEYFDGNPNLLTDPMEDQYPPPSDTLLKYVSEILMEESNGDYKQSMFYDSLALRKTEEMLQQVITDSQNQSFSPADSLITNSWDASGSIDESAYSADPQPVNEIMVKSMFSDAESALQFKKGVEEASKFLPNSDQWVINLDIERSERRDSVKEEMGLDQLRVKKNHERDFEEVRSSKQFASNVEDSKVTDMFDKVLLLDGECDPQTLLDSEIQAIRSSKNIGEKGKKKKKKKSQVVDFRTLLTHCAQAISTGDKTTALEFLLQIRQQSSPLGDAGQRLAHCFANALEARLQGSTGPMIQTYYNALTSSLKDTAADTIRAYRVYLSSSPFVTLMYFFSIWMILDVAKDAPVLHIVDFGILYGFQWPMFIQSISDRKDVPRKLRITGIELPQCGFRPAERIEETGRRLAEYCKRFNVPFEYKAIASQNWETIRIEDLDIRPNEVLAVNAGLRLKNLQDETGSEENCPRDAVLKLIRNMNPDVFIHAIVNGSFNAPFFISRFKEAVYHYSALFDMFDSTLPRDNKERIRFEREFYGREAMNVIACEEADRVERPETYRQWQVRMVRAGFKQKTIKPELVELFRGKLKKWRYHKDFVVDENSKWLLQGWKGRTLYASSCWVPA

SEQ ID NO: 205 - DNA, 1338 bp, Arabidopsis thaliana
  G988
atgcttacttccttcaaatcctctagctcctcctccgaagatgccaccgctaccaccaccgagaatcctcctcctttgtgcatcgcctcctcctcggccgcaacctccgcctcacatcacctccgtcgtcttcttttcaccgctgcgaatttcgtctcccagtcaaacttcaccgccgctcaaaacttactctcaatcctctcccttaactcttctcctcacggcgactccaccgagcgacttgtacacctcttcactaaagccttgtccgtacgaatcaaccgtcagcaacaagatcagacggctgaaacggttgccacgtggacgacgaacgaaatgacgatgagtaactccacggtgttcacgagcagtgtatgcaaagaacagttcttgtttcgaaccaagaacaacaattctgacttcgagtcttgttactatctttggctaaaccaactaacgccgtttattcggttcggtcatttaacggcgaaccaagctatcctcgacgcgacggagacaaacgataacggagctctacatatacttgatttagatatatcacaaggacttcaatggcctccattgatgcaagccctagcagagaggtcatcaaaccctagcagtccacctccatctctccgcataaccggatgcggtcgagatgtaaccggattaaaccgaactggagaccggttaacccggttcgctgactctttaggtctccaattccagtttcacacgctagtgatcgtagaagaagatctcgccggacttttgctacagatccgattgttagctctctcagccgtacaaggagagaccattgccgtcaattgtgttcacttcctccacaaaatatttaacgacgatggagatatgatcggtcacttcttgtcagcgatcaagagcttaaactctagaatcgttacaatggcagagagagaagctaatcatggagatcactcgttcttgaatagattctctgaggcagtggatcattacatggcgatctttgattcgttggaagcgacgttgccgccaaatagccgagagagactaaccctagagcaacggtggttcggtaaggagattttggatgttgtggcggcggaagagacggagagaaagcaaagacatcggaggtttgagatttgggaagagatgatgaagaggtttggtttcgttaacgttcctattggaagctttgctttgtctcaagctaagcttcttcttagacttcattatccttcagaaggttataatcttcagttccttaacaattctttgtttcttggctggcaaaatcgtcccctcttctccgtttcgtcgtggaaatga

SEQ ID NO: 206 - protein, 445 aa, Arabidopsis thaliana
  G988  (conserved domain in AA coordinates:178-195)
MLTSFKSSSSSSEDATATTTENPPPLCIASSSAATSASHHLRRLLFTAANFVSQSNFTAAQNLLSILSLNSSPHGDSTERLVHLFTKALSVRINRQQQDQTAETVATWTTNEMTMSNSTVFTSSVCKEQFLFRTKNNNSDFESCYYLWLNQLTPFIRFGHLTANQAILDATETNDNGALHILDLDISQGLQWPPLMQALAERSSNPSSPPPSLRITGCGRDVTGLNRTGDRLTRFADSLGLQFQFHTLVIVEEDLAGLLLQIRLLALSAVQGETIAVNCVHFLHKIFNDDGDMIGHFLSAIKSLNSRIVTMAEREANHGDHSFLNRFSEAVDHYMAIFDSLEATLPPNSRERLTLEQRWFGKEILDVVAAEETERKQRHRRFEIWEEMMKRFGFVNVPIGSFALSQAKLLLRLHYPSEGYNLQFLNNSLFLGWQNRPLFSVSSWK

SEQ ID NO: 207 - DNA, 1057 bp, Arabidopsis thaliana
  G1040
ctttgatctccactatttaagtagacaagaatcataaagaaaatagtgagatgatgatgttagagtcaagaaacagtatgagagcttcaaactcagtcccagatctgtctcttcagatcagtcttcctaactatcacgccggaaaacctcttcacggcggtgaccggagctccacaagcagtgattctggaagcagcctcagtgacctgagccatgagaacaacttcttcaacaaacctctcttgagcttaggatttgaccatcatcatcaaaggcgctcaaacatgttccaacctcaaatctacggtcgagatttcaagagaagctcatcatcaatggttggtcttaaacgaagcattcgtgctccaagaatgagatggacttctactcttcatgctcacttcgtccatgctgttcaacttcttggcggccatgaaagagcaacgcctaaatcagtgttggagctcatgaatgtgaaggatctaaccctagctcatgtcaagagtcacttgcagatgtatagaacagtgaaatgcactgataaaggatcaccaggagaaggaaaggtagagaaagaggcagagcagaggatagaggacaataataataatgaagaagctgatgaaggaactgacacaaattcgccaaactcatcatctgtgcaaaagacccaaagagcttcatggtcatcgacaaaggaagtatctaggagcatatctacacaagcatattctcacttgggaacaactcatcacactaaggccaatgaagagaaagaggataccaacattcatctcaatttggatttcacattgggcggcctagttgggggatggaatatgcggaaccctccagtgatttaacccttctcaagtgctaattgccttaagctacaacaaataagtcagcttaggttaccagttttaacataattttaacttgttttgatcatatgagcttcggaagaatcatattatcatcatatatgaacttctttccaagaatgttctatgagttttttgatatgtataatcaagagaatcgtttgaagtaaaaa

SEQ ID NO: 208 - protein, 270 aa, Arabidopsis thaliana
  G1040  (conserved domain in AA coordinates: 109-158)
MMMLESRNSMRASNSVPDLSLQISLPNYHAGKPLHGGDRSSTSSDSGSSLSDLSHENNFFNKPLLSLGFDHHHQRRSNMFQPQIYGRDFKRSSSSMVGLKRSIRAPRMRWTSTLHAHFVHAVQLLGGHERATPKSVLELMNVKDLTLAHVKSHLQMYRTVKCTDKGSPGEGKVEKEAEQRIEDNNNNEEADEGTDTNSPNSSSVQKTQRASWSSTKEVSRSISTQAYSHLGTTHHTKANEEKEDTNIHLNLDFTLGGLVGGWNMRNPPVI

SEQ ID NO: 209 - DNA, 715 bp, Arabidopsis thaliana
  G1047
caattttaaaccggtcattatgatgtctactgtaccggcctttacctttactgaaccgggtttggttaaccaattatcggatttccagaccggattcactccttgggaattgaactgctccgatctcttctctacaatccatctcgaaccggtcgtaccgagtccttgttctggtgaatccgatgccggttctgtcaaaattaacaccgattttaacggttttgacgaatcgtgtatcggttccatcaaaactaactccggttctgatgattccaaccttttccacggcgtaccgagtcctcaatccgacgaattggactcaaaaaacacgaaaatccgaagtaacgccacgaatcataaccggaacaaattgaaccggtcggttttgcaggtgactgacgaccgtaaacgcaaacggatggaatcaaaccgagaatcagcgaagcggtcgaggatgcgtaaacaaagacacattgataatttaaaagacgaagcaaatcgtctcggtttagaaaaccgggaactcgcaaaccggcttcgaattgttttgtacaacatcgcattaatgtgtacggacaacaatcagcttttgtcggaacaagagattctcagacggagattcttggagatgaggcagattttgattttcagacagcttcagctgaatccatcattgatcatcaatcatcatcatatgatttgaaagaaaaaaaaa

SEQ ID NO: 210 - protein, 227 aa, Arabidopsis thaliana
  G1047  (conserved domain in AA coordinates: 129-180)
MMSTVPAFTFTEPGLVNQLSDFQTGFTPWELNCSDLFSTIHLEPVVPSPCSGESDAGSVKINTDFNGFDESCIGSIKTNSGSDDSNLFHGVPSPQSDELDSKNTKIRSNATNHNRNKLNRSVLQVTDDRKRKRMESNRESAKRSRMRKQRHIDNLKDEANRLGLENRELANRLRIVLYNIALMCTDNNQLLSEQEILRRRFLEMRQILIFRQLQLNPSLIINHHHMI

SEQ ID NO: 211 - DNA, 1291 bp, Arabidopsis thaliana
  G1051
cctgtaaattcagatttgctttctttggtaatcttttggatcaagatccatctattttttcttcaatggcacaactccctcctaaaatccccaacatgacacaacattggcctgatttctcttcccaaaagctctctcctttctctaccccaaccgcaaccgctgtcgccaccgctacaaccaccgtacaaaacccctcatgggtcgacgaattcctcgacttctcagcgtctcgccgtggcaaccaccgtcgttccatcagcgactctatcgcattcctcgaagctccaacagtcagcatcgaagaccaccaattcgacaggttcgatgacgaacagttcatgtcgatgttcaccgacgacgacaaccttcatagcaatccttcccatatcaacaacaaaaataacaatgtggggcccacgggatcttcctcgaacacatccacgccgtccaatagcttcaacgacgataacaaagaattaccaccgtccgatcataacatgaacaataatatcaacaacaactataacgatgaagtccaaagccaatgcaagatggagccagaagatggtacggcgtcgaataacaattccggtgatagctccggcaaccggattctcgatcccaaaagggttaagagaatattagcaaatcggcaatcagcacagagatcaagggtgaggaaactgcaatacatatcagagctcgaacgtagcgtcacttcgttgcaggcggaagtgtcagtgttatcgccaagagttgcattcttggatcatcaacgtttgcttcttaacgttgacaacagcgctctcaagcaacgaatcgctgctttatctcaagacaagcttttcaaagacgcacatcaagaagcattgaagagagaaatagagagacttcgacaagtgtataatcaacaaagcctcacgaatgtggaaaatgcaaatcatttatcggcgaccggagccggtgctactccggccgtcgacatcaagtcgtccgttgaaacagagcagctcctcaatgtctcataaattaaccatcatgcatcatcatcaacatttctctcttttagcttcttggcaaaagttcttgactataaaatctctttcgggtaagaaattcaggagatatacattttttattctaatcacattgtttttaagttgtgatgaattcagtttgatgtatcttatttattttgtttatgtcgtctttttttcttggggttgatggaagggaatcatcaattgttgtttgtacaaagaactagttgaatttttttttttttttt

SEQ ID NO: 212 - protein, 321 aa, Arabidopsis thaliana
  G1051  (conserved domain in AA coordinates: 189-250)
MAQLPPKIPNMTQHWPDFSSQKLSPFSTPTATAVATATTTVQNPSWVDEFLDFSASRRGNHRRSISDSIAFLEAPTVSIEDHQFDRFDDEQFMSMFTDDDNLHSNPSHINNKNNNVGPTGSSSNTSTPSNSFNDDNKELPPSDHNMNNNINNNYNDEVQSQCKMEPEDGTASNNNSGDSSGNRILDPKRVKRILANRQSAQRSRVRKLQYISELERSVTSLQAEVSVLSPRVAFLDHQRLLLNVDNSALKQRIAALSQDKLFKDAHQEALKREIERLRQVYNQQSLTNVENANHLSATGAGATPAVDIKSSVETEQLLNVS

SEQ ID NO: 213 - DNA, 1304 bp, Arabidopsis thaliana
  G1052
tgatcatctaaaactttcaatttctctcttgatcctcacttgaattttttgttgtttctctcaaatctttgatcctttcctttgtttttcatttgacctcttacaaaaaaatctggtgtgccattaaatctttattaatggcacaacttcctccgaaaatcccaaccatgacgacgccaaattggcctgacttctcctcccagaaactcccttccatagccgcaacggcggcagccgcagcaaccgctggacctcaacaacaaaacccttcatggatggatgagtttctcgacttctcagcgactcgccgtgggactcaccgtcgttctataagcgactccattgctttccttgaaccaccttcctccggcgtcggaaaccaccacttcgataggtttgacgacgagcaattcatgtccatgttcaacgacgacgtacacaacaataaccacaatcatcatcatcatcacagcatcaacggcaatgtgggtcccacgcgttcatcctccaacacctccacgccgtccgatcataatagccttagcgacgacgacaacaacaaagaagcaccaccgtccgatcatgatcatcacatggacaataatgtagccaatcaaaacaacgccgccggtaacaattacaacgaatcagacgaggtccaaagccagtgcaagacggagccacaagatggtccgtcggcgaatcaaaactccggtggaagctccggtaatcgtattcacgaccctaaaagggtaaaaagaattttagcaaataggcaatcagcacagagatcaagggtgaggaaattgcaatacatatcagagcttgaaaggagcgttacttcattgcagactgaagtgtcagtgttatcgccaagagttgcgtttttggatcatcagcgattgcttctcaacgtcgacaatagtgctatcaagcaacgaatcgcagctttagcacaagataagattttcaaagacgctcatcaagaagcattgaagagagaaatagagagacttcgacaagtatatcatcaacaaagcctcaagaagatggagaataatgtctccgatcaatctccggccgatatcaaaccgtccgttgagaaggaacagctcctcaatgtctaaagctgttcgttcactaagatctttcttttcatggcgaaaagattcttgactataaaacctctttgtgtcaagaaattaatttatcaaagaagatggccttttttatttgatctaatcacatttttttaagttgtgatgaatttgcttttgatgtatctgtttttttttttttttttt

SEQ ID NO: 214 - protein, 329 aa, Arabidopsis thaliana
  G1052  (conserved domain in AA coordinates: 201-261)
MAQLPPKIPTMTTPNWPDFSSQKLPSIAATAAAAATAGPQQQNPSWMDEFLDFSATRRGTHRRSISDSIAFLEPPSSGVGNHHFDRFDDEQFMSMFNDDVHNNNHNHHHHHSINGNVGPTRSSSNTSTPSDHNSLSDDDNNKEAPPSDHDHHMDNNVANQNNAAGNNYNESDEVQSQCKTEPQDGPSANQNSGGSSGNRIHDPKRVKRILANRQSAQRSRVRKLQYISELERSVTSLQTEVSVLSPRVAFLDHQRLLLNVDNSAIKQRIAALAQDKIFKDAHQEALKREIERLRQVYHQQSLKKMENNVSDQSPADIKPSVEKEQLLNV

SEQ ID NO: 215 - DNA, 2026 bp, Arabidopsis thaliana
  G1062
caaaaaaaaagtttcaatttttgaaagctctgagaaatgaaatctatcattctctctctctatctctatcttccttttcagatttcgcttcttcaattcatgaaatcctcgtgattctactttaatgcttctctttttttacttttccaagtctctgaatattcaaagtatatatcttttgttttcaaacttttgcagaattgtcttcaagcttccaaatttcagttaaaggtctcaactttgcagaattttcctctaaaggttcagactttggggtaaaggtgtcaactttggcgatgggtcttgacggaaacaatggtggaggggtttggttaaacggtggtggtggagaaagggaagagaacgaggaaggttcatggggaaggaatcaagaagatggttcttctcagtttaagcctatgcttgaaggtgattggtttagtagtaaccaaccacatccacaagatcttcagatgttacagaatcagccagatttcagatactttggtggttttccttttaaccctaatgataatcttcttcttcaacactctattgattcttcttcttcttgttctccttctcaagcttttagtcttgacccttctcagcaaaatcagttcttgtcaactaacaacaacaagggttgtcttctcaatgttccttcttctgcaaacccttttgataatgcttttgagtttggctctgaatctggttttcttaaccaaatccatgctcctatttcgatggggtttggttctttgacacaattggggaacagggatttgagttctgttcctgatttcttgtctgctcggtcacttcttgcgccggaaagcaacaacaacaacacaatgttgtgtggtggtttcacagctccgttggagttggaaggttttggtagtcctgctaatggtggttttgttgggaacagagcgaaagttctgaagcctttagaggtgttagcatcgtctggtgcacagcctactctgttccagaaacgtgcagctatgcgtcagagctctggaagcaaaatgggaaattcggagagttcgggaatgaggaggtttagtgatgatggagatatggatgagactgggattgaggtttctgggttgaactatgagtctgatgagataaatgagagcggtaaagcggctgagagtgttcagattggaggaggaggaaagggtaagaagaaaggtatgcctgctaagaatctgatggctgagaggagaaggaggaagaagcttaatgataggctttatatgcttagatcagttgtccccaagatcagcaaaatggatagagcatcaatacttggagatgcaattgattatctgaaggaacttctacaaaggatcaatgatcttcacaatgaacttgagtcaactcctcctggatctttgcctccaacttcatcaagcttccatccgttgacacctacaccgcaaactctttcttgtcgtgtcaaggaagagttgtgtccctcttctttaccaagtcctaaaggccagcaagctagagttgaggttagattaagggaaggaagagcagtgaacattcatatgttctgtggtcgtagaccgggtctgttgctcgctaccatgaaagctttggataatcttggattggatgttcagcaagctgtgatcagctgttttaatgggtttgccttggatgttttccgcgctgagcaatgccaagaaggacaagagatactgcctgatcaaatcaaagcagtgcttttcgatacagcagggtatgctggtatgatctgatctgatcctgacttcgagtccattaagcatctgttgaagcagagctagaagaactaagtccctttaaatctgcaattttcttctcaactttttttcttatgtcataacttcaatctaagcatgtaatgcaattgcaaatgagagttgtttttaaattaagcttttgagaacttgaggttgttgttgttggatacataacttcaaccttttattagcaatgttaacttccatttatgtttcatctt

SEQ ID NO: 216 - protein, 494 aa, Arabidopsis thaliana
  G1062  (conserved domain in AA coordinates: 308-359)
MGLDGNNGGGVWLNGGGGEREENEEGSWGRNQEDGSSQFKPMLEGDWFSSNQPHPQDLQMLQNQPDFRYFGGFPFNPNDNLLLQHSIDSSSSCSPSQAFSLDPSQQNQFLSTNNNKGCLLNVPSSANPFDNAFEFGSESGFLNQIHAPISMGFGSLTQLGNRDLSSVPDFLSARSLLAPESNNNNTMLCGGFTAPLELEGFGSPANGGFVGNRAKVLKPLEVLASSGAQPTLFQKRAAMRQSSGSKMGNSESSGMRRFSDDGDMDETGIEVSGLNYESDEINESGKAAESVQIGGGGKGKKKGMPAKNLMAERRRRKKLNDRLYMLRSVVPKISKMDRASILGDAIDYLKELLQRINDLHNELESTPPGSLPPTSSSFHPLTPTPQTLSCRVKEELCPSSLPSPKGQQARVEVRLREGRAVNIHMFCGRRPGLLLATMKALDNLGLDVQQAVISCFNGFALDVFRAEQCQEGQEILPDQIKAVLFDTAGYAGMI

SEQ ID NO: 217 - DNA, 1148 bp, Arabidopsis thaliana
  G1063
gttaaagaagatggatgggccacaagttgctatataaatccttccacttcttgttgtatactattgcttgagttctgattgggcacagtagtaccattgccatttctctcacacataccgtctctttctctcatcatcaatcatcaatcatccaaaagaaaaaaccctaaaatttcacttgtaagcttttcaccagtttctctccatacccattttatcagcttctccatatctttctctatggattctgacataatgaacatgatgatgcatcagatggagaagcttcctgagttttgtaaccctaattcctctttcttctctcccgaccacaacaacacttacccttttctctttaactccactcattaccagtccgatcactcaatgaccaacgaaccaggtttccgctacggttccggtttactcactaacccttcttctatctctcccaacacagcttactcttccgtttttcttgacaaaagaaacaacagtaacaacaacaataatggcacgaacatggcagctatgcgagagatgatcttccgtatcgccgtgatgcaaccgatccatatcgatcccgaggcggttaagccaccgaagaggaggaacgtcaggatctctaaagatcctcaaagcgtggcggctaggcatagaagggagagaataagcgagaggattcggattttgcaacggcttgttcctggtgggacgaagatggatacagcttcgatgctcgatgaagcaattcattatgtgaagtttttaaagaaacaggtgcagtctctggaggagcaggcggtggttactggcggagggggaggaggaggaggaagggttttgatcggtggaggtggaatgacggcggcgagtggtggtggtggcggcgggggagtggttatgaaagggtgtggaacagtggggactcatcagatggtgggcaatgcacagattcttagatgatgatgatttttaattttattattattatattaatgttggagaaaaagagaaaaatgattctggagagggaagccaagtaatttatgtgagagtctttaatttaactttattttcttgtttagataatgtgtaatgatggtttttaaagccaaagactctccatggttgttggagcgagtttg

SEQ ID NO: 218 - protein, 241 aa, Arabidopsis thaliana
  G1063  (conserved domain in aa coordinates: 131-182)
MDSDIMNMMMHQMEKLPEFCNPNSSFFSPDHNNTYPFLFNSTHYQSDHSMTNEPGFRYGSGLLTNPSSISPNTAYSSVFLDKRNNSNNNNNGTNMAAMREMIFRIAVMQPIHIDPEAVKPPKRRNVRISKDPQSVAARHRRERISERIRILQRLVPGGTKMDTASMLDEAIHYVKFLKKQVQSLEEQAVVTGGGGGGGGRVLIGGGGMTAASGGGGGGGVVMKGCGTVGTHQMVGNAQILR

SEQ ID NO: 219 - DNA, 1728 bp, Arabidopsis thaliana
  G1064
ctttattttttttcccctcttgtcgaaaacatcacatataaataaaaaaccaaaaaccctaatttataaaatatatataaaatagttatagctccccacttatatatgcaaaagccaacatcaagtatcttaaatgtcataatggacggtggagacagcgtcggaggaggaggaggagatgatcaccaccgtcacctccaccatcaccaccgccctactttcccttttcaactactcggaaaacacgaccccgacgacaaccatcaacaacaaccttccccttcctcctcctcctctctattttctctccatcaacaccaacaattatctcaatcgcaacctcaatcgcaatcgcaaaagtcacaaccgcagacaacgcaaaaagagttattacaaacgcaagaggaatctgcggtggtggcagctaaaaagccaccgttgaaacgagcgtcgacgaaagaccgacacacgaaagtagacggaagagggaggagaataaggatgccggcgttatgtgcagctagggtttttcagctaacgcgagagctaggtcataaatccgacggtgagacaatagagtggcttcttcaacaagctgaaccatctgtaatcgccgccaccggaaccggaacaatcccggcgaatttcacttctttaaacatctctctccgttcttcaggctcttccatgtctcttccttctcatttccgctccgccgcttccacttttagccctaataacatattttctccggcgatgcttcaacaacaacaacaacaacaacgtggtggtggtgttgggtttcatcatccccatctacagggacgtgcacctacgtcgtctttgtttcctggtattgataacttcacaccaacgacgtcgtttttgaactttcataatccaacaaagcaagaaggagatcaagattctgaagagttaaactcggagaagaaaagaagaatccaaacgacgtcggatttgcatcaacaacaacaacaacaccaacatgatcaaatcggaggatatacacttcaatctagcaacagtggatctacggccaccgcagccgccgcgcaacaaataccgggaaatttctggatggttgcggcggctgcggctgcaggtggtggtggtggtaataacaaccaaacaggtggtcttatgacagcttctattggtactggtggcggcggtggagagcctgtttggacgtttccttccattaacacggcagcggcagcgttatatagaagtggcgtttcgggcgttccaagcggcgcggtttctagcggtttacattttatgaatttcgcagcgccaatggcatttcttactggacaacaacagctagcaacaactagtaatcatgagattaatgaagatagtaataataatgaaggaggaagaagtgacggtggtggtgatcatcataatacacagagacatcatcatcatcaacaacaacatcatcataatattctctccggcttgaaccagtacggacggcaagtttccggcgactctcaagctagtggatcacttggaggtggtgatgaggaggatcagcaagattagacacacacaaaaacattttaatggtgggattttctgccgacggcggtagcggtgacggcgttcggcggctgtgtaaaacttttgttttcaccgttaattttttttattttctgtagtaattttttttgctaagtaaaaaaaaaaaaaaaaaaa

SEQ ID NO: 220 - protein, 489 aa, Arabidopsis thaliana
  G1064  (conserved domain in AA coordinates: 116-179)
MQKPTSSILNVIMDGGDSVGGGGGDDHHRHLHHHHRPTFPFQLLGKHDPDDNHQQQPSPSSSSSLFSLHQHQQLSQSQPQSQSQKSQPQTTQKELLQTQEESAVVAAKKPPLKRASTKDRHTKVDGRGRRIRMPALCAARVFQLTRELGHKSDGETIEWLLQQAEPSVIAATGTGTIPANFTSLNISLRSSGSSMSLPSHFRSAASTFSPNNIFSPAMLQQQQQQQRGGGVGFHHPHLQGRAPTSSLFPGIDNFTPTTSFLNFHNPTKQEGDQDSEELNSEKKRRIQTTSDLHQQQQQHQHDQIGGYTLQSSNSGSTATAAAAQQIPGNFWMVAAAAAAGGGGGNNNQTGGLMTASIGTGGGGGEPVWTFPSINTAAAALYRSGVSGVPSGAVSSGLHFMNFAAPMAFLTGQQQLATTSNHEINEDSNNNEGGRSDGGGDHHNTQRHHHHQQQHHHNILSGLNQYGRQVSGDSQASGSLGGGDEEDQQD

SEQ ID NO: 221 - DNA, 1116 bp, Arabidopsis thaliana
  G1069
ttggaaccctagaggcctttcaagcaaatcatcagggtaacaatttcttgatctttctttttagcgaatttccagtttttggtcaatcatggcaaacccttggtggacgaaccagagtggtttagcgggcatggtggaccattcggtctcctcaggccatcaccaaaaccatcaccaccaaagtcttcttaccaaaggagatcttggaatagccatgaatcagagccaagacaacgaccaagacgaagaagatgatcctagagaaggagccgttgaggtggtcaaccgtagaccaagaggtagaccaccaggatccaaaaacaaacccaaagctccaatctttgtgacaagagacagccccaacgcactccgtagccatgtcttggagatctccgacggcagtgacgtcgccgacacaatcgctcacttctcaagacgcaggcaacgcggcgtttgcgttctcagcgggacaggctcagtcgctaacgtcaccctccgccaagccgccgcaccaggaggtgtggtctctctccaaggcaggtttgaaatcttatctttaaccggtgctttcctccctggaccttccccacccgggtcaaccggtttaacggtttacttagccggggtccagggtcaggtcgttggaggtagcgttgtaggcccactcttagccatagggtcggtcatggtgattgctgctactttctctaacgctacttatgagagattgcccatggaagaagaggaagacggtggcggctcaagacagattcacggaggcggtgactcaccgcccagaatcggtagtaacctgcctgatctatcagggatggccgggccaggctacaatatgccgccgcatctgattccaaatggggctggtcagctagggcacgaaccatatacatgggtccacgcaagaccaccttactgactcagtgagccatttctatatataatggtctatataaataaatatatagatgaatataagcaagcaatttgaggtagtctattacaaagcttttgctctggttggaaaaataaataagtatcaaagctttgtttgttcttaatggaaatatagagcttgggaaggtagaaagagacgacatt

SEQ ID NO: 222 - protein, 281 aa, Arabidopsis thaliana
  G1069  (conserved domain in AA coordinates: 67-74)
MANPWWTNQSGLAGMVDHSVSSGHHQNHHHQSLLTKGDLGIAMNQSQDNDQDEEDDPREGAVEVVNRRPRGRPPGSKNKPKAPIFVTRDSPNALRSHVLEISDGSDVADTIAHFSRRRQRGVCVLSGTGSVANVTLRQAAAPGGVVSLQGRFEILSLTGAFLPGPSPPGSTGLTVYLAGVQGQVVGGSVVGPLLAIGSVMVIAATFSNATYERLPMEEEEDGGGSRQIHGGGDSPPRIGSNLPDLSGMAGPGYNMPPHLIPNGAGQLGHEPYTWVHARPPY

SEQ ID NO: 223 - DNA, 974 bp, Arabidopsis thaliana
  G1073
ccccccgacctgcctctacagagacctgaagattccagaaccccacctgatcaaaaataacatggaacttaacagatctgaagcagacgaagcaaaggccgagaccactcccaccggtggagccaccagctcagccacagcctctggctcttcctccggacgtcgtccacgtggtcgtcctgcaggttccaaaaacaaacccaaacctccgacgattataactagagatagtcctaacgtccttagatcacacgttcttgaagtcacctccggttcggacatatccgaggcagtctccacctacgccactcgtcgcggctgcggcgtttgcattataagcggcacgggtgcggtcactaacgtcacgatacggcaacctgcggctccggctggtggaggtgtgattaccctgcatggtcggtttgacattttgtctttgaccggtactgcgcttccaccgcctgcaccaccgggagcaggaggtttgacggtgtatctagccggaggtcaaggacaagttgtaggagggaatgtggctggttcgttaattgcttcgggaccggtagtgttgatggctgcttcttttgcaaacgcagtttatgataggttaccgattgaagaggaagaaaccccaccgccgagaaccaccggggtgcagcagcagcagccggaggcgtctcagtcgtcggaggttacggggagtggggcccaggcgtgtgagtcaaacctccaaggtggaaatggtggaggaggtgttgctttctacaatcttggaatgaatatgaacaattttcaattctccgggggagatatttacggtatgagcggcggtagcggaggaggtggtggcggtgcgactagacccgcgttttagagttttagcgttttggtgacaccttttgttgcgtttgcgtgtttgacctcaaactactaggctactagctatagcggttgcgaaatgcgaatattaggtt

SEQ ID NO: 224 - protein, 270 aa, Arabidopsis thaliana
  G1073  (conserved domain in AA coordinates: 33-42, 78-175)
MELNRSEADEAKAETTPTGGATSSATASGSSSGRRPRGRPAGSKNKPKPPTIITRDSPNVLRSHVLEVTSGSDISEAVSTYATRRGCGVCIISGTGAVTNVTIRQPAAPAGGGVITLHGRFDILSLTGTALPPPAPPGAGGLTVYLAGGQGQVVGGNVAGSLIASGPVVLMAASFANAVYDRLPIEEEETPPPRTTGVQQQQPEASQSSEVTGSGAQACESNLQGGNGGGGVAFYNLGMNMNNFQFSGGDIYGMSGGSGGGGGGATRPAF

SEQ ID NO: 225 - DNA, 1084 bp, Arabidopsis thaliana
  G1075
tttgtgtttggtgctggcatggctggtctcgatctaggcacaacttctcgctacgtccacaacgtcgatggtggcggcggcggacagttcaccaccgacaaccaccacgaagatgacggtggcgctggaggaaaccaccatcatcaccatcataatcataatcaccatcaaggtttagatttaatagcttctaatgataactctggactaggcggcggtggaggaggagggagcggtgacctcgtcatgcgtcggccacgtggccgtccagctggatcgaagaacaaaccgaagccgccggtgattgtcacgcgcgagagcgcaaacactcttagggctcacattcttgaagttggaagtggctgcgacgttttcgaatgtatctccacttacgctcgtcggagacagcgcgggatttgcgttttatccgggacgggaaccgtcactaacgtcagcatccgtcagcctacggcggccggagctgttgtgactctgcggggtacttttgagattctttccctctccggatcttttcttccgccacctgctcctccaggggcgactagcttgacgatattcctcgctggagctcaaggacaggtcgtcggaggtaacgtagttggtgagttaatggcggcggggccggtaatggtcatggcagcgtcttttacaaacgtggcttacgaaaggttgcctttggacgagcatgaggagcacttgcaaagtggcggcggcggaggtggagggaatatgtactcggaagccactggcggtggcggagggttgcctttctttaatttgccgatgagtatgcctcagattggagttgaaagttggcaggggaatcacgccggcgccggtagggctccgttttagcaatttaagaaactttaattgttttttccacttttttgtttttctccgaattttatgaaattatgatttaagaaaaaaaacgatattgttcatgtattgaccctcttactgcatggtttcttctattgggttaattggctagctcataagaattgtttaatttggttattgtcatcaaatttgcccacatataaagcttctagcaaat

SEQ ID NO: 226 - protein, 285 aa, Arabidopsis thaliana
  G1075  (conserved domain in AA coordinates: 78-85)
MAGLDLGTTSRYVHNVDGGGGGQFTTDNHHEDDGGAGGNHHHHHHNHNHHQGLDLIASNDNSGLGGGGGGGSGDLVMRRPRGRPAGSKNKPKPPVIVTRESANTLRAHILEVGSGCDVFECISTYARRRQRGICVLSGTGTVTNVSIRQPTAAGAVVTLRGTFEILSLSGSFLPPPAPPGATSLTIFLAGAQGQVVGGNVVGELMAAGPVMVMAASFTNVAYERLPLDEHEEHLQSGGGGGGGNMYSEATGGGGGLPFFNLPMSMPQIGVESWQGNHAGAGRAPF

SEQ ID NO: 227 - DNA, 2535 bp, Arabidopsis thaliana
  G1084
atgggatgttctcattccaagttagatgatgaagaagcagttcagatctgtaaagacaggaaacgtttcatcaaacaagctattgaacatagaactaagtttgcttctggtcacattgcttatattcactctcttagaaaagtctctgatgctctccatgactttatcctccaaggagacaacaacaatgagtttgttcctactctctgtcaagactcattcgtcactccggtcaagagaatgccacagagacgtcgtcgaagcagccgtagtaatagcggtgagttcatctccatttcgccttcttcgattcctccgaaaatgattcaaggtaggccaagatcgaatgtgaaagcgaattatttgatggctaatagaagtagaccggttagagtcgaacagagatctcctgaaacgtttagagttgagacattttctccacctagtagtagtaaccaatatggtgaatcagatggtttctttggaatgaatatgaatatgaatacttctgcgtctacttcatcttcgttttggaatccgttgagctctcctgagcaaaggttaagtagtcataacattcctcctccttcaccgcagaattcgcagtgggatttcttctggaatccgttttcttcgttggattattatggatacaatagttatgaccgaggaagtgttgatagtaggagtggtatagatgatgagattagaggattgagacgtgttagagaggaagaagggattcctgatttggaagaagatgatgaacctcataaacctgaacctgtcgtcaatgtgcggtttcagaatcataatccgaatccgaaagcaacggaagagaatagaggtaaagttgataagagttgttgcaatgaggaagttaaagttgaagatgttgatgaggatgaagacgaggatggagatgaggatgatgatgagtttacggatagcgggtgtgagactgagaatgagggagacgagaaatgcgttgctcctccaacgcaagaacagcgaaaagctgaggtgtgtagaggaggagaagctacagggaatgttgttggagtaggtaaggttcaagagatgaagaatgttgttggtgttagagatgatgcaaagacgacggggttcacggtatatgtgaaccggagaccaactagcatggctgaagtaatcaaagatcttgaagatcagttcacaacaatttgtgatgcggctaaggaagtctcggggctattggaagctggtagagctcaatacacatcatcctttaatgaccatagtggtgagtttatgaacaatgttgcaatatttctctccaggaaaatgctgaatccagtagcgttgttccgctcgggttcatcaagatcttcctcgtcaagattcttgatcacttcttctggtggttcaagagagagcgggtctgaaagcagaagcgatgtttcagatgaatcttgcatgatttcaggtagccaccaaacaacattggacagacttttcgcgtgggagaagaaactctatgatgaagttagggtaagtaacaagagatataagcaactatctggagaacgtgttcgaagagcatatgaaaagaaatgtatgcagctgaggaatcaggacgtgaaaggagatgatccgcttgcggttgataaaactagggctactatcagagatctagatacacagatcaaggtgtcaatacactccattgaatccatctccaaaagaatcgagactcttcgtgaccaagaactgttgcctcagcttcttgagctcgttgaaggactgacaaatggtaatcatgatcataacagattaacaaggatgtggaaagtaatggcggaaagtcaccagatacagaaacgaacactagacgaagccaaactgttacttgcaggcacaccggtttcaaagcgtcacaagaagagacaacctccaataatgccagaggctattaactctcaaagattagctcaatctgctttgaatcttgaagctcagcttcgaaactggagaacctgttttgaattctggatcacctctcagagatcctacatgaaagcattatctggttggcttctaagatgtttcagatgtgatcctgaccccgaaaaagttagattatcctcatgtcttcacccgatataccgagtctgcattcaatggtcaaggttgcttaacagcttgaatgaaaaaccagttttggacaaacttgagttctttgcctcagggatgggttcaatatatgcaaggcaagttagggaagatccaaactggagtggaagcgggtcaaggagatactccgggtcagaaagcatggagcttgtagtggctgataagggagaagaagatgttgtgatgactgctgagaaacttgcagaggttgctgtgaaggttctctgccatggaatgtctgttgcagttagttcactagctgagttttccatcaactcggccgatgaacactcgaagcttgttagccaaccagcagacgatgcgtcggagcagcagcccccggatgtaaatttcaattcctag

SEQ ID NO: 228 - protein, 844 aa, Arabidopsis thaliana
  G1084  (conserved domain in AA coordinates: 1-53, 490-619)
MGCSHSKLDDEEAVQICKDRKRFIKQAIEHRTKFASGHIAYIHSLRKVSDALHDFILQGDNNNEFVPTLCQDSFVTPVKRMPQRRRRSSRSNSGEFISISPSSIPPKMIQGRPRSNVKANYLMANRSRPVRVEQRSPETFRVETFSPPSSSNQYGESDGFFGMNMNMNTSASTSSSFWNPLSSPEQRLSSHNIPPPSPQNSQWDFFWNPFSSLDYYGYNSYDRGSVDSRSGIDDEIRGLRRVREEEGIPDLEEDDEPHKPEPVVNVRFQNHNPNPKATEENRGKVDKSCCNEEVKVEDVDEDEDEDGDEDDDEFTDSGCETENEGDEKCVAPPTQEQRKAEVCRGGEATGNVVGVGKVQEMKNVVGVRDDAKTTGFTVYVNRRPTSMAEVIKDLEDQFTTICDAAKEVSGLLEAGRAQYTSSFNDHSGEFMNNVAIFLSRKMLNPVALFRSGSSRSSSSRFLITSSGGSRESGSESRSDVSDESCMISGSHQTTLDRLFAWEKKLYDEVRVSNKRYKQLSGERVRRAYEKKCMQLRNQDVKGDDPLAVDKTRATIRDLDTQIKVSIHSIESISKRIETLRDQELLPQLLELVEGLTNGNHDHNRLTRMWKVMAESHQIQKRTLDEAKLLLAGTPVSKRHKKRQPPIMPEAINSQRLAQSALNLEAQLRNWRTCFEFWITSQRSYMKALSGWLLRCFRCDPDPEKVRLSSCLHPIYRVCIQWSRLLNSLNEKPVLDKLEFFASGMGSIYARQVREDPNWSGSGSRRYSGSESMELVVADKGEEDVVMTAEKLAEVAVKVLCHGMSVAVSSLAEFSINSADEHSKLVSQPADDASEQQPPDVNFNS

SEQ ID NO: 229 - DNA, 2663 bp, Arabidopsis thaliana
  G1089
aagtaagagagcttcttaaggaagaagaagatgggttgtgctcaatcaaagatcgagaacgaagaagcagttactcgttgcaaagaacgaaaacaattgatgaaagacgccgtcactgctcgtaacgctttcgccgccgctcactcagcttacgctatggctcttaaaaacaccggagctgctctttccgattactctcacggcgagtttttagtctctaatcactcgtcttcctccgcagctgcagcaatcgcttctacttcttctcttcccactgctatatctcctcctcttccttcttccaccgctccggtttctaattcaaccgcttcttcttcctccgctgcggttcctcagccgattcctgatactcttcctcctcctcctcctccaccaccgcttcctcttcaacgtgctgctactatgccggagatgaacggtagatccggtggtggtcatgctggtagtggactcaacggaattgaagaagatggagccctagataacgatgatgatgacgatgatgatgatgatgactctgaaatggagaatcgtgatcgtttgattaggaaatcgagaagccgtggaggtagtactagaggaaataggacgacgattgaagatcatcatcttcaggaggagaaagctccgccacctccccctttggcgaattcgcggccaattccgccgccacgtcagcatcagcatcaacatcagcaacagcaacaacaacctttctacgattacttcttccctaatgttgagaatatgcctggaactactttagaagatactcctccacaaccacaaccacaaccaacaaggcctgtgcctcctcaaccacattcaccagtcgttactgaggatgacgaagatgaggaggaggaagaggaggaagaggaggaggaagaggagacggtgattgaacggaaaccactggtggaggaaagaccgaagagagtagaggaagtgacgattgaattggaaaaagttactaatttgagagggatgaagaagagtaaagggatagggattcccggagagaggagaggaatgcgaatgccggtgactgcgacgcatttggcgaatgtattcattgagcttgatgataatttcttgaaagcttctgaaagtgctcatgatgtttctaagatgcttgaagctactaggctccattaccattctaattttgcagataaccgaggacatattgatcactctgctagagtgatgcgtgtaattacatggaatagatcatttagaggaataccaaatgctgatgatgggaaagatgatgttgatttggaagagaatgaaactcatgctactgttcttgacaaattgctagcatgggaaaagaagctctatgacgaagtcaaggctggcgaactcatgaaaatcgagtaccagaaaaaggttgctcatttaaatcgggtgaagaaacgaggtggccactcggattcattagagagagctaaagcagcagtaagtcatttgcatacaagatatatagttgatatgcaatccatggactccacagtttcagaaatcaatcgtcttagggatgaacaactatacctaaagctcgttcaccttgttgaggcgatggggaagatgtgggaaatgatgcaaatacatcatcaaagacaagctgagatctcaaaggtgttgagatctctagatgtttcacaagcggtgaaagaaacaaatgatcatcatcacgaacgcaccatccagctcttggcagtggttcaagaatggcacacgcagttttgcaggatgatagatcatcagaaagaatacataaaagcacttggcggatggctaaagctaaatctcatccctatcgaaagcacactcaaggagaaagtatcttcgcctcctcgagttcccaatcccgcaatccaaaaactcctccacgcttggtatgaccgtttagacaaaatccccgacgaaatggctaaaagtgccataatcaatttcgcagcggttgtaagcacgataatgcagcagcaagaagacgagataagtctcagaaacaaatgcgaagagacaagaaaagaattgggaagaaaaattagacagtttgaggattggtaccacaaatacatccagaagagaggaccggaggggatgaatccggatgaagcggataacgatcataatgatgaggtcgctgtgaggcaattcaatgtagaacaaattaagaagaggttggaagaagaagaagaagcttaccatagacaaagccatcaagttagagagaagtcactggctagtcttcgaactcgcctccccgagctttttcaggcaatgtccgaggttgcgtattcatgttcggatatgtatagagctataacgtatgcgagtaagcggcaaagccaaagcgaacggcatcagaaacctagccagggacagagttcgtaagaactaatgtaagatcagagtaatgtcttcttcttctttgatcttgaatatttaagcacacacatacatacaacgtatagctaaatctttatcattgctttcttatattaaggttttggcttttgtaagaaggtttcttacatatgagattcatatagtgtttgattcttaaggaactgttctgttgagtaataagaaagttgtgtattgaaatagagttgcatttgttaattttg

SEQ ID NO: 230 - protein, 798 aa, Arabidopsis thaliana
  G1089  (conserved domain in AA coordinates: 425-500)
MGCAQSKIENEEAVTRCKERKQLMKDAVTARNAFAAAHSAYAMALKNTGAALSDYSHGEFLVSNHSSSSAAAAIASTSSLPTAISPPLPSSTAPVSNSTASSSSAAVPQPIPDTLPPPPPPPPLPLQRAATMPEMNGRSGGGHAGSGLNGIEEDGALDNDDDDDDDDDDSEMENRDRLIRKSRSRGGSTRGNRTTIEDHHLQEEKAPPPPPLANSRPIPPPRQHQHQHQQQQQQPFYDYFFPNVENMPGTTLEDTPPQPQPQPTRPVPPQPHSPVVTEDDEDEEEEEEEEEEEEETVIERKPLVEERPKRVEEVTIELEKVTNLRGMKKSKGIGIPGERRGMRMPVTATHLANVFIELDDNFLKASESAHDVSKMLEATRLHYHSNFADNRGHIDHSARVMRVITWNRSFRGIPNADDGKDDVDLEENETHATVLDKLLAWEKKLYDEVKAGELMKIEYQKKVAHLNRVKKRGGHSDSLERAKAAVSHLHTRYIVDMQSMDSTVSEINRLRDEQLYLKLVHLVEAMGKMWEMMQIHHQRQAEISKVLRSLDVSQAVKETNDHHHERTIQLLAVVQEWHTQFCRMIDHQKEYIKALGGWLKLNLIPIESTLKEKVSSPPRVPNPAIQKLLHAWYDRLDKIPDEMAKSAIINFAAVVSTIMQQQEDEISLRNKCEETRKELGRKIRQFEDWYHKYIQKRGPEGMNPDEADNDHNDEVAVRQFNVEQIKKRLEEEEEAYHRQSHQVREKSLASLRTRLPELFQAMSEVAYSCSDMYRAITYASKRQSQSERHQKPSQGQSS

SEQ ID NO: 231 - DNA, 1064 bp, Arabidopsis thaliana
  G1134
taaagaaagagaaaaaaagctttcgtagtgtctattgaaaccagagaaaagccaaaggggatgcaaccaacatccgtcggtagtagcggcggtggtgacgacggaggaggcagaggaggaggaggagggctaagtagaagtggactatctcggatccgttcagctccagcgacttggcttgaagctttacttgaggaagatgaagaagagtctttgaaacctaatcttggtctcaccgatttgcttaccgggaactcgaacgatttaccgacaagtcgcggctcgttcgagttcccgattcctgttgagcaagggttgtatcaacaaggtgggtttcaccgacagaatagtactccggcggattttcttagtggttctgatggatttatccaaagctttgggattcaggcgaattacgattacttatcggggaatatcgatgtttctccgggaagtaagcggtctagagaaatggaagcactcttctcttctcctgagtttacttctcaaatgaaaggagagcaaagcagcggtcaagttcctaccggagtatcaagcatgtcggatatgaacatggagaaccttatggaggactctgttgcttttagggttcgggctaaacgtggttgcgcaactcatccccgcagcattgccgagagggtacgaaggacgcggattagtgatcggataaggaagctacaagagcttgtacctaacatggacaagcaaaccaacactgcagacatgttagaagaagcagtagaatacgtgaaagttcttcaaaggcagatccaggagttaacagaagaacagaagaggtgcacatgcatacctaaggaagaacaataaggtttgctcctgatttgttttatatttgcttaacggcaatgatctgatcgaaaaattcgaaagatgatcttagcttgaatttagatggatgtcatgttgaaaagtatattatttgataaatggatgtaggtgtaatataaaatttttgtacaataatgaagaaagttaaaaagaattaatgaaaacatatattctttatgatataaaaaaaaaaa

SEQ ID NO: 232 - protein, 262 aa, Arabidopsis thaliana
  G1134  (conserved domain in AA coordinates: 198-247)
MQPTSVGSSGGGDDGGGRGGGGGLSRSGLSRIRSAPATWLEALLEEDEEESLKPNLGLTDLLTGNSNDLPTSRGSFEFPIPVEQGLYQQGGFHRQNSTPADFLSGSDGFIQSFGIQANYDYLSGNIDVSPGSKRSREMEALFSSPEFTSQMKGEQSSGQVPTGVSSMSDMNMENLMEDSVAFRVRAKRGCATHPRSIAERVRRTRISDRIRKLQELVPNMDKQTNTADMLEEAVEYVKVLQRQIQELTEEQKRCTCIPKEEQ

SEQ ID NO: 233 - DNA, 956 bp, Arabidopsis thaliana
  G1140
atccaagatcctccaactcacagaaaggcagattcaagaacagtagtgaaggagagatctggtaaaatggcgagagagaagataaggataaagaagattgataacataacagcgagacaagttactttctcaaagagaagaagaggaatcttcaagaaagccgatgaactttcagttctttgcgatgctgatgttgctctcatcatcttctctgccaccggaaagctcttcgagttctccagctcaagaatgagagacatattgggaaggtatagtcttcatgcaagtaacatcaacaaattgatggatccaccttctactcatctccggcttgagaattgtaacctctccagactaagtaaggaagtcgaagacaaaaccaagcagctacggaaactgagaggagaggatcttgatggattgaacttagaagagttgcagcggctggagaaactacttgaatccggacttagccgtgtgtctgaaaagaagggcgagtgtgtgatgagccaaattttctcacttgagaaacggggatcggaattggtggatgagaataagagactgagggataaactagagacgttggaaagggcaaaactgacgacgcttaaagaggctttggagacagagtcggtgaccacaaatgtgtcaagctacgacagtggaactccccttgaggatgactccgacacttccctgaagcttgggcttccatcttgggaatgaatctgagagagagaaagatccagcagagttgacttcgatggaagcccacaaatattaagtctaccttttccctttcttttctttgaataagtgttgaaaaagaattgagatgggaaggatgaattctcattgcattgcagagaagcaagtttcagatattgtacgtgttattgggtctttataactatttttctccccaaaaaaaaaaaaaaaaaaaaaaaaaaaaa

SEQ ID NO: 234 - protein, 220 aa, Arabidopsis thaliana
  G1140  (conserved domain in AA coordinates:2-57)
MAREKIRIKKIDNITARQVTFSKRRRGIFKKADELSVLCDADVALIIFSATGKLFEFSSSRMRDILGRYSLHASNINKLMDPPSTHLRLENCNLSRLSKEVEDKTKQLRKLRGEDLDGLNLEELQRLEKLLESGLSRVSEKKGECVMSQIFSLEKRGSELVDENKRLRDKLETLERAKLTTLKEALETESVTTNVSSYDSGTPLEDDSDTSLKLGLPSWE

SEQ ID NO: 235 - DNA, 805 bp, Arabidopsis thaliana
  G1143
aaataagaatataaacacttttgtctgaaaaattatcaaagaagaagaaataaatgggtggaggaagcagatttcaagaaccagtgaggatgagccgtaggaaacaagtaacaaaagagaaggaagaagatgaaaacttcaaatctccaaatcttgaagcagagagacgtagaagagagaagcttcattgtcggcttatggctctgcgatctcatgtccccattgtcaccaacatgactaaagcaagtattgttgaagatgcgattacttacataggagagcttcaaaacaatgttaagaatctcttagagacatttcatgaaatggaagaagctcctcctgagattgatgaagaacaaacggatccaatgataaaacctgaagttgaaactagtgatcttaacgaagagatgaagaaactcggaatcgaggagaatgtgcaattgtgtaagattggggagaggaagttttggttaaagatcataacagagaagagagatgggatctttactaaattcatggaggttatgagatttctcggattcgagattatcgatattagtctaacaacttcaaatggagcaattcttattagtgcctctgttcagacacaggaactctgtgatgttgaacagacaaaagattttcttttggaagttatgagaagcaatccataagtattaattatatacatcttggaaatttcttgatctaataacatttccattggtttttattacattgttgttccattttaaatatgatatgattcagatgaaaaagagtttgtgttacaagccaatga

SEQ ID NO: 236 - protein, 207 aa, Arabidopsis thaliana
  G1143  (conserved domain in AA coordinates:33-82)
MGGGSRFQEPVRMSRRKQVTKEKEEDENFKSPNLEAERRRREKLHCRLMALRSHVPIVTNMTKASIVEDAITYIGELQNNVKNLLETFHEMEEAPPEIDEEQTDPMIKPEVETSDLNEEMKKLGIEENVQLCKIGERKFWLKIITEKRDGIFTKFMEVMRFLGFEIIDISLTTSNGAILISASVQTQELCDVEQTKDFLLEVMRSNP

SEQ ID NO: 237 - DNA, 3323 bp, Arabidopsis thaliana
  G1146
cttctctagcgtcactcttcttcttcattggtcggtagaataaggccaaggaagggatcagttttaagttttgtttcattctttttgtagtggagaaaaagagtttttgaaaatcaaaacaacaaaaaatgccgattaggcaaatgaaagatagctctgagactcacttagttatcaaaacccaacctttaaagcaccacaatccaaaaaccgttcaaaacggtaaaatccctcctccttctccttctccggtgacggtgactactccggcgacggttactcagagtcaagcttcttcaccttcaccaccgtcaaagaatcgtagccggaggagaaaccgtggtggaagaaaatctgatcaaggagatgtttgtatgagacctagctctcgtcctcgtaaaccgccaccgccaagtcaaaccacttcctccgccgtctccgtcgccaccgccggtgagattgtcgctgtgaatcatcagatgcagatgggtgttcgtaaaaactcaaactttgctccaagacctggatttggaacacttggaactaaatgcattgttaaagctaaccactttctcgctgatttgcctaccaaggatttgaatcagtatgatgttacaattactcctgaagtgtcatcaaagagtgttaacagagctataattgctgagttagttagactttacaaagagtctgatctcgggaggagacttccggcttacgatggccggaaaagtctttacactgctggagaacttccttttacttggaaggagttcagtgttaagattgttgatgaagatgacggtatcatcaatggccctaaaagggagagatcatataaggtggcaatcaagtttgttgcacgggcaaatatgcatcacttaggcgagtttctagctggtaaacgggcagattgtccgcaagaggcggtgcagattcttgatattgtactcagggagttgtcggttaagaggttttgtcccgttggaagatctttcttttcgcctgatattaaaacaccgcagcgactcggtgaagggttagagtcatggtgtgggttttaccagagtattagaccaactcaaatgggtttatcactaaatatcgatatggcttcagctgcattcatcgagcctcttccagtgatagagtttgtagcacagcttcttggaaaggatgtcttgtcgaagccattgtcggattctgatcgcgtcaagattaagaagggtcttagaggagtgaaagtagaggttactcacagagcgaatgtaagaaggaaataccgtgttgcgggtttaacaactcaaccaacaagagagctaatgtttccagtagatgagaactgtactatgaagtcagttattgagtatttccaagagatgtatggattcacgatccagcacacgcatttgccatgtctccaagttggaaaccaaaagaaggcaagctatttgccgatggaggcatgcaaaattgtcgagggacaacggtacacgaaaaggttgaatgagaagcagattactgctctcttgaaagttacatgccaaagggccgagggacagagaaacgatattttgcggactgtccaacacaacgcatatgatcaagatccatatgcaaaggagtttggcatgaacataagcgaaaagttagcttctgttgaagctcgtattcttccagctccatggcttaagtatcacgagaacgggaaagaaaaagattgtctcccgcaagttggtcagtggaatatgatgaacaagaaaatgatcaacgggatgactgtgagcagatgggcctgtgttaacttctcacgcagcgttcaagaaaacgttgctcgtggattttgtaatgaacttggtcagatgtgtgaagtctcaggcatggagtttaatccagaacccgtgataccaatatatagtgcgaggcccgatcaagtcgagaaagctctaaagcatgtttatcacacttcaatgaacaaaaccaaaggcaaagagttagagcttctgctggcaatattacctgataacaacggttcactttatggtgatcttaagagaatctgtgaaaccgagcttggtttgatatctcaatgttgtctcacaaaacatgtgttcaagattagcaaacagtatctggcagatgtatcccttaaaatcaacgtaaagatgggaggaaggaacacagttctagtagacgccataagctgtagaattccactggttagcgatataccgacaatcatttttggcgcagacgtgactcacccagagaacggggaagagtcaagcccttcaatcgctgctgttgttgcttctcaagactggcctgaagtgacaaaatatgcgggtttagtttgtgctcaagctcacaggcaagaacttatacaagatttgtataaaacatggcaagatcctgttcgcggtactgttagtggcggtatgatcagggaccttcttatctcatttagaaaagcaacagggcaaaaaccgcttcgaattatcttttatcgtgatggagtaagcgaagggcaattctatcaagttttactctatgagttggatgcaattcgaaaggcttgtgcatcgcttgaaccgaattatcagccaccggtgacattcatagttgtacagaagcgtcaccacactcgtttgtttgctaataatcaccgagacaaaaacagtactgaccgaagcggaaatatcttaccaggtactgtagttgacactaaaatatgtcatccaactgaattcgacttctacctttgtagccatgcgggtattcagggaacaagcaggcctgcacattaccatgttctttgggacgagaacaatttcacagcagatggtattcaatctctgactaacaatctctgttatacctatgcgcggtgcactcggtcggtctctatagttcctccagcgtattatgctcatcttgcagcatttcgagcacgtttctacctggaacctgagataatgcaagacaacggatcaccgggtaaaaagaacacgaaaacaacaactgtcggagacgtaggtgtgaagcctttaccagccttgaaggagaatgtgaagagagtaatgttctactgctaaaaatccaaacattccttaatcagttttaataagtagtttggttgtttgcttgtagttcggctttagatttaccaatgtttttcttatgtaaattttgtcggtttggtttaagcctttaggaattagtgtattagggtttttctaaagttgtactttagctgatgataacgttgatgcagtgactttgttaaaacctcctcttctacagtagtgtttacgtcgttcctc

SEQ ID NO: 238 - protein, 988 aa, Arabidopsis thaliana
  G1146  (conserved domain in AA coordinates: 886-896)
MPIRQMKDSSETHLVIKTQPLKHHNPKTVQNGKIPPPSPSPVTVTTPATVTQSQASSPSPPSKNRSRRRNRGGRKSDQGDVCMRPSSRPRKPPPPSQTTSSAVSVATAGEIVAVNHQMQMGVRKNSNFAPRPGFGTLGTKCIVKANHFLADLPTKDLNQYDVTITPEVSSKSVNRAIIAELVRLYKESDLGRRLPAYDGRKSLYTAGELPFTWKEFSVKIVDEDDGIINGPKRERSYKVAIKFVARANMHHLGEFLAGKRADCPQEAVQILDIVLRELSVKRFCPVGRSFFSPDIKTPQRLGEGLESWCGFYQSIRPTQMGLSLNIDMASAAFIEPLPVIEFVAQLLGKDVLSKPLSDSDRVKIKKGLRGVKVEVTHRANVRRKYRVAGLTTQPTRELMFPVDENCTMKSVIEYFQEMYGFTIQHTHLPCLQVGNQKKASYLPMEACKIVEGQRYTKRLNEKQITALLKVTCQRAEGQRNDILRTVQHNAYDQDPYAKEFGMNISEKLASVEARILPAPWLKYHENGKEKDCLPQVGQWNMMNKKMINGMTVSRWACVNFSRSVQENVARGFCNELGQMCEVSGMEFNPEPVIPIYSARPDQVEKALKHVYHTSMNKTKGKELELLLAILPDNNGSLYGDLKRICETELGLISQCCLTKHVFKISKQYLADVSLKINVKMGGRNTVLVDAISCRIPLVSDIPTIIFGADVTHPENGEESSPSIAAVVASQDWPEVTKYAGLVCAQAHRQELIQDLYKTWQDPVRGTVSGGMIRDLLISFRKATGQKPLRIIFYRDGVSEGQFYQVLLYELDAIRKACASLEPNYQPPVTFIVVQKRHHTRLFANNHRDKNSTDRSGNILPGTVVDTKICHPTEFDFYLCSHAGIQGTSRPAHYHVLWDENNFTADGIQSLTNNLCYTYARCTRSVSIVPPAYYAHLAAFRARFYLEPEIMQDNGSPGKKNTKTTTVGDVGVKPLPALKENVKRVMFYC

SEQ ID NO: 239 - DNA, 2054 bp, Arabidopsis thaliana
  G1196
catctgttctgagattgtcttcttcttcttgaaatctttttcatttgtgcaatgattttgaagactacccatctattcagttctttctcttatgatttaagtttcatttagtttttttttctcatccgccattttcgttgactttttgaagcatttctcgaattgactttgttcttcacattgattcattagaatgttctttcataaagtttggatcttttcttcagggcttgattaatttcatatctatgatcttctctgtattgtttttgatccaatcacttctcaaaatttgatccttgtcattggatttagatttagggtttttgtatccttggggatttgaagatcaaaaacagagtctttgagtgatacttctggggaacaaaatggctgcaactgcaatagagccatcttcatctataagtttcacatcttctcacttatcaaacccttctcctgttgttactacttatcactcagctgctaatcttgaagagctcagctctaacttggagcagcttctcactaatccagattgcgattacactgacgcagagatcatcattgaagaagaagctaaccctcggaagcttcgtaactatgttgagaagtcactagtagagaatgttcttcctatcctcttagttgcgtttcattgtgatttgacacagcttcttgatcaatgcattgagagagtggcgagatcagacttagacagattctgtatcgaaaaggagcttcctttagaagtattggaaaaaatcaaacagcttcgagttaagtcggtgaacatacccgaggtggaggataaatcgatagagagaacagggaaagtactcaaggcattggattcagatgatgtagaactcgtgaagcttcttttgactgagtcagatataactctagaccaagccaatggtctacattatgcagtggcatacagtgatccgaaagttgtgacacaggttcttgatctagatatggctgatgttaatttcagaaattccagggggtatacggttcttcatattgctgctatgcgtagagagccaacaattatcataccacttattcaaaaaggagctaatgcttcagatttcacgtttgatggacgcagtgcggtaaatatatgtaggagactcactaggccgaaagattatcataccaaaacctcaaggaaagaacctagtaaataccgcttatgcatcgatatcttggaaagggaaattagaaggaatccattggttagtggggatacacccacttgttcccattcgatgcccgaggatctccaaatgaggttgttatacttagaaaagcgagtgggacttgctcagttgttcttcccagcagaagccaatgtggctatggacgttgctaatgttgaagggacaagcgagtgcacaggtcttctaactccacctccatcaaatgatacaactgaaaacttgggtaaagtcgatttaaatgaaacgccttatgtgcaaacgaaaagaatgcttacacgtatgaaagccctcatgaaaacagttgagacaggtcggagatacttcccatcttgttatgaggttctggataagtacatggatcagtatatggacgaagaaatccctgatatgtcgtatcccgagaaaggcactgtgaaagagagaagacagaagaggatgagatataacgagctgaagaacgacgttaaaaaagcatatagcaaagacaaagtcgcgcggtcttgtctttcttcttcatcaccagcttcttctcttagagaagccttagagaatccaacatgatcttgtcccagataagtaatgctactagagatagttccttggaagaaattagctattttataggttttggtttagaaaacagtggagatcccattttggtattcaggtttattacatggtttaggtttgattttgtattaaaggagatggatttttgaaatgtataaagcaaaacctttcctttttgctttgcttctttctttaaaaaaaaaattgtaatatatggaagtgaaatcgaagcaacgattgagcaaaaaaaaa

SEQ ID NO: 240 - protein, 467 aa, Arabidopsis thaliana
  G1196  (conserved domain in AA coordinates: 179-254)
MAATAIEPSSSISFTSSHLSNPSPVVTTYHSAANLEELSSNLEQLLTNPDCDYTDAEIIIEEEANPRKLRNYVEKSLVENVLPILLVAFHCDLTQLLDQCIERVARSDLDRFCIEKELPLEVLEKIKQLRVKSVNIPEVEDKSIERTGKVLKALDSDDVELVKLLLTESDITLDQANGLHYAVAYSDPKVVTQVLDLDMADVNFRNSRGYTVLHIAAMRREPTIIIPLIQKGANASDFTFDGRSAVNICRRLTRPKDYHTKTSRKEPSKYRLCIDILEREIRRNPLVSGDTPTCSHSMPEDLQMRLLYLEKRVGLAQLFFPAEANVAMDVANVEGTSECTGLLTPPPSNDTTENLGKVDLNETPYVQTKRMLTRMKALMKTVETGRRYFPSCYEVLDKYMDQYMDEEIPDMSYPEKGTVKERRQKRMRYNELKNDVKKAYSKDKVARSCLSSSSPASSLREALENPT

SEQ ID NO: 241 - DNA, 1780 bp, Arabidopsis thaliana
  G1198
tcttttcaaattccaatcatttgatcaactaatcaagaattaattataagactttgcaatctctctccctctccctctccctagctagttctctcttgtgtttcttaactcgagcttctctcaatagtgattatcatctttttcatcatttcaagatttaatgtgttttgcagaaaagagactaatcaagaagagatatcatcaattgaagctgttttcttgagtagagatggcgaaccatagaatgagcgaagctacaaaccataaccacaatcatcatcttccttattcacttattcatggtctcaacaacaatcatccatcttctggtttcattaaccaagatggatcgtccagtttcgattttggagagctagaagaagcaattgttctgcaaggtgtcaagtataggaacgaggaagccaagccacctttattaggaggaggaggaggagctacgactctggagatgttcccttcgtggccaatcagaactcaccaaactcttcctactgagagttccaagtcaggaggagagagcagcgattcaggatcggctaatttctccggcaaagctgaaagtcaacaaccggagtctcctatgagtagcaaacatcatctcatgcttcaacctcatcataataacatggcaaactcaagttcaacatctggacttccttccacttctcgaactttagctcctcctaaaccttcggaagataagaggaaggctacaacttcaggcaaacagcttgatgctaagacgttgagacgtttggcccaaaatagagaagctgctcgcaaaagccgtcttaggaaaaaggcgtatgtgcaacagctagaatcaagtaggataaagctttcccaattggagcaagaacttcagcgagctcgttctcaggggctgttcatgggtggttgtggaccaccaggacctaacatcacttccggagctgcaatatttgacatggaatatgggagatggctagaggatgataaccggcatatgtcggagattcgaaccggtcttcaggctcatttatctgacaatgatttaaggttgatcgttgacggttacattgctcattttgatgagatattccgattaaaagccgtggcagcgaaagccgatgtttttcacctcatcattgggacatggatgtccccagccgaacgttgttttatttggatggctggtttccgtccatccgacctaatcaagatattggtgtcgcaaatggatctattgacggagcaacaactgatgggaatatatagcctacaacactcgtcgcaacaagcagaggaggctctctcgcaaggcctcgaacaacttcagcaatctctcatcgatactctcgccgcatctccagtcattgacggaatgcaacaaatggctgtcgctctcggaaagatctctaatctcgaaggctttatccgccaggctgataacttgaggcagcagaccgttcaccagctgaggcggatcttgaccgtccgacaagctgcacggtgtttcctagtcatcggagagtactatggacggctcagagctcttagctccctttggttgtcacgcccacgagagacactgatgagtgatgaaacctcttgtcaaacgacgacggatttgcagattgttcagtcatctcggaaccacttctccaatttctgaatggaatgaaactttgtataactaaaaggccaagtttcattgtctgtcgtaatttcacctatttcctttaaagttgtactagagaaaagataggatcttccttcg

SEQ ID NO: 242 - protein, 481 aa, Arabidopsis thaliana
  G1198  (conserved domain in AA coordinates: 173-223)
MANHRMSEATNHNHNHHLPYSLIHGLNNNHPSSGFINQDGSSSFDFGELEEAIVLQGVKYRNEEAKPPLLGGGGGATTLEMFPSWPIRTHQTLPTESSKSGGESSDSGSANFSGKAESQQPESPMSSKHHLMLQPHHNNMANSSSTSGLPSTSRTLAPPKPSEDKRKATTSGKQLDAKTLRRLAQNREAARKSRLRKKAYVQQLESSRIKLSQLEQELQRARSQGLFMGGCGPPGPNITSGAAIFDMEYGRWLEDDNRHMSEIRTGLQAHLSDNDLRLIVDGYIAHFDEIFRLKAVAAKADVFHLIIGTWMSPAERCFIWMAGFRPSDLIKILVSQMDLLTEQQLMGIYSLQHSSQQAEEALSQGLEQLQQSLIDTLAASPVIDGMQQMAVALGKISNLEGFIRQADNLRQQTVHQLRRILTVRQAARCFLVIGEYYGRLRALSSLWLSRPRETLMSDETSCQTTTDLQIVQSSRNHFSNF

SEQ ID NO: 243 - DNA, 1056 bp, Arabidopsis thaliana
  G1225
atgactctagaagctttatcatcaaacggtcttttaaactttttgctctctgaaactctttcaccaactccattcaagtctctcgtcgatctcgagccattgccggaaaatgatgtcatcatatcgaagaacacaatttcggagatatctaatcaagaaccgccaccacagcgacaaccaccagctacgaatcgagggaagaagcggcggaggaggaagcctagggtttgcaaaaacgaggaagaagctgagaatcaacgaatgactcacattgccgtcgaaagaaatcgaagaagacaaatgaatcaacatctctctgtcttgcgatctctcatgcctcaaccttttgctcacaagggtgatcaagcttcaatagttggtggagccatagatttcatcaaagaacttgaacacaaattactatctcttgaagctcaaaaacatcataatgctaaattaaaccagtcggttacttcttcaacaagtcaagactcaaatggtgaacaagagaatcctcatcaaccatcttcactatctctatcgcagttctttcttcattcatacgatccgagccaagagaataggaacggctcaacaagctcggtgaaaacccctatggaagatcttgaggtgactctaatcgaaactcatgctaacatcagaatcttgtcgagaagaagaggtttccggtggagcacgttggccaccaccaaaccgccgcagctttcgaagctggtggcttctctacaatcgctgtccctctccattcttcaccttagtgtcacaacattggacaattatgctatttactccatcagcgctaaggtggaagagagttgccagctaagttcagtagatgacattgcaggagcagttcaccacatgctaagtatcattgaagaggagcctttttgttgctcatcaatgtcagaattaccatttgacttctctttgaatcactcaaatgtcactcattctctctgagaaatctcttttttgttgttgttattccttcttttaattttatcacatagcacatctttagttttttttttt

SEQ ID NO: 244 - protein, 327 aa, Arabidopsis thaliana
  G1225  (conserved domain in AA coordinates: 78-147)
MTLEALSSNGLLNFLLSETLSPTPFKSLVDLEPLPENDVIISKNTISEISNQEPPPQRQPPATNRGKKRRRRKPRVCKNEEEAENQRMTHIAVERNRRRQMNQHLSVLRSLMPQPFAHKGDQASIVGGAIDFIKELEHKLLSLEAQKHHNAKLNQSVTSSTSQDSNGEQENPHQPSSLSLSQFFLHSYDPSQENRNGSTSSVKTPMEDLEVTLIETHANIRILSRRRGFRWSTLATTKPPQLSKLVASLQSLSLSILHLSVTTLDNYAIYSISAKVEESCQLSSVDDIAGAVHHMLSIIEEEPFCCSSMSELPFDFSLNHSNVTHSL

SEQ ID NO: 245 - DNA, 1362 bp, Arabidopsis thaliana
  G1226
ctgcatttattaagaacagtttagaaagtgtcaacccctaaaggaatgtttttagtttagaggaaagagagagaagaagaagcagcagcagaagttgttaatttgaagactatttgaggaaagacacctatatctaaatactcaaagttacaaaaatattacttcagaaaacagttccattagagagactcataaagcttctcatctaattatgagtggattgatgagttttggtgaattagaagaccaatttggtcagatttcagacactactatggaagagaagataccatttctgcaaatgcttcaatgcatagaacacccttttacaacaacagaaccaaatcagtttctccaatcacttctccagatccaaaccctagaatcaaagagctgtctcacccttgaaacaaacatcaaaagagatccgggtcaaacagatgacccggaaaaggatccaagaacagaaaacggagcagtaacggtcaaagaaaaaagaaaacggaaacgtacaagagctccaaagaacaaagacgaagttgaaaaccaaaggatgactcacattgccgtcgaacgtaatcgaagacgacaaatgaacgaacacttaaactctctccgatctctcatgcctccttcgtttcttcaacggggtgaccaagcttcgattgtaggaggggcaatagatttcatcaaggaactagagcaactcttgcaatctctagaagctgagaaacgaaaggatggaactgatgaaactcctaaaacggcgtcgtgttcttcatcttcgtctcttgcatgcactaactcttctatttctagcgtgtctacgacgtcggaaaatggatttacggcgagattcggcggtggagatacgacagaagtggaggctacggtgatacagaaccatgtgagcttaaaagttcggtgtaagagaggaaaacgacagatcttaaaagctattgtctcgattgaagaactaaagcttgcgattctacatctcactatctcttcttcctttgactttgtcatctactctttcaatctcaagatggaagatggttgtaaattaggatcagcagatgagatagcgacagccgttcatcagatcttcgagcaaatcaacggtgaagtcatgtggtcaaatcttagtcgaacttagttgacttttgactcctagtaacgtgtgtaaactttaggttacaaagaaaagggacgtgatataaataagaaaaaccaaagaggtgaaattttgggagttttaattattatcttatactttttggattttagattagtagcaaactcgcagtgttctacgatgacattattattggtcacatgaaggtttaggttaaaaaaaaa

SEQ ID NO: 246 - protein, 315 aa, Arabidopsis thaliana
  G1226  (conserved domain in AA coordinates:115-174)
MSGLMSFGELEDQFGQISDTTMEEKIPFLQMLQCIEHPFTTTEPNQFLQSLLQIQTLESKSCLTLETNIKRDPGQTDDPEKDPRTENGAVTVKEKRKRKRTRAPKNKDEVENQRMTHIAVERNRRRQMNEHLNSLRSLMPPSFLQRGDQASIVGGAIDFIKELEQLLQSLEAEKRKDGTDETPKTASCSSSSSLACTNSSISSVSTTSENGFTARFGGGDTTEVEATVIQNHVSLKVRCKRGKRQILKAIVSIEELKLAILHLTISSSFDFVIYSFNLKMEDGCKLGSADEIATAVHQIFEQINGEVMWSNLSRT

SEQ ID NO: 247 - DNA, 1604 bp, Arabidopsis thaliana
  G1229
tttgggcgggtctttctttccctaaatctttcttttattttgctgtttaaaaaaaaaatccaaccataagacaaaacaacgaacgaggaagagagagagagaaggatatatctctaatcacgatgcaggagataataccggattttcttgaagagtgtgaatttgtcgacacttcactagccggagatgatctatttgccatcttagagagtcttgaaggtgccggagagatatctccgacagctgcatctacacctaaagatggaaccacaagttccaaggagttagttaaggatcaagattatgaaaactcatctcctaagaggaaaaagcaaagactagaaaccaggaaagaagaggacgaagaagaagaagacggagacggagaagcagaagaagataataagcaagatgggcaacaaaagatgtctcatgtaaccgtggaacgtaaccggagaaagcaaatgaacgagcacttaaccgttttgcgttctcttatgccttgtttctacgtcaaacggggggaccaagcatcgatcataggaggagttgtggagtacataagcgagttacaacaagttctccaatctttggaagccaagaaacaacgtaaaacctacgccgaagtcctaagcccgagagttgtcccgagccctcgtccttcaccgcctgttctaagcccaagaaaaccgcctcttagcccgcgcatcaaccaccaccagattcaccaccacctacttctccctcccataagtcctcgaacacctcagccaacaagcccataccgggccattccaccgcaactaccactcatcccacagcctccgcttcgctcttacagctcattggccagttgcagcagcttaggagatccacctccatactctcctgcttcatcttcttcatctccttcagttagtagtaaccatgagagtagtgtgatcaatgagcttgttgctaactcaaaatcggctttggctgatgtggaagtgaagttttcaggagctaacgtgctgctcaaaacggtgtcgcataagatcccgggacaagttatgaagataattgctgctcttgaagatttggctcttgagattcttcaggttaatattaacaccgtcgacgaaaccatgcttaattctttcaccatcaagattggaattgagtgccaactaagtgcagaagaactggctcaacaaattcagcaaacattctgctagtaaagaaggatttaatatagcttcgtataaaccttaacgagagagcagtacgtactcactttctctccttagtatccctttaattatcttttcagttttctgcaaagatatggagtttaaaaaaataaaattgttatctaaagttttaatcaaatattgattaattataactaatataggtataagtgagttttaaagattatcagcttcataacagccatcgtcatgtttactttcttttaaattttagaatttagacgtactcctaccatgtaattttatttctgtcattacatcaagcattgtagctgtaattgcatatgaatgaacaatagtgtatgagtgatctcatgaataatattcttcttgcaacacaaaaaaaaaaaa

SEQ ID NO: 248 - protein, 364 aa, Arabidopsis thaliana
  G1229  (conserved domain in AA coordinates: 102-160)
MQEIIPDFLEECEFVDTSLAGDDLFAILESLEGAGEISPTAASTPKDGTTSSKELVKDQDYENSSPKRKKQRLETRKEEDEEEEDGDGEAEEDNKQDGQQKMSHVTVERNRRKQMNEHLTVLRSLMPCFYVKRGDQASIIGGVVEYISELQQVLQSLEAKKQRKTYAEVLSPRVVPSPRPSPPVLSPRKPPLSPRINHHQIHHHLLLPPISPRTPQPTSPYRAIPPQLPLIPQPPLRSYSSLASCSSLGDPPPYSPASSSSSPSVSSNHESSVINELVANSKSALADVEVKFSGANVLLKTVSHKIPGQVMKIIAALEDLALEILQVNINTVDETMLNSFTIKIGIECQLSAEELAQQIQQTFC

SEQ ID NO: 249 - DNA, 1538 bp, Arabidopsis thaliana
  G1255
cagctcaaactctctaggactacactaaatctaactttttgcagagagcaaaagattcaataattgagattgatctcaaaaccaaagctctcgtgctcttgtcgttgatgttggttgtgtagactttgtatacaatgatgaaaagtttggcgaatgctgttggagcgaagacggcgagggcttgcgacagctgcgtgaagagacgtgcacggtggtactgcgcggccgacgatgcttttctttgccagtcttgcgacagtttggtccattcagcaaaccctcttgctcgccgccacgagagagtccgtttgaagacggctagcccggcggtcgtaaagcatagcaaccactcatcagcttctcctccacatgaggtcgccacgtggcatcacgggtttactcgtaaagctcgaacgccacgtggctctggtaagaaaaacaattcgtcgatatttcatgacttggttcctgatattagtattgaggatcagacagacaactatgagcttgaagagcagctgatctgtcaagtgccggttctagatccgttggtgtctgagcagttcttgaacgatgtcgttgagcccaagatcgagtttcctatgatcagaagtggtttgatgatcgaggaggaggaagacaacgctgaaagttgtcttaatggatttttcccgaccgacatggagcttgaggagtttgctgctgacgtggagactctgctcggtcgcgggttagacacggagtcgtatgccatggaggagctagggttatctaattcagagatgttcaaaatcgaaaaagatgagattgaagaagaagtagaagagataaaagccatgagcatggatatatttgatgatgatcgaaaagacgtggatggaacagtaccgtttgagctaagctttgattacgagtcgtcacacaagacgtccgaagaagaggtaatgaagaacgttgaaagtagtggtgaatgtgttgttaaggtgaaagaggaagaacataagaatgttctgatgctaagattaaactatgactcggtgatatccacttggggaggtcaaggtccaccgtggagttcaggagagccaccggaacgagacatggacatcagcggttggccagccttttccatggtggagaatggaggagaaagtactcatcagaagcaatacgttggtggatgtttaccatcaagtgggtttggagatggaggtagagaagctagagtttcgagatacagagagaagaggaggacaaggttgttttctaagaagatacggtacgaggtacgtaaattgaatgcagagaaaagaccacgaatgaaaggaagattcgtgaagagagcctcgctcgctgctgctgcttcaccattaggtgttaattactgaatagttaatatctattcatgttatatctcactttacaaatttcggtgaatcttttttcttctgaaacaacagaagttattttggcacttaattgtgctttgaggacttgtatgtacatagaagtaaccaataataatgtgacttttacta

SEQ ID NO: 250 - protein, 416 aa, Arabidopsis thaliana
  G1255  (conserved domain in aa coordinates: 18-56)
MKSLANAVGAKTARACDSCVKRRARWYCAADDAFLCQSCDSLVHSANPLARRHERVRLKTASPAVVKHSNHSSASPPHEVATWHHGFTRKARTPRGSGKKNNSSIFHDLVPDISIEDQTDNYELEEQLICQVPVLDPLVSEQFLNDVVEPKIEFPMIRSGLMIEEEEDNAESCLNGFFPTDMELEEFAADVETLLGRGLDTESYAMEELGLSNSEMFKIEKDEIEEEVEEIKAMSMDIFDDDRKDVDGTVPFELSFDYESSHKTSEEEVMKNVESSGECVVKVKEEEHKNVLMLRLNYDSVISTWGGQGPPWSSGEPPERDMDISGWPAFSMVENGGESTHQKQYVGGCLPSSGFGDGGREARVSRYREKRRTRLFSKKIRYEVRKLNAEKRPRMKGRFVKRASLAAAASPLGVNY

SEQ ID NO: 251 - DNA, 859 bp, Arabidopsis thaliana
  G1266
caatccactaacgatccctaaccgaaaacagagtagtcaagaaacagagtattttttctacatggatccatttttaattcagtccccattctccggcttctcaccggaatattctatcggatcttctccagattctttctcatcctcttcttctaacaattactctcttcccttcaacgagaacgactcagaggaaatgtttctctacggtctaatcgagcagtccacgcaacaaacctatattgactcggatagtcaagaccttccgatcaaatccgtaagctcaagaaagtcagagaagtcttacagaggcgtaagacgacggccatgggggaaattcgcggcggagataagagattcgactagaaacggtattagggtttggctcgggacgttcgaaagcgcggaagaggcggctttagcctacgatcaagctgctttctcgatgagagggtcctcggcgattctcaatttttcggcggagagagttcaagagtcgctttcggagattaaatatacctacgaggatggttgttctccggttgtggcgttgaagaggaaacactcgatgagacggagaatgaccaataagaagacgaaagatagtgactttgatcaccgctccgtgaagttagataatgtagttgtctttgaggatttgggagaacagtaccttgaggagcttttggggtcttctgaaaatagtgggacttggtgaaagattaggatttgtattagggaccttaagtttgaagtggttgattaattttaaccctaatatgttttttgtttgcttaaatatttgattctattgagaaacatcgaaaacagtttgtatgtacttttgtgatacttggcg

SEQ ID NO: 252 - protein, 218 aa, Arabidopsis thaliana
  G1266  (conserved domain in AA coordinates: 79-147)
MDPFLIQSPFSGFSPEYSIGSSPDSFSSSSSNNYSLPFNENDSEEMFLYGLIEQSTQQTYIDSDSQDLPIKSVSSRKSEKSYRGVRRRPWGKFAAEIRDSTRNGIRVWLGTFESAEEAALAYDQAAFSMRGSSAILNFSAERVQESLSEIKYTYEDGCSPVVALKRKHSMRRRMTNKKTKDSDFDHRSVKLDNVVVFEDLGEQYLEELLGSSENSGTW

SEQ ID NO: 253 - DNA, 748 bp, Arabidopsis thaliana
  G1275
ccaagaaaagggaagatcacgcattcttataggcgtaattcgtaaatagtggtgagtatgaatgatgcagacacaaacttggggagtagtttcagcgatgatactcactctgtgttcgagtttccggagctagacttgtcagatgaatggatggatgatgatcttgtgtctgcggtttccgggatgaatcagtcttatggttatcagactagtgatgttgctggtgctttattctcaggttcttctagctgtttcagtcatcctgaatctccaagtaccaaaacttatgttgctgctacagccactgcttctgccgacaaccaaaacaagaaagaaaagaaaaaaattaaagggagagttgcgttcaagacacggtccgaggtggaagtgcttgacgacgggttcaagtggagaaagtatgggaagaagatggtgaagaacagcccacatccaagaaactactacaaatgttcagttgatggctgtcccgtgaagaaaagggttgaacgagacagagatgatccgagctttgtgataacaacttacgagggttcccacaatcactcaagcatgaactaagactcgaactaaggctcaaggcgaccatgctatattcagcacatcttattttctatggttacgaacgatacttaaaactgcttctagttctttatatccattgtaaactggttgcaggttcacaaattttgagaggtttatgacattctaaatctgtagtacttatata

SEQ ID NO: 254 - protein, 173 aa, Arabidopsis thaliana
  G1275  (conserved domain in AA coordinates: 113-169)
MNDADTNLGSSFSDDTHSVFEFPELDLSDEWMDDDLVSAVSGMNQSYGYQTSDVAGALFSGSSSCFSHPESPSTKTYVAATATASADNQNKKEKKKIKGRVAFKTRSEVEVLDDGFKWRKYGKKMVKNSPHPRNYYKCSVDGCPVKKRVERDRDDPSFVITTYEGSHNHSSMN

SEQ ID NO: 255 - DNA, 720 bp, Arabidopsis thaliana
  G1305
atggggaatagaagagcaccatgctgtgacaaaagccaagtgaagagagggccatggagtgatgaagaaagtgaaagactcagatcttttatcctcaaaaatggtcatcaaaattggcgatctcttcccaaactcgctggattgatgagatgcggaaagagttgtcgtctaagatggataaactatctgagaccaggtctcaaacgaggcaacttcaccaaggaggaggaagataccattatccaccttcaccaagcttatggaaacaagtggtctaagatcgcatccaacttcccgggaaggacagacaacgagatcaagaatgtatggaacactcatctcaagaagcggttggtgaagaggagcatttcatcatcatcatccgatgttaccaatcattcagtgtcttctacctcttcttcctcttcctcaatctcgtcagtcttgcaggacgttattattaagagtgagaggcctaaccaggaagaggagtttggggaaatcttggtggagcaaatggcatgtggatttgaggtggatgcaccacaatcactagaatgtctctttgacgatagccaggttcctcctcctatatctaaaccagactcactacaaacccatgggaagtcatcagatcacgaattttggagccgactgattgaaccagggttcgatgattacaatgagtggctcattttcttggataaccaaacttgctag

SEQ ID NO: 256 - protein, 239 aa, Arabidopsis thaliana
  G1305  (conserved domain in AA coordinates:15-118)
MGNRRAPCCDKSQVKRGPWSDEESERLRSFILKNGHQNWRSLPKLAGLMRCGKSCRLRWINYLRPGLKRGNFTKEEEDTIIHLHQAYGNKWSKIASNFPGRTDNEIKNVWNTHLKKRLVKRSISSSSSDVTNHSVSSTSSSSSSISSVLQDVIIKSERPNQEEEFGEILVEQMACGFEVDAPQSLECLFDDSQVPPPISKPDSLQTHGKSSDHEFWSRLIEPGFDDYNEWLIFLDNQTC

SEQ ID NO: 257 - DNA, 1011 bp, Arabidopsis thaliana
  G1322
aaagttattgatagtttctgttacttattaatttttaaggttatgtgtattattaccaattggaggactatatagtcgcaagtctcaaccctataaaagaaaacattcgtcgatcatcttcccgcctcgagtatctctctctctctctctcttctctgttttctttattgattgcatagacaaaaatacacacatacacaacagaaagaaagatggagacgacgatgaagaagaaagggagagtgaaagcgacaataacgtcacagaaagaagaagaaggaacagtgagaaaaggaccttggactatggaagaagatttcatcctctttaattacatccttaatcatggtgaaggtctttggaactctgtcgccaaagcctctggtctaaaacgtactggaaaaagttgtcggctccggtggctgaactatctccgaccagatgtgcggcgagggaacataaccgaagaagaacagcttttgatcattcagcttcatgctaagcttggaaacaggtggtcgaagattgcgaagcatcttccgggaagaacggacaacgagataaagaacttctggaggacaaagattcagagacacatgaaagtgtcatcggaaaatatgatgaatcatcaacatcattgttcgggaaactcacagagctcggggatgacgacgcaaggcagctccggcaaagccatagacacggctgagagcttctctcaggcgaagacgacgacgtttaatgtggtggaacaacagtcaaacgagaattactggaacgttgaagatctgtggcccgtccacttgcttaatggtgaccaccatgtgatttaagatatatatatagacctcctatacatttatatgccccagctgggtttttttgtatggtacgttatttggtttttctattgctgaaatgtcgttgcatttaatttacatacgaaaagtgcattaaatcattaaatcttcaatacatatggaggtggtgtttgagtaaaaaaaaaaaaaa

SEQ ID NO: 258 - protein, 206 aa, Arabidopsis thaliana
  G1322  (conserved domain in AA coordinates:26-130)
METTMKKKGRVKATITSQKEEEGTVRKGPWTMEEDFILFNYILNHGEGLWNSVAKASGLKRTGKSCRLRWLNYLRPDVRRGNITEEEQLLIIQLHAKLGNRWSKIAKHLPGRTDNEIKNFWRTKIQRHMKVSSENMMNHQHHCSGNSQSSGMTTQGSSGKAIDTAESFSQAKTTTFNVVEQQSNENYWNVEDLWPVHLLNGDHHVI

SEQ ID NO: 259 - DNA, 1088 bp, Arabidopsis thaliana
  G1323
aagagggaatctcaaaagtgtgtgtctgtgagagaggagagagagaatatgggcaaaggaagagcaccatgttgtgacaaaaccaaagtgaagagaggaccatggagccatgatgaagacttgaaactcatctctttcattcacaagaatggtcatgagaattggagatctctcccaaagcaagctggattgttgaggtgtggcaagagttgtcgtctgcgatggattaattacctcagacctgatgtgaaacgtggcaatttcagtgcagaggaagaagacaccatcatcaaacttcaccagagctttggtaacaagtggtcgaagattgcttctaagctgcctggaagaacagacaatgagatcaagaatgtgtggcatacacatctcaagaaaagattgagctcggaaactaaccttaatgccgatgaagcgggttcaaaaggttctttgaatgaagaagagaactctcaagagtcatctccaaatgcttcaatgtcttttgctggttccaacatttcaagcaaagacgatgatgcacagataagtcaaatgtttgagcacattctaacttatagcgagtttacggggatgttacaagaggtagacaaaccagagctgctggagatgccttttgatttagatcctgacatttggagtttcatagatggttcagactcattccaacaaccagagaacagagctcttcaagagtctgaagaagatgaagttgataaatggtttaagcacctggaaagcgaactcgggttagaagaaaacgataaccaacaacaacaacagcataaacagggaacagaagatgaacattcatcatcactcttggagagttacgagctcctcatacattaatgaagccataaagcaagtcattttcaccttgaaaatggaattattagctaacttattggcattattagtatataagcaagatcagataggcgcatgtagtagcaacaacgaagaaacgtcgaattgtagacaaaatgtagatattacagagttgaaagattgtattttgcaaatgattgctttgtagtgaaatcaagttatcacaaaaaaaaaaaaaa

SEQ ID NO: 260 - protein, 273 aa, Arabidopsis thaliana
  G1323  (conserved domain in AA coordinates: 15-116)
MGKGRAPCCDKTKVKRGPWSHDEDLKLISFIHKNGHENWRSLPKQAGLLRCGKSCRLRWINYLRPDVKRGNFSAEEEDTIIKLHQSFGNKWSKIASKLPGRTDNEIKNVWHTHLKKRLSSETNLNADEAGSKGSLNEEENSQESSPNASMSFAGSNISSKDDDAQISQMFEHILTYSEFTGMLQEVDKPELLEMPFDLDPDIWSFIDGSDSFQQPENRALQESEEDEVDKWFKHLESELGLEENDNQQQQQHKQGTEDEHSSSLLESYELLIH

SEQ ID NO: 261 - DNA, 981 bp, Arabidopsis thaliana
  G1330
gtaccggcgacctctttgtgggtcactcttcatcaatgggtgacaaaggaaggagcttaaagatcaacaagaacatggaggaattcacgaaagtggaagaagaaatggacgtaaggagaggtccatggacagttgaggaagatttagagctcatcaattacattgctagtcatggtgaaggtcgatggaactctctcgctcgttgcgccgaactcaaaaggaccggaaaaagctgcagacttcggtggctgaactatctccgaccagatgtgcgccgtggaaacataaccctcgaagaacaactcttgattcttgaacttcacacacgttggggcaatagatggtctaagattgcacaatatttaccaggaagaacggataacgagatcaaaaactattggagaacacgtgttcaaaagcatgcaaaacagcttaaatgcgacgtgaacagtcaacaatttaaagacaccatgaagtatctttggatgcctcggctcgtagaaaggatccaagccgcgtccatcgggtctgtttccatgtcatcttgcgtcaccacctcctcagatcagttcgtgatcaacaacaacaacaccaacaacgtggataatttggctttaatgagtaaccctaatggttacatcacgccggataattccagcgtggcagtatctcctgtatcagatttgacggagtgtcaagtgagtagtgaagtgtggaagattggtcaggatgagaatttggtggatccaaaaatgacatcgccgaattatatggataatagcagtggactattaaacggagattttacgaagatgcaagatcaaagtgaccttaattggtttgaaaatattaatgggatggtaccaaattattcggacagtttttggaacattggaaatgatgaagacttctggctcttacaacaacatcaacaagtccacgacaatggaagcttctgaatagacaagaagctatgcggcc

SEQ ID NO: 262 - protein, 307 aa, Arabidopsis thaliana
  G1330  (conserved domain in AA coordinates: 28-134)
MGDKGRSLKINKNMEEFTKVEEEMDVRRGPWTVEEDLELINYIASHGEGRWNSLARCAELKRTGKSCRLRWLNYLRPDVRRGNITLEEQLLILELHTRWGNRWSKIAQYLPGRTDNEIKNYWRTRVQKHAKQLKCDVNSQQFKDTMKYLWMPRLVERIQAASIGSVSMSSCVTTSSDQFVINNNNTNNVDNLALMSNPNGYITPDNSSVAVSPVSDLTECQVSSEVWKIGQDENLVDPKMTSPNYMDNSSGLLNGDFTKMQDQSDLNWFENINGMVPNYSDSFWNIGNDEDFWLLQQHQQVHDNGSF

SEQ ID NO: 263 - DNA, 786 bp, Arabidopsis thaliana
  G1331
atggtggaagaagtttggagaaagggtccatggaccgccgaagaagaccgtcttttgatcgaatacgtccgtgttcacggtgaaggtcgttggaactctgtctctaaactcgcaggattgaaaaggaatggcaaaagctgcagactaagatgggtgaattaccttagaccagacctcaagagaggacagatcactccacatgaagaaagtataatacttgagctacacgctaagtggggaaataggtggtcaacaattgcacgtagtttaccaggaagaacagacaatgagatcaagaactattggagaacccatttcaagaaaaaggcaaagcctacgactaacaatgcggagaagataaagagtcgtctcctaaaaaggcaacacttcaaggaacagagagaaatagagttgcaacaagaacagcagttgtttcagttcgaccaactcggtatgaaaaagatcatctctttactcgaagaaaacaatagcagtagcagtagcgatggcggtggtgatgtgttctattatcctgatcaaataacacattcatcaaaaccctttggctataactctaattcattagaggagcagttacaaggtagattttctcctgtaaacatacctgatgctaatactatgaacgaagacaatgccatatgggacgggttttggaacatggatgttgtaaatggacatggtgggaacttgggtgttgtggctgctactgctgcttgtggcccaaggaagccctatttccataacttggtgattccattttgttaa

SEQ ID NO: 264 - protein, 261 aa, Arabidopsis thaliana
  G1331  (conserved domain in AA coordinates:8-109)
MVEEVWRKGPWTAEEDRLLIEYVRVHGEGRWNSVSKLAGLKRNGKSCRLRWVNYLRPDLKRGQITPHEESIILELHAKWGNRWSTIARSLPGRTDNEIKNYWRTHFKKKAKPTTNNAEKIKSRLLKRQHFKEQREIELQQEQQLFQFDQLGMKKIISLLEENNSSSSSDGGGDVFYYPDQITHSSKPFGYNSNSLEEQLQGRFSPVNIPDANTMNEDNAIWDGFWNMDVVNGHGGNLGVVAATAACGPRKPYFHNLVIPFC

SEQ ID NO: 265 - DNA, 606 bp, Arabidopsis thaliana
  G1332
atggaatgcaaaagagaagaagggaagtcttacgtgaagagagggttgtggaaaccagaagaagatatgatattaaaaagctatgttgagactcatggtgaaggaaactgggcagacatttctcgtagatccgggttgaagagaggaggaaaaagctgtaggctgagatggaagaactatctaagaccaaatatcaaaagaggaagcatgtcaccacaagaacaagaccttatcatccgcatgcataagcttcttggaaacagatggtcgttgatcgctggtcgccttccaggtcgtactgacaatgaagtgaagaactactggaatactcatttgaacaagaaacctaattcccgaaaacagaatgcacctgaatcaatcgtcggcgccactcctttcacggataagccagttatgtctacagaactgagaagaagccatggagaaggaggagaagaggagagcaatacctggatggaggagaccaaccactttggctatgacgtccacgtaggatctcccttgccacttatttcccactacccagacaacactctcgtgtttgacccatgtttttcctttaccgatttctttcctctgctttag

SEQ ID NO: 266 - protein, 201 aa, Arabidopsis thaliana
  G1332  (conserved domain in AA coordinates:13-116)
MECKREEGKSYVKRGLWKPEEDMILKSYVETHGEGNWADISRRSGLKRGGKSCRLRWKNYLRPNIKRGSMSPQEQDLIIRMHKLLGNRWSLIAGRLPGRTDNEVKNYWNTHLNKKPNSRKQNAPESIVGATPFTDKPVMSTELRRSHGEGGEEESNTWMEETNHFGYDVHVGSPLPLISHYPDNTLVFDPCFSFTDFFPLL

SEQ ID NO: 267 - DNA, 1011 bp, Arabidopsis thaliana
  G1363
cgtctacctactatggtctggagattagttcgtttattgaactaatgttttagacaatgcaagagttccatagtagcaaagattcattgccttgtcctgcaacttcttgggataactctgtcttcaccaactcaaatgtccaaggatcatcatccttgaccgataacaacactttaagcttgacaatggagatgaaacaaactggttttcaaatgcagcactatgattcctcctctactcaatccactggaggagaatcatatagtgaagttgctagcttaagtgaacctactaatcgttatggccacaacattgttgtcactcatctctcaggttacaaagaaaacccggaaaatcctattggaagtcattcgatatcaaaggtgtctcaagattcagtggttcttcctattgaggcggcttcttggcctttacacggcaatgtaacgccacatttcaatggtttcttgtcttttccttatgcatcacaacacacggtgcagcatcctcaaatcagagggttggttccgtctagaatgcctttgcctcacaacattccagagaacgaaccaattttcgtcaatgcaaaacagtaccaagccattctccgccgcagagagcgccgtgcaaagcttgaagctcagaacaagctcatcaaagtccgcaaaccatatcttcacgagtcgcggcacctccatgcactaaagagagttagaggctctggtggacgtttcctcaacacaaagaagcatcaagaatcaaattcctcactatctcctccattcttgattccacctcatgtcttcaagaactctccaggaaagttccggcaaatggacatttcaaggggtggggttgtgtctagtgtctcgacaacatcttgctcggacataaccgggaacaacaacgacatgttccagcaaaacccacaattcaggttctcaggttatccatcaaaccaccatgtctcagtcctcatgtgagagagctcccgcaagtggtggatgaggc

SEQ ID NO: 268 - protein, 308 aa, Arabidopsis thaliana
  G1363  (conserved domain in AA coordinates: 174-226)
MQEFHSSKDSLPCPATSWDNSVFTNSNVQGSSSLTDNNTLSLTMEMKQTGFQMQHYDSSSTQSTGGESYSEVASLSEPTNRYGHNIVVTHLSGYKENPENPIGSHSISKVSQDSVVLPIEAASWPLHGNVTPHFNGFLSFPYASQHTVQHPQIRGLVPSRMPLPHNIPENEPIFVNAKQYQAILRRRERRAKLEAQNKLIKVRKPYLHESRHLHALKRVRGSGGRFLNTKKHQESNSSLSPPFLIPPHVFKNSPGKFRQMDISRGGVVSSVSTTSCSDITGNNNDMFQQNPQFRFSGYPSNHHVSVLM

SEQ ID NO: 269 - DNA, 1034 bp, Arabidopsis thaliana
  G1411
taaagaaaaactgaacaaccctaaagtactgtataaatcctatatcaaattttttttttggaagaaaaggctatatttaaaagaaaatcaagcaaaagtagatcctcggatgtatgggaagaggccttttggaggtgatgaatctgaagaaagggaagaagatgagaacttgttcccggtcttctcggcccgatctcaacacgacatgcgtgttatggtctcggccttgactcaagtaatcggaaaccaacaaagcaaatctcatgataacatcagctctattgatgataactatccttctgtgtataatccacaagaccctaatcaacaagttgcgcctactcatcaagaccaaggggacttgaggaggagacattatagaggtgtaaggcaaaggccatggggaaagtgggcagctgaaatccgagacccaaaaaaggcggcacgtgtgtggctcgggacatttgaaaccgctgaatctgcggccttagcttatgatgaagcagccctaaagttcaaaggaagcaaagcaaaactcaatttcccggagagggttcagcttggaagtaactctacatattactcctccaaccaaattccacaaatggaaccacaaagtataccgaactataatcaatactatcatgatgcgagtagtggtgatatgctaagttttaatttgggcggtgggtatgggagtggtaccggatattcaatgtctcatgataatagtactacgactgctgctacaacttcttcgtcttctggtggctcttctaggcaacaagaagagcaagattatgccagattctggcgctttggggattcttcttcctctcctcattcgggatattaattaggagatttgatcagttacttgtgatgaagtaatgatacatttcccgtcaaaattgagatgatcatatgcttcctgaatgtttttgagtgtcatttttgtcttccgcgttaagatttattgaacgtgttttcttgtttttttggttaaaaaaaaaaaaaaaaaaaaaaaaaaaaaa

SEQ ID NO: 270 - protein, 248 aa, Arabidopsis thaliana
  G1411  (conserved domain in AA coordinates: 87-154)
MYGKRPFGGDESEEREEDENLFPVFSARSQHDMRVMVSALTQVIGNQQSKSHDNISSIDDNYPSVYNPQDPNQQVAPTHQDQGDLRRRHYRGVRQRPWGKWAAEIRDPKKAARVWLGTFETAESAALAYDEAALKFKGSKAKLNFPERVQLGSNSTYYSSNQIPQMEPQSIPNYNQYYHDASSGDMLSFNLGGGYGSGTGYSMSHDNSTTTAATTSSSSGGSSRQQEEQDYARFWRFGDSSSSPHSGY

SEQ ID NO: 271 - DNA, 1651 bp, Arabidopsis thaliana
  G1417
tctatctctatctatctctctttgtctgcaaatggaagaacatattcaagatcgccgtgaaattgcgttcttacactcaggagaatttctccacggagattctgactcaaaggatcatcaaccgaacgagtctccggtggaacgtcatcacgagtcgtctatcaaagaagttgatttcttcgctgctaaaagtcagccgtttgatcttggtcatgtgagaacaacgacgatcgttggatcatctggttttaatgatggattaggtttggtaaattcatgtcatggaacatcaagcaatgatggcgatgacaaaaccaaaactcaaattagtagactgaagttggagctagagaggcttcacgaggagaatcacaaactgaagcatttattagatgaggtcagtgagagttacaacgacctccaaagaagagttttgttagcaagacaaacacaagtggaaggtcttcatcataaacaacatgaggatgtacctcaagctggttcctcacaagctctagagaacagaagaccaaaggatatgaaccatgaaactccggccaccaccttgaaacgacggtctccagacgacgtggatggtcgtgatatgcaccgaggatcaccaaaaactcctcgaatagaccaaaacaagagtactaatcatgaagaacaacaaaaccctcatgatcaattaccctatagaaaagctagggtttccgttagagctagatctgatgccactacggtaaatgacggatgtcaatggagaaaatacggtcagaaaatggcgaaagggaatccatgtcctcgcgcttattatcgttgcaccatggccgttggatgtcctgtccgtaaacaggtccaacgatgcgcggaggatacaactatcttgacaacaacgtacgaaggaaaccataaccatcctcttcccccgtcagccacagccatggctgcaaccacctccgccgcagcagccatgctcttatcaggctcctcctccagcaacctccaccaaacactctctagcccctccgccacgtcatcatcatccttctaccataacttcccatacacctccacaatcgcaacactctctgcctcagctcctttccccaccataaccttagacctcaccaacccacctcgaccgctacaaccgccaccgcagtttctaagccagtatggtcccgccgcgtttttaccaaacgctaatcaaattaggtctatgaataataataaccagcagttattaatacctaatttgtttggcccacaagccccaccacgtgaaatggtcgattcagttagggctgcgattgcgatggatccgaacttcacggcggcacttgcggccgcgatctcaaacattatcggaggaggtaataacgacaacaataataatactgatattaatgataacaaggttgatgcaaaaagtggagggagtagtaacggagattcgccacagcttcctcagtcttgcaccactttctctacaaactaattttactaccattattatatgttatcttattatatattacacacacatattatacattatgcgtatcttaagtttttttttgggggccattatatatgaatgatatggagatcactgagagagagagagagctattatgggttttttttt

SEQ ID NO: 272 - protein, 489 aa, Arabidopsis thaliana
  G1417  (conserved domain in AA coordinates: 239-296)
MEEHIQDRREIAFLHSGEFLHGDSDSKDHQPNESPVERHHESSIKEVDFFAAKSQPFDLGHVRTTTIVGSSGFNDGLGLVNSCHGTSSNDGDDKTKTQISRLKLELERLHEENHKLKHLLDEVSESYNDLQRRVLLARQTQVEGLHHKQHEDVPQAGSSQALENRRPKDMNHETPATTLKRRSPDDVDGRDMHRGSPKTPRIDQNKSTNHEEQQNPHDQLPYRKARVSVRARSDATTVNDGCQWRKYGQKMAKGNPCPRAYYRCTMAVGCPVRKQVQRCAEDTTILTTTYEGNHNHPLPPSATAMAATTSAAAAMLLSGSSSSNLHQTLSSPSATSSSSFYHNFPYTSTIATLSASAPFPTITLDLTNPPRPLQPPPQFLSQYGPAAFLPNANQIRSMNNNNQQLLIPNLFGPQAPPREMVDSVRAAIAMDPNFTAALAAAISNIIGGGNNDNNNNTDINDNKVDAKSGGSSNGDSPQLPQSCTTFSTN

SEQ ID NO: 273 - DNA, 820 bp, Arabidopsis thaliana
  G1419
gaagactccaacataattcatcatctatggcttcttcacatcaacaacagcaagaacaagaccagtcagctttagatctcataacccaacaccttcttactgatttcccttccttagacacctttgcctccaccatccaccactgcaccacctcaactctaagccaacgcaaaccacctcttgccactatagcagttcctactactgcaccggtggttcaagagaatgatcaaaggcattacagaggcgtcaggagaagaccatggggtaagtatgcggctgagatcagagacccaaacaagaaaggtgttcgtgtctggttaggcacttttgacacagccatggaagctgcaagaggttatgacaaggcagcttttaaactacgaggaagcaaagctattcttaacttcccacttgaagcaggaaagcatgaggacttgggagacaacaagaagactatttctttaaaagcaaagaggaagagacaggtgacggaggatgaaagccagctgatcagccgtaaagctgttaagagggaagaagctcaggttcaggctgatgcttgtccattaacgccatcaagttggaaggggttttgggacggagcagacagtaaagacatgggaatattttccgtgcctctgttatctccttgtccatctcttggacactctcaactcgtagttacttaagcttcagagggtcaaactggaaaaaatcaacattggattgttttcaaagcttctagattagctgattgtaaaaaaatgttttactatattcattcattcttcttaaatgcaattctttctacccttcc

SEQ ID NO: 274 - protein, 221 aa, Arabidopsis thaliana
  G1419  (conserved domain in AA coordinates: 69-137)
MASSHQQQQEQDQSALDLITQHLLTDFPSLDTFASTIHHCTTSTLSQRKPPLATIAVPTTAPVVQENDQRHYRGVRRRPWGKYAAEIRDPNKKGVRVWLGTFDTAMEAARGYDKAAFKLRGSKAILNFPLEAGKHEDLGDNKKTISLKAKRKRQVTEDESQLISRKAVKREEAQVQADACPLTPSSWKGFWDGADSKDMGIFSVPLLSPCPSLGHSQLVVT

SEQ ID NO: 275 - DNA, 799 bp, Arabidopsis thaliana
  G1449
tagacagagagaaatagaaatagagagagagagacatgaagagcactctcaatagagaagagaaggaagcatgaagctagctctgcagcttcaaggtctcattaatggaggtctctaactcttgttcttcattttcttcatcctctgtcgacagtactaaaccttctccttctgaatcttctgttaatctctcccttagtctcacatttccttctacttctccacaaagagaagcaagacaagattggccaccgataaagtctagattaagagatacactaaagggtcgtcgtcttcttcgtcgtggtgatgacacttctctctttgttaaggtttatatggaaggtgttcccattggaagaaaactcgacctttgcgtattctcaggctacgagagtctattagaaaatctctctcacatgttcgatacttcaatcatctgcggtaatcgagatcgaaaacatcatgttttgacatatgaagacaaggatggagattggatgatggtcggagatattccatgggatatgtttcttgaaaccgtgagaagactaaagatcacgagaccggagaggtattaaaacttggatcggtcaaggctgtgattgcgcagttacgagacgtgtaagatttaggcattgatgaagagacttgaggcgggacggagctattgctgcatattgcaacaaaggccttgaagaagttggagaattgattgatgcatatatttatttatatgacacctttgagtgtgttttttcttataaataaatcacaatatccaagacttctctttaaa

SEQ ID NO: 276 - protein, 158 aa, Arabidopsis thaliana
  G1449  (conserved domain in AA coordinates: 48-53,74-107,122-152)
MEVSNSCSSFSSSSVDSTKPSPSESSVNLSLSLTFPSTSPQREARQDWPPIKSRLRDTLKGRRLLRRGDDTSLFVKVYMEGVPIGRKLDLCVFSGYESLLENLSHMFDTSIICGNRDRKHHVLTYEDKDGDWMMVGDIPWDMFLETVRRLKITRPERY

SEQ ID NO: 277 - DNA, 2816 bp, Arabidopsis thaliana
  G1451
tttgtacttccggagctaaagagttatagctactgtagtagctggaagtgaagaagattttttaatagattgtacggaaaaattagggttttcaaagtttggtttcttgaagttgaattagacatgaagctgtcaacatctggattgggtcaacagggtcatgaaggagagaagtgtctgaattctgagctatggcatgcttgtgctggaccattagtctctcttccatcatctggtagtcgagttgtttactttccacagggtcacagtgaacaggtagctgctacaactaataaggaagttgatggtcacatacccaattacccaagcctaccaccacaattgatatgccagctccataatgttacaatgcatgcagatgttgagacggatgaagtctatgctcaaatgacacttcaaccattgacaccggaggagcagaaggaaacatttgtaccgattgagttggggataccgagtaagcaacctagtaattatttttgtaagactctcacagctagtgataccagtacacatggagggttttctgttcctagacgtgctgctgagaaagtgtttcctccattggattacacactgcagccaccagctcaagaactgattgcaagggatctccatgatgttgaatggaagtttaggcatatctttcggggacagcccaaacggcatctcctaactactggatggagtgtctttgtcagtgccaagcgactagtagctggagattctgtcattttcatcaggaatgaaaagaatcaactctttttgggaattcgtcatgccactcggccgcagactattgtaccatcatctgttttatctagtgatagcatgcatattggactccttgctgctgctgcacatgcttctgcaactaatagctgtttcactgttttctttcatccaagggctagccaatctgagtttgtgatacaactttccaagtacattaaagccgtttttcacacgcgtatttcagttgggatgcgctttcgcatgctcttcgagacagaagagtcgagtgtccgcaggtacatgggtactataactggtattagtgatctagattctgttcgttggccaaactctcattggcgatctgtgaaggttggttgggatgaatcgactgcaggggagagacagccaagggtttctttatgggagattgagcctctgactacctttcctatgtatccatctctttttcctctcagactaaaacgtccatggcatgctggcacatcatctttgcctgatggaaggggtgatttgggaagtggtctaacatggctaagagggggaggtggagagcagcaaggtttgcttcctctaaattatccatctgttggtttgtttccatggatgcaacaaaggctggatctcagtcaaatggggactgataataatcagcaataccaagcaatgttagctgctgggttgcagaacatcggcggtggagatcctttaagacagcagtttgtacagctgcaagagcctcaccaccaatatcttcaacaatcagcttcccataattctgatttgatgcttcagcagcaacagcagcaacaagcgtcacgccatctcatgcatgctcaaacacagattatgagtgagaatcttccgcagcagaatatgcgacaagaagttagtaaccaaccagctggacagcagcaacagctacagcaaccggaccaaaatgcatatcttaatgctttcaaaatgcaaaatggccatcttcaacagtggcagcagcaatcagagatgccatctccctcgttcatgaagtcagattttactgactcaagcaacaaatttgcaacaactgctagtccggcttctggagatggcaatcttttgaatttttctataaccggtcagtctgtactccctgagcagttaacaacagagggctggtctccaaaagcatccaacactttttctgaaccgttgtcacttccacaagcctatcctgggaagagtcttgctctagaacccggaaatccgcagaatccctctcttttcggtgttgatcccgactctggactcttcctccccagtacggttccccgctttgcttcttcatcaggagatgctgaagcttcccctatgtcactaacagattcaggatttcagaattccttatatagctgcatgcaagacacaactcatgagttattgcatggagctggacagattaactcgtccaaccaaaccaagaactttgtaaaggtttataaatctggttcggttgggcgttcattagacatctcccgattcagcagctaccacgagctgcgagaagagttagggaagatgtttgctatcgaagggttgttggaagacccccttagatcaggctggcagcttgtattcgttgacaaggaaaatgatattcttctccttggtgatgacccatgggagtcatttgtgaataacgtttggtacataaagatactatcaccagaagatgtgcatcaaatgggagatcatggagaaggcagtggtgggttattcccgcaaaacccgacccatctctagaagctgcttcggtgttagtctcatcatgctacaacgcgggagccctttgtttcccatttgaagtcgtttccactcatctttatatgccattcgttcgcatctctctcgttttgacgtttttagaaagaaacataatcatatttgtgagtatgggtcctgaaactttaggacgtactttagcttgtattagacagacactctcgtcataaacataagaacctttatgtagctgtctcagggtaactaaacttttctag

SEQ ID NO: 278 - protein, 811 aa, Arabidopsis thaliana
  G1451  (conserved domain in AA coordinates: 22-357)
MKLSTSGLGQQGHEGEKCLNSELWHACAGPLVSLPSSGSRVVYFPQGHSEQVAATTNKEVDGHIPNYPSLPPQLICQLHNVTMHADVETDEVYAQMTLQPLTPEEQKETFVPIELGIPSKQPSNYFCKTLTASDTSTHGGFSVPRRAAEKVFPPLDYTLQPPAQELIARDLHDVEWKFRHIFRGQPKRHLLTTGWSVFVSAKRLVAGDSVIFIRNEKNQLFLGIRHATRPQTIVPSSVLSSDSMHIGLLAAAAHASATNSCFTVFFHPRASQSEFVIQLSKYIKAVFHTRISVGMRFRMLFETEESSVRRYMGTITGISDLDSVRWPNSHWRSVKVGWDESTAGERQPRVSLWEIEPLTTFPMYPSLFPLRLKRPWHAGTSSLPDGRGDLGSGLTWLRGGGGEQQGLLPLNYPSVGLFPWMQQRLDLSQMGTDNNQQYQAMLAAGLQNIGGGDPLRQQFVQLQEPHHQYLQQSASHNSDLMLQQQQQQQASRHLMHAQTQIMSENLPQQNMRQEVSNQPAGQQQQLQQPDQNAYLNAFKMQNGHLQQWQQQSEMPSPSFMKSDFTDSSNKFATTASPASGDGNLLNFSITGQSVLPEQLTTEGWSPKASNTFSEPLSLPQAYPGKSLALEPGNPQNPSLFGVDPDSGLFLPSTVPRFASSSGDAEASPMSLTDSGFQNSLYSCMQDTTHELLHGAGQINSSNQTKNFVKVYKSGSVGRSLDISRFSSYHELREELGKMFAIEGLLEDPLRSGWQLVFVDKENDILLLGDDPWESFVNNVWYIKILSPEDVHQMGDHGEGSGGLFPQNPTHL

SEQ ID NO: 279 - DNA, 1371 bp, Arabidopsis thaliana
  G1452
atttattaagcatcaatgagagaacttcagagctgggtttgagttctgtccaataatacataaccacgttatcatttttgtcctttactatctcattacactcttctgttattcgcccaattcttacagtcattactctctatagggctcgagcggccgcccgggcaggtttctatgcagatggttcacacttcccgctccattgcccagattgggttcggtgttaagtcgcaattagtactcactatagggctcgagcggccgcccgggcaggtaaaagatcaaacaatgtctaaagaagctgagatgtcgatcgcggtgtcggctttgttccctggttttagattctctcctactgatgttgaacttatctcgtactatcttcgtcgtaaaatcgatggtgatgagaactctgttgctgtgattgctgaggtcgagatttacaagttcgagccgtgggacttgccagaggaatcgaaactgaaatcggagaacgagtggttttacttctgcgcgagggggaggaagtacccgcacgggtcacaaagccggcgagccacacagctaggatattggaaagcgaccggtaaagagcggagtgttaaatccgggaaccaagttgttggaaccaagagaacgcttgtatttcatatcggtcgggctcctcgtggcgagagaacggagtggattatgcatgaatactgcatccatggagccccacaggatgcattagtggtgtgccggttaagaaaaaatgctgattttcgggctagttcgacccaaaaaattgaggatggtgttgtgcaagacgatggctacgttggccaaagaggtggtttggacaaggaggacaaatcctactatgaatctgagcatcagataccaaatggtgacatcgcagaatcatcaaatgttgttgaggatcaggccgataccgatgatgattgttacgccgagattctgaacgatgatataataaagctcgacgaagaagcgttgaaagctagccaagcgtttcgaccaactaatccaactcatcaagaaacaatatcaagcgagtcatcgagtaagaggtcaaaatgtggtataaaaaaagaatcaacggaaacaatgaattgttacgctttgttcaggatcaagaacgttgccggaaccgactccagctggagattcccgaacccgttcaaaatcaagaaagatgatagccagagattgatgaagaatgttctggccactactgttttcttggctatcttattttctttcttttggactgtattaatagctaggaactaaagctagttacgacatacatattatttatacataaataaatatagtattttgtctatggcaaaaaaaaaaaaaaaa

SEQ ID NO: 280 - protein, 373 aa, Arabidopsis thaliana
  G1452  (conserved domain in AA coordinates: 30-177)
MQMVHTSRSIAQIGFGVKSQLVLTIGLERPPGQVKDQTMSKEAEMSIAVSALFPGFRFSPTDVELISYYLRRKIDGDENSVAVIAEVEIYKFEPWDLPEESKLKSENEWFYFCARGRKYPHGSQSRRATQLGYWKATGKERSVKSGNQVVGTKRTLVFHIGRAPRGERTEWIMHEYCIHGAPQDALVVCRLRKNADFRASSTQKIEDGVVQDDGYVGQRGGLDKEDKSYYESEHQIPNGDIAESSNVVEDQADTDDDCYAEILNDDIIKLDEEALKASQAFRPTNPTHQETISSESSSKRSKCGIKKESTETMNCYALFRIKNVAGTDSSWRFPNPFKIKKDDSQRLMKNVLATTVFLAILFSFFWTVLIARN

SEQ ID NO: 281 - DNA, 1319 bp, Arabidopsis thaliana
  G1463
tatccttcgcaagacccttcctctatataaggaagttcatttcatttggagaggacacgctgacaagctgactctagcagatctggtaccgtcgacagtttgagatttgcttcatccggtttttttattttctgcaaaatatgtcactctctcccattttgttcatatataatatgtttgaagtttgatcaacttagtatgcgtttctttttctctctagttcctctgtttcttggtcgatttagtttcgttatggcggacacactgctcaacgcagaagacgaagtaataatctcacgttatctgaagcctatgatcgttaacagagtatcatggcctgatctcttcatcgaagacgcagacgtgttcaacaaggatccatatgtgaagttccatgctgagatccctagcttcgtgatcgttaaaccacgaacaaaggcttgtggtaaaaccgatggatgtgattcgggttgctggaggatcattggtcgtgataagctgataaagtcggaggagactggtaagattctagggttcaagaagatactcaagttctgcctaaagtggaaacctagagaatacaagagaagtttggtaatggaagagtataggcttaccaataacttcaactggaagcaagatcatgtgatttgcaagattcggcttttgtttgaagcagaaattagtttcttgctagccaagcatttctacactacatcagactcacttcctcgaaatgtgctgttgccagcttatggattctgttcaccagataaacaagaggaggacgaattttatccggtgacgataatgatttcagaaggaaaagattggcctagctacgttaccaacaacgtgtattgtctgcatccatcggagcttgtgaatgttcacgatgggaagtttcatgataacggaatctgcatcttcgctaacaggacttgtggtgtaaccgataaatgcaatgaaggttactggaagattaagcaccgtgagaagctgatcatgtcacggtacgggcagaccattggttggaagaaagtttttcagttttatgaaacggagaaagaaagacattttggtaatggagaagaagtgaaggtaacttggactctaaaagagtataggcttaccagaaaaatgaacaagaataaagtggtgtgcgttatcaagtataaggtaaagtgtttaccgaggataactagctagggacttctactcttggtttcatgatcgatgcgaccgctctagacaggcctcgtaccggatcctctagctagagctttcgttcgtatcatcggtttcgacaacgttcgtca

SEQ ID NO: 282 - protein, 336 aa, Arabidopsis thaliana
  G1463  (conserved domain in AA coordinates:9-156)
MRFFFSLVPLFLGRFSFVMADTLLNAEDEVIISRYLKPMIVNRVSWPDLFIEDADVFNKDPYVKFHAEIPSFVIVKPRTKACGKTDGCDSGCWRIIGRDKLIKSEETGKILGFKKILKFCLKWKPREYKRSLVMEEYRLTNNFNWKQDHVICKIRLLFEAEISFLLAKHFYTTSDSLPRNVLLPAYGFCSPDKQEEDEFYPVTIMISEGKDWPSYVTNNVYCLHPSELVNVHDGKFHDNGICIFANRTCGVTDKCNEGYWKIKHREKLIMSRYGQTIGWKKVFQFYETEKERHFGNGEEVKVTWTLKEYRLTRKMNKNKVVCVIKYKVKCLPRITS

SEQ ID NO: 283 - DNA, 735 bp, Arabidopsis thaliana
  G1471
atggagaaccaatctatgtcttcatcaagctcctccacacacaaacatgatcaaaaactcaaaagttccgttgtggccatggaggtcctggaggagaaggagacagtgaacaatccgccccagtattataataagatctacatctgttacttgtgcaagagagcgttcccaacccctcatgcccttggcggtcacggaaccacccacaaggaggaccgagaattggagaggcaacagatcgagtcaaggctttctaacaaagacaagtctaacttgctctttggtgggtcttcacaagatgttttatcaaatgataatcaccttggactctctcttggtccattgaagtccatagaaggtagcagcagcagcaacaacgttaacccattgcttaatgttggagtccctagaggaaccacagatatgaacatgaacaactatagctcacatgctttatcaactgatgatattaatcttgatcttactcttggtccatctaagtccataggagatagcaacaatatcattaataacaacactaactcatccttcgatgggaatctgatcattcccgttcgtcctcgtgtgtctagataccattttgttgctgggaacccccttgattcaatctctagaaacattcctccttctattacttttcctcatctaaacatcaatctttctcatgattcgttttctttacaagagaatggttcgggctctagtcactcataa

SEQ ID NO: 284 - protein, 244 aa, Arabidopsis thaliana
  G1471  (conserved domain in AA coordinates: 49-70)
MENQSMSSSSSSTHKHDQKLKSSVVAMEVLEEKETVNNPPQYYNKIYICYLCKRAFPTPHALGGHGTTHKEDRELERQQIESRLSNKDKSNLLFGGSSQDVLSNDNHLGLSLGPLKSIEGSSSSNNVNPLLNVGVPRGTTDMNMNNYSSHALSTDDINLDLTLGPSKSIGDSNNIINNNTNSSFDGNLIIPVRPRVSRYHFVAGNPLDSISRNIPPSITFPHLNINLSHDSFSLQENGSGSSHS

SEQ ID NO: 285 - DNA, 354 bp, Arabidopsis thaliana
  G1478
atgtgtagagggtttgagaaagaagaagagagaagaagcgacaatggaggatgccaaagactatgcacggagagtcacaaagctccggtaagctgtgagctttgcggcgagaacgccaccgtgtattgtgaggcagacgcagctttcctttgtaggaaatgcgatcgatgggtccattctgctaattttctagctcggagacatctccggcgcgtgatctgcacgacctgtcggaagctaactcgtcgatgtcttgtcggtgataattttaatgttgttttaccggagataaggatgatagcaaggattgaagaacatagtagtgatcacaaaattccctttgtgtttctctga

SEQ ID NO: 286 - protein, 117 aa, Arabidopsis thaliana
  G1478  (conserved domain in aa coordinates: 32-76)
MCRGFEKEEERRSDNGGCQRLCTESHKAPVSCELCGENATVYCEADAAFLCRKCDRWVHSANFLARRHLRRVICTTCRKLTRRCLVGDNFNVVLPEIRMIARIEEHSSDHKIPFVFL

SEQ ID NO: 287 - DNA, 1131 bp, Arabidopsis thaliana
  G1482
cgtcgacaccaccatctctatctctctcttaatcgatcgatgaagatcaggtgcgacgtctgcgataaagaagaagcgtcggtgttttgcacggccgacgaagcatctctctgcggcggctgcgaccaccaagtccaccacgctaacaaactcgcctctaaacatctccgtttctctctcctttatccttcttcttccaacacctcctctcctctctgcgacatctgtcaggataaaaaagctctgttgttctgtcaacaagatagagctattttatgcaaagattgcgattcatcgatccacgctgcgaacgaacacacaaagaaacacgataggtttcttcttacaggggttaagctctctgcaacatcgtctgtttacaaacctacttcgaaatcttcttcttcttcttcaagcaaccaagatttctctgtccctggatcatcaatctctaatcctcctcctctcaagaaacctctctcagctcctcctcagagcaacaagatccaacccttttcgaagatcaacggcggtgatgcgtcggtgaatcagtggggatccacaagcacgatttctgagtatttgatggatacgttacctggttggcacgttgaggatttcctcgattcctctcttcctacttatggtttctctaagagtggtgatgatgatggagtgttaccatatatggaaccagaagatgacaacaacactaagagaaacaacaacaacaacaacaacaacaacaacaatacagtgtcacttccatctaagaatttagggatttgggtccctcagattccacaaactcttccttcttcatacccaaatcaatacttttctcaagacaacaacatacagtttgggatgtacaacaaagaaacatcaccagaagtagtgtcttttgctccaatacaaaacatgaaacaacaaggacagaacaacaagagatggtatgatgatggtggcttcactgtcccacagatcactcctcctcctctttcttctaataaaaagtttagatctttctggtaattttactatcttccctaaatgggggagttttttttttgtttgtttgtttctccttcatttctcccaactttgatctcagaattaggcgcggccgct

SEQ ID NO: 288 - protein, 331 aa, Arabidopsis thaliana
  G1482  (conserved domain in aa coordinates: 5-63)
MKIRCDVCDKEEASVFCTADEASLCGGCDHQVHHANKLASKHLRFSLLYPSSSNTSSPLCDICQDKKALLFCQQDRAILCKDCDSSIHAANEHTKKHDRFLLTGVKLSATSSVYKPTSKSSSSSSSNQDFSVPGSSISNPPPLKKPLSAPPQSNKIQPFSKINGGDASVNQWGSTSTISEYLMDTLPGWHVEDFLDSSLPTYGFSKSGDDDGVLPYMEPEDDNNTKRNNNNNNNNNNNTVSLPSKNLGIWVPQIPQTLPSSYPNQYFSQDNNIQFGMYNKETSPEVVSFAPIQNMKQQGQNNKRWYDDGGFTVPQITPPPLSSNKKFRSFW

SEQ ID NO: 289 - DNA, 996 bp, Arabidopsis thaliana
  G1488
atggaagatgaagcacatgaattcttccacacatctgattttgccgttgatgaccttttagttgatttctctaacgatgatgacgaagaaaacgatgttgttgctgattccaccactaccaccaccataaccgacagctctaacttctccgctgctgatcttcccagtttccacggtgatgttcaagacggcactagcttctccggtgacctttgtataccttctgatgatttggctgatgagttagagtggctttcgaacattgtggatgaatcattgtcgcctgaagatgtacacaagctcgagctaatatccggttttaagagtcgaccggacccgaaatccgataccggaagcccggaaaacccgaatagcagcagtccgatttttactaccgacgtttctgtaccggccaaagctagaagcaaacgctcacgcgccgctgcgtgtaattgggcctcacgtgggcttctcaaggaaacgttttacgacagtcctttcaccggagaaaccattctctctagccaacaacacttgtctccgccaacctcgccgcctttgttgatggctccgctagggaaaaagcaagccgttgatggaggacaccgacggaagaaggatgtttcttcaccggagtctggtggcgcagaggagagacggtgtctccactgcgccacggataagactccgcaatggcggacaggcccaatgggcccgaagacgttgtgcaacgcttgcggtgttaggtacaaatcgggacgtttagtgccggagtatcggcccgcggcgagtccgacgtttgtgctggcgaaacactcaaattctcatcggaaagttatggagctccggcgacagaaggagatgagtagggcccatcatgagttcatacatcaccatcacggtacggacactgccatgattttcgacgtttcatcggacggtgatgattacttgatccaccacaacgttggcccagatttcagacagcttatttga

SEQ ID NO: 290 - protein, 331 aa, Arabidopsis thaliana
  G1488  (conserved domain in AA coordinates: 221-246)
MEDEAHEFFHTSDFAVDDLLVDFSNDDDEENDVVADSTTTTTITDSSNFSAADLPSFHGDVQDGTSFSGDLCIPSDDLADELEWLSNIVDESLSPEDVHKLELISGFKSRPDPKSDTGSPENPNSSSPIFTTDVSVPAKARSKRSRAAACNWASRGLLKETFYDSPFTGETILSSQQHLSPPTSPPLLMAPLGKKQAVDGGHRRKKDVSSPESGGAEERRCLHCATDKTPQWRTGPMGPKTLCNACGVRYKSGRLVPEYRPAASPTFVLAKHSNSHRKVMELRRQKEMSRAHHEFIHHHHGTDTAMIFDVSSDGDDYLIHHNVGPDFRQLI

SEQ ID NO: 291 - DNA, 1424 bp, Arabidopsis thaliana
  G1494
tcgacagagttgtgttgggcgtggaacttggactagttccacatatcaggttatatagatcttctctttcaacttctgattcgtccagaagctttcctaatctgagatctgacatggaacaccaaggttggagttttgaggagaattatagtttgtccactaatagaagatctatcaggccacaagatgaactagtggagttattatggcgagatggacaagtggttctgcagagccaaactcatagagaacaaacccaaacccagaaacaagatcatcatgaagaagccctaagatccagcacctttcttgaagatcaagaaactgtctcttggatccaataccctccagatgaagacccattcgaacccgacgacttctcctcccacttcttctcaaccatggatcccctccagagaccaacctcagagacggttaagcctaagtccagtcctgaacctcctcaagtcatggttaagcctaaggcctgtcctgaccctcctcctcaagtcatgcctcctccaaaatttaggttaacaaattcatcatcggggattagggaaacagaaatggaacagtactcggtaacgaccgttggacctagccattgcggaagcaacccatcacagaacgatctcgatgtctcaatgagtcatgatcgaagcaaaaacatagaagaaaagcttaatccgaacgcaagttcctcatcaggtggctcctctggttgcagctttggcaaagatatcaaagaaatggctagtggaagatgcatcacaaccgaccgtaagagaaaacgtataaatcacactgacgaatctgtatctctatcagatgcaatcggtaacaagtcgaaccaacgatcaggatcaaaccgaaggagtcgagcagctgaagttcataatctctccgaaaggaggaggagagataggatcaatgagagaatgaaggctttgcaagaactaatacctcactgcagtaaaactgataaagcttcgattttagacgaagccatagattatttgaaatcacttcagttacagcttcaagtgatgtggatggggagtggaatggcggcggcggcggcttcggctccgatgatgttccccggagttcaacctcagcagttcatacgtcagatacagagcccggtacagttacctcgatttccggttatggatcagtctgcaattcagaacaatcccggtttagtttgccaaaacccggtacaaaaccagatcatctccgaccggtttgctagatacatcggtgggttcccacacatgcaggccgcgactcagatgcagccgatggagatgttgagatttagttcaccggcgggacagcaaagtcaacaaccgtcgtctgtgccgacgaagaccaccgacggttctcgtttggaccactaggttggtgagccactttgc

SEQ ID NO: 292 - protein, 430 aa, Arabidopsis thaliana
  G1494  (conserved domain in aa coordinates: 261-311)
MEHQGWSFEENYSLSTNRRSIRPQDELVELLWRDGQVVLQSQTHREQTQTQKQDHHEEALRSSTFLEDQETVSWIQYPPDEDPFEPDDFSSHFFSTMDPLQRPTSETVKPKSSPEPPQVMVKPKACPDPPPQVMPPPKFRLTNSSSGIRETEMEQYSVTTVGPSHCGSNPSQNDLDVSMSHDRSKNIEEKLNPNASSSSGGSSGCSFGKDIKEMASGRCITTDRKRKRINHTDESVSLSDAIGNKSNQRSGSNRRSRAAEVHNLSERRRRDRINERMKALQELIPHCSKTDKASILDEAIDYLKSLQLQLQVMWMGSGMAAAAASAPMMFPGVQPQQFIRQIQSPVQLPRFPVMDQSAIQNNPGLVCQNPVQNQIISDRFARYIGGFPHMQAATQMQPMEMLRFSSPAGQQSQQPSSVPTKTTDGSRLDH

SEQ ID NO: 293 - DNA, 1306 bp, Arabidopsis thaliana
  G1496
aaacccaccaaataactcagagcttttttgcattttttcccattctctattttgttttgtacttttggtctcactttaaaagatcataagttgaaagatttctgcagagaacaatatgttggaaggtcttgtctctcaagaaagcttgtccttaaactctatggacatgtctgtacttgaaaggcttaaatgggtacaacagcaacaacagcaactgcaacaagttgtgtcccatagcagtaataattcacctgaacttcttcagatacttcagttccatggaagcaacaatgatgagttgttggagagtagtttcagccaatttcaaatgcttggatctggttttggaccaaactataacatgggttttggtcctccacatgaatccatttcaagaacaagtagctgccatatggaacctgtggatacaatggaggttttgttgaagaccggtgaagaaaccagagccgttgccttgaagaacaagagaaaaccagaggttaagacaagggaagagcaaaagacagagaagaagatcaaagtagaggctgagacagagtcaagcatgaaaggaaaatcaaacatgggaaacactgaagcatcttcagacacttcaaaggagacatcgaaaggagcttcagagaatcagaaattagattatatccacgtgagagctcgtcgaggccaagccactgacagacacagcttagcagaaagggcgagaagagaaaagatcagcaagaaaatgaaatatctgcaagatattgtgcctggatgcaataaggtcacaggaaaagctggtatgcttgatgagatcatcaattatgttcaatgtctccaaagacaagtcgagttcctgtcgatgaaacttgctgtcttgaacccggaactagagcttgccgtggaagatgtatccgtaaaacaggcttactttacaaatgtagttgcttcaaagcaatcaataatggttgatgtgccattgtttccgttagaccagcaaggatctctagatttgtctgcgataaacccgaaccaaacgacatctatcgaagctccatctggaagctgggaaactcaatcacagagtctctacaacacatctagcctcggttttcattactaagcaagattcattgaaacaacatggttgacatcaatcaatcatcaaaatcagaagcaaattctattacatttgctcatcaaagtagtaatttcgaaatttggttaatgcattatcctttgatccttgttttctgatatttaaaccagaagaactggagatagcaatccaatgatcttgtcacca

SEQ ID NO: 294 - protein, 335 aa, Arabidopsis thaliana
  G1496  (conserved domain in AA coordinates: 184-248)
MLEGLVSQESLSLNSMDMSVLERLKWVQQQQQQLQQVVSHSSNNSPELLQILQFHGSNNDELLESSFSQFQMLGSGFGPNYNMGFGPPHESISRTSSCHMEPVDTMEVLLKTGEETRAVALKNKRKPEVKTREEQKTEKKIKVEAETESSMKGKSNMGNTEASSDTSKETSKGASENQKLDYIHVRARRGQATDRHSLAERARREKISKKMKYLQDIVPGCNKVTGKAGMLDEIINYVQCLQRQVEFLSMKLAVLNPELELAVEDVSVKQAYFTNVVASKQSIMVDVPLFPLDQQGSLDLSAINPNQTTSIEAPSGSWETQSQSLYNTSSLGFHY

SEQ ID NO: 295 - DNA, 902 bp, Arabidopsis thaliana
  G1499
tcgactccttaattgcatcaccaacctaacccctcatcatatgatcacctttctttttttcctttaatatatatatatgctcacacacacacatatatatatacatataagcatcgcctcaagcattaaaatttttacgaaccaaacaaacaaaaattatgaataattataatatgaacccatctctcttccaaaattacacttggaacaacatcatcaacagcagcaacaacaacaacaagaatgatgatcatcatcatcaacataataatgatccaatcggtatggccatggaccagtacacacagctccatatcttcaatcctttctcttcttctcatttccctcctctctcttcttccctcacaaccaccactcttctctccggagatcaagaagacgacgaagacgaagaagaacctctagaggaactcggtgctatgaaggaaatgatgtacaagatcgcagccatgcaatcggttgacatcgacccagcaaccgtcaagaaacccaaacgccgtaacgtgaggatctccgacgaccctcagagtgtggcggctagacatcgccgtgagagaatcagtgagaggatcagaattcttcagagactcgtgccaggtggcactaaaatggatacggcttcaatgctcgatgaagctatacgctatgtcaagttcttgaaacggcagatccggctactcaataataataccggatatactcctccgccgccgcaagatcaagcttctcaggcggtgacgacgtcatgggtttcaccgccaccaccgccaagtttcggccgtgggggaagaggagtaggagaattaatctagacaagatgacatttccattagtagtaactaaattatgctataatgtgtgagtaatggtgcaattatgga

SEQ ID NO: 296 - protein, 224 aa, Arabidopsis thaliana
  G1499  (conserved domain in AA coordinates: 118-181)
MNNYNMNPSLFQNYTWNNIINSSNNNNKNDDHHHQHNNDPIGMAMDQYTQLHIFNPFSSSHFPPLSSSLTTTTLLSGDQEDDEDEEEPLEELGAMKEMMYKIAAMQSVDIDPATVKKPKRRNVRISDDPQSVAARHRRERISERIRILQRLVPGGTKMDTASMLDEAIRYVKFLKRQIRLLNNNTGYTPPPPQDQASQAVTTSWVSPPPPPSFGRGGRGVGELI

SEQ ID NO: 297 - DNA, 1146 bp, Arabidopsis thaliana
  G1519
atgaggcttaatggggattcgggtccgggtcaggatgaacccggttcgagcgggtttcacggcggaatcagacgattcccgttagcagctcagccggagattatgagagctgctgagaaagacgatcaatacgcttctttcatccacgaagcttgccgcgatgccttccgacaccttttcggtacaagaatcgctcttgcttaccagaaggagatgaagctacttggacagatgctttactatgttcttacgacaggttcagggcaacaaactttaggagaggaatattgtgacattatacaggttgcagggccttatggactctctcctacaccagctagacgtgctttgttcatattgtaccagaccgcagttccatatatcgcagagagaattagcactcgagctgctacgcaagcagtcacctttgatgagtctgatgagttttttggtgatagtcatatccactcaccaagaatgatagatcttccatcttcatctcaagttgaaacttcaacttctgtagtatctaggttaaacgatagacttatgagatcgtggcaccgagctattcagcgatggcctgtggttcttcctgttgcccgcgaagtcttacaactggttttgcgtgccaatctgatgctcttctactttgaaggtttttattatcatatatcgaaacgtgcatccggggttcgttatgttttcataggaaagcaactgaatcagagacctagataccaaattcttggggttttccttctaatccaattgtgcatccttgctgctgagggcttgcgtcggagtaatttgtcatctatcactagctccattcagcaggcttctataggatcttatcaaacttcaggagggagaggtttacctgttttaaatgaagaggggaatttgataacttcggaagctgaaaagggaaactggtctacctccgattcaacttcaacggaggcagtagggaaatgcactctctgcttaagcacccgtcagcacccaacggccactccttgtggtcatgtgttttgttggagctgcattatggaatggtgcaacgagaagcaagaatgccctctttgtcgaacgcccaatacccattcaagtttggtttgtttgtatcattctgatttttag

SEQ ID NO: 298 - protein, 381 aa, Arabidopsis thaliana
  G1519  (conserved domain in AA coordinates: 327-364)
MRLNGDSGPGQDEPGSSGFHGGIRRFPLAAQPEIMRAAEKDDQYASFIHEACRDAFRHLFGTRIALAYQKEMKLLGQMLYYVLTTGSGQQTLGEEYCDIIQVAGPYGLSPTPARRALFILYQTAVPYIAERISTRAATQAVTFDESDEFFGDSHIHSPRMIDLPSSSQVETSTSVVSRLNDRLMRSWHRAIQRWPVVLPVAREVLQLVLRANLMLFYFEGFYYHISKRASGVRYVFIGKQLNQRPRYQILGVFLLIQLCILAAEGLRRSNLSSITSSIQQASIGSYQTSGGRGLPVLNEEGNLITSEAEKGNWSTSDSTSTEAVGKCTLCLSTRQHPTATPCGHVFCWSCIMEWCNEKQECPLCRTPNTHSSLVCLYHSDF

SEQ ID NO: 299 - DNA, 3090 bp, Arabidopsis thaliana
  G1526
atgggaacgaaagtctcagacgatcttgtttccaccgtcagatcagtcgtgggttccgattactcagatatggatataatcagggctttacacatggcgaatcatgatccaacggctgctatcaatataatcttcgacactccaagtttcgccaaacctgatgtagccactcctaccccgagcggctctaatggagggaagcgagttgatagtggattaaagggctgtacttttggtgacagcggaagtgttggagcgaatcatcgcgtggaggaagaaaatgagagtgttaatggtggaggagaagagagtgtttcagggaatgagtggtggtttgttggttgttctgaattggctgggttatcgacatgtaaaggaaggaaattgaagtctggtgatgaattggtgttcacgtttccgcatagtaaaggattaaagcctgagactacgcctgggaagcgcggttttgggcggggaaggccagctttgcgtggtgcttctgatatcgttaggttctctacaaaggattcaggagagattggtagaataccaaacgagtgggctcggtgtcttctaccacttgtgagagacaagaaaattaggatagaaggcagttgcaagtcggcgcctgaagctttgagcatcatggatacaattcttctgtctgtaagcgtgtacattaatagttccatgtttcaaaagcatagtgcgacttcatttaagacagctagtaatacggcagaggaatcaatgttccatcctctcccaaatctctttcggttactcggtttgatcccctttaagaaggcagagtttactccagaggatttttactctaagaagcgacctttgagttccaaggatggttctgctattcctacttcgttgcttcaattaaacaaggtcaagaatatgaatcaagatgcaaacggagatgaaaatgagcagtgtatcagcgatggtgatcttgataacattgttggtgttggggacagttctggattaaaggaaatggaaactccacatacacttctgtgtgagcttcgtccataccaaaagcaggcacttcattggatgacccaactggagaaaggaaattgcactgatgaggcagcaacaatgcttcacccgtgttgggaagcatactgtttagcagacaagagggaactggttgtctacctgaattcttttactggtgatgctacaatacacttccctagcacacttcaaatggcaagaggaggaatattagcagacgcaatgggtcttggaaagactgtaatgaccatatcccttttgcttgcccattcttggaaagctgcatcaactgggtttctatgccccaactatgaaggagacaaagtgatcagcagttctgtagatgatctcactagtcccccggtgaaggcaaccaaatttctaggctttgataagaggcttcttgaacaaaaaagtgtacttcaaaatggtggtaacctgattgtatgtccgatgacacttttaggacagtggaagacagagattgaaatgcatgcaaagcctgggtctctatctgtctatgttcactatgggcaaagcaggccgaaggatgcaaaacttctttcccagagtgatgtggtaatcaccacatatggagttctaacatccgaattctcgcaagagaactcagcagaccatgaaggaatttatgcagttcgatggtttaggattgttcttgacgaggcacataccatcaaaaactcaaaaagccaaatttccttggctgctgcagctctggttgctgataggcgttggtgtcttacgggtactcctattcagaacaatctggaggatttatacagccttctacggtttttgaggattgaaccatggggaacttgggcatggtggaataaacttgtccaaaagccatttgaagagggtgatgagagagggttaaagctagtgcagtctatcttaaaacctatcatgcttaggagaacaaagtctagcacagaccgagaaggaaggccgattcttgttctaccccctgctgatgcacgggtcatttactgtgaactttcggagtctgagagggatttctacgacgcgctatttaaaagatccaaggtcaaatttgatcaatttgttgaacaaggcaaagttcttcataactatgcttcgatcctggaactgcttttgcgtcttcgacaatgttgtgatcacccatttttagtaatgagtcgaggggatacagcggaatactctgatctgaataagctttctaaacgtttccttagtggaaagtcttctggcttagaaagggaaggaaaagatgtaccgtcagaggcttttgttcaggaggtggtagaggaactgcgcaaaggagagcaaggagagtgtccaatatgccttgaagcacttgaggatgctgtattaacgccatgtgctcatagattatgtcgtgagtgtctcttggcaagttggagaaattctacttctgggttatgtcctgtgtgtaggaacactgtaagcaaacaagaactcatcacagcaccaaccgaaagtagattccaggttgacgtggaaaagaattgggtggaatcatcgaaaatcactgctcttctggaagagcttgaaggtcttcgttcttcaggctctaagagcattctctttagccagtggaccgctttcctcgatctcctccaaattcccctctctcggaataacttttcatttgtccgtcttgatggcacgctaagtcagcagcaacgagagaaggtccttaaagaattttccgaagatggcagtatcctggtactgttgatgtctctaaaagctggtggcgttgggataaatctaacagctgcgtccaatgcttttgtcatggatccatggtggaacccagcggtagaggaacaagctgttatgcgtattcatcgtatagggcaaactaaggaagtcaaaatcagaagattcatcgttaagggaacggttgaagagagaatggaggcggttcaggcgaggaagcagagaatgatctctggggctttaaccgatcaagaagtacgaagtgcacgtatagaggaactcaagatgttatttacctga

SEQ ID NO: 300 - protein, 1029 aa, Arabidopsis thaliana
  G1526  (conserved domain in AA coordinates: 493-620, 864-1006)
MGTKVSDDLVSTVRSVVGSDYSDMDIIRALHMANHDPTAAINIIFDTPSFAKPDVATPTPSGSNGGKRVDSGLKGCTFGDSGSVGANHRVEEENESVNGGGEESVSGNEWWFVGCSELAGLSTCKGRKLKSGDELVFTFPHSKGLKPETTPGKRGFGRGRPALRGASDIVRFSTKDSGEIGRIPNEWARCLLPLVRDKKIRIEGSCKSAPEALSIMDTILLSVSVYINSSMFQKHSATSFKTASNTAEESMFHPLPNLFRLLGLIPFKKAEFTPEDFYSKKRPLSSKDGSAIPTSLLQLNKVKNMNQDANGDENEQCISDGDLDNIVGVGDSSGLKEMETPHTLLCELRPYQKQALHWMTQLEKGNCTDEAATMLHPCWEAYCLADKRELVVYLNSFTGDATIHFPSTLQMARGGILADAMGLGKTVMTISLLLAHSWKAASTGFLCPNYEGDKVISSSVDDLTSPPVKATKFLGFDKRLLEQKSVLQNGGNLIVCPMTLLGQWKTEIEMHAKPGSLSVYVHYGQSRPKDAKLLSQSDVVITTYGVLTSEFSQENSADHEGIYAVRWFRIVLDEAHTIKNSKSQISLAAAALVADRRWCLTGTPIQNNLEDLYSLLRFLRIEPWGTWAWWNKLVQKPFEEGDERGLKLVQSILKPIMLRRTKSSTDREGRPILVLPPADARVIYCELSESERDFYDALFKRSKVKFDQFVEQGKVLHNYASILELLLRLRQCCDHPFLVMSRGDTAEYSDLNKLSKRFLSGKSSGLEREGKDVPSEAFVQEVVEELRKGEQGECPICLEALEDAVLTPCAHRLCRECLLASWRNSTSGLCPVCRNTVSKQELITAPTESRFQVDVEKNWVESSKITALLEELEGLRSSGSKSILFSQWTAFLDLLQIPLSRNNFSFVRLDGTLSQQQREKVLKEFSEDGSILVLLMSLKAGGVGINLTAASNAFVMDPWWNPAVEEQAVMRIHRIGQTKEVKIRRFIVKGTVEERMEAVQARKQRMISGALTDQEVRSARIEELKMLFT

SEQ ID NO: 301 - DNA, 1227 bp, Arabidopsis thaliana
  G1540
atctctttactaccagcaagttgttttcttgctaacttcaaacttctctttctcttgttcctctctaagtcttgatcttatttaccgttaactttgtgaacaaaagtcgaatcaaacacacatggagccgccacagcatcagcatcatcatcatcaagccgaccaagaaagcggcaacaacaacaacaagtccggctctggtggttacacgtgtcgccagaccagcacgaggtggacaccgacgacggagcaaatcaaaatcctcaaagaactttactacaacaatgcaatccggtcaccaacagccgatcagatccagaagatcactgcaaggctgagacagttcggaaagattgagggcaagaacgtcttttactggttccagaaccataaggctcgtgagcgtcagaagaagagattcaacggaacaaacatgaccacaccatcttcatcacccaactcggttatgatggcggctaacgatcattatcatcctctacttcaccatcatcacggtgttcccatgcagagacctgctaattccgtcaacgttaaacttaaccaagaccatcatctctatcatcataacaagccatatcccagcttcaataacgggaatttaaatcatgcaagctcaggtactgaatgtggtgttgttaatgcttctaatggctacatgagtagccatgtctatggatctatggaacaagactgttctatgaattacaacaacgtaggtggaggatgggcaaacatggatcatcattactcatctgcaccttacaacttcttcgatagagcaaagcctctgtttggtctagaaggtcatcaagacgaagaagaatgtggtggcgatgcttatctggaacatcgacgtacgcttcctctcttccctatgcacggtgaagatcacatcaacggtggtagtggtgccatctggaagtatggccaatcggaagttcgcccttgcgcttctcttgagctacgtctgaactagctcttacgccggtgtcgctcgggattaaagctctttcctctctctctctctttcgtactcgtatgttcacaactatgcttcgctagtgattaatgatgcagttgttatattagtagttaactagttatctctcgttatgtgtaatttgtaattactagctaagtatcgtctaggtttaattgtaattgacaaccgtttatctctatgatgaataagttaaatttatatat

SEQ ID NO: 302 - protein, 291 aa, Arabidopsis thaliana
  G1540  (conserved domain in AA coordinates: 35-98)
MEPPQHQHHHHQADQESGNNNNKSGSGGYTCRQTSTRWTPTTEQIKILKELYYNNAIRSPTADQIQKITARLRQFGKIEGKNVFYWFQNHKARERQKKRFNGTNMTTPSSSPNSVMMAANDHYHPLLHHHHGVPMQRPANSVNVKLNQDHHLYHHNKPYPSFNNGNLNHASSGTECGVVNASNGYMSSHVYGSMEQDCSMNYNNVGGGWANMDHHYSSAPYNFFDRAKPLFGLEGHQDEEECGGDAYLEHRRTLPLFPMHGEDHINGGSGAIWKYGQSEVRPCASLELRLN

SEQ ID NO: 303 - DNA, 828 bp, Arabidopsis thaliana
  G1543
atgataaaactactatttacgtacatatgcacatacacatataaactatatgctctatatcatatggattacgcatgcgtgtgtatgtataaatataaaggcatcgtcacgcttcaagtttgtctcttttatattaaactgagagttttcctctcaaactttaccttttcttcttcgatcctagctcttaagaaccctaataattcattgatcaaaataatggcgattttgccggaaaactcttcaaacttggatcttactatctccgttccaggcttctcttcatcccctctctccgatgaaggaagtggcggaggaagagaccagctaaggctagacatgaatcggttaccgtcgtctgaagacggagacgatgaagaattcagtcacgatgatggctctgctcctccgcgaaagaaactccgtctaaccagagaacagtcacgtcttcttgaagatagtttcagacagaatcatacccttaatcccaaacaaaaggaagtacttgccaagcatttgatgctacggccaagacaaattgaagtttggtttcaaaaccgtagagcaaggagcaaattgaagcaaaccgagatggaatgcgagtatctcaaaaggtggtttggttcattaacggaagaaaaccacaggctccatagagaagtagaagagcttagagccataaaggttggcccaacaacggtgaactctgcctcgagccttactatgtgtcctcgctgcgagcgagttacccctgccgcgagcccttcgagggcggtggtgccggttccggctaagaaaacgtttccgccgcaagagcgtgatcgttga

SEQ ID NO: 304 - protein, 275 aa, Arabidopsis thaliana
  G1543  (conserved domain in AA coordinates: 135-195)
MIKLLFTYICTYTYKLYALYHMDYACVCMYKYKGIVTLQVCLFYIKLRVFLSNFTFSSSILALKNPNNSLIKIMAILPENSSNLDLTISVPGFSSSPLSDEGSGGGRDQLRLDMNRLPSSEDGDDEEFSHDDGSAPPRKKLRLTREQSRLLEDSFRQNHTLNPKQKEVLAKHLMLRPRQIEVWFQNRRARSKLKQTEMECEYLKRWFGSLTEENHRLHREVEELRAIKVGPTTVNSASSLTMCPRCERVTPAASPSRAVVPVPAKKTFPPQERDR

SEQ ID NO: 305 - DNA, 896 bp, Arabidopsis thaliana
  G1634
ttatctcgtagcctttaaacgatggagactctgcatccactactctcgcacgtgccaacttctgaccaccggtttgtagttcaagagatgatgtgcttgcaaagctcgagctggactaaagaagagaacaagaagtttgagcgagctcttgctgtctacgctgatgacacgcctgatcgctggttcaaagttgctgctatgatccctggaaagaccatatcagatgtcatgaggcaatactctaagcttgaagaagacctcttcgatatcgaagcaggacttgtcccgatcccgggttaccgttcagttactccttgtggatttgatcaggttgtgagtccacgtgactttgatgcgtatcgtaaacttcctaatggagccagaggatttgatcaagaccgtaggaaaggagttccatggacggaggaagaacacaggagattcttgttagggcttctcaagtatgggaaaggagattggagaaacatatcgaggaactttgtgggatcaaaaacaccaactcaggttgcaagtcatgcccaaaagtactaccaaagacagctttccggtgcgaaagacaaacgacggcctagcattcacgacatcaccaccgtcaatcttctcaatgccaatcttagccgtccatcgtctgatcacggttgcttagtctcaaaacaggccgagccgaaactagggttcaccgacagggataatgcagaggagggagttatgtttcttggtcagaatctatcctcggtcttctcttcctacgatcctgccattaagttttccggagcaaatgtttacggtgaaggaggttactgtatctcacaagatcttgaaacgagaaaatgagaattttgaaattttaactattgcaacgaaaccataattgc

SEQ ID NO: 306 - protein, 277 aa, Arabidopsis thaliana
  G1634  (conserved domain in AA coordinates: 129-180)
METLHPLLSHVPTSDHRFVVQEMMCLQSSSWTKEENKKFERALAVYADDTPDRWFKVAAMIPGKTISDVMRQYSKLEEDLFDIEAGLVPIPGYRSVTPCGFDQVVSPRDFDAYRKLPNGARGFDQDRRKGVPWTEEEHRRFLLGLLKYGKGDWRNISRNFVGSKTPTQVASHAQKYYQRQLSGAKDKRRPSIHDITTVNLLNANLSRPSSDHGCLVSKQAEPKLGFTDRDNAEEGVMFLGQNLSSVFSSYDPAIKFSGANVYGEGGYCISQDLETRK

SEQ ID NO: 307 - DNA, 954 bp, Arabidopsis thaliana
  G1637
atggtgaaggagacggtgacggtggcgaaaacgtgctcacactgtggccataatggccataacgcacggacttgtctcaacggcgttaataaggcaagtgttaaactgttcggcgttaatatatcgtctgatccgattaggccgcctgaggtaacggcgttaaggaagagtcttagtttgggaaaccttgatgctcttctcgctaacgatgaaagtaacggtagcggtgatcctatcgccgccgttgatgataccggttatcattccgatggtcagattcattccaagaagggtaaaactgctcatgagaagaaaaaggggaagccatggacggaagaagaacatcgtaatttcttaatcggtttaaacaaactcggaaaaggagattggagaggcattgcaaagagtttcgtgtcgacaagaacaccaacacaagtcgcaagtcatgctcagaaatattttattaggttaaacgttaacgacaagagaaaaagacgtgctagtctctttgacatctctctcgaagatcagaaggagaaagagaggaactctcaagatgcttcaacaaagactccacctaaacaaccaataaccggaattcaacaaccggtagtacaaggtcatactcaaaccgagatttcgaacaggtttcagaatttatcaatggagtatatgccaatctaccaacccataccaccttactacaactttccacctattatgtaccatccaaattatccaatgtactatgccaaccctcaagtaccggttaggtttgttcatccttctggtatacctgttccaagacatataccgattggtttgcctctgtctcaaccgagtgaagcttctaatatgacaaataaagacggtttggatcttcatatcggtttgcctccacaagctactggagcttctgacttgactggtcatggcgttattcatgtgaaatga

SEQ ID NO: 308 - protein, 317 aa, Arabidopsis thaliana
  G1637  (conserved domain in AA coordinates: 109-173)
MVKETVTVAKTCSHCGHNGHNARTCLNGVNKASVKLFGVNISSDPIRPPEVTALRKSLSLGNLDALLANDESNGSGDPIAAVDDTGYHSDGQIHSKKGKTAHEKKKGKPWTEEEHRNFLIGLNKLGKGDWRGIAKSFVSTRTPTQVASHAQKYFIRLNVNDKRKRRASLFDISLEDQKEKERNSQDASTKTPPKQPITGIQQPVVQGHTQTEISNRFQNLSMEYMPIYQPIPPYYNFPPIMYHPNYPMYYANPQVPVRFVHPSGIPVPRHIPIGLPLSQPSEASNMTNKDGLDLHIGLPPQATGASDLTGHGVIHVK

SEQ ID NO: 309 - DNA, 1300 bp, Arabidopsis thaliana
  G1640
ttcgccagatccttcctctatataaggaagttcatttcatttggagaggtttcgctgacaagctgctctagcttatctggtaccgtcgacctctcactcaagggtccaaaagtgttttctctttttcagtttctctttctctttttgacagaagagaccgagaagcaatgggaagggctccgtgttgtgagaaaatcgggttgaagagagggagatggacagccgaggaagatgagatcctcaccaagtatattcagaccaatggtgaaggttcttggcgatctttgcctaagaaagctggattgttgagatgtggaaagagctgtagactaaggtggataaactacttaagaagagacttaaaaagaggaaatattacttccgacgaagaagaaataatcgtcaagttgcattcccttctcggcaacagatggtcacttattgcaacacatctaccaggaagaacagacaacgaaattaaaaactattggaactcacatctcagccgcaaaatctatgccttcactgccgtttccggagatggacacaatctactcgtcaacgatgtagtcttgaagaaatcttgttcatcgtcttctggagccaagaacaataacaagaccaagaagaagaagaagggaaggactagtaggtcatccatgaagaaacacaagcaaatggtgacggcctcacaatgtttctcacaacctaaggagctagagagtgatttcagtgagggagggcaaaatggtaattttgaaggagagtctttggggccttatgagtggttggatggtgagttagaacggctcttgagtagttgtgtctgggaatgcactagtgaagaggctgtgattggagtaaatgatgaaaaggtgtgtgagagtggggacaatagtagttgttgtgttaatttgtttgaagaagaacaaggaagcgagacaaagattggtcacgtaggaatcacagaggttgatcatgatatgacggtggaaagagaaagagagggaagttttttaagttcgaattcaaatgaaaataatgataaagattggtgggttggtctatgtaattcttcagaagttgggtttggggttgatgaggagttgcttgattgggagtttcaaggtaatgtcacttgtcaaagtgatgatctatgggatctctcagatattggagagataacattggagtgattgtaccgagcaagtggattggcggccgctctagacaggcctcgtaccggatctctagctagagctttcgttcgtatcatcggtttcgacaacgttcgtcaagt

SEQ ID NO: 310 - protein, 342 aa, Arabidopsis thaliana
  G1640  (conserved domain in AA coordinates: 14-115)
MGRAPCCEKIGLKRGRWTAEEDEILTKYIQTNGEGSWRSLPKKAGLLRCGKSCRLRWINYLRRDLKRGNITSDEEEIIVKLHSLLGNRWSLIATHLPGRTDNEIKNYWNSHLSRKIYAFTAVSGDGHNLLVNDVVLKKSCSSSSGAKNNNKTKKKKKGRTSRSSMKKHKQMVTASQCFSQPKELESDFSEGGQNGNFEGESLGPYEWLDGELERLLSSCVWECTSEEAVIGVNDEKVCESGDNSSCCVNLFEEEQGSETKIGHVGITEVDHDMTVEREREGSFLSSNSNENNDKDWWVGLCNSSEVGFGVDEELLDWEFQGNVTCQSDDLWDLSDIGEITLE

SEQ ID NO: 311 - DNA, 1144 bp, Arabidopsis thaliana
  G1645
cgtcgacctcccaacactaactccatgtttataacggaaaaacaagtgtggatggatgagatcgtcgcaagaagagcttcttcttcttgggacttccctttcaacgacattaatattcatcagcatcatcatcgtcactgcaacacaagtcatgagtttgaaatcttgaagagtcctcttggagatgtagcggttcacgaagaagagagtaataataataaccctaatttcagtaacagcgagagtggtaagaaggagacaacagatagtggtcagtcttggtcctcgtcgtcttcaaaaccatcggtcttggggagaggacattggagaccagctgaagatgttaaactcaaagagcttgtctccatttacggcccacaaaactggaacctcatagctgaaaagcttcaaggaagatctgggaagagctgtagactacgatggtttaaccaattggacccgaggataaaccgaagagctttcacagaagaagaagaggagaggctgatgcaagcacataggctttatggtaacaaatgggcaatgattgcgaggcttttccctggtagaactgataattcagtgaagaaccattggcatgttgtcatggctcgtaagtatagagaacactcttctgcttaccgtaggagaaagcttatgagtaataatccacttaaacctcacctcaccaataatcatcatcctaaccctaaccctaattaccactcttttatctccactaatcattacttcgctcagcctttccccgagtttaatttgactcatcacctggttaataatgcccctatcacgagtgaccataaccagcttgtgttgcctttccattgctttcaaggttatgagaacaatgaacctccgatggttgtgagtatgtttggcaaccaaatgatggtcggcgataacgttggtgccacgtcagacgcgttatgcaatattccgcacattgaccctagtaaccaagagaaaccggagccaaatgatgcaatgcattggatcggaatggacgcggtagatgaggaggtgttcgaaaaggctaagcagcaaccacattttttcgattttcttggcttggggacggcgtgaatgttgaacaaattggtgttaatcagataacgacagtggc

SEQ ID NO: 312 - protein, 359 aa, Arabidopsis thaliana
  G1645  (conserved domain in AA coordinates: 90-210)
MFITEKQVWMDEIVARRASSSWDFPFNDINIHQHHHRHCNTSHEFEILKSPLGDVAVHEEESNNNNPNFSNSESGKKETTDSGQSWSSSSSKPSVLGRGHWRPAEDVKLKELVSIYGPQNWNLIAEKLQGRSGKSCRLRWFNQLDPRINRRAFTEEEEERLMQAHRLYGNKWAMIARLFPGRTDNSVKNHWHVVMARKYREHSSAYRRRKLMSNNPLKPHLTNNHHPNPNPNYHSFISTNHYFAQPFPEFNLTHHLVNNAPITSDHNQLVLPFHCFQGYENNEPPMVVSMFGNQMMVGDNVGATSDALCNIPHIDPSNQEKPEPNDAMHWIGMDAVDEEVFEKAKQQPHFFDFLGLGTA

SEQ ID NO: 313 - DNA, 800 bp, Arabidopsis thaliana
  G1646
gatcttttgatccaatcacaaggcaaagatccaatggacaataacaacaacaacaacaaccagcaaccaccaccaacctccgtctatccacctggctccgccgtcacaaccgtaatccctcctccaccatctggatctgcatcaatagtcaccggaggaggagcgacataccaccacctcctccagcaacaacagcaacagcttcaaatgttctggacataccagagacaagagatcgaacaggtaaacgatttcaaaaaccatcagctccctctagctcgtatcaaaaaaatcatgaaagctgatgaagatgtgcgtatgatctccgccgaagcaccgattctcttcgcgaaagcttgtgagcttttcattctcgaacttacgattagatcttggcttcacgctgaagagaacaaacgtcgtacgcttcagaaaaacgatatcgctgctgcgattactagaaccgatatcttcgatttccttgttgatattgttcctagggaagagatcaaggaagaggaagatgcagcatcggctcttggtggaggaggtatggttgctcccgccgcgagcggtgttccttattattatccaccgatgggacaaccggcggttcctggagggatgatgattggaagaccggcgatggatcctagcggtgtttatgctcagcctccttctcaggcatggcaaagcgtttggcagaattcagctggtggtggtgatgatgtgtcttatggaagtggaggaagtagcggccatggtaatctcgatagccaagggtaagtgaattctagtag

SEQ ID NO: 314 - protein, 250 aa, Arabidopsis thaliana
  G1646  (conserved domain in AA coordinates: 72-162)
MDNNNNNNNQQPPPTSVYPPGSAVTTVIPPPPSGSASIVTGGGATYHHLLQQQQQQLQMFWTYQRQEIEQVNDFKNHQLPLARIKKIMKADEDVRMISAEAPILFAKACELFILELTIRSWLHAEENKRRTLQKNDIAAAITRTDIFDFLVDIVPREEIKEEEDAASALGGGGMVAPAASGVPYYYPPMGQPAVPGGMMIGRPAMDPSGVYAQPPSQAWQSVWQNSAGGGDDVSYGSGGSSGHGNLDSQG

SEQ ID NO: 315 - DNA, 1387 bp, Arabidopsis thaliana
  G1652
agcaagtccaaatctccctctctctctctctatctatctctctatagaagattttttaactaagaagctagcgatcatggccacagcgatgaacgttttctctaccaaatggtcctccgaattggatatagaagaatatagtatcatccaccaattccacatgaactcactcgtcggagatgttccacagtctctctcatctcttgatgataccaccacttgttataaccttgatgcttcttgtaataaaagtttggtagaagaaagaccttcaaagatcctcaagaccactcacatatcaccaaacttacatcctttttcttcttctaatcctcctcctccaaagcaccagccctcttctaggattctttcttttgaaaagacaggtttacatgttatgaatcacaactctccaaacttaatatttagccccaaggacgaagaaattggattaccagagcataagaaagccgagctgataataagagggacaaagagagctcaatccttgactcgaagccaatcaaatgctcaagatcacatactggcagagagaaaacggagagagaagcttactcaaagatttgtagctctttccgcgctaattcctggcctaaagaagatggacaaggcttctgtgttgggagatgcaataaagcatataaagtacctccaagagagtgtgaaagagtatgaggaacaaaagaaggaaaagacaatggaatcagtggttcttgtaaagaagtctagtctggttttagatgaaaatcatcaaccatcatcatcatcttcctcagatggaaatcgcaatagctcgagctcaaatcttccagaaatagaagttagggtttcaggaaaagatgttcttattaagatcctatgcgagaagcaaaagggtaatgtgatcaagattatgggggagattgaaaagcttggtttgtctatcaccaacagcaatgtcttgccctttggacccacttttgacatctctattatcgctcagaagaataacaattttgatatgaaaatcgaggatgttgtgaagaacttgagttttggcttatcaaagctcacttaattggtttcacgttacatacatatacacattcatcatcgatttctccgatcgaagaatccaaaatcagtttttccatgaaagtggttttttagttgttaagtttgttgtatggagattcttaagtcatttaaagatccttgttcttgtgttgttaagtgtgctttaagatgcatatcatcaaatgtttagtaattatttctctccagtttcatttgggacggaatttttttcgcagttgttggatatatatttcctgcgatgtaaagcatttcgttagtttaataaacgtccgatatgtttctttgaaaa

SEQ ID NO: 316 - protein, 333 aa, Arabidopsis thaliana
  G1652  (conserved domain in AA coordinates:143-215)
MATAMNVFSTKWSSELDIEEYSIIHQFHMNSLVGDVPQSLSSLDDTTTCYNLDASCNKSLVEERPSKILKTTHISPNLHPFSSSNPPPPKHQPSSRILSFEKTGLHVMNHNSPNLIFSPKDEEIGLPEHKKAELIIRGTKRAQSLTRSQSNAQDHILAERKRREKLTQRFVALSALIPGLKKMDKASVLGDAIKHIKYLQESVKEYEEQKKEKTMESVVLVKKSSLVLDENHQPSSSSSSDGNRNSSSSNLPEIEVRVSGKDVLIKILCEKQKGNVIKIMGEIEKLGLSITNSNVLPFGPTFDISIIAQKNNNFDMKIEDVVKNLSFGLSKLT

SEQ ID NO: 317 - DNA, 1690 bp, Arabidopsis thaliana
  G1672
ccattcctgacgtccgggatgacgcacaatcccactatccttcgcaagacccttcctctatataaggaagttcatttcatttggagaggacacgctgacaagctgactctagcagatctggtaccgatcactcccgtctttatcaaattcttcttcctcttacattttccctatccaatcgatctcacgcagatctgatcaatttctcatcaaatcatttagagatcaaaagaaaactatgaagaatagtaaatgtaacctcatagattcaaagctcgaagaacatcatcatctttgcggatcaaaacattgtcctggatgtggtcgcatgattcaagctgctactaaaccaaattgggttggattgccggcaggagtgaaattcgatccgacagatcaagaacttatagaacatttagaagcaaaagtgaagggaaaagaagaaaataagaaatggtcgtcgtctcatccacttatagatgaatttattcccaccattgatggagaagatggaatatgttacactcatcctcagaagcttccaggggtgacaagagatggcttgagcaaacacttcttccacaaaccatcaagagcttacacaaccggaacaagaaaacgacgtaaaataattcaaaccgatcacgactctgagttaaccggatcatcagaaaccaggtggcacaaaacgggcaaaacaagaccggttatgatcaacggtcaacaaagaggatgcaagaagatattagtactctacacaaacttcggcaagaatcgtcgaccggagaaaacaaattgggtgatgcatcaatatcatttagggattaatgaggaagagagagaaggagaacttgtggtctccaagatattttatcagacacaaccaagacagtgtgttagtaatactaattggtctgatcaccatggttccaaggacgtgatcggaattggtgtcggagatgagatttccagcgtagctgccacgttgcagagtcttggctccggtgacgtcgtttctagggttaatatgcatccccatacaagatcctttgatgaggggacagccgaagcttcaaagggaagagagaaccagcatgtgtctggcacgtgcgaggaagtacatgatgggatcataacatcatcaatgtcatctcatcatatgattcatgatcatcataatcaacatcatcaaatcggagatagaagagaatttcacatgtcatcatcatatcccatgacccctactatcacatcacaacatgagtcaatcttccatgttacaagtactatgccctttcagcggcagcaattaaggggtcggtcgtctggttcgggattagaagacctaattatgggttgtaccacagctacgtgtacagaagacaataatcacaaatgattaaattcgcaggagcattcagaagcaaaccctcagcgaaatgcagagtggttaacgtttccacaattctggaaccaagccgaatcagatgatcaaaaccgaagattttaacagaaccaaaaggaagcagagaaatcttgcaaaaagctcctgcttagctgttgatcaatgccggaaatgctgagctatgactgactagtctctgccatttaacttacaatatcaccagaggttgcgatgaatgttgattcgctcaaaggagagcggccgctctagacaggcctcgtaccg

SEQ ID NO: 318 - protein, 386 aa, Arabidopsis thaliana
  G1672  (conserved domain in AA coordinates: 41-194)
MKNSKCNLIDSKLEEHHHLCGSKHCPGCGRMIQAATKPNWVGLPAGVKFDPTDQELIEHLEAKVKGKEENKKWSSSHPLIDEFIPTIDGEDGICYTHPQKLPGVTRDGLSKHFFHKPSRAYTTGTRKRRKIIQTDHDSELTGSSETRWHKTGKTRPVMINGQQRGCKKILVLYTNFGKNRRPEKTNWVMHQYHLGINEEEREGELVVSKIFYQTQPRQCVSNTNWSDHHGSKDVIGIGVGDEISSVAATLQSLGSGDVVSRVNMHPHTRSFDEGTAEASKGRENQHVSGTCEEVHDGIITSSMSSHHMIHDHHNQHHQIGDRREFHMSSSYPMTPTITSQHESIFHVTSTMPFQRQQLRGRSSGSGLEDLIMGCTTATCTEDNNHK

SEQ ID NO: 319 - DNA, 1130 bp, Arabidopsis thaliana
  G1677
cagtactaattctgtgtgtgttaatggttctagttatggatgatgaagagagtaacaacgttgaaagatatgacgacgtcgtattgccagggtttaggttccatcccactgatgaagaactcgtaagtttctacttgaaacggaaggttttacacaaatctcttccctttgatctcatcaagaaagtcgacatttacaaatacgatccatgggacctcccaaagcttgcagcgatgggggaaaaagagtggtacttttattgtcctagagacaggaaataccgcaacagcacaagacctaaccgagtaactggaggtggcttctggaaagcaaccggaacagaccggcctatatactcattggactccactcgatgcatcggtttgaagaaatcacttgtgttctaccgtggtcgagctgctaaaggagtcaaaaccgattggatgatgcatgaatttcgtctcccttctctctctgactctcatcactcatcatatcccaattacaataacaagaagcaacaccttaacaataacaacaacagcaaggagcttccttcaaacgatgcttgggcgatatgtagaatatttaagaagacaaatgcagtatcctcacaaagatcaatcccacaatcttgggtttatccaacgattcctgacaacaatcaacagtcacacaacaacaccgcaactctcttagcttcatcagacgttctcagccacatatcaacaagacaaaactttattccttctccagtcaacgaacccgcaagcttcacagaatcagctgcttcttacttcgcgtctcagatgctcggagtcacgtacaatacagccagaaacaacggaacaggggatgctctgtttctgagaaacaatggaacaggggatgctctggttctgagcaacaatgagaataactacttcaacaacttgactggagggttgactcatgaggttccgaatgtaagatcaatggtgatggaggagactacggggagtgagatgtcggcgacgtcgtattccactaacaattaagatcatagtactattaacacttgaattagtgtagacgttgatcatcgctaatatgtattaatttttcttgtcttactataaacgaaaaaaaaa

SEQ ID NO: 320 - protein, 337 aa, Arabidopsis thaliana
  G1677  (conserved domain in AA coordinates:17-181)
MVLVMDDEESNNVERYDDVVLPGFRFHPTDEELVSFYLKRKVLHKSLPFDLIKKVDIYKYDPWDLPKLAAMGEKEWYFYCPRDRKYRNSTRPNRVTGGGFWKATGTDRPIYSLDSTRCIGLKKSLVFYRGRAAKGVKTDWMMHEFRLPSLSDSHHSSYPNYNNKKQHLNNNNNSKELPSNDAWAICRIFKKTNAVSSQRSIPQSWVYPTIPDNNQQSHNNTATLLASSDVLSHISTRQNFIPSPVNEPASFTESAASYFASQMLGVTYNTARNNGTGDALFLRNNGTGDALVLSNNENNYFNNLTGGLTHEVPNVRSMVMEETTGSEMSATSYSTNN

SEQ ID NO: 321 - DNA, 755 bp, Arabidopsis thaliana
  G1749
caacacttctcagtgaccgtgagcaacgaattattttcagttcaacgactccgcggaaatggaaaattcagaaaatgttccctcttacgatcaaaacatcaatttcactcctaatttgacgagagatcaagaacatgtgatcatggtctctgctttgcaacaagtaatatccaacgtcggaggtgacacgaactcgaatgcatgggaagctgatcttccacctttgaacgctggcccttgtcctctttgtagtgtcaccggctgctacggttgcgtcttcccacgacacgaggcgataattaagaaggagaagaagcacaaaggagtgaggaaaaaaccatcaggtaaatgggcggcggagatatgggatccgagtttgaaagtaaggagatggcttggaacgtttccaacagcggagatggcggctaaggcttacaacgatgcggcggctgagtttgtcggaagaagatcagcaagacgtggcacaaagaacggagaggaagcatctaccaagaagacgactgagaaaaattaacggagaaggagcacgtatagaaaggcaggaagaggcatcttacttgcttcacaagtaaatcagaatttttttgaaaagtaaaaacgttattttgtttggtaataaaataaagtaaaacaaaatattgctaacgcaagacttatcaagttcagtcgtgactgtgagtgtgtttttatgtatcttacttcattttttgtctttcaattgtgtgtgtgtgtgt

SEQ ID NO: 322 - protein, 158 aa, Arabidopsis thaliana
  G1749  (conserved domain in AA coordinates:84-155)
MENSENVPSYDQNINFTPNLTRDQEHVIMVSALQQVISNVGGDTNSNAWEADLPPLNAGPCPLCSVTGCYGCVFPRHEAIIKKEKKHKGVRKKPSGKWAAEIWDPSLKVRRWLGTFPTAEMAAKAYNDAAAEFVGRRSARRGTKNGEEASTKKTTEKN

SEQ ID NO: 323 - DNA, 1136 bp, Arabidopsis thaliana
  G1750
cccttttcctctctttctccaaatctctgaaaattttcaccagaatctctgttctttttttcaccagaatctctctgtttaaaataataggtgatgatgatggatgagtttatggatcttagaccagtgaagtacacagagcacaagactgttatcagaaagtacactaaaaagtcgtctatggagaggaagaccagtgttcgtgactcggccaggttggttcgggtctcaatgacggatcgtgacgccactgattcatcaagcgacgaggaagagtttctgttccctcgaagacgtgtcaagagattgattaacgagatcagagtcgagcctagcagctcttccaccggcgacgtctctgcttctccgacgaaggaccggaaaagaatcaacgttgattctacggttcaaaagccctctgtttccggccaaaaccagaagaagtaccgcggcgtgagacagcgaccatggggaaaatgggcggcggagattcgtgatcctgagcaacgccggagaatctggctcggtacttttgcaacggcggaggaagctgccatcgtctacgacaacgcagcaatcaaacttcgtggccctgatgctcttaccaacttcaccgtacaaccagaaccagaaccggtacaagaacaagaacaagaaccggagagcaacatgtcggtttcgatatcagaatcaatggacgattctcaacatctatcatctccgacatcggttctcaactaccaaacatatgtctcggaggaaccaatcgatagtcttatcaaaccggttaaacaagagtttcttgaaccagaacaagagccaataagctggcatcttggagaaggtaatactaatactaatgatgattcatttccattggacattacatttctcgacaactatttcaatgaatcattaccagacatctccatcttcgatcaacctatgtctcctattcaaccaacagagaatgatttcttcaacgaccttatgttattcgatagcaacgcagaagaatactactcctccgagatcaaagagattggttcatcgttcaacgatcttgatgattctttgatatccgatctcttacttgtgtgatatttttgccattaaccaaacaccggtttggttgc

SEQ ID NO: 324 - protein, 335 aa, Arabidopsis thaliana
  G1750  (conserved domain in AA coordinates: 107-173)
MMMDEFMDLRPVKYTEHKTVIRKYTKKSSMERKTSVRDSARLVRVSMTDRDATDSSSDEEEFLFPRRRVKRLINEIRVEPSSSSTGDVSASPTKDRKRINVDSTVQKPSVSGQNQKKYRGVRQRPWGKWAAEIRDPEQRRRIWLGTFATAEEAAIVYDNAAIKLRGPDALTNFTVQPEPEPVQEQEQEPESNMSVSISESMDDSQHLSSPTSVLNYQTYVSEEPIDSLIKPVKQEFLEPEQEPISWHLGEGNTNTNDDSFPLDITFLDNYFNESLPDISIFDQPMSPIQPTENDFFNDLMLFDSNAEEYYSSEIKEIGSSFNDLDDSLISDLLLV

SEQ ID NO: 325 - DNA, 1031 bp, Arabidopsis thaliana
  G1756
atatgtacttgtacaccaacccaccaaaagagataaaagaggaaacaaaaactcgaaaagagagagatatatgggtgaggtggcttatatggacgaaggagacctagaagcaatagtcagaggctactccggctccggagacgcgttttccggcgaaagttccggtacgttttcaccttcgttttgcctaccgatggagacgtctagtttctacgaaccggagatggagacaagtggcttagatgagctcggtgaactttacaaacccttttaccctttctccacacaaacgatcctcacaagctcggtctctctccctgaagattcaaaacctttccgagatgacaagaaacaacgatcacatggttgtcttttatccaacggatcaagagctgatcatatccgaatttcagaatccaaatcaaagaaaagcaagaagaatcaacagaagagagttgttgagcaagtgaaagaagagaatctgttgtcggacgcatgggcgtggcgtaaatacgggcagaaacccatcaaaggatctccatacccaaggagttattacagatgcagtagctcaaaagggtgtttggcaagaaaacaagtcgaaagaaatcctcaaaacccggagaaattcaccataacatacactaatgagcacaatcatgaactaccaacccggagaaactcattagccggttcgactcgagcaaaaacttcccaacccaaaccaaccttaaccaaaaaatccgaaaaagaagttgtttcttcccctacaagtaatcctatgatcccatccgctgatgaatcttctgttgcggttcaagaaatgagcgttgcggaaacgagtacgcaccaagcggctggagcaatcgagggccgccgcttgagtaacggtttaccatcggatttgatgtccgggagcggaacttttccaagttttaccggtgacttcgatgaactattgaatagccaagagttcttcagtgggtatttatggaattactagagagcattaggtgtatgtatatatatat

SEQ ID NO: 326 - protein, 310 aa, Arabidopsis thaliana
  G1756  (conserved domain in aa coordinates: 138-200)
MGEVAYMDEGDLEAIVRGYSGSGDAFSGESSGTFSPSFCLPMETSSFYEPEMETSGLDELGELYKPFYPFSTQTILTSSVSLPEDSKPFRDDKKQRSHGCLLSNGSRADHIRISESKSKKSKKNQQKRVVEQVKEENLLSDAWAWRKYGQKPIKGSPYPRSYYRCSSSKGCLARKQVERNPQNPEKFTITYTNEHNHELPTRRNSLAGSTRAKTSQPKPTLTKKSEKEVVSSPTSNPMIPSADESSVAVQEMSVAETSTHQAAGAIEGRRLSNGLPSDLMSGSGTFPSFTGDFDELLNSQEFFSGYLWNY

SEQ ID NO: 327 - DNA, 1095 bp, Arabidopsis thaliana
  G1765
tccttcgcaagacccttcctctatataaggaagttcatttcatttggagaggacacgctgacaagctgactctagcagatctggtaccgtcgacaagaatgacttgattggtgttctaaagagatcgatgtagtgaagatgagtggcgaaggtaacttaggtaaggatcatgaagaagaaaacgaagcaccacttcctgggttcaggtttcatccgacggatgaagagcttttaggatactatcttcgaagaaaagtagagaacaaaaccatcaaactcgaacttatcaaacagatcgatatctataagtacgatccttgggatcttccaagagtgagcagcgtcggagaaaaggagtggtacttcttctgcatgagaggtaggaaatacaggaatagcgttcgaccaaaccgagtgaccggttcaggtttctggaaagccactggtattgataaaccggtttactccaatcttgactgtgttggtctcaagaaatctctggtttactatcttggttcagccggtaaaggcaccaaaaccgattggatgatgcatgaattccgcctcccctccaccacgaaaaccgactctccagctcaacaagcagaggtatggacactttgcagaatcttcaaacgagtcacatctcaaagaaacccaaccatcttaccaccaaaccgaaaaccggttatcactttaaccgacacttgttctaagaccagcagcttagattccgaccacacgagccaccgtacagtagattccatgtcccacgagccgccgcttccacagccacagaatccttattggaaccaacatatagttggttttaatcaaccgacatatactggtaatgataataacctcctgatgagtttctggaacggcaacggtggagatttcataggagactcagcaagttgggatgaacttagatctgttatagatggcaacactaaaccctagtaataaagtttccttttttcagctttgtacaaaaagataaaacaaacggcaaccgctctagacaggcctcgtaccgggatcctctagctagagctttcgtttcgtatcatcggtttcgacaacgttcgt

SEQ ID NO: 328 - protein, 275 aa, Arabidopsis thaliana
  G1765  (conserved domain in AA coordinates: 20-140)
MSGEGNLGKDHEEENEAPLPGFRFHPTDEELLGYYLRRKVENKTIKLELIKQIDIYKYDPWDLPRVSSVGEKEWYFFCMRGRKYRNSVRPNRVTGSGFWKATGIDKPVYSNLDCVGLKKSLVYYLGSAGKGTKTDWMMHEFRLPSTTKTDSPAQQAEVWTLCRIFKRVTSQRNPTILPPNRKPVITLTDTCSKTSSLDSDHTSHRTVDSMSHEPPLPQPQNPYWNQHIVGFNQPTYTGNDNNLLMSFWNGNGGDFIGDSASWDELRSVIDGNTKP

SEQ ID NO: 329 - DNA, 2006 bp, Arabidopsis thaliana
  G1777
ctcgtactttatcacctccgtcgttctataatactctcttccgtcaatcatatcatttgtcgacaatttcattctgatcagtttaaaaattgatccatggatgataatttaagcggcgaggaagaagattactattactcctccgatcaggaatctctcaacgggattgataatgatgaatccgtttcgatacctgtttcttcccgatcaaatactgtcaaggttattacgaaggaatcacttttggctgcacagagggaggatttgcggagagtgatggaattgttatcggttaaggagcaccatgctcggactcttcttatacattaccgatgggatgtggagaagttgtttgctgttcttgttgagaaagggaaagatagcttgttttctggtgctggtgttacacttcttgaaaaccaaagttgtgattcttccgtttctggttcttcttcgatgatgagttgtgatatctgcgtagaggatgtaccgggttatcagctgacaaggatggactgtggccatagcttttgcaataactgttggactgggcattttactgtaaagataaatgaaggtcagagcaaaaggattatatgcatggctcataagtgtaatgctatttgtgatgaagatgttgtcagggctctagttagtaaaagccaaccagatttagctgagaagtttgatcgttttcttcttgagtcgtatatcgaagataacaaaatggtgaagtggtgtccgagtactcctcattgtgggaatgccatacgtgttgaggatgacgagctctgtgaggttgaatgctcttgtggtttgcagttctgtttcagttgttcatctcaagctcactccccttgctcttgtgtgatgtgggaactatggagaaagaagtgctttgatgagtccgagactgttaattggataactgttcacacaaagccgtgtcccaaatgtcacaagcctgttgaaaagaatggtggatgcaatctcgtgacttgtctttgtcgacaatctttttgttggttgtgtggtgaagctactggaagggaccacacttgggctagaatctcgggtcatagttgtggtcggttccaagaagataaagagaaacaaatggagagagcgaaaagggatctcaagcggtatatgcattatcataaccgatacaaagcacatatcgactcctccaagctagaggctaagcttagtaataatattagtaaaaaggtgtctatttcagaaaagagggagttacaacttaaagacttcagctgggctaccaatggactccatcggttatttagatcaagacgagttctttcatattcataccctttcgcattttacatgtttggagatgagctgtttaaagatgagatgagctctgaggaaagagaaataaaacaaaatctgtttgaggatcagcagcagcagcttgaggctaatgttgagaaactttctaagttcttggaggaaccttttgatcaatttgctgatgataaggtcatgcagataaggattcaagtcatcaatttgtcagttgcggtcgatacactctgcgaaaatatgtatgaatgcattgagaatgacttgttgggttctctgcaacttggcatccacaacattactccatacagatcaaacggcatagaacgagcatctgatttttatagttcccagaattccaaggaagctgttggtcagtcttcggattgtggatggacgtccaggctcgatcaagctttggagtcagggaagtcggaagacacaagttgctcttccgggaagcgtgctagaatagacgaaagttacagaaacagccaaaccaccttactagatttaaacttgccagcggaagccattgagcggaaatgaacacttatccttcttcacctcccaataacaccctttttgtccaaataaagtgtgttacccggatatttatagctctaaacccaatcccctctgcttaatttgtcagtgaccttacctaaccctcttca

SEQ ID NO: 330 - protein, 593 aa, Arabidopsis thaliana
  G1777  (conserved domain in AA coordinates:124-247)
MDDNLSGEEEDYYYSSDQESLNGIDNDESVSIPVSSRSNTVKVITKESLLAAQREDLRRVMELLSVKEHHARTLLIHYRWDVEKLFAVLVEKGKDSLFSGAGVTLLENQSCDSSVSGSSSMMSCDICVEDVPGYQLTRMDCGHSFCNNCWTGHFTVKINEGQSKRIICMAHKCNAICDEDVVRALVSKSQPDLAEKFDRFLLESYIEDNKMVKWCPSTPHCGNAIRVEDDELCEVECSCGLQFCFSCSSQAHSPCSCVMWELWRKKCFDESETVNWITVHTKPCPKCHKPVEKNGGCNLVTCLCRQSFCWLCGEATGRDHTWARISGHSCGRFQEDKEKQMERAKRDLKRYMHYHNRYKAHIDSSKLEAKLSNNISKKVSISEKRELQLKDFSWATNGLHRLFRSRRVLSYSYPFAFYMFGDELFKDEMSSEEREIKQNLFEDQQQQLEANVEKLSKFLEEPFDQFADDKVMQIRIQVINLSVAVDTLCENMYECIENDLLGSLQLGIHNITPYRSNGIERASDFYSSQNSKEAVGQSSDCGWTSRLDQALESGKSEDTSCSSGKRARIDESYRNSQTTLLDLNLPAEAIERK

SEQ ID NO: 331 - DNA, 696 bp, Arabidopsis thaliana
  G1792
aatccatagatctcttattaaataacagtgctgaccaagctcttacaaagcaaaccaatctagaacaccaaagttaatggagagctcaaacaggagcagcaacaaccaatcacaagatgacaagcaagctcgtttccggggagttcgaagaaggccttggggaaagtttgcagcagagattcgagacccgtcgagaaacggtgcccgtctttggctcgggacatttgagaccgctgaggaggcagcaagggcttatgaccgagcagcctttaaccttaggggtcatctcgctatactcaacttccctaatgagtattatccacgtatggacgactactcgcttcgccctccttatgcttcttcttcttcgtcgtcgtcatcgggttcaacttctactaatgtgagtcgacaaaaccaaagagaagttttcgagtttgagtatttggacgataaggttcttgaagaacttcttgattcagaagaaaggaagagataatcacgattagttttgttttgatattttatgtggcactgttgtggctacctacgtgcattatgtgcatgtataggtcgcttgattagtactttataacatgcatgccacgaccataaattgtaagagaagacgtactttgcgttttcatgaaatatgaatgttagatggtttgagtacaaaaaaaaaaaaaaaaaaaaaaa

SEQ ID NO: 332 - protein, 139 aa, Arabidopsis thaliana
  G1792  (conserved domain in aa coordinates: 17-85)
MESSNRSSNNQSQDDKQARFRGVRRRPWGKFAAEIRDPSRNGARLWLGTFETAEEAARAYDRAAFNLRGHLAILNFPNEYYPRMDDYSLRPPYASSSSSSSSGSTSTNVSRQNQREVFEFEYLDDKVLEELLDSEERKR

SEQ ID NO: 333 - DNA, 1818 bp, Arabidopsis thaliana
  G1793
agtgatttattgattaacccaaacacaaaataaacagatttgactcaaaaagaagaaaatgaattctaacaactggcttggctttcctctttcaccgaacaactcttctttgcctcctcatgaatacaaccttggcttggtcagcgaccatatggacaacccttttcaaacacaagagtggaatatgatcaatccacacggtggaggaggagatgaaggaggagaggttccaaaagtggccgattttctcggtgtgagcaaaccggacgaaaaccaatccaaccacctagtagcttacaacgactcagactactacttccataccaatagcttgatgcctagcgtccaatcaaacgatgtcgttgtagcagcttgtgactccaatactcctaacaacagtagctatcatgagcttcaagagagtgctcacaatctacagtcacttactttgtccatggggaccaccgctggtaataatgttgtagacaaagcttcaccatccgagaccaccggggataacgctagcggtggagcactagccgttgttgagacggccacgccaagacgtgcattggacactttcggacaacgaacctcgatctatcgtggtgtcacaagacatcgatggactggtcgatatgaggctcatctatgggataatagttgtagaagggaaggccagtctaggaaaggaagacaagtttacttgggtggatatgacaaagaagataaagcagcaagatcatatgatctagctgcacttaagtactggggtccttcaactactactaatttccccattacaaactacgagaaagaagtagaggaaatgaagcacatgacgagacaagagttcgtggctgccattagaaggaaaagtagtggattttcgagaggcgcttcgatgtatcgaggagttacaaggcatcaccaacatggaagatggcaagcaaggatcggccgagtcgccggaaacaaagacctctacttgggaacttttagcactgaggaagaagcagcagaagcttacgatatagctgcaataaagtttagaggacttaatgcagtgaccaacttcgagatcaaccggtacgacgtgaaagccattctagagagtagcactcttcccatcggaggaggcgcagctaaacggctcaaagaagctcaagctcttgagtcttcaaggaaacgcgaggcggagatgatagcccttggttcaagtttccagtacggtggtggctcgagcacaggctctggctccacctcatcaagacttcagcttcaaccttaccctctaagcattcaacaaccattagagccttttctatctcttcagaacaatgacatctctcattacaacaacaacaatgctcacgattcctcctcttttaatcaccatagctatatccagacacaacttcatctccaccaacagaccaacaattacttgcagcaacagtcgagccagaactctcagcagctctacaatgcgtatcttcatagcaatccggctctgcttcatggacttgtctctacctctatcgttgacaacaataataacaatggaggctctagtgggagctacaacactgcagcatttcttgggaaccacggtattggtattgggtccagctcgactgttggatcgaccgaggagtttccaaccgttaaaacagattacgatatgccttccagtgatggaaccggagggtatagtggttggaccagtgagtctgttcaggggtcaaaccctggtggtgttttcactatgtggaatgagtaaacaaggatctctttcttgcggcacaaggaatgggt

SEQ ID NO: 334 - protein, 574 aa, Arabidopsis thaliana
  G1793  (conserved domain in AA coordinates:179-255, 281-349)
MNSNNWLGFPLSPNNSSLPPHEYNLGLVSDHMDNPFQTQEWNMINPHGGGGDEGGEVPKVADFLGVSKPDENQSNHLVAYNDSDYYFHTNSLMPSVQSNDVVVAACDSNTPNNSSYHELQESAHNLQSLTLSMGTTAGNNVVDKASPSETTGDNASGGALAVVETATPRRALDTFGQRTSIYRGVTRHRWTGRYEAHLWDNSCRREGQSRKGRQVYLGGYDKEDKAARSYDLAALKYWGPSTTTNFPITNYEKEVEEMKHMTRQEFVAAIRRKSSGFSRGASMYRGVTRHHQHGRWQARIGRVAGNKDLYLGTFSTEEEAAEAYDIAAIKFRGLNAVTNFEINRYDVKAILESSTLPIGGGAAKRLKEAQALESSRKREAEMIALGSSFQYGGGSSTGSGSTSSRLQLQPYPLSIQQPLEPFLSLQNNDISHYNNNNAHDSSSFNHHSYIQTQLHLHQQTNNYLQQQSSQNSQQLYNAYLHSNPALLHGLVSTSIVDNNNNNGGSSGSYNTAAFLGNHGIGIGSSSTVGSTEEFPTVKTDYDMPSSDGTGGYSGWTSESVQGSNPGGVFTMWNE

SEQ ID NO: 335 - DNA, 1562 bp, Arabidopsis thaliana
  G1794
tctttctttcttcctctttgtctctgtttcttgtttctctctctctctctctacagagttttctttccctcgaagaaaaagaatatttttaaatttaattttctctgcgtttataagctttaagtttcagaggaggaggatttagaaggagggttttgtatgtgtgtcttaaaagtggcaaatcaggaagataacgttggcaaaaaagccgagtctattagagacgatgatcatcggacgttatctgaaatcgatcaatggctttacttattcgcagccgaagacgaccaccaccgtcatagcttccctacgcagcagccgcctccatcgtcgtcgtcctcatctcttatctcaggtttcagtagagagatggagatgtctgctattgtctctgctttgactcacgttgttgctggaaatgttcctcagcatcaacaaggaggcggtgaaggtagcggagaagggacttcgaattcgtcttcttcctcggggcagaaaaggaggagagaggtggaggaaggtggcgccaaagcggttaaggcagctaatactttgacggttgatcaatatttctccggtggtagctctacttctaaagtgagagaagcttcgagtaacatgtcaggtccgggcccaacatacgagtatacaactacggcaactgctagtagcgaaacgtcgtcgtttagtggggaccaacctcggcgaagatacagaggagttagacaaagaccatggggaaagtgggcggctgagattcgagatccatttaaagcagctagagtttggctcggtacgttcgacaatgctgaatcagcagcaagagcttacgacgaagctgcacttcggtttagaggcaacaaagccaaactcaacttccctgaaaacgtcaaactcgttagacctgcttcaaccgaagcacaacctgtgcaccaaaccgctgctcaaagaccgacccagtcaaggaactcgggttcaacgactacccttttgcccataagacctgcttcgaatcaaagcgttcattcgcagccgttgatgcaatcatacaacttgagttactctgaaatggctcgtcaacaacaacagtttcagcaacatcatcaacaatctttggatttatacgatcaaatgtcgtttccgttgcgtttcggtcacactggaggttcaatgatgcaatctacgtcgtcatcatcatctcattctcgtcctctgttttccccggctgctgttcagccgccaccagaatcagctagcgaaaccggttatctccaggatatacaatggccatcagacaagactagtaataactacaataatagtccatcctcctgatgacttgcttcattttatttgtttcactatagagtaatagaaaacaggaaaatgattatatgttatagagttatttttccaaatattatagggtttaggttgtttgtattgttctgctttcatcctctcatgctttttttcttaatttattatatttttgcattataatttcgtttcattgtaacaaacattaaaaagaccacatggagaaaggaaaaaaaagagag

SEQ ID NO: 336 - protein, 391 aa, Arabidopsis thaliana
  G1794  (conserved domain in AA coordinates: 182-249)
MCVLKVANQEDNVGKKAESIRDDDHRTLSEIDQWLYLFAAEDDHHRHSFPTQQPPPSSSSSSLISGFSREMEMSAIVSALTHVVAGNVPQHQQGGGEGSGEGTSNSSSSSGQKRRREVEEGGAKAVKAANTLTVDQYFSGGSSTSKVREASSNMSGPGPTYEYTTTATASSETSSFSGDQPRRRYRGVRQRPWGKWAAEIRDPFKAARVWLGTFDNAESAARAYDEAALRFRGNKAKLNFPENVKLVRPASTEAQPVHQTAAQRPTQSRNSGSTTTLLPIRPASNQSVHSQPLMQSYNLSYSEMARQQQQFQQHHQQSLDLYDQMSFPLRFGHTGGSMMQSTSSSSSHSRPLFSPAAVQPPPESASETGYLQDIQWPSDKTSNNYNNSPSS

SEQ ID NO: 337 - DNA, 1716 bp, Arabidopsis thaliana
  G1804
tatctctctctttctcaaaacctttcagtcaaaattctccggcggcttttaaactatgtgaaggaggagaacctccataacaagaagcggattctctcagttttccggcggcggaggaacacaaagccaccggtttttagacacacagatttcattttcagttgttaaatggtaactagagaaacgaagttgacgtcagagcgagaagtagagtcgtccatggcgcaagcgagacataatggaggaggtggtggtgagaatcatccgtttacttctttgggaagacaatcctctatctactcattgacccttgacgagttccaacatgctttatgtgagaacggcaagaactttgggtccatgaacatggacgagtttcttgtctctatttggaacgcagaggagaataataacaatcaacaacaagcagcagcagctgcaggttcacattctgttccggctaatcacaatggtttcaacaacaacaataacaatggaggcgagggtggtgttggtgtctttagtggtggttctagaggcaacgaagatgctaacaataagagagggatagcgaacgagtctagtcttcctcgacaaggctctttgacacttccagctccgctttgtaggaagactgttgatgaggtttggtctgagatacatagaggtggtggtagcggtaatggaggagacagcaatggacgtagtagtagtagtaatggacagaacaatgctcagaacggcggtgagactgcggctagacaaccgacttttggagagatgacacttgaggatttcttggtgaaggctggtgtggttagagaacatcccactaatcctaaacctaatccaaacccgaaccaaaaccaaaacccgtctagtgtaatacccgcagctgcacagcaacagctttatggtgtgtttcaaggaaccggtgatccttcattcccgggtcaagctatgggtgtgggtgacccatcaggttatgctaaaaggacaggaggaggagggtatcagcaggcgccaccagttcaggcaggtgtttgctatggaggtggcgttgggtttggagcgggtggacagcaaatgggaatggttggaccgttaagcccggtgtcttcagatggattaggacatggacaagtggataacataggaggtcagtatggagtagatatgggagggctaaggggaaggaaaagagtagtggatggtccagtggagaaagtagtggagagaagacagaggaggatgatcaagaaccgcgagtctgctgctagatctagagcaagaaaacaagcatatacagtggaattggaagctgaacttaaccagttgaaagaagagaatgcgcagctaaaacatgcattggcggagttggagaggaagaggaagcaacagtattttgagagtttgaagtcaagggcacaaccgaaattgccgaaatcgaacgggagattgcggacattgatgaggaacccgagttgtccactctaaacaaacaataggaagatggagaagaagtcggagacagaacgagggaaaaactgatgattttctacgttgttgttttgtctttgaggaatgaggttatagaatctttatactttgatgttttctgtgttggtaggaggaacaccatctgatctgctttactagtgttccctgtgaacaaagaaagtgattctgtgtttcaacatcatcaatctttggaaa

SEQ ID NO: 338 - protein, 442 aa, Arabidopsis thaliana
  G1804  (conserved domain in AA coordinates: 357-407)
MVTRETKLTSEREVESSMAQARHNGGGGGENHPFTSLGRQSSIYSLTLDEFQHALCENGKNFGSMNMDEFLVSIWNAEENNNNQQQAAAAAGSHSVPANHNGFNNNNNNGGEGGVGVFSGGSRGNEDANNKRGIANESSLPRQGSLTLPAPLCRKTVDEVWSEIHRGGGSGNGGDSNGRSSSSNGQNNAQNGGETAARQPTFGEMTLEDFLVKAGVVREHPTNPKPNPNPNQNQNPSSVIPAAAQQQLYGVFQGTGDPSFPGQAMGVGDPSGYAKRTGGGGYQQAPPVQAGVCYGGGVGFGAGGQQMGMVGPLSPVSSDGLGHGQVDNIGGQYGVDMGGLRGRKRVVDGPVEKVVERRQRRMIKNRESAARSRARKQAYTVELEAELNQLKEENAQLKHALAELERKRKQQYFESLKSRAQPKLPKSNGRLRTLMRNPSCPL

SEQ ID NO: 339 - DNA, 1740 bp, Arabidopsis thaliana
  G1818
taacaaatcaaataattagagaaataaccaaaatttaacttttagagggactacaggatttgtactttgtacattcatatattattgttatatatcgtttcatacattaatttgaaccaatgtaaattaagtaaaattcaatttaacatcatgagcaaattcttattaaaattctcttaaaattttgagcaaattatgctttcacatttaacatttgaaaacatcatttttaacaagatattcaaaactaagttttgtacagcaaaattttaactttcaattttatagagaaaaaggtatttttttttttgtttcatttttataagactattatttggtatataatatacactttaagtaaaaacaaatctctttcttttttcttcttataataccaaccacaagtctgtcagtcacacacatacagttaataacattaaatattcttaacaaactactaaataggttgagattcatatatgtaaagagatcacttcttaatcttatcctaccatatcttatatacgcttaattttcctttatatatgcaaacctccacataaaaatatctcaaacccaaacacttcaaacaaaaaaaaaatggagaacaacaacaacaaccaccaacagccaccgaaagataacgagcaactaaagagtttctggtcaaaggggatggaaggtgacttgaatgtcaagaatcacgagttccccatctctcgtatcaagaggataatgaagtttgatccggatgtgagtatgatcgctgctgaggctccaaatctcttatctaaggcttgtgaaatgtttgtcatggacctcacgatgcgttcatggctccatgctcaagagagcaaccgactcacgatacggaaatctgatgttgatgccgtagtgtctcaaaccgtcatctttgatttcttgcgtgatgatgtccctaaggacgagggagagcccgttgtcgccgctgctgatcctgtggacgatgttgctgatcatgtggctgtgccagatcttaacaatgaagaactgccgccgggaacggtgataggaactccggtttgttacggtttaggaatacacgcgccacacccgcagatgcctggagcttggaccgaggaggatgcgactggggcaaatggaggaaacggtgggaattaatatttggattgggttttgtaaccgctgttgtgagaacttgaatttctttttgagttctgcttatgttttcaatgttatgttttttagttgttgaatgtatttctgttgttttgtccaaaaaaaaaaaagaatgtatttctgttgttgtctttcaaatgaatctaatggtttatgaatattggctttagattaatttatgcatacaaaaacacaaggattacggataaaaaagtcctcagtttacccatggaaacataatcttctagtgattccttatgagagtagaaaagaatcatatattataatctatttcataagagatagggtactgtaaacaaggatgtttattcggctatttcttttttttttaatcacttttacttgtcaagactcttttgtgtttgcagctttttgttagattacattctagaggcaacaagatccagagatctagcaaaaaaaacttattttgaaacctgaatctattttaaaaattttccaactcatttttcgttcttattctttgttttccaacggaatttggcgcacaaacgatttatttgaattttgtctttcaag

SEQ ID NO: 340 - protein, 186 aa, Arabidopsis thaliana
  G1818  (conserved domain in AA coordinates: 36-113)
MENNNNNHQQPPKDNEQLKSFWSKGMEGDLNVKNHEFPISRIKRIMKFDPDVSMIAAEAPNLLSKACEMFVMDLTMRSWLHAQESNRLTIRKSDVDAVVSQTVIFDFLRDDVPKDEGEPVVAAADPVDDVADHVAVPDLNNEELPPGTVIGTPVCYGLGIHAPHPQMPGAWTEEDATGANGGNGGN

SEQ ID NO: 341 - DNA, 609 bp, Arabidopsis thaliana
  G1820
atggctgagaacaacaacaacaacggcgacaacatgaacaacgacaaccaccagcaaccaccgtcgtactcgcagctgccgccgatggcatcatccaaccctcagttacgtaattactggattgagcagatggaaaccgtctcggatttcaaaaaccgtcagcttccattggctcgaattaagaagatcatgaaggctgatccagatgtgcacatggtctccgcagaggctccgatcatcttcgcaaaggcttgcgaaatgttcatcgttgatctcacgatgcggtcgtggctcaaagccgaggagaacaaacgccacacgcttcagaaatcggatatctccaacgcagtggctagctctttcacctacgatttccttcttgatgttgtccctaaggacgagtctatcgccaccgctgatcctggctttgtggctatgccacatcctgacggtggaggagtaccgcaatattattatccaccgggagtggtgatgggaactcctatggttggtagtggaatgtacgcgccatcgcaggcgtggccagcagcggctggtgacggggaggatgatgctgaggataatggaggaaacggcggcggaaattga

SEQ ID NO: 342 - protein, 202 aa, Arabidopsis thaliana
  G1820  (conserved domain in AA coordinates: 70-133)
MAENNNNNGDNMNNDNHQQPPSYSQLPPMASSNPQLRNYWIEQMETVSDFKNRQLPLARIKKIMKADPDVHMVSAEAPIIFAKACEMFIVDLTMRSWLKAEENKRHTLQKSDISNAVASSFTYDFLLDVVPKDESIATADPGFVAMPHPDGGGVPQYYYPPGVVMGTPMVGSGMYAPSQAWPAAAGDGEDDAEDNGGNGGGN

SEQ ID NO: 343 - DNA, 668 bp, Arabidopsis thaliana
  G1836
ataacaagcctagaacactagaaacttcaaaaaagaaaaaaatcttatggagaacaacaacggcaacaaccagctgccaccgaaaggtaacgagcaactgaagagtttctggtcaaaagagatggaaggtaacttagatttcaaaaatcacgaccttcctataactcgtatcaagaagattatgaagtatgatccggatgtgactatgatagctagtgaggctccaatcctcctctcgaaagcatgtgagatgtttatcatggatctcacgatgcgttcgtggctccatgctcaggaaagcaaacgagtcacgctacagaaatctaatgtcgatgccgcagtggctcaaactgttatctttgatttcttgcttgatgatgacattgaggtaaagagagagtctgttgccgccgctgctgatcctgtggccatgccacctattgacgatggagagctgcctccaggaatggtaattggaactcctgtttgttgtagtcttggaatccaccaaccacaaccacaaatgcaggcatggcctggagcttggacctcggtgtctggtgaggaggaagaagcgcgtgggaaaaaaggaggtgacgacggaaactaataagtggaatacgttttagggtattttcaagggaatatgtagtaaatagtcatggatc

SEQ ID NO: 344 - protein, 187 aa, Arabidopsis thaliana
  G1836  (conserved domain in AA coordinates: 30-164)
MENNNGNNQLPPKGNEQLKSFWSKEMEGNLDFKNHDLPITRIKKIMKYDPDVTMIASEAPILLSKACEMFIMDLTMRSWLHAQESKRVTLQKSNVDAAVAQTVIFDFLLDDDIEVKRESVAAAADPVAMPPIDDGELPPGMVIGTPVCCSLGIHQPQPQMQAWPGAWTSVSGEEEEARGKKGGDDGN

SEQ ID NO: 345 - DNA, 1941 bp, Arabidopsis thaliana
  G1838
ttccttggcattctctttagaactttcgtacaaaatgcaaaacctgaacctctaaagctaaaaaaaaagattagagactgtaactgcttttatcagattttcaactaggaaaaaagttacaatcttttttgatggctcctccaatgacgaattgcttaacgttttctctgtcaccaatggagatgttgaaatcaactgatcagtctcacttctcttcttcttacgacgattcttctactccttatctcatcgataacttctatgctttcaaagaagaagctgagatagaagctgctgctgcttcaatggcggattcaacaaccttatctacttttttcgatcattctcagactcagattccaaagctggaagatttcctcggtgattcctttgtccgttactctgataaccaaacagagacccaagactcttcttctctcactccattctacgatccacgtcaccgcaccgttgccgaaggagttacagggttcttctctgatcatcatcagccagatttcaagacgataaactcgggaccagaaatcttcgatgactcaacaacttccaacatcggtggtactcatctctccagtcacgtggtggagtcatcaacgacggcgaagttagggtttaacggtgattgcaccaccaccggaggagttttgtctctaggggttaacaacacatcagatcaacctttgagctgtaacaatggcgagagaggtggaaacagtaacaagaagaaaacagtttctaagaaggaaacatcagatgattcaaagaagaagattgtcgaaacattgggacaaagaacttcaatttatcgtggagtcacccgacatagatggactggaagatacgaagcgcatctatgggataacagctgtaggagggaaggtcaagccagaaaaggacgtcaagtgtacttaggtggatatgacaaggaagatagagcagctagagcctatgacttggcagctttaaaatactggggttctactgctactacaaattttccggtctcgagttattcaaaagaacttgaggaaatgaatcacatgaccaagcaagagtttattgcatctcttaggaggaaaagtagcggtttttcgagaggagcttcaatatatagaggtgtcacaaggcatcatcaacaaggtcgctggcaagcaagaatcggccgtgtcgcaggaaacaaagatctttacctcggaacctttgcaaccgaagaggaagcagcagaggcttatgacattgcagccataaagttcagaggaatcaacgcagtaactaactttgagatgaacaggtatgacattgaagctgtcatgaatagttctttacctgtaggaggagcagctgcgaaacgccacaaactcaaactcgctcttgaatctccttcttcatcatcctctgaccataacctccaacaacaacagttgcttccgtcctcttctccctcggatcaaaaccctaactcaatcccatgtggcattccatttgagccttcagttctctattaccaccagaacttctttcagcattatcctttggtctctgactctacaattcaagctcctatgaaccaagctgagtttttcttgtggcctaaccagtcttactaaatcatttggttcgttcttgcttagacttctattcaccgcactaaccgatgacccgaggcttatcttcttgattctggctataaggatgaatctttcaagttccttttttaactgtaggctaagacagaagtagaggggagaaaagttgaagaatctgaaacttttggggtcaattttgtattaatgtttttcttttgtcaagggtggattatcggttttattacttattttttgaatgtaatcggcctataacggtataactctgtttccatttatgaatatttttctcaaattgaaaaaaaaaaaaaaaaaa

SEQ ID NO: 346 - protein, 498 aa, Arabidopsis thaliana
  G1838  (conserved domain in AA coordinates:229-305, 330-400)
MAPPMTNCLTFSLSPMEMLKSTDQSHFSSSYDDSSTPYLIDNFYAFKEEAEIEAAAASMADSTTLSTFFDHSQTQIPKLEDFLGDSFVRYSDNQTETQDSSSLTPFYDPRHRTVAEGVTGFFSDHHQPDFKTINSGPEIFDDSTTSNIGGTHLSSHVVESSTTAKLGFNGDCTTTGGVLSLGVNNTSDQPLSCNNGERGGNSNKKKTVSKKETSDDSKKKIVETLGQRTSIYRGVTRHRWTGRYEAHLWDNSCRREGQARKGRQVYLGGYDKEDRAARAYDLAALKYWGSTATTNFPVSSYSKELEEMNHMTKQEFIASLRRKSSGFSRGASIYRGVTRHHQQGRWQARIGRVAGNKDLYLGTFATEEEAAEAYDIAAIKFRGINAVTNFEMNRYDIEAVMNSSLPVGGAAAKRHKLKLALESPSSSSSDHNLQQQQLLPSSSPSDQNPNSIPCGIPFEPSVLYYHQNFFQHYPLVSDSTIQAPMNQAEFFLWPNQSY

SEQ ID NO: 347 - DNA, 1009 bp, Arabidopsis thaliana
  G1841
cattccgaaaagtacttgtttattggtgttattcatcgctgctcaaggtggcaaaccaaggagaacaagaagagtccagggccaatgagcctgagggtatcaaatcagtgattgatgacatctacatttttgaagacgaccctgtggttgataggttcaataggtttggcacggagatgtctgccatggtctcggccttgacacaggtggtttctgctcgctctcagactgaggctgaaggtgctcactctcagactgaggctgaaggtgctcactcttcttcctcttcggctggacataaaagaggatggcttggaatcgattctgctcctattccctcatcatttgctcgtgtagactcttcacataatccgatcgaagaatccatgagcaaggcatttccagaggaagcaagggagaaaaaaaggaggtacagaggagtaaggcagagaccatggggcaaatgggcagctgagatacgtgatccacatagagccgctagggtttggctcgggacgtttgatacagcggaggccgcggctagagcctacgacgaggctgcactccggttccgtggaaataaagcaaagctaaatttcccagaggatgtaaggattcttcctcctccccctcctcttcttcgttcaccagctgacacggtggcgaataaagcagaagaggatctgataaattattggagttatacaaagttgttgcaaagttcaggccaacggtcatttctcgagcgaggacaagaagagagtagtaacatatttgaacattcaccaatggaacaacctctgcctccttcaagttctggtccaagttcctctaattttcctgcaccttctctacctaatacatagtttcacttttattaaagctctacaaatacaattaaatacatagctaaatgaaaatgattttcttgtctgtataccttcttaagtgctaaacaatatattgtactctttgttttccttaactaaaaaaaaaaaaaaaaaaaaaa

SEQ ID NO: 348 - protein, 229 aa, Arabidopsis thaliana
  G1841  (conserved domain in AA coordinates: 83-150)
MSAMVSALTQVVSARSQTEAEGAHSQTEAEGAHSSSSSAGHKRGWLGIDSAPIPSSFARVDSSHNPIEESMSKAFPEEAREKKRRYRGVRQRPWGKWAAEIRDPHRAARVWLGTFDTAEAAARAYDEAALRFRGNKAKLNFPEDVRILPPPPPLLRSPADTVANKAEEDLINYWSYTKLLQSSGQRSFLERGQEESSNIFEHSPMEQPLPPSSSGPSSSNFPAPSLPNT

SEQ ID NO: 349 - DNA, 1059 bp, Arabidopsis thaliana
  G1842
actattacatgcctcttcctcgcttcaaaacggcaccgtttccacttgttattatttttctctctatcgtctaacaaaaaaaaaaactgacttgggattttttttcatttgtctagcccaaaagaagaagatagaaacgaagaaaaaaagcaaacacattttgggtccccggtggttaggatcaaattagggcacaaaccttatcggagaaagaagccatgggaagaagaaaagtcgagatcaagcgaatcgagaacaaaagcagtcgacaagtcactttctccaaacgacgcaaaggtctcatcgaaaaagctcgacaactttcaattctctgtgaatcttccatcgctgttgtcgccgtctccggttccggaaaactctacgactctgcctccggtgacaacatgtcaaagatcattgatcgttatgaaatacatcatgctgatgaacttaaagccttagatcttgcagaaaaaattcggaattatcttccacacaaggagttactagaaatagtccaaagcaagcttgaagaatcaaatgtcgataatgtaagtgtagattctctaatatctatggaggaacagctcgagactgctctgtcagtaattagagctaagaagacagaactaatgatggaggatatgaagtcacttcaagaaagggagaagttgctgatagaagagaaccagattctggctagccaggtggggaagaagacgtttctggttatagaaggtgacagaggaatgtcacgggaaaatggctccggcaacaaagtaccggagactctttcgctgctcaagtaatcaccatcatcaacggctgagctttcaccataaacttactcacagcctgattcagaagcttttacaaaattgtaaattataaaaagctgcataataatctcaacctttttatcttcctcgcgccaatgtggaaataaaggtaaaacaaaacgaagctcttttcttttatgcgaaagaattgtaaaactaagataaagctaccgatctttgttgtaccttagtagacaaatatcagagttcttgtgcttgt

SEQ ID NO: 350 - protein, 196 aa, Arabidopsis thaliana
  G1842  (conserved domain in AA coordinates: 2-57)
MGRRKVEIKRIENKSSRQVTFSKRRKGLIEKARQLSILCESSIAVVAVSGSGKLYDSASGDNMSKIIDRYEIHHADELKALDLAEKIRNYLPHKELLEIVQSKLEESNVDNVSVDSLISMEEQLETALSVIRAKKTELMMEDMKSLQEREKLLIEENQILASQVGKKTFLVIEGDRGMSRENGSGNKVPETLSLLK

SEQ ID NO: 351 - DNA, 818 bp, Arabidopsis thaliana
  G1843
cagacatcacaatcaaattaggtcagaagaattagtcggagaaaacagccatgggaagaagaaaagtagagatcaaacgaattgagaacaaaagctctcgacaagttactttctgtaaacgacgaaatggtctcatggagaaagctcgtcaactctcaattctttgtgaatcctccgtcgctcttatcatcatctctgccaccggaagactctacagcttctcctcaggtgatagcatggccaagatcctcagtcgttatgaattagaacaggctgatgatcttaaaaccttggatctagaagaaaaaactcttaattatctttcgcacaaggagttgctagaaacaatccaatgcaagattgaagaagcgaaaagcgataatgtaagtatagattgtctaaagtccctggaagagcagctcaagactgctctgtctgtaactagagctaggaagacagaactaatgatggagcttgtgaagacccatcaagagaaggagaagctgctgagagaggagaaccagagtttgactaaccagcttataaagatggggaagatgaagaagtctgtggaagcagaggatgcaagagcaatgtcaccggaaagtagctctgacaacaagccaccggagactctcctgcttctcaagtaaccaccatcaccaacgactgattcgaaaaataaaaattgtaaaaattatgatttgtagttcataaggaaagctacatactgtatgttaaaaatcctcttcttccccctgctacggaaaagtcatccaaggagatgcatcaaataaagtaattgatttttattgtta

SEQ ID NO: 352 - protein, 200 aa, Arabidopsis thaliana
  G1843  (conserved domain in AA coordinates: 2-57)
MGRRKVEIKRIENKSSRQVTFCKRRNGLMEKARQLSILCESSVALIIISATGRLYSFSSGDSMAKILSRYELEQADDLKTLDLEEKTLNYLSHKELLETIQCKIEEAKSDNVSIDCLKSLEEQLKTALSVTRARKTELMMELVKTHQEKEKLLREENQSLTNQLIKMGKMKKSVEAEDARAMSPESSSDNKPPETLLLLK

SEQ ID NO: 353 - DNA, 1927 bp, Arabidopsis thaliana
  G1852
catctgatctgctctcgaagacgaaagcttcgagtactggttgaagctaaagctatgggacacgtgaatctacctgcatcaaagcgtggtaaccctcgtcaatggcgtctcctcgacatcgtaaccgctgctttcttcggtatcgtacttctcttcttcatccttttattcactcctcttggtgattccatggcggcttctggtcggcaaacgctgcttctctctacggcgtcagatccgaggcaacggcagcgattagtgactttggttgaagctggtcagcatttgcaaccgatcgagtattgtcctgcggaagctgttgctcatatgccttgtgaggatccgagaaggaatagtcagcttagtagagagatgaatttctatagggagagacattgtcctttgcctgaggagactccgctctgtttgattcctccgccttctggttataaaattcctgttccgtggcctgagagtcttcacaagatttggcatgcaaacatgccatataacaaaattgctgaccggaaaggtcatcaaggatggatgaaaagggaaggggaatactttactttcccaggcggtggcacgatgtttcctggcggagctggccaatacattgaaaagcttgcacagtatattccgcttaatggtggaactttgagaactgctcttgacatgggatgcggggtagctagttttggaggtactctactatctcaaggcattctagccctctcatttgctccaagagattcacataaatctcaaattcagttcgctttggaaagaggagtgcctgcatttgttgccatgcttggcactcgtagactcccctttcctgcatactcctttgacctgatgcactgttcccgatgtttgattccttttacggcttacaatgcaacttacttcatcgaagtagataggttactgcgccctggaggatatcttgtaatctctggcccacctgtacaatggcctaaacaagacaaagaatgggctgatcttcaggcggtggctagagctttgtgctatgagctaattgcggttgatggaaacactgtcatctggaagaagcctgttggagattcatgtctacctagccagaatgagtttgggcttgagttgtgtgatgagtctgttccgccaagtgatgcatggtattttaaattgaagaggtgtgttaccaggccatcatccgtcaaaggagaacacgctttgggaactatatccaagtggccggagaggcttactaaagttccttctagggccattgtcatgaaaaacggattggatgtgtttgaagcagatgcaaggcggtgggcaagacgcgttgcttattacagggattctcttaacttgaagctgaaatctccaactgtccgcaatgtcatggacatgaacgcattcttcggaggctttgcagcaacccttgcatctgatcctgtgtgggttatgaatgtcattccagctcggaagccattaactcttgacgtgatttatgacagaggtctcatcggtgtttaccatgattggtgtgaaccattttcaacatatccccgcacgtatgatttcatccatgtatcaggaattgaatcactgataaaacgacaagactcaagcaaatcgaggtgtagcctagtagatctaatggtagagatggacagaatattacgtccagaaggaaaggttgtgatccgagactctcctgaggtgctagataaagtcgcacgaatggctcatgctgtaagatggtcttcttccatacacgagaaagaacctgaatcccatggaagagagaagattcttatcgcaaccaaatctctctggaaattgccatcaaactcccactgaagacacaaaagaagaagaaaagaagaagctcttctcaatcttgtaggtactgtcacttgctctccagccc

SEQ ID NO: 354 - protein, 600 aa, Arabidopsis thaliana
  G1852  (conserved domain in AA coordinates: 1-600)
MGHVNLPASKRGNPRQWRLLDIVTAAFFGIVLLFFILLFTPLGDSMAASGRQTLLLSTASDPRQRQRLVTLVEAGQHLQPIEYCPAEAVAHMPCEDPRRNSQLSREMNFYRERHCPLPEETPLCLIPPPSGYKIPVPWPESLHKIWHANMPYNKIADRKGHQGWMKREGEYFTFPGGGTMFPGGAGQYIEKLAQYIPLNGGTLRTALDMGCGVASFGGTLLSQGILALSFAPRDSHKSQIQFALERGVPAFVAMLGTRRLPFPAYSFDLMHCSRCLIPFTAYNATYFIEVDRLLRPGGYLVISGPPVQWPKQDKEWADLQAVARALCYELIAVDGNTVIWKKPVGDSCLPSQNEFGLELCDESVPPSDAWYFKLKRCVTRPSSVKGEHALGTISKWPERLTKVPSRAIVMKNGLDVFEADARRWARRVAYYRDSLNLKLKSPTVRNVMDMNAFFGGFAATLASDPVWVMNVIPARKPLTLDVIYDRGLIGVYHDWCEPFSTYPRTYDFIHVSGIESLIKRQDSSKSRCSLVDLMVEMDRILRPEGKVVIRDSPEVLDKVARMAHAVRWSSSIHEKEPESHGREKILIATKSLWKLPSNSH

SEQ ID NO: 355 - DNA, 1316 bp, Arabidopsis thaliana
  G1863
ccattatccttaaagtaaccaacacttctctctctctttcttcaatggatttgcaactgaaacaatggagaagccagcagcagcaacaacatcagacagagtcagaagaacaaccttctgcagctaagataccaaaacatgtctttgaccagattcattctcacactgcaacttctactgctcttcctctctttacccctgagcctacttcttctaaactctcctctttgtctcctgattcttcctccaggttccccaagatggggagcttctttagctgggcacagtggcaagaacttgaactacaagctctgatctacaggtacatgttggctggtgctgctgttcctcaggagctccttttaccaatcaagaaaagccttctccatctatctccttcctactttcttcaccatcctcttcaacacctacctcattaccaacctgcttggtatttgggaagggcagcgatggatcctgagccaggcagatgcaggagaacggatggtaagaagtggagatgttcaagagacgtcttcgctggccacaagtattgcgagcgccacatgcaccgtggccgcaaccgttcaagaaagcctgtggaaactccaaccaccgtcaatgcaactgccacgtccatggcttcatcagtagcagccgcagccaccactacaacagcaacaacaacatctacgtttgcttttggtggtggtggtggtagtgaggaagtggttggtcaaggaggatctttcttcttctctggctcttctaactcttcatctgaacttctccaccttagtcaaagttgttcggagatgaagcaagaaagcaacaacatgaacaacaagaggccatacgagtcccacatcggattcagtaacaacagatcagatggaggacacatcctgaggcccttctttgacgattggcctcgttcttcgctccaagaagctgacaatagttcaagccccatgagctcagccacttgtctctccatctccatgcccgggaactcttcctcagacgtctctctgaagctgtccacaggcaacgaagagggagcccggagcaacaacaatgggagagatcagcaaaacatgagctggtggagcggtggaggttccaaccaccatcatcacaacatgggcggaccattggccgaagccctgagatcttcttcctcatcttccccaaccagtgttctccatcagcttggtgtctcgacacaagcctttcattgaccagtgtaaaaccaacacaacaatgcggtttttactgtgtttttggtttttatccaaatttcctgtataaagagg

SEQ ID NO: 356 - protein, 398 aa, Arabidopsis thaliana
  G1863  (conserved domain in AA coordinates: 77-186)
MDLQLKQWRSQQQQQHQTESEEQPSAAKIPKHVFDQIHSHTATSTALPLFTPEPTSSKLSSLSPDSSSRFPKMGSFFSWAQWQELELQALIYRYMLAGAAVPQELLLPIKKSLLHLSPSYFLHHPLQHLPHYQPAWYLGRAAMDPEPGRCRRTDGKKWRCSRDVFAGHKYCERHMHRGRNRSRKPVETPTTVNATATSMASSVAAAATTTTATTTSTFAFGGGGGSEEVVGQGGSFFFSGSSNSSSELLHLSQSCSEMKQESNNMNNKRPYESHIGFSNNRSDGGHILRPFFDDWPRSSLQEADNSSSPMSSATCLSISMPGNSSSDVSLKLSTGNEEGARSNNNGRDQQNMSWWSGGGSNHHHHNMGGPLAEALRSSSSSSPTSVLHQLGVSTQAFH

SEQ ID NO: 357 - DNA, 1320 bp, Arabidopsis thaliana
  G1880
atgttgtccaacaagaacacaaacacatgttgtgtggtttcttcttcttcttctgatcctttcctctcctcttcagaaaatggggtcaccaccacaaacacatccactcagaagaggaaaagaagacctgcaggtaccccagatccagatgcagaagttgtgtctttatcaccaagaactcttcttgaatcagacagatacatatgtgagatctgtaaccaagggtttcaaagagaccagaatctccagatgcatagaagacgtcacaaagttccatggaagcttcttaaaagagacaacaacatagaggtgaagaaacgagtctatgtttgccctgaacccacttgccttcaccataatccttgtcatgctctgggagatcttgtcggcatcaaaaaacatttcagaagaaaacatagtaaccataagcaatgggtttgtgagagatgctctaaaggttatgctgttcaatctgattacaaagctcatctcaaaacttgtggtactagaggacattcttgtgactgtggtcgtgtcttctccagggtggagagttttattgaacatcaagataattgttccgcacggagagttcaccgtgaaccgcctcgaccaccacaaaccgcggtaacagtcccggcatgctcttctagaaccgcctcaaccgtcagcactccgtctagtgaaaccaattacggcggtacagttgcggttacgactcctcaacctctagaaggccgtccaattcatcagagaatctcatcttcaattctcaccaactcatcaaacaatctcaacctcgaactccaacttcttccattatcgtcgaatcaaaaccctaatcaagaaaaccaacaacaaaaagttaaagaaccatctcatcatcataatcataatcatgataccacaaacttaaacctctccattgcaccatcatcatcatatcaacattacaacaactttgatcgtataaaagagattatggcgagcgagcaaattatgaagatagcgatgaaggagaaagcttacgctgaggaagctaaaagagaagccaagaggcaacgagagatagcggaaaacgagtttgcaaatgccaaaaagattaggcaaaaagcacaagctgaactcgagagagctaagtttttaaaggaacaatctatgaagaagataagttcaacgatcatgcaggtcacttgtcaaacatgtaaaggacagtttcaagcagttgcggttccggcggctacggctgatgagacgtctcttgtcgtgagttacatgtcgtcagcgaatactgacggagagttggaaaatggtttttaa

SEQ ID NO: 358 - protein, 439 aa, Arabidopsis thaliana
  G1880  (conserved domain in aa coordinates: 69-89, 111-139)
MLSNKNTNTCCVVSSSSSDPFLSSSENGVTTTNTSTQKRKRRPAGTPDPDAEVVSLSPRTLLESDRYICEICNQGFQRDQNLQMHRRRHKVPWKLLKRDNNIEVKKRVYVCPEPTCLHHNPCHALGDLVGIKKHFRRKHSNHKQWVCERCSKGYAVQSDYKAHLKTCGTRGHSCDCGRVFSRVESFIEHQDNCSARRVHREPPRPPQTAVTVPACSSRTASTVSTPSSETNYGGTVAVTTPQPLEGRPIHQRISSSILTNSSNNLNLELQLLPLSSNQNPNQENQQQKVKEPSHHHNHNHDTTNLNLSIAPSSSYQHYNNFDRIKEIMASEQIMKIAMKEKAYAEEAKREAKRQREIAENEFANAKKIRQKAQAELERAKFLKEQSMKKISSTIMQVTCQTCKGQFQAVAVPAATADETSLVVSYMSSANTDGELENGF

SEQ ID NO: 359 - DNA, 1503 bp, Arabidopsis thaliana
  G1895
cgtcgaccacataacacaaatctaatctcatactccatcttcttttctgtcttatgtcttcaaagattggtatgtctcaagttagagatactccggttaaattgtttggctggacaattacaccggtttctcatgatccatactcttcttcgtcccatgttcttcctgattcttcctcgtcttcctcgtcttcttctctatcacttcgaccacacatggtatgtttcatggtcttacctttatttgttaagaaatgctaaagatttaatattttctctagtccttgtatcagtttgaaactagttcatgatgttaatcctaatccaagttccttcaatttttttcagatgaataaccaatctgttactgacaatacaagtcttaagctgtcatctaatcttaacaacgagtcaaaagaaacatctgagaacagtgatgaccaacacagcgagatcacaacaattacatcggaagaagagaaaacaactgaactgaagaaaccagacaagattcttccatgtccgagatgcaacagcgcagacaccaaattctgttactacaacaactacaacgttaaccagccacgtcacttctgtagaaaatgccagaggtattggaccgctggtggatccatgaggatcgtcccggttggctcaggccgtcgcaagaacaagggatgggtttcttcagaccagtacctgcacatcacttccgaggatactgacaattacaatagctcctcaacaaagattctaagcttcgagtcttcggactctttggtaactgagaggcctaagcatcaatcaaacgaagtgaagataaacgctgaacctgtttcacaagaacccaacaacttccaagggttacttcctccccaagcatcccctgtttcgcctccttggccttaccaataccctccaaaccctagtttctaccacatgcccgtctactggggctgcgcgataccggtttggtctaccctcgacacttctacatgtcttgggaaaaggacaagagacgaaacttctcatgaaactgttaaagagagtaaaaatgcttttgagagaacaagcatgcttttggaatctcagagcatcaaaaatgaaacaagtatggctacaaataaccatgtgtggtatccagtaccgatgacccgcgagaagacacaagaattcagctttttcagtaatggagctgaaacaaagagcagcaacaacagattcgtccctgaaacgtatcttaacctgcaagcaaaccctgcagccatggcaagatctatgaacttcagagagagcatataacgttaaaggagaaaagaaactttgtagatacctttttttgtgtgatgaattaacttttaatatctatcttatttatataccacaatccccattttgtagattatccaaacagatggaaatgctgaagtgtaatgtcttttttggtaaatgtggttcgaaaatattgtttactccattatttgtattctgtagtactagtgtc

SEQ ID NO: 360 - protein, 317 aa, Arabidopsis thaliana
  G1895  (conserved domain in AA coordinates: 58-100)
MNNQSVTDNTSLKLSSNLNNESKETSENSDDQHSEITTITSEEEKTTELKKPDKILPCPRCNSADTKFCYYNNYNVNQPRHFCRKCQRYWTAGGSMRIVPVGSGRRKNKGWVSSDQYLHITSEDTDNYNSSSTKILSFESSDSLVTERPKHQSNEVKINAEPVSQEPNNFQGLLPPQASPVSPPWPYQYPPNPSFYHMPVYWGCAIPVWSTLDTSTCLGKRTRDETSHETVKESKNAFERTSMLLESQSIKNETSMATNNHVWYPVPMTREKTQEFSFFSNGAETKSSNNRFVPETYLNLQANPAAMARSMNFRESI

SEQ ID NO: 361 - DNA, 615 bp, Arabidopsis thaliana
  G1902
atgcaggatccagcagcatattaccagacgatgatggcgaagcaacaacaacaacaacaaccacagtttgcagagcaagaacagttaaagtgtcctcgttgtgactcaccaaacactaaattctgttactacaacaactacaatctctcacagcctcgtcacttttgcaaaagctgtcgtcgttactggactaaaggcggcgctctccgtaacgttcccgtcggtggtggttctcgtaagaacgcaaccaaacgatccacttcttcttcttcttctgcttcctctccttccaacagtagccaaaacaagaagacgaaaaacccggatccggatcctgatccacgtaattctcaaaaaccggatttggatccgacccggatgctttacgggtttccgatcggtgaccaagacgtgaagggtatggagattggtggaagctttagctcgttgttggcgaataatatgcagcttggtcttggaggaggagggatcatgcttgacgggtcgggttgggatcatccgggtatgggtttgggtttgaggagaaccgaaccgggtaataataataataacccatggaccgatctggctatgaacagagcggagaaaaactga

SEQ ID NO: 362 - protein, 204 aa, Arabidopsis thaliana
  G1902  (conserved domain in AA coordinates:31-59)
MQDPAAYYQTMMAKQQQQQQPQFAEQEQLKCPRCDSPNTKFCYYNNYNLSQPRHFCKSCRRYWTKGGALRNVPVGGGSRKNATKRSTSSSSSASSPSNSSQNKKTKNPDPDPDPRNSQKPDLDPTRMLYGFPIGDQDVKGMEIGGSFSSLLANNMQLGLGGGGIMLDGSGWDHPGMGLGLRRTEPGNNNNNPWTDLAMNRAEKN

SEQ ID NO: 363 - DNA, 1200 bp, Arabidopsis thaliana
  G1903
atgtctaaatctagagatacggagataaagttgtttgggaggacaatcacatctcttttagatgtgaattgttatgatccgtcgtcgttgtcccctgttcacgatgtttcttctgatccaagcaaggaggattcgtcttcttcttcatcttcttgttctccaactattggaccaatcagggttccggttaaaaaaagtgagcaagagagtaacaaattcaaagatccatatatattatccgatctaaacgaaccaccaaaagcagtatctgagatttcatcaccaagaagttccaagaacaactgtgatcaacagagcgagatcacaacaacaactaccacaagtactacatcaggagagaaatcaacggctctcaagaaaccggacaagcttattccatgtcctagatgtgaaagcgcaaacaccaaattctgttattacaacaactacaacgtgaaccagccacgttacttctgcaggaactgtcagaggtattggacagctggtggatctatgaggaacgttcctgttggctcaggtcgtcgcaagaacaaaggatggccttcttcaaaccattacttgcaagtcacttctgaggattgtgataataataactcggggacgatccttagtttcggttcttcggagtcttcggttacagagactggtaagcatcagtcaggtgatacagcaaagataagtgctgattcagtttctcaagaaaataaaagctaccaagggtttcttcctccgcaagtaatgttacctaataattcttctccttggccttaccaatggagtccaacgggtcctaacgctagtttctaccctgtccccttctactggggatgcacggttccgatataccctacctcagagacttcatcatgtttaggaaaacggtcaagagatcaaactgaaggaagaatcaatgatactaatacaacaataactactacaagagcaagattggtctcagaatctcttagaatgaatatcgaagctagtaagagcgctgtgtggtctaagttaccgacaaaacccgagaaaaaaacgcaaggattcagtttgttcaatggatttgacacaaagggaaacagcaacagaagtagcttggtctccgaaacttctcacagtctacaagcaaaccctgcagcgatgtctagagctatgaacttcagggagagcatgcaacaataa

SEQ ID NO: 364 - protein, 399 aa, Arabidopsis thaliana
  G1903  (conserved domain in AA coordinates: 134-180)
MSKSRDTEIKLFGRTITSLLDVNCYDPSSLSPVHDVSSDPSKEDSSSSSSSCSPTIGPIRVPVKKSEQESNKFKDPYILSDLNEPPKAVSEISSPRSSKNNCDQQSEITTTTTTSTTSGEKSTALKKPDKLIPCPRCESANTKFCYYNNYNVNQPRYFCRNCQRYWTAGGSMRNVPVGSGRRKNKGWPSSNHYLQVTSEDCDNNNSGTILSFGSSESSVTETGKHQSGDTAKISADSVSQENKSYQGFLPPQVMLPNNSSPWPYQWSPTGPNASFYPVPFYWGCTVPIYPTSETSSCLGKRSRDQTEGRINDTNTTITTTRARLVSESLRMNIEASKSAVWSKLPTKPEKKTQGFSLFNGFDTKGNSNRSSLVSETSHSLQANPAAMSRAMNFRESMQQ

SEQ ID NO: 365 - DNA, 1521 bp, Arabidopsis thaliana
  G1919
atggagtacgatggacggagaccctactctgttctaacgagaaatgaaattaccgtaaagatgaagaaacagatcaatgaaatctctgacatcttcttcatatcaaactccgatgcgaccgtacttcttatgtatctccgatgggactcgcttcgtgtttcagagcgtttaggtgaaaacaaggagaaattattgatggattcaggtttgaaatcagtcatgatcgatcccagtccagattcatctagcgagattagcttggagactgatgtttatgagtttgatggtgataatgatttaatctccatgcccttttgttctcacaagttcgactcaaaatattggagagagtatcttgagaagaatttctactatgtggagaaaatccaaaccacaatctcttgtcctgatcaagattgtcgatctgcggttggaccagacacgattgagaaactaacagtacgtgatcaagagatgtacgagaggtacatttggagatcttacattgaaggaaacaaggtattgatgatcaaacagtgtcctgcacggaattgcgattatgttattgagtttcatcaagagaatgatgatgatgatgagtatagtttaaacgtggtgtgtatctgtggtcatatcttctgttggagatgcagacttgagtcacacagaccagtgagttgtaacaaggcctctgattggttgtgtagtgccacaatgaaaatatcagatgaatcatttagcctttatccgaccaaaaccaagacagtgacttgccctcattgcctctgttctctggagtctgatacaaaaatgccccagttcttgacttgtgtctgcaggcttcgtttctgttcgaggtgtttgcggtcagaggaagcccacaaaattgaagcagtagactctggattctgtattaaaacagaagtggggattttatgtgaggatcgctggaacgtgtgtcagaagttactggagcaagccaaatccgatctagaagctttcgaggaaaccaacatcaagaaaccgagtgacttattaagggagcaagacattatgattataagagaagggttgatgttgattgttcaatgcagacgagtccttaaatggtgttgtgtgtatgactatttccacacagagtatgagaactcgaaggagtatctacgatacctccaaggaaatgcaatcgccacgctccagagttactcaaacactttacaagagcaaaaagatatcgtcctcgctgcagctacttatgaagagtgtactttcttcagacatacgatacctactgcgacaagcaacattggtaactacttttatgattttatgaaaactttacaagatggtttggtcgatgtaaaggtgaagtcatacaacggcgggactggtcctttctggtactgtgatcgctgcacgtatgcaaacacttgggaggataatgagtgtgagatgtgctatgatgatagtgcctctcttgtgggagagataagtgatttgtttcttaacaaagtttcttaa

SEQ ID NO: 366 - protein, 506 aa, Arabidopsis thaliana
  G1919  (conserved domain in AA coordinates:214-287)
MEYDGRRPYSVLTRNEITVKMKKQINEISDIFFISNSDATVLLMYLRWDSLRVSERLGENKEKLLMDSGLKSVMIDPSPDSSSEISLETDVYEFDGDNDLISMPFCSHKFDSKYWREYLEKNFYYVEKIQTTISCPDQDCRSAVGPDTIEKLTVRDQEMYERYIWRSYIEGNKVLMIKQCPARNCDYVIEFHQENDDDDEYSLNVVCICGHIFCWRCRLESHRPVSCNKASDWLCSATMKISDESFSLYPTKTKTVTCPHCLCSLESDTKMPQFLTCVCRLRFCSRCLRSEEAHKIEAVDSGFCIKTEVGILCEDRWNVCQKLLEQAKSDLEAFEETNIKKPSDLLREQDIMIIREGLMLIVQCRRVLKWCCVYDYFHTEYENSKEYLRYLQGNAIATLQSYSNTLQEQKDIVLAAATYEECTFFRHTIPTATSNIGNYFYDFMKTLQDGLVDVKVKSYNGGTGPFWYCDRCTYANTWEDNECEMCYDDSASLVGEISDLFLNKVS

SEQ ID NO: 367 - DNA, 1695 bp, Arabidopsis thaliana
  G1927
atggttgattcttctcgtgattcgtgtttcaaagctggtaagtttagtgctccaggttttcgatttcaccctactgatgaagagcttgtggtttattatcttaagaggaagatctgttgtaaaaaacttcgagtcaatgccattggtgtcgttgatgtttacaaagtcgatccttctgaattgcctggtctatcgatgttgaagacgggagatagacagtggttctttttcactccaaggaataggaagtatcctaacgcagctaggtcaagtagaggtactgcaactggttattggaaggcgacaggaaaggatcgagtcattgagtacaattcaagatctgttggactcaagaagactcttgttttctatagaggtcgtgctcctaatggtgagagaactgactgggtgatgcatgagtacactatggatgaagaagagctagggagatgtaagaacgctaaggagtattatgctctttataagctttataagaagagtggggctggtcctaagaatggtgaacagtatggtgctccgttccaagaagaagaatgggttgatagtgatagtgaagatgcagatagtgtcgctgtaccggattatcccgtggtccgttatgagaatggtccttgtgtggatgatactaaattttgcaatcctgtcaaacttcagttagaggatattgagaagcttctcaatgaaatcccagatgcacccggggttaaccaaagacagtttgatgagtttgttggtgttccacagggtaatagtgcagaagtgatacagagcacattgctgaataattcttctggagagtatattgaccctcggacgaatggaatgttcttgccaaatggccagctatacaacagggactcgagttttcagtcccatttgaattcatttgaggctacctctggtatggcacctcttctagataatgagaaggaggagtacattgaaatgaatgatcttctgatccctgagctcggtgcttcttcaacagagaaatccacagagttcttgaaccatggtgaatttggtgatgttaatgaatacgaccaattgttcaatgacatatctgtttttcagggaacttctacagatctgtcttgtctgagtaattttactaataacacatcaggccaaagacagcaattactttatgaacagttccagtaccagacacctgagaaccagcttaataactacatgcatcctagtaccactcttaatcagttcactgacaatatgtggtttaaagatgatcaggctgctctctatgttcaaccaccacaatcttcttctggagcattcacttcacagtcaacaggtgtgatgcctgagtctatgaatcccactatgagtgtaaatccccaatacaaggaaggacaaaatggtggtggaacaaggagccagttctcatcagctctgtgggaattattggaatcaataccatcaacaccagcctctgcctgtgagggtcctcttaaccagacctttgtgcgtatgtctagcttcagccgcatcaggttcaatggaacgtcagtgactagtagaaaagtcactgtagcaaagaagcgtatcagtaacagaggttttcttctgttatcaattatgggtgctttgtgtgctatcttctgggtgttcaaagccaccgttggagttatgggaagacctctcttgtcgtga

SEQ ID NO: 368 - protein, 564 aa, Arabidopsis thaliana
  G1927  (conserved domain in AA coordinates:17-188)
MVDSSRDSCFKAGKFSAPGFRFHPTDEELVVYYLKRKICCKKLRVNAIGVVDVYKVDPSELPGLSMLKTGDRQWFFFTPRNRKYPNAARSSRGTATGYWKATGKDRVIEYNSRSVGLKKTLVFYRGRAPNGERTDWVMHEYTMDEEELGRCKNAKEYYALYKLYKKSGAGPKNGEQYGAPFQEEEWVDSDSEDADSVAVPDYPVVRYENGPCVDDTKFCNPVKLQLEDIEKLLNEIPDAPGVNQRQFDEFVGVPQGNSAEVIQSTLLNNSSGEYIDPRTNGMFLPNGQLYNRDSSFQSHLNSFEATSGMAPLLDNEKEEYIEMNDLLIPELGASSTEKSTEFLNHGEFGDVNEYDQLFNDISVFQGTSTDLSCLSNFTNNTSGQRQQLLYEQFQYQTPENQLNNYMHPSTTLNQFTDNMWFKDDQAALYVQPPQSSSGAFTSQSTGVMPESMNPTMSVNPQYKEGQNGGGTRSQFSSALWELLESIPSTPASACEGPLNQTFVRMSSFSRIRFNGTSVTSRKVTVAKKRISNRGFLLLSIMGALCAIFWVFKATVGVMGRPLLS

SEQ ID NO: 369 - DNA, 1155 bp, Arabidopsis thaliana
  G1930
attcacattactaatctctcaagatttcacaattttcttgtgattttctctcagtttcttatttcgtttcataacatggatgccatgagtagcgtagacgagagctctacaactacagattccattccggcgagaaagtcatcgtctccggcgagtttactatatagaatgggaagcggaacaagcgtggtacttgattcagagaacggtgtcgaagtcgaagtcgaagccgaatcaagaaagcttccttcttcaagattcaaaggtgttgttcctcaaccaaatggaagatggggagctcagatttacgagaaacatcaacgcgtgtggcttggtactttcaacgaggaagacgaagcagctcgtgcttacgacgtcgcggctcaccgtttccgtggccgcgatgccgttactaatttcaaagacacgacgttcgaagaagaggttgagttcttaaacgcgcattcgaaatcagagatcgtagatatgttgagaaaacacacttacaaagaagagttagaccaaaggaaacgtaaccgtgacggtaacggaaaagagacgacggcgtttgctttggcttcgatggtggttatgacggggtttaaaacggcggagttactgtttgagaaaacggtaacgccaagtgacgtcgggaaactaaaccgtttagttataccaaaacaccaagcggagaaacattttccgttaccgttaggtaataataacgtctccgttaaaggtatgctgttgaatttcgaagacgttaacgggaaagtgtggaggttccgttactcttattggaatagtagtcaaagttatgtgttgaccaaaggttggagtagattcgttaaagagaagagactttgtgctggtgatttgatcagttttaaaagatccaacgatcaagatcaaaaattctttatcgggtggaaatcgaaatccgggttggatctagagacgggtcgggttatgagattgtttggggttgatatttctttaaacgccgtcgttgtagtgaaggaaacaacggaggtgttaatgtcgtcgttaaggtgtaagaagcaacgagttttgtaataacaatttaacaacttgggaaagaaaaaaaagctttttgattttaatttctcttcaacgttaatcttgctgagatta

SEQ ID NO: 370 - protein, 333 aa, Arabidopsis thaliana
  G1930  (conserved domain in AA coordinates: 59-124)
MDAMSSVDESSTTTDSIPARKSSSPASLLYRMGSGTSVVLDSENGVEVEVEAESRKLPSSRFKGVVPQPNGRWGAQIYEKHQRVWLGTFNEEDEAARAYDVAAHRFRGRDAVTNFKDTTFEEEVEFLNAHSKSEIVDMLRKHTYKEELDQRKRNRDGNGKETTAFALASMVVMTGFKTAELLFEKTVTPSDVGKLNRLVIPKHQAEKHFPLPLGNNNVSVKGMLLNFEDVNGKVWRFRYSYWNSSQSYVLTKGWSRFVKEKRLCAGDLISFKRSNDQDQKFFIGWKSKSGLDLETGRVMRLFGVDISLNAVVVVKETTEVLMSSLRCKKQRVL

SEQ ID NO: 371 - DNA, 955 bp, Arabidopsis thaliana
  G1936
tcgacccaccttgaatctgagagagagagagaagtacgtccccacaccttgacatggtcatggagcccaagaagaaccaaaatctaccaagtttcttaaacccatcacgacagaatcaggacaacgacaagaagaggaaacaaacagaggttaaaggtttcgacattgtggtcggcgaaaagaggaagaagaaggagaatgaagaggaagaccaagaaattcagattctttatgagaaggagaagaagaaaccaaacaaagatcgtcaccttaaagttgaaggaagaggtcgtagagttaggttacctccactctgtgcagcaaggatttatcaattgactaaagaattaggtcacaaatcagatggtgagactcttgaatggttgcttcaacatgctgagccatcgatactctctgctactgtaaatggtatcaaacccactgagtctgttgtttctcaacctcctctcacggctgatttgatgatttgtcatagcgttgaagaagcttcaaggactcaaatggaggcaaatgggttgtggagaaatgaaacaggacagaccattggagggtttgatctgaattacggaattgggtttgatttcaatggtgttccagagattggttttggagataatcaaacgcctggacttgaattaaggctgtctcaagttggggttttgaatccacaggtttttcaacaaatgggtaaagaacagttcagggttcttcatcatcattcacatgaagatcagcagcagagtgcagaggaaaatggttcataaagctcaaacctttaaatggcttttaattagatatatttagcgagaatgtgattgctagtgaaatctcaaacttgatagcttattcatagcttattttacttcgatcagcaagagaacaatggttcctaaagctcaaaccttttttggcgtttgctttagattgtgcatac

SEQ ID NO: 372 - protein, 243 aa, Arabidopsis thaliana
  G1936  (conserved domain in AA coordinates:64-129)
MVMEPKKNQNLPSFLNPSRQNQDNDKKRKQTEVKGFDIVVGEKRKKKENEEEDQEIQILYEKEKKKPNKDRHLKVEGRGRRVRLPPLCAARIYQLTKELGHKSDGETLEWLLQHAEPSILSATVNGIKPTESVVSQPPLTADLMICHSVEEASRTQMEANGLWRNETGQTIGGFDLNYGIGFDFNGVPEIGFGDNQTPGLELRLSQVGVLNPQVFQQMGKEQFRVLHHHSHEDQQQSAEENGS

SEQ ID NO: 373 - DNA, 1445 bp, Arabidopsis thaliana
  G1944
tcgaccttcctaatttccaacctctgttcttagcaatatattttttctccaaaaataattctcagtttgattttcttcttctagctcttaagtatatttctttgttgttatttatcttttaatcctttaatctcatctttgtttatctttaatcaaaacccaaaatttacatgggttcttgaaaatctagaagaaataaaggaaacataacaaaaatagaaagaaaaagaagctaatggtcttaaatatggagtctaccggagaagctgttagatcaaccaccggtaacgacggtggtattacggtggttagatccgacgcgccgtcagatttccacgtagctcaaagatcagaaagctcaaaccaatctcccacctctgtcactcctcctccaccacagccatcgtctcatcacacagctcctccgccgctgcaaatttcgacggtgacgactacgactacgacggccgcgatggaaggtatctccggtggactgatgaagaagaagcgtggacggccaaggaagtatggaccggacgggactgttgtagcgttatctcctaaaccgatttcatcagcgccggcgccgtcgcatcttccgccgccgagttcacacgtcatcgatttctccgcttctgagaaacgtagcaaagtgaaaccaacgaactcgtttaacagaacaaagtatcatcaccaagttgagaatttgggtgaatgggctccttgctccgtcggtggtaatttcacacctcatataatcacagtcaacaccggcgaggatgtaacaatgaagataatctcgttttcgcaacaaggacctcgctctatttgtgttctgtcagcaaacggtgttatttcaagcgttacacttcgtcagccagattcctctggcggcacattgacatacgaaggtcggtttgagatattatcattatccgggtcattcatgcctaatgattcaggcggaacacgaagtagaacgggaggaatgagtgtatcgttagcaagtcccgatggacgtgtagtaggcggtggcctcgccggtttactagtagccgcgagtccggttcaggtggttgtaggaagttttttagcgggcactgaccatcaagatcagaaaccgaaaaagaacaaacatgatttcatgttgtcgagtcctaccgctgcaattcctatctctagtgcagctgatcaccggacaatccattcggtctcgtctcttccggtcaataataatacatggcagacttctttagcttccgatccaagaaacaagcataccgatattaatgtcaatgtaacttgaaatccaatctttctctgtattttctgttaacaagtttgatttggttgtttatctacattaggattttactaaaatggtagtattatttatagggttttagggtctttattttggttccactgttgtcacttgtaggata

SEQ ID NO: 374 - protein, 356 aa, Arabidopsis thaliana
  G1944  (conserved domain in AA coordinates:87-100)
MVLNMESTGEAVRSTTGNDGGITVVRSDAPSDFHVAQRSESSNQSPTSVTPPPPQPSSHHTAPPPLQISTVTTTTTTAAMEGISGGLMKKKRGRPRKYGPDGTVVALSPKPISSAPAPSHLPPPSSHVIDFSASEKRSKVKPTNSFNRTKYHHQVENLGEWAPCSVGGNFTPHIITVNTGEDVTMKIISFSQQGPRSICVLSANGVISSVTLRQPDSSGGTLTYEGRFEILSLSGSFMPNDSGGTRSRTGGMSVSLASPDGRVVGGGLAGLLVAASPVQVVVGSFLAGTDHQDQKPKKNKHDFMLSSPTAAIPISSAADHRTIHSVSSLPVNNNTWQTSLASDPRNKHTDINVNVT

SEQ ID NO: 375 - DNA, 1605 bp, Arabidopsis thaliana
  G1946
tctcacctattgtaaaaatcaccagtttcgtatataaaaccctaattttctcaaaattcccaaatattgacttggaatcaaaaatccgaatggatgtgagcaaagtaaccacaagcgacggcggaggagattcaatggagactaagccatctcctcaacctcagcctgcggcgattctaagttcaaacgcgcctcctccgtttctgagcaagacctatgatatggttgatgatcacaatacagattcgattgtctcttggagtgctaataacaacagttttatcgtttggaaaccaccggagttcgctcgcgatcttcttcctaagaactttaagcataataatttctccagcttcgttagacagcttaatacctatggtttcaggaaggttgacccagatagatgggaatttgcgaatgaaggttttttaagaggtcagaagcacttgctacaatcaataactaggcgaaaacctgcccatggacagggacagggacatcagcgatctcagcactcgaatggacagaactcatctgttagcgcatgtgttgaagttggcaaatttggtctcgaagaagaagttgaaaggcttaaaagagataagaacgtccttatgcaagaactcgtcagattaagacagcagcaacagtccactgataaccaacttcaaacgatggttcagcgtctccagggcatggagaatcggcaacaacaattaatgtcattccttgcaaaggcagtacaaagccctcattttctatctcaattcttacagcagcagaatcagcaaaacgagagtaataggcgcatcagtgataccagtaagaagcggagattcaagcgagacggcattgtccgtaataatgattctgctactcctgatggacagatagtgaagtatcaacctccaatgcacgagcaagccaaagcaatgtttaaacagcttatgaagatggaaccttacaaaaccggcgatgatggtttccttctaggtaatggtacgtctactaccgagggaacagagatggagacttcatcaaaccaagtatcgggtataactcttaaggaaatgcctacagcttctgagatacagtcatcatcaccaattgaaacaactcctgaaaatgtttcggcagcatcagaagcaaccgagaactgtattccttcacctgatgatctaactcttcccgacttcactcatatgctaccggaaaataattcagagaagcctccagagagtttcatggaaccaaacctgggaggttctagtccattactagatccagatctgttgatcgatgattctttgtccttcgacattgacgactttccaatggattctgatatagaccctgttgattacggtttactcgaacgcttactcatgtcaagcccggttccagataatatggattcaacaccagtggacaatgaaacagagcaggaacaaaatggatgggacaaaactaagcatatggataatctgactcaacagatgggtctcctctctcctgaaaccttagatctctcaaggcaaaatccttgattttgggagtttttaaagtcttttgaggtaacacagtccctgagagcagcatattcat

SEQ ID NO: 376 - protein, 485 aa, Arabidopsis thaliana
  G1946  (conserved domain in AA coordinates: 32-130)
MDVSKVTTSDGGGDSMETKPSPQPQPAAILSSNAPPPFLSKTYDMVDDHNTDSIVSWSANNNSFIVWKPPEFARDLLPKNFKHNNFSSFVRQLNTYGFRKVDPDRWEFANEGFLRGQKHLLQSITRRKPAHGQGQGHQRSQHSNGQNSSVSACVEVGKFGLEEEVERLKRDKNVLMQELVRLRQQQQSTDNQLQTMVQRLQGMENRQQQLMSFLAKAVQSPHFLSQFLQQQNQQNESNRRISDTSKKRRFKRDGIVRNNDSATPDGQIVKYQPPMHEQAKAMFKQLMKMEPYKTGDDGFLLGNGTSTTEGTEMETSSNQVSGITLKEMPTASEIQSSSPIETTPENVSAASEATENCIPSPDDLTLPDFTHMLPENNSEKPPESFMEPNLGGSSPLLDPDLLIDDSLSFDIDDFPMDSDIDPVDYGLLERLLMSSPVPDNMDSTPVDNETEQEQNGWDKTKHMDNLTQQMGLLSPETLDLSRQNP

SEQ ID NO: 377 - DNA, 1076 bp, Arabidopsis thaliana
  G1947
acaactattctctcctctctctttttttattaaaaaagctcaaatttatataggttttttgttcacaaaatggattataaccttccaattccattagagggtctcaaagaaacgccaccaacggctttcttgacgaaaacatacaacatagtggaggattcaagcacaaacaacatagtttcatggagcagagacaacaacagcttcattgtttgggaaccagagacttttgccctaatttgcctccctagatgctttaagcacaataatttctccagctttgttagacagctcaatacttatgggtttaagaagattgatacagagagatgggaatttgcaaatgagcattttctgaagggagagaggcatcttcttaagaacatcaagagaagaaagacatcatctcaaacgcaaacgcagtcgctagaaggagagatccatgagctgcgaagagacagaatggctttagaagtagaactggttagactgcgacgaaaacaagaaagcgtgaagacatatctgcatttgatggaagagaaactgaaagtcacagaagtaaagcaagaaatgatgatgaatttcttgctaaagaagattaagaaaccgagttttttacagagcttaaggaaacgtaatctgcaaggaatcaagaatcgagagcaaaagcaagaggtgatctcaagccatggtgttgaggataatggaaagtttgttaaagctgagccagaagagtatggtgatgacatcgatgatcaatgtggaggtgtgtttgattatggtgatgagcttcacatagcttcaatggagcatcaaggacaaggggaggatgaaattgaaatggatagtgaaggaatttggaagggtttcgtgttgagtgaggaggagatgtgtgatttagtggaacattttatataataaactaatgtattatgagaggtttttttttgtttttttgctttttttttccgagtttgtcatcaagcattgtatacaatttgggccaaactaaaagcccaacaaaatatttggccttggcatttgttaacaaattgactaattcggccacaccttcc

SEQ ID NO: 378 - protein, 282 aa, Arabidopsis thaliana
  G1947  (conserved domain in AA coordinates: 37-120)
MDYNLPIPLEGLKETPPTAFLTKTYNIVEDSSTNNIVSWSRDNNSFIVWEPETFALICLPRCFKHNNFSSFVRQLNTYGFKKIDTERWEFANEHFLKGERHLLKNIKRRKTSSQTQTQSLEGEIHELRRDRMALEVELVRLRRKQESVKTYLHLMEEKLKVTEVKQEMMMNFLLKKIKKPSFLQSLRKRNLQGIKNREQKQEVISSHGVEDNGKFVKAEPEEYGDDIDDQCGGVFDYGDELHIASMEHQGQGEDEIEMDSEGIWKGFVLSEEEMCDLVEHFI

SEQ ID NO: 379 - DNA, 1320 bp, Arabidopsis thaliana
  G1948
aaaaggtcttcttggccatggatacttgtgctctagtaatccatcagtctctgtctcgcatcaaactttctcctcccaaatcttcttcttcttcttcttctgctttctcccctgaatccttaccgatcagacggatcgagctgtgtttccgaggagctatatgtgccgccgtacaaagaaactacgaagaaacgacctcctccgtggaagaggcagaggaagatgatgagtcatcatcatcgtacggagaagtgaacaagatcattggaagccgaacggcgggggaaggagccatggagtaccttatcgagtggaaggacggccattctccgtcgtgggttccatcgagctacatcgcagcagacgtagtgtcggagtacgagacaccctggtggacggcagctagaaaagccgacgagcaggccctgtcacagctcctggaggaccgagacgtcgatgccgtggacgaaaacggccggacggctctgcttttcgtggcaggtctggggtcggacaagtgcgtaaggcttctggcggaggctggagccgatctcgaccaccgagacatgaggggaggcttgacggcgctgcacatggcggctggttacgtgaggccggaggtggtggaggcgctggtggagctgggagctgatattgaagtggaagacgagagagggttaacggcgttggaactagcgagggagattctgaagacgacgccgaaggggaatccgatgcagttcgggaggagaattgggttagagaaagtgatcaatgtcctggaaggacaagtgttcgagtacgccgaggtggatgagatcgtagagaaacgagggaaaggcaaagacgttgaatatctggtcagatggaaggacggtggagattgcgagtgggtgaaaggtgtacacgtggcggaagatgtggctaaggactacgaggatgggctggagtacgctgtagcggagagtgtgatcgggaagagggtgggagacgatgggaagaccatcgagtatcttgtcaaatggactgatatgtctgatgccacttgggagcctcaggacaatgtcgactctactcttgttctactctaccaacaacaacaaccaatgaatgaatgattgattttgatgattacattcttctcaatttgcttctttctcatatgtgttggttcatctgaccggttcggttggtacgtaccggtacattttcattttcttttaagatgtgatcttgatggtttttggccttttggggacactatttgattttatatccatgctttgaattttgcttccctttttggggagattcatgaaa

SEQ ID NO: 380 - protein, 366 aa, Arabidopsis thaliana
  G1948  (conserved domain in AA coordinates: 1-367)
MDTCALVIHQSLSRIKLSPPKSSSSSSSAFSPESLPIRRIELCFRGAICAAVQRNYEETTSSVEEAEEDDESSSSYGEVNKIIGSRTAGEGAMEYLIEWKDGHSPSWVPSSYIAADVVSEYETPWWTAARKADEQALSQLLEDRDVDAVDENGRTALLFVAGLGSDKCVRLLAEAGADLDHRDMRGGLTALHMAAGYVRPEVVEALVELGADIEVEDERGLTALELAREILKTTPKGNPMQFGRRIGLEKVINVLEGQVFEYAEVDEIVEKRGKGKDVEYLVRWKDGGDCEWVKGVHVAEDVAKDYEDGLEYAVAESVIGKRVGDDGKTIEYLVKWTDMSDATWEPQDNVDSTLVLLYQQQQPMNE

SEQ ID NO: 381 - DNA, 883 bp, Arabidopsis thaliana
  G1950
ctgaattcgaactttggaagaagaagaagctttgatcaatcatggaaattgcaaccgatacagcaaagcagatgagagacgaagagttgttcaaagcagcggaatggggagattcatcgttgttcatgtcattatctgaagaacagctctctaaatctctcaatttcagaaacgaagatggtcgctctctcctccatgtcgctgcttccttcggccattctcaaatagtgaagttgttatcaagttcagatgaagcaaagactgtaatcaatagcaaggatgatgaaggatgggctcctttgcattccgctgctagcatcggtaatgctgagctcgttgaggtgcttttgaccagaggtgctgatgtcaatgccaaaaataacggtggtcgcactgctcttcactatgctgctagcaaaggccggttggagattgctcagcttttattaacacacggtgcaaagattaacatcacagacaaggttggttgcactccgcttcacagggcagcaagcgtgggaaagttagaagtttgtgaatttcttattgaagaaggagcagagatcgatgctacggataaaatgggtcaaactgcactcatgcattcagttatctgcgatgacaaacaggttgcgttcctgcttataagacatggtgcagatgtggatgtagaagacaaggaaggctacactgttctaggccgagctaccaatgaattccgacctgcacttatcgatgctgctaaggccatgcttgaaggataaaatgactctggattactttaaaacttactaactctgagagttgtttagttacttaaaaggatttttctttactgtatcatgtttgcaaaatgtttctgccttatcaattcatgttctgt

SEQ ID NO: 382 - protein, 240 aa, Arabidopsis thaliana
  G1950  (conserved domain in AA coordinates: 65-228)
MEIATDTAKQMRDEELFKAAEWGDSSLFMSLSEEQLSKSLNFRNEDGRSLLHVAASFGHSQIVKLLSSSDEAKTVINSKDDEGWAPLHSAASIGNAELVEVLLTRGADVNAKNNGGRTALHYAASKGRLEIAQLLLTHGAKINITDKVGCTPLHRAASVGKLEVCEFLIEEGAEIDATDKMGQTALMHSVICDDKQVAFLLIRHGADVDVEDKEGYTVLGRATNEFRPALIDAAKAMLEG

SEQ ID NO: 383 - DNA, 1444 bp, Arabidopsis thaliana
  G1958
gtaccgtcgaccgattatccccaagaggagaatcctcataatcattttctccgattcgattcgtcttccttggtcctggattgcttcatgaatttctaggacaacaatggaggctcgtccagttcatagatcaggttcgagagacctcacacgcacttcttcaatcccatctacacaaaaaccttcaccagtagaagatagtttcatgagatcagataacaacagtcagttaatgtctagaccattaggacaaacctaccatttactttcatctagtaacggtggagctgttggacatatatgttcttcttcatcatctggttttgcaaccaatctccattactcaactatggtatctcatgagaaacaacaacactacacaggaagcagcagtaataatgctgtgcagacaccaagcaacaacgatagtgcttggtgtcatgattcattgccaggagggtttcttgacttccatgaaaccaacccggcgattcaaaacaactgtcagattgaggatggtggcattgcggctgcttttgatgacattcaaaaacgaagtgattggcatgaatgggctgaccatttgatcactgatgatgatcctttgatgtctactaactggaatgatctcttgcttgaaacaaattccaattcagattcaaaggaccagaagacactgcaaattccgcaacctcagattgttcagcagcaaccttctccgtctgtggaattgcgacctgttagcacaacatcttcaaacagcaataacggaacgggcaaggcacgaatgcgttggacgccagagcttcacgaggcttttgttgaggctgtcaacagtcttggcggtagtgaaagagctactcctaaaggggtactgaagattatgaaagttgaaggcttgactatatatcatgttaaaagccatttacagaaatataggacagctagatatcggccagaaccatcagaaactggttcgccagaaaggaagttgacaccgcttgaacatataacatctcttgatttgaaaggtgggataggtattacagaggctctacgacttcagatggaagtacagaagcaactccatgagcagctcgagattcaaagaaacctgcaactccgaatagaagaacaaggcaagtacctgcaaatgatgttcgagaagcaaaactctggtcttaccaaagggacagcctcaacatcagattccgcagccaaatctgaacaagaagacaagaagactgctgattcgaaggaggttccagaagaagaaaccaggaaatgtgaggaactagaatctccacagccaaagcgtcccaaaatcgataattgaaagtattggtcttttgctggataatctcggagtttcagagttaacagtgatagagagaacgagctcttatcttgaggttcttcaggacttctctcgcggccgctctag

SEQ ID NO: 384 - protein, 409 aa, Arabidopsis thaliana
  G1958  (conserved domain in AA coordinates: 230-278)
MEARPVHRSGSRDLTRTSSIPSTQKPSPVEDSFMRSDNNSQLMSRPLGQTYHLLSSSNGGAVGHICSSSSSGFATNLHYSTMVSHEKQQHYTGSSSNNAVQTPSNNDSAWCHDSLPGGFLDFHETNPAIQNNCQIEDGGIAAAFDDIQKRSDWHEWADHLITDDDPLMSTNWNDLLLETNSNSDSKDQKTLQIPQPQIVQQQPSPSVELRPVSTTSSNSNNGTGKARMRWTPELHEAFVEAVNSLGGSERATPKGVLKIMKVEGLTIYHVKSHLQKYRTARYRPEPSETGSPERKLTPLEHITSLDLKGGIGITEALRLQMEVQKQLHEQLEIQRNLQLRIEEQGKYLQMMFEKQNSGLTKGTASTSDSAAKSEQEDKKTADSKEVPEEETRKCEELESPQPKRPKIDN

SEQ ID NO: 385 - DNA, 861 bp, Arabidopsis thaliana
  G2007
atgggaaggcagccatgttgtgacaagctcatggtgaagaaggggccgtggacggcggaggaagacaagaaactgataaactttatcttgaccaacggccactgttgctggagggctttgccgaagctggccggtctccgtcgctgtgggaagagctgccgtctacggtggaccaattatctccgacctgacttgaagagaggtcttctctccgacgccgaggaacagcttgtcatcgaccttcatgctcttctcggcaacagatggtccaagatcgctgcaagattaccaggaagaacagacaacgaaataaaaaatcattggaatactcatatcaagaagaagctccttaagatggaaatcgatccttcgacccatcaacctttaaacaaagtatttaccgatacaaacttagtcgataaatctgaaacttcatcgaaagccgacaatgtaaatgataataaaatcgtagagatcgatgggacaacgacaaatacaatagatgatagcattatcactcatcaaaatagttcaaatgatgattatgaattacttggtgatataattcataattatggagatttatttaatattctatggaccaacgatgaacctcctctagtcgatgatgcatcatggagcaatcataacgttggtattggaggaacagctgcagttgcagcctcagacaagaacaacactgctgccgaggaagatttcccggaaagatcatttgaaaaacagaacggcgaaagttggatgttcttggattattgccaagaatttggtgttgaagattttgggttcgagtgttaccatggttttggtcaaagctccatgaagacgggtcacaaggactag

SEQ ID NO: 386 - protein, 286 aa, Arabidopsis thaliana
  G2007  (conserved domain in AA coordinates: 14-116)
MGRQPCCDKLMVKKGPWTAEEDKKLINFILTNGHCCWRALPKLAGLRRCGKSCRLRWTNYLRPDLKRGLLSDAEEQLVIDLHALLGNRWSKIAARLPGRTDNEIKNHWNTHIKKKLLKMEIDPSTHQPLNKVFTDTNLVDKSETSSKADNVNDNKIVEIDGTTTNTIDDSIITHQNSSNDDYELLGDIIHNYGDLFNILWTNDEPPLVDDASWSNHNVGIGGTAAVAASDKNNTAAEEDFPERSFEKQNGESWMFLDYCQEFGVEDFGFECYHGFGQSSMKTGHKD

SEQ ID NO: 387 - DNA, 525 bp, Arabidopsis thaliana
  G2010
atggagggtaagagatcacaaggacaaggttacatgaaaaagaagtcttaccttgtggaagaagatatggagactgatacggatgaagaagaggaagtaggtagggatagagttagagggtctagaggtagcatcaatcgtggtggctcgttgcggctttgccaagtagatagatgcacagctgatatgaaagaggcaaaactgtatcaccggagacacaaagtgtgtgaagttcatgcaaaggcatcttctgtctttctctcaggacttaaccaacgcttttgtcaacaatgcagtaggtttcatgacctccaagagtttgatgaagctaagagaagttgcaggaggcgcttagctggacacaatgagcgaagaaggaagagctctggtgagagtacttatggagaaggatcaggtcggagaggaatcaatggtcaggtggtgatgcagaatcaagaaagatcaagggtagagatgacacttcctatgccaaactcatcattcaagcgaccacagattagatag

SEQ ID NO: 388 - protein, 174 aa, Arabidopsis thaliana
  G2010  (conserved domain in AA coordinates: 53-127)
MEGKRSQGQGYMKKKSYLVEEDMETDTDEEEEVGRDRVRGSRGSINRGGSLRLCQVDRCTADMKEAKLYHRRHKVCEVHAKASSVFLSGLNQRFCQQCSRFHDLQEFDEAKRSCRRRLAGHNERRRKSSGESTYGEGSGRRGINGQVVMQNQERSRVEMTLPMPNSSFKRPQIR

SEQ ID NO: 389 - DNA, 1029 bp, Arabidopsis thaliana
  G2053
atggagaatccggtgggtttaagattccgtccgaccgacaaggagatcgtcgtcgattacctccgaccaaaaaactccgatagggacacgagtcatgttgatcgagtcattagcacagtcactatccgtagcttcgacccttgggagttaccttgccagtctaggatcaaactgaaagatgagtcttggtgtttcttcagccctaaggagaacaaatatggcagaggtgatcaacaaattagaaaaacgaaatctggttactggaagattactggcaaaccaaagcctatcttgcgtaaccgccaagagatcggtgagaaaaaggttttgatgttttacatgagtaaggaacttggtggatccaaatccgactgggttatgcacgagtaccatgctttctctcctactcagatgatgatgacatatacaatatgtaaagttatgtttaagggtgacgtgagagagatttcttcttcttctgcttcttatggtagtgaaattgagcagagtcgtgactctttaatccctcttcttgtgaacgattctgaggaagaagctcaaatcgaggatgctataccaatagaggaatgggaaacatggttgactgatgatggtgttgatgagcaggtgaatcatattatgaatatgaaagatgatcgcaacaaccacaggcctcaaaagccattgactggtgtcttgattgacgatagtagtgatgatgatgatgattctgatttgctatctccaacaacaaattctattgaaaattcgagcacttgtgatagttttggtagctcagaccaaatcaacttagtgtcactaactcaagaggtgagccaagctctgataaccagtattgatacacccgagaagattaagagtccttatgatgatgcacaagggactggggctggagggcaaaaattgggtcaagagactcgagagaagaaacgagctggtttctttcacaggatgatacaaatattcgtcaagaaaattcaccaatgttcttctatctcaagaacataa

SEQ ID NO: 390 - protein, 342 aa, Arabidopsis thaliana
  G2053  (conserved domain in AA coordinates:10-149)
MENPVGLRFRPTDKEIVVDYLRPKNSDRDTSHVDRVISTVTIRSFDPWELPCQSRIKLKDESWCFFSPKENKYGRGDQQIRKTKSGYWKITGKPKPILRNRQEIGEKKVLMFYMSKELGGSKSDWVMHEYHAFSPTQMMMTYTICKVMFKGDVREISSSSASYGSEIEQSRDSLIPLLVNDSEEEAQIEDAIPIEEWETWLTDDGVDEQVNHIMNMKDDRNNHRPQKPLTGVLIDDSSDDDDDSDLLSPTTNSIENSSTCDSFGSSDQINLVSLTQEVSQALITSIDTPEKIKSPYDDAQGTGAGGQKLGQETREKKRAGFFHRMIQIFVKKIHQCSSISRT

SEQ ID NO: 391 - DNA, 1270 bp, Arabidopsis thaliana
  G2059
ttaagaacaggcttcattctctggacaaacactcaaaaaacaaacaaaaaaaggaacatggaagatcagtttcctaaaatagaaactagcttcatgcacgacaagctcttgtcttctggaatctacgggttcttgagttcttcgacgccgccacaacttctcggtgttccaatatttttggaaggtatgaaatctcctcttcttcctgcttcttcgactccgagctactttgtgtcgcctcatgatcatgagctcacatcttctattcatccatctccggtagcttctgttccttggaactttctagaatcttttcctcagtctcaacatcctgatcatcatccttctaaacctccaaaccttactttgttccttaaagaaccaaagctactagaactttctcaatccgaaagcaacatgagcccttaccataaatacatcccaaactccttttatcaatcagaccaaaacagaaacgaatgggtagagatcaataaaactctaaccaactatccctcgaaaggttttggaaactattggctaagtaccaccaagactcaacccatgaagtcaaaaacaagaaaggttgttcagacgacgaccccaacaaaactgtatagaggagtgagacaaagacactggggcaaatgggtcgcagagattaggcttccaaggaacagaacccgtgtttggctcggcacttttgaaaccgctgagcaagcagcaatggcttacgatacagcagcttatatccttcgtggcgaattcgcacacctcaactttcctgatcttaaacaccagctcaagtccggttctttgcgatgcatgatcgcctcacttttggagtccaagattcaacagatctcatcttcccaagtaagtaactctccttctcctcctcctccaaaagtgggaacaccggagcaaaagaatcatcacatgaagatggagtcaggagaagacgtgatgatgaagaaacagaaaagccataaggaagtgatggaaggagatggtgtacaattgagtaggatgccttctttggatatggatctcatttgggatgctctctcatttcctcattcttcttgacttcaaattaatatttgtcaaacttattttacttacttctacccttttttatatcaaaagtttccaccaaagaaagaaattcatattatgatgccaagattggtttgcatttggggttgaacacattgtaattcttcttacgaccacataatcaagtggttctcctttttttgtctgctaa

SEQ ID NO: 392 - protein, 343 aa, Arabidopsis thaliana
  G2059  (conserved domain in AA coordinates:184-254)
MEDQFPKIETSFMHDKLLSSGIYGFLSSSTPPQLLGVPIFLEGMKSPLLPASSTPSYFVSPHDHELTSSIHPSPVASVPWNFLESFPQSQHPDHHPSKPPNLTLFLKEPKLLELSQSESNMSPYHKYIPNSFYQSDQNRNEWVEINKTLTNYPSKGFGNYWLSTTKTQPMKSKTRKVVQTTTPTKLYRGVRQRHWGKWVAEIRLPRNRTRVWLGTFETAEQAAMAYDTAAYILRGEFAHLNFPDLKHQLKSGSLRCMIASLLESKIQQISSSQVSNSPSPPPPKVGTPEQKNHHMKMESGEDVMMKKQKSHKEVMEGDGVQLSRMPSLDMDLIWDALSFPHSS

SEQ ID NO: 393 - DNA, 1688 bp, Arabidopsis thaliana
  G2085
aagcgagagtagggaactgccaggcatcaaataaaacgaaaggctcagtcggaagactgggcctttcgttttatctgttgtttgtcggtgaacgctctcctgagtaggacaaatccgccgggagcggatttgaacgttgtgaagcaacggcccggagggtggcgggcaggacgcccgccataaactgccaggcatcaaactaagcagaaggccatcctgacggatggcctttttgcgtttctacaaactcttcctgttagttagttacttaagctcgggccccaaataatgattttattttgactgatagtgacctgttcgttgcaacaaattgataagcaatgcttttttataatgccaactttgtacaaaaaagcaggctttaaaggaaccaattcagtcgacgttctttctctatatccttcaatcaatgtgaaaaaaaagctctcccttttggcagtttccgatgtttggtcgccattcgattatcccaaataaccagattggtaccgcctctgcttccgctggtgaagaccatgtctctgcctccgctacgtctggtcacattccttacgacgatatggaagaaatccctcatcctgactctatctatggtgctgcctccgatttgattcccgatggctctcaattggttgctcaccgatccgatggctctgaattacttgtttctcggccaccggaaggggcgaatcagcttacgatctcgttccgtggacaagtttacgtttttgatgccgttggtgctgacaaggtggatgctgtgttgtcgctgttgggtggttctactgagcttgctcctggtccgcaggtgatggaactagctcaacagcagaatcatatgcctgttgtagaatatcagagccgctgtagccttccgcaacgggcacaatccttggataggtttcggaagaagaggaatgctagatgtttcgagaagaaagtaagatacggtgttcgccaagaagttgccttaagaatggcacgtaataaaggtcaattcacctcttcaaagatgacagatggggcttataactctggcacagatcaagattctgcccaagatgatgcccatccagaaatatcgtgtactcattgcggcattagttccaaatgtacaccaatgatgcgacgtggcccttccggccccaggactctctgcaatgcctgtggacttttttgggctaacaggggtacattgagggatctctcaaagaaaacagaagagaatcagttggctttaatgaaaccggatgatggtgggagtgttgctgatgctgctaacaacttaaacactgaagctgcaagtgttgaagaacacacttccatggtttctcttgccaatggggataattctaatctgttaggtgatcactaaatactgtgataagaatcagaagatagaaatctttgtagaatcagatggtcttctctatgaatttatcttttcaccatcacatgtattatagaaaccgtaaccgaacctcaaatcaaataccatctcaggcggccgcactcgagatatctagacccagctttcttgtacaaagttggcattataagaaagcattgcttatcaatttgttgcaacgaacaggtcactatcagtcaaaataaaatcattatttgccatccagctgcagctctggcccgtgtctcaaaatctcggg

SEQ ID NO: 394 - protein, 309 aa, Arabidopsis thaliana
  G2085  (conserved domain in aa coordinates: 214-241)
MFGRHSIIPNNQIGTASASAGEDHVSASATSGHIPYDDMEEIPHPDSIYGAASDLIPDGSQLVAHRSDGSELLVSRPPEGANQLTISFRGQVYVFDAVGADKVDAVLSLLGGSTELAPGPQVMELAQQQNHMPVVEYQSRCSLPQRAQSLDRFRKKRNARCFEKKVRYGVRQEVALRMARNKGQFTSSKMTDGAYNSGTDQDSAQDDAHPEISCTHCGISSKCTPMMRRGPSGPRTLCNACGLFWANRGTLRDLSKKTEENQLALMKPDDGGSVADAANNLNTEAASVEEHTSMVSLANGDNSNLLGDH

SEQ ID NO: 395 - DNA, 1536 bp, Arabidopsis thaliana
  G2105
ctctctgacttgaactcttctcttctaccgaatcaaaccaaatggaggatcatcaaaaccatccacagtacggtatagaacaaccatcttctcaattctcctctgatctcttcggcttcaacctcgtttcagcgccggaccagcaccatcgtcttcatttcaccgaccatgagataagtttattgccacgtggaatacaagggcttacggtggctggaaacaacagtaacactattacaacgatccagagtggtggctgtgttggtgggtttagtggctttacggacggcggaggaacagggaggtggccgaggcaagagacgttgatgttgttggaggtcagatctcgtcttgatcacaagttcaaagaagctaatcaaaagggtcctctctgggatgaagtttctaggattatgtcggaggaacatggatacactaggagtggcaagaagtgtagagagaagttcgagaatctctacaagtactataaaaaaacaaaagaaggcaaatccggtcggcgacaagatggtaaaaactatagatttttccggcagcttgaagcgatatacggcgaatccaaagactcggtttcttgctataacaacacgcagttcataatgaccaatgctcttcatagtaatttccgcgcttctaacattcataacatcgtccctcatcatcagaatcccttgatgaccaataccaatactcaaagtcaaagccttagcatttctaacaatttcaactcctcctccgatttggatctaacttcttcctctgaaggaaacgaaactactaaaagagaggggatgcattggaaggaaaagatcaaggaattcattggtgttcatatggagaggttgatagagaagcaagatttttggcttgagaagttgatgaagattgtggaagacaaagaacatcaaaggatgctgagagaagaggaatggagaaggattgaagcggaaaggatcgataaggaacgttcgttttggacaaaagagagggagaggattgaagctcgggatgttgcggtgattaatgccttgcagtacttgacgggaagggcattgataaggccggattcttcgtctcctacagagaggattaatgggaatggaagcgataaaatgatggctgataatgaatttgctgatgaaggaaataagggcaagatggataaaaaacaaatgaataagaaaaggaaggagaaatggtcaagccacggagggaatcatccaagaaccaaagagaatatgatgatatacaacaatcaagaaactaagattaatgatttttgtcgagatgatgaccaatgccatcatgaaggttactcaccttcaaactccaagaacgcaggaactccgagctgcagcaatgccatggcagctagtacaaagtgctttccattgcttgaaggagaaggagatcagaacttgtgggagggttatggtttgaagcaaaggaaagaaaataatcatcagtaagctacatttttcattctcaaaatgaagaataagagaacttagaaacgat

SEQ ID NO: 396 - protein, 481 aa, Arabidopsis thaliana
  G2105  (conserved domain in AA coordinates: 100-153)
MEDHQNHPQYGIEQPSSQFSSDLFGFNLVSAPDQHHRLHFTDHEISLLPRGIQGLTVAGNNSNTITTIQSGGCVGGFSGFTDGGGTGRWPRQETLMLLEVRSRLDHKFKEANQKGPLWDEVSRIMSEEHGYTRSGKKCREKFENLYKYYKKTKEGKSGRRQDGKNYRFFRQLEAIYGESKDSVSCYNNTQFIMTNALHSNFRASNIHNIVPHHQNPLMTNTNTQSQSLSISNNFNSSSDLDLTSSSEGNETTKREGMHWKEKIKEFIGVHMERLIEKQDFWLEKLMKIVEDKEHQRMLREEEWRRIEAERIDKERSFWTKERERIEARDVAVINALQYLTGRALIRPDSSSPTERINGNGSDKMMADNEFADEGNKGKMDKKQMNKKRKEKWSSHGGNHPRTKENMMIYNNQETKINDFCRDDDQCHHEGYSPSNSKNAGTPSCSNAMAASTKCFPLLEGEGDQNLWEGYGLKQRKENNHQ

SEQ ID NO: 397 - DNA, 1828 bp, Arabidopsis thaliana
  G2110
gagagctaataaaaaatttatcaaagaagactaatatggagaaggacgatttcttgaggagtggtcatggaagagaagaaagccatgatgagatgagaaaacttgattcatctcacgatgattctcatcaagaacacgaccatattataagatccaagttggactcaactaaagtcgaaatggatgaggctaaagaggaaaatcgaagactaaagtcatcattgagtaaaatcaagaaagattttgacatccttcaaacacaatacaaccaattaatggccaaacataacgaaccaaccaagttccaatcaaaagggcatcatcaagacaaaggcgaagatgaagacagagaaaaagttaacgaacgtgaagaacttgtctcgttgagcctaggcagacggttaaattcagaggttccaagtggttcgaataaagaagaaaaaaataaagatgttgaagaagcggaaggtgacagaaattatgatgataatgaaaaaagcagtattcaagggttgagtatggggattgaatacaaggctttgagtaatcctaatgagaagttagagattgatcataatcaagaaaccatgtcgttggagattagtaacaataataagatcagatcacaaaatagttttgggtttaagaatgatggagatgatcatgaagatgaagatgagattttgcctcaaaaccttgttaagaaaactagggtttcggtgagatcaagatgtgagacaccaacgatgaacgacggatgtcaatggaggaaatatggccagaaaatagctaaaggcaatccatgtccccgagcttactatcgttgcaccattgcagcttcttgtccagtaagaaaacaggtgcaaagatgttcagaagatatgtctatacttatctcaacgtacgaaggaacacataaccatccacttcccatgtcagcaactgccatggcctctgccacttccgctgccgcctccatgcttctctccggcgcctcctcctcctcatccgccgcagctgatcttcatggccttaacttctctctttccggcaacaacatcactccaaaacctaaaactcatttcctccaatccccttcttcttctggccatccgaccgtcactctcgacctcacaacctcctcctcgtcgcagcaaccgttcttatcaatgctcaatagattcagctctcctccaagtaatgtctcacgatctaatagttatccttcaaccaatctcaacttttcaaacaacaccaacacattgatgaattggggtggtggtggtaatcccagtgatcaataccgtgcagcttacggcaacattaacacccatcagcaatcaccttaccacaaaatcattcaaacccgaaccgccgggtcatctttcgatccgtttggaagatcatcttcatcacattctccacaaataaatcttgatcatatcggaatcaagaacatcatcagtcaccaagtgccatctttaccggctgaaacaatcaaggcaatcacgacagatccaagtttccaatcggctttggcgacagctctatcttccatcatgggcggcgatttaaagattgatcacaatgtgactagaaatgaagctgagaagagcccttaaagagaattgttatatatatgttcttatatactcagtacattggtaaatgggtttagactttcactagtttcctagttcatctatatattggttgtttaatcacaagtttattttgttgttggagtttatggaactaatgtgtacatatgaaactttagaacgaataaataaaacttggaattcctttttaaaaaaaaaaaaaaaaa

SEQ ID NO: 398 - protein, 528 aa, Arabidopsis thaliana
  G2110  (conserved domain in AA coordinates:239-298)
MEKDDFLRSGHGREESHDEMRKLDSSHDDSHQEHDHIIRSKLDSTKVEMDEAKEENRRLKSSLSKIKKDFDILQTQYNQLMAKHNEPTKFQSKGHHQDKGEDEDREKVNEREELVSLSLGRRLNSEVPSGSNKEEKNKDVEEAEGDRNYDDNEKSSIQGLSMGIEYKALSNPNEKLEIDHNQETMSLEISNNNKIRSQNSFGFKNDGDDHEDEDEILPQNLVKKTRVSVRSRCETPTMNDGCQWRKYGQKIAKGNPCPRAYYRCTIAASCPVRKQVQRCSEDMSILISTYEGTHNHPLPMSATAMASATSAAASMLLSGASSSSSAAADLHGLNFSLSGNNITPKPKTHFLQSPSSSGHPTVTLDLTTSSSSQQPFLSMLNRFSSPPSNVSRSNSYPSTNLNFSNNTNTLMNWGGGGNPSDQYRAAYGNINTHQQSPYHKIIQTRTAGSSFDPFGRSSSSHSPQINLDHIGIKNIISHQVPSLPAETIKAITTDPSFQSALATALSSIMGGDLKIDHNVTRNEAEKSP

SEQ ID NO: 399 - DNA, 1500 bp, Arabidopsis thaliana
  G2114
ataaaacgaaaccctatacatataaactaagagcgagaaagacagctagagagagagagagagatgaagaaatggttgggattttcattgacacctcctttgagaatctgcaatagtgaagaagaagaacttaggcatgacggttccgatgtttggagatatgatattaactttgatcatcatcatcatgatgaagacgttccaaaggtggaagatctcctctcaaactctcatcaaaccgagtatcctataaaccataaccaaaccaatgtcaactgcaccactgtggttaacaggttaaacccacccggttaccttctccacgaccaaaccgtagttacaccacattacccgaacctagatccgaaccttagcaatgattatggaggttttgagagggtcggttcggtctcggttttcaaatcttggttagagcaaggcactccagcattcccactctcgagtcattacgttactgaagaggctggtacgagcaataatattagtcattttagtaacgaagagactggttataacaccaatggctcaatgctatcattggctttgagccatggggcttgttctgatttgatcaacgaatcgaatgtatccgcacgggtcgaagaaccggttaaggtagatgagaagcggaagagattggttgttaaacctcaggtaaaggaatccgttcctcggaagtcggttgatagttatggacaaagaacttctcagtatcgtggagttacaaggcatagatggacagggagatatgaagctcacttatgggataatagctgtaagaaggagggacagacaaggagaggaagacaagtgtatcttggagggtatgatgaggaggagaaagcagcgagggcatatgatttagcggctctgaagtattggggtcctaccactcacttaaatttccctttgagtaattacgaaaaggagatcgaggaactcaataacatgaatcggcaagaatttgttgccatgttgaggaggaatagcagcgggttttcgaggggagcttccgtgtatagaggagttacaaggcatcatcaacatggaaggtggcaagccagaattggaagagttgctggaaacaaggacttgtaccttggaacatttagcacgcaagaagaagcagcggaggcgtacgatatcgcggcaattaaattcagaggcctaaacgctgtaaccaatttcgatataaatagatatgacgtgaagaggatatgttcaagctcaacgattgttgatagcgaccaggccaaacattctcccaccagctctggcgccggccactaaccgacaccgtaaactcctcgccggagagactattcccacgtacggttggtttgaggaaataagttcgtccagtctgtttaatcatttatggtttaataaacatatattcctaagtaattgaggccggtctacatatatacaacttttttagcaaattaagttatcagaatccactatatattattctct

SEQ ID NO: 400 - protein, 415 aa, Arabidopsis thaliana
  G2114  (conserved domain in AA coordinates:221-297, 323-393)
MKKWLGFSLTPPLRICNSEEEELRHDGSDVWRYDINFDHHHHDEDVPKVEDLLSNSHQTEYPINHNQTNVNCTTVVNRLNPPGYLLHDQTVVTPHYPNLDPNLSNDYGGFERVGSVSVFKSWLEQGTPAFPLSSHYVTEEAGTSNNISHFSNEETGYNTNGSMLSLALSHGACSDLINESNVSARVEEPVKVDEKRKRLVVKPQVKESVPRKSVDSYGQRTSQYRGVTRHRWTGRYEAHLWDNSCKKEGQTRRGRQVYLGGYDEEEKAARAYDLAALKYWGPTTHLNFPLSNYEKEIEELNNMNRQEFVAMLRRNSSGFSRGASVYRGVTRHHQHGRWQARIGRVAGNKDLYLGTFSTQEEAAEAYDIAAIKFRGLNAVTNFDINRYDVKRICSSSTIVDSDQAKHSPTSSGAGH

SEQ ID NO: 401 - DNA, 506 bp, Arabidopsis thaliana
  G2117
atacttgtcaacaaaaattttcttaaagaacgcataactgtttttttcatggctggttctgtctataaccttccaagtcaaaaccctaatccacagtctttattccaaatctttgttgatcgagtaccactttcaaacttgcctgccacgtcagacgactctagccggactgcagaagataatgagaggaagcggagaaggaaggtatcgaaccgcgagtcagctcggagatcgcgtatgcggaaacagcgtcacatggaagaactgtggtccatgcttgttcaactcatcaataagaacaaatctctagtcgatgagctaagccaagccagggaatgttacgagaaggttatagaagagaacatgaaacttcgagaggaaaactccaagtcgaggaagatgattggtgagatcgggcttaataggtttcttagcgtagaggccgatcagatctggaccttctaatcgtctcgtaagcttgttggttttttgttgtttatttaaag

SEQ ID NO: 402 - protein, 138 aa, Arabidopsis thaliana
  G2117  (conserved domain in AA coordinates:46-106)
MAGSVYNLPSQNPNPQSLFQIFVDRVPLSNLPATSDDSSRTAEDNERKRRRKVSNRESARRSRMRKQRHMEELWSMLVQLINKNKSLVDELSQARECYEKVIEENMKLREENSKSRKMIGEIGLNRFLSVEADQIWTF

SEQ ID NO: 403 - DNA, 657 bp, Arabidopsis thaliana
  G2123
atgagaaaagtatgtgagcttgatatagagctaagtgaagaggaaagagacctactaacaactggatacaagaatgtcatggaggctaagagagtttcattgagagtaatatcatccattgaaaaaatggaagactcgaaaggaaacgaccaaaatgtgaaactgataaaaggacaacaagaaatggttaaatatgagtttttcaatgtttgtaatgacattttgtctctcattgattctcatctcataccatcaactactactaatgtcgaatcaattgtcctttttaacagagtgaaaggagattattttcgatatatggcagagtttggttctgatgctgaacgtaaagaaaatgcagataattctctagatgcatataaggttgcaatggaaatggcagagaatagtttagcacccaccaatatggttagacttggattggctttaaatttctcgatattcaattatgagatccataaatctattgaaagcgcatgtaaattggttaagaaagcttacgatgaagcaatcactgaactcgatggccttgacaagaatatatgcgaagagagcatgtatatcatagagatgcttaaatacaatctttctacgtggacttcaggcgatggtaatggtaataagacagacggttag

SEQ ID NO: 404 - protein, 218 aa, Arabidopsis thaliana
  G2123  (conserved domain in AA coordinates:99-109)
MRKVCELDIELSEEERDLLTTGYKNVMEAKRVSLRVISSIEKMEDSKGNDQNVKLIKGQQEMVKYEFFNVCNDILSLIDSHLIPSTTTNVESIVLFNRVKGDYFRYMAEFGSDAERKENADNSLDAYKVAMEMAENSLAPTNMVRLGLALNFSIFNYEIHKSIESACKLVKKAYDEAITELDGLDKNICEESMYIIEMLKYNLSTWTSGDGNGNKTDG

SEQ ID NO: 405 - DNA, 1019 bp, Arabidopsis thaliana
  G2130
cctctcttcattttttaactccctctctctctctctctctatggagagacgaacgagacgagtgaagttcacagagaatcgtacggtcacaaacgtagcagctacaccatctaacgggtctccgagactggtccgtatcactgttactgatcctttcgctactgactcgtctagcgacgacgacgacaacaacaacgtcacggtggttccaagagtgaaacgatacgtgaaggagattagattctgccaaggtgaatcttcttcctccaccgcggcgaggaaaggtaagcacaaggaggaggaaagcgtagtggttgaagatgacgtgtcgacgtcggtgaagcctaaaaagtacagaggcgtgagacagagaccttggggaaaattcgcggcggagattagagatccgtcgagccgtactcggatttggcttgggacttttgtcacggcggaggaagctgctatagcgtacgatagagccgcgattcatctcaaaggacctaaagcgctcacgaatttcctaactccgccgacgccaacgccggttatcgatctccaaacggtttccgcctgcgattacggtagagattctcggcagagccttcattcaccgacctctgttctaagattcaacgtcaacgaggaaacagagcatgagattgaagcgatcgagctatctccggagagaaagtcgacggttataaaagaagaagaagaatcgtcggcgggtttggtgttcccggatccgtatctgttaccggatttatctctcgccggcgaatgtttttgggataccgaaattgcccctgaccttttgtttctcgatgaagaaaccaaaatccaatcaacgttgttaccaaacacagaggtttcgaaacaaggagaaaacgaaactgaagatttcgagtttggtttgattgatgatttcgagtcttctccatgggatgtggatcatttcttcgaccatcatcatcactctttcgattaaaaatctcttcttttttggggaaatttttgtg

SEQ ID NO: 406 - protein, 315 aa, Arabidopsis thaliana
  G2130  (conserved domain in AA coordinates: 93-160)
MERRTRRVKFTENRTVTNVAATPSNGSPRLVRITVTDPFATDSSSDDDDNNNVTVVPRVKRYVKEIRFCQGESSSSTAARKGKHKEEESVVVEDDVSTSVKPKKYRGVRQRPWGKFAAEIRDPSSRTRIWLGTFVTAEEAAIAYDRAAIHLKGPKALTNFLTPPTPTPVIDLQTVSACDYGRDSRQSLHSPTSVLRFNVNEETEHEIEAIELSPERKSTVIKEEEESSAGLVFPDPYLLPDLSLAGECFWDTEIAPDLLFLDEETKIQSTLLPNTEVSKQGENETEDFEFGLIDDFESSPWDVDHFFDHHHHSFD

SEQ ID NO: 407 - DNA, 485 bp, Arabidopsis thaliana
  G2133
atctcatcttcatccacccaaaaacatggattcaagagacaccggagaaactgaccagagcaagtacaaaggtatccgtcgtcggaaatggggaaaatgggtatcagagattcgtgtcccgggaactcgtcaacgtctctggttaggctctttctccaccgcagaaggcgctgccgtagcccacgacgtcgctttttactgcttgcaccgaccatcttccctcgacgacgaatcttttaacttccctcacttacttacaacctccctcgcctccaatatatctcctaagtccatccaaaaagctgcttccgacgccggcatggccgtggacgccggattccatggtgctgtgtctgggagtggtggttgtgaagagagatcttccatggcgaatatggaggaggaggacaaacttagtatctccgtgtatgattatcttgaagacgatctcgtttgatctatacgagtacgtttttagcagttaa

SEQ ID NO: 408 - protein, 143 aa, Arabidopsis thaliana
  G2133  (conserved domain in AA coordinates:11-83)
MDSRDTGETDQSKYKGIRRRKWGKWVSEIRVPGTRQRLWLGSFSTAEGAAVAHDVAFYCLHRPSSLDDESFNFPHLLTTSLASNISPKSIQKAASDAGMAVDAGFHGAVSGSGGCEERSSMANMEEEDKLSISVYDYLEDDLV

SEQ ID NO: 409 - DNA, 539 bp, Arabidopsis thaliana
  G2138
ggaaccctaatttccgcaaattcactatgaagcgtattatcagaatctcattcaccgacgcagaagccaccgattcttctagcgacgaagacacggaggagcgtggaggagcatcccagactcggcgccgtgggaaacgcctcgttaaagagatcgtaatcgatccttccgattccgccgataaactcgatgtctgcaaaacacggttcaaaatcaggatcccggcggaatttctcaagacggcgaaaacggagaagaaatatcgtggagtgaggcagaggccgtgggggaagtgggtggcggagatcagatgtggaagaggagcttgtaaaggacgacgtgatcgtctctggctgggtacttttaacactgctgaggaagctgctctagcttatgataacgcttcaattaagctgattggacctcacgcgccgaccaattttggtttgccggcggagaatcaagaggataagacggtgattggagcttctgaggttgctagaggcgcgtgaagtggggttggtaatttagttgttagc

SEQ ID NO: 410 - protein, 161 aa, Arabidopsis thaliana
  G2138  (conserved domain in AA coordinates: 76-148)
MKRIIRISFTDAEATDSSSDEDTEERGGASQTRRRGKRLVKEIVIDPSDSADKLDVCKTRFKIRIPAEFLKTAKTEKKYRGVRQRPWGKWVAEIRCGRGACKGRRDRLWLGTFNTAEEAALAYDNASIKLIGPHAPTNFGLPAENQEDKTVIGASEVARGA

SEQ ID NO: 411 - DNA, 1514 bp, Arabidopsis thaliana
  G2140
actctcttaactttcgtttcttctcctaccttcttttaccaacctttcctttctcttacacacatatatatatacatatatagagagagagaagaggacaaagagttgaaagatgaagactctcatgtcttcatagaaacaagtgatatgtgcgctaagaaagaagaagaagaagaagaagaagaagacagttctgaagccatgaacaacatacaaaattaccaaaatgacctcttctttcaccaactcatctctcatcatcaccatcatcatcatgatccttctcaatctgaaactttgggagcatccggtaacgttggatctggtttcactatcttctctcaagattccgtctctccaatatggtctctacctccacctacctcgatccaaccaccatttgatcagtttcctcctccttcttcttctccagcatctttctacggaagtttcttcaacagaagtcgagctcatcatcagggattacagtttgggtacgagggttttggtggagccacgtcagcagcacatcatcatcatgaacaacttcggatcttgtcggaagctttaggtccggtagtacaagccgggtccggtccttttgggttacaagctgagttagggaagatgacagcacaagagatcatggacgctaaagctttggctgcttcaaagagtcatagtgaagctgagagaagaagaagagagagaatcaataatcatctcgctaagctccgtagcatattacccaacaccaccaaaacggataaagcgtcgttactagctgaagtgatccaacatgtgaaagagttgaagagagagacttcagtgatctcagagacaaatcttgtcccaacggaaagcgatgagttaacggtagctttcacggaggaggaagaaaccggagatggcagatttgtaattaaagcgtcgctttgctgtgaagacaggtcggatctcttgcctgacatgattaaaacattgaaagctatgcgtctcaaaacgctcaaggcggagataaccaccgttgggggacgagtcaagaacgttttgtttgttaccggagaagagagctccggtgaggaagtggaggaagagtactgtatagggacgattgaggaagctttgaaagcggtgatggagaagagcaatgtagaggaatcatcttcttctggaaatgctaagagacagagaatgagtagtcacaacactatcactatcgtcgaacaacaacaacaatataatcagaggtaatcaattttttacttaaatcgcttttttttcttactttcggtgtatctactacgtgtgttgtttgctggttatggaaatgaatgttgtacgtcacgttatactatagatatatgtgtgtttgtgtgtatgtataacggaagtatttgtatccgttgtggtcttggacttttggtttggttctaagatacttatttttaaaaacttgtatcgttgagttggttttctagatatgcttaatgggagtatgtgacgaaaaaaaa

SEQ ID NO: 412 - protein, 368 aa, Arabidopsis thaliana
  G2140  (conserved domain in AA coordinates:167-242)
MCAKKEEEEEEEEDSSEAMNNIQNYQNDLFFHQLISHHHHHHHDPSQSETLGASGNVGSGFTIFSQDSVSPIWSLPPPTSIQPPFDQFPPPSSSPASFYGSFFNRSRAHHQGLQFGYEGFGGATSAAHHHHEQLRILSEALGPVVQAGSGPFGLQAELGKMTAQEIMDAKALAASKSHSEAERRRRERINNHLAKLRSILPNTTKTDKASLLAEVIQHVKELKRETSVISETNLVPTESDELTVAFTEEEETGDGRFVIKASLCCEDRSDLLPDMIKTLKAMRLKTLKAEITTVGGRVKNVLFVTGEESSGEEVEEEYCIGTIEEALKAVMEKSNVEESSSSGNAKRQRMSSHNTITIVEQQQQYNQR

SEQ ID NO: 413 - DNA, 1024 bp, Arabidopsis thaliana
  G2143
tcttcttcttcctccataccttatctcaccagcttctccatatctctcaaagaaaaaacaaaccctataaattccacaaaaaaggaggatggataactccgacattctaatgaacatgatgatgcagcagatggagaagcttcctgaacacttctctaactcaaaccctaaccctaatccccataacattatgatgctttctgaatccaacacccacccgttcttcttcaaccccactcattctcatctcccatttgaccaaaccatgcctcaccaccaacccggtttaaatttccggtacgccccctccccgtcatcatctctcccggagaagagaggaggctgcagcgacaacgccaacatggcggcgatgagagagatgatctttcgaatagccgtgatgcagcctatacatattgatccggaatccgtaaagccaccaaagagaaagaacgtgaggatctctaaggatccacagagcgtggcagctcggcatcgaagggagaggataagcgagcggattcggattcttcagcggcttgttcccggtgggactaagatggatacggcgtcgatgctcgatgaggctatccattacgttaagtttctcaagaagcaagtgcagtcgctggaggaacatgcggtggttaacggcggaggaatgacggcggtggccggaggagcacttgcgggtactgttggtggaggatatggaggaaaagggtgtggcattatgcggtctgatcatcaccagatgcttggaaatgcacagattcttagatgatgatgatgttgatttttaaatatatatcatatgtttattaatatgacgggaaaaaatattatcgagggagttgaatttagtatcatgaaactatgagagcattttttttaaatgtttttatctttccgggtttcgataatgtttgggatggttaattaacaatttaaaagtcagacaacttggttgtaaagactaaagaataagcatagtttatcaatttatcattactaaatgaaatag

SEQ ID NO: 414 - protein, 231 aa, Arabidopsis thaliana
  G2143  (conserved domain in aa coordinates: 128-179)
MDNSDILMNMMMQQMEKLPEHFSNSNPNPNPHNIMMLSESNTHPFFFNPTHSHLPFDQTMPHHQPGLNFRYAPSPSSSLPEKRGGCSDNANMAAMREMIFRIAVMQPIHIDPESVKPPKRKNVRISKDPQSVAARHRRERISERIRILQRLVPGGTKMDTASMLDEAIHYVKFLKKQVQSLEEHAVVNGGGMTAVAGGALAGTVGGGYGGKGCGIMRSDHHQMLGNAQILR

SEQ ID NO: 415 - DNA, 1456 bp, Arabidopsis thaliana
  G2144
attagggttttgttgtcgtgagatttgattacacaaattgctgaatttggtttcgattattggtgttattgttttcgaagatttccagtgagtttccgtttatggatctgactggaggatttggagctagatccggcggtgttggaccgtgccgggaaccaataggccttgaatcgctacatctcggtgacgaatttcggcaactagtgacgactttacctcccgagaaccccggcggttcgttcacggctttgcttgagcttccacctacacaagcagtggagcttctccatttcactgattcttcgtcttctcaacaagcggcagtgacagggatcggtggagagattcctccgccgcttcactctttcggtgggacattggcttttccttctaactcagttctcatggagcgagcagctcgtttctcggtgattgccactgagcaacaaaacggaaatatctccggggagactccgacgagctctgtaccttccaattcaagtgctaatctcgacagagtcaagacggagcctgctgagaccgattcatctcagcggttgatttctgattcagcgattgagaatcaaatcccttgccctaaccagaacaatcgaaatgggaagaggaaagatttcgaaaagaagggtaaaagctcgacgaagaagaacaaaagctctgaagagaacgagaagctgccatatgttcacgttagagctcgtcgtggtcaagcaaccgatagccatagcttagcagaacgagcaagaagagagaagataaatgcacgaatgaagctgttacaggaactggtcccaggctgtgataagattcaaggtaccgcgctggtgctggatgaaatcattaaccatgtccagtcattacaacgtcaagtggagatgctatcaatgagacttgctgcggtaaaccccagaatcgacttcaatctcgacaccatattggcttcagaaaacggttctttaatggatgggagcttcaatgccgcaccaatgcagcttgcttggcctcagcaagccattgagaccgaacagtcctttcatcaccggcaactgcaacaaccaccaacacaacaatggccttttgacggcttgaaccagccggtatggggaagagaagaggatcaagctcatggcaatgataacagcaatttgatggcagtttctgaaaatgtaatggtggcttctgctaatttgcacccaaatcaggtcaaaatggagctgtaagttgggaaaacggtagagatcatgaatgtgtatatacatcgtataagctcgtttctctctatataaatataatcataaatatagatatctgttaagaaggtatcagtcatttgattcagagagacaacactggtatgattgtttcttattcttgtaccagatttcgacaatgtagaatttagtaggatatgatcattttgatctcgttatatata

SEQ ID NO: 416 - protein, 379 aa, Arabidopsis thaliana
  G2144  (conserved domain in AA coordinates:203-283)
MDLTGGFGARSGGVGPCREPIGLESLHLGDEFRQLVTTLPPENPGGSFTALLELPPTQAVELLHFTDSSSSQQAAVTGIGGEIPPPLHSFGGTLAFPSNSVLMERAARFSVIATEQQNGNISGETPTSSVPSNSSANLDRVKTEPAETDSSQRLISDSAIENQIPCPNQNNRNGKRKDFEKKGKSSTKKNKSSEENEKLPYVHVRARRGQATDSHSLAERARREKINARMKLLQELVPGCDKIQGTALVLDEIINHVQSLQRQVEMLSMRLAAVNPRIDFNLDTILASENGSLMDGSFNAAPMQLAWPQQAIETEQSFHHRQLQQPPTQQWPFDGLNQPVWGREEDQAHGNDNSNLMAVSENVMVASANLHPNQVKMEL

SEQ ID NO: 417 - DNA, 1383 bp, Arabidopsis thaliana
  G2153
ttcttgcttagtatcattctttgtcgtgttcttttaattaaccttttgcaatttgtcttgtgtttctcacaacacaaaaacttgtaaaagtgttaaaaaatcaagatctgaaaaatcttatcaccgcttctaggtttttcagttttttttcttccttttcctgatctaaattaacttatatttcttagggtttcacttcttgaaacatttaatcagaattaattaacctctctagggctttcatggcgaatccatggtggacaggacaagtgaacctatccggcctcgaaacgacgccgcctggttcctctcagttaaagaaaccagatctccacatctccatgaacatggccatggactcaggtcacaataatcatcaccatcaccaagaagtcgataacaacaacaacgacgacgatagagacaacttgagtggagacgaccacgagccacgtgaaggagccgtagaagcccccacgcgccgtccacgtggacgtcctgctggttccaagaacaaaccaaagccaccgatcttcgtcactcgcgattctccaaatgctctcaagagccatgtcatggagatcgctagtgggactgacgtcatcgaaaccctagctacttttgctaggcggcgtcaacgtggcatctgcatcttgagcggaaatggcacagtggctaacgtcaccctccgtcaaccctcgaccgctgccgttgcggcggctcctggtggtgcggctgttttggctttacaagggaggtttgagattctttctttaaccggttctttcttgccaggaccggctccacctggttccaccggtttaacgatttacttagccggtggtcaaggtcaggttgttggaggaagcgtggtgggcccattgatggcagcaggtccggtgatgctgatcgccgccacgttctctaacgcgacttacgagagattgccattggaggaggaagaggcagcagagagaggcggtggtggaggcagcggaggagtggttccggggcagctcggaggcggaggttcgccactaagcagcggtgctggtggaggcgacggtaaccaaggacttccggtgtataatatgccgggaaatcttgtttctaatggtggcagtggtggaggaggacagatgagcggccaagaagcttatggttgggctcaagctaggtcaggattttaacgtgcgttaaaatggtttttaatttacagaagttaacaataagattataatgatgtttattatgatgatgaaaaccagtcagttgctacttgttactagtgagctatatagtttgtggacattatattatgttctctcttgactatgattattatttgctaaatttcacttagctaaaaaaaaaaaaaaaaaa

SEQ ID NO: 418 - protein, 315 aa, Arabidopsis thaliana
  G2153  (conserved domain in AA coordinates: 75-94, 162-206)
MANPWWTGQVNLSGLETTPPGSSQLKKPDLHISMNMAMDSGHNNHHHHQEVDNNNNDDDRDNLSGDDHEPREGAVEAPTRRPRGRPAGSKNKPKPPIFVTRDSPNALKSHVMEIASGTDVIETLATFARRRQRGICILSGNGTVANVTLRQPSTAAVAAAPGGAAVLALQGRFEILSLTGSFLPGPAPPGSTGLTIYLAGGQGQVVGGSVVGPLMAAGPVMLIAATFSNATYERLPLEEEEAAERGGGGGSGGVVPGQLGGGGSPLSSGAGGGDGNQGLPVYNMPGNLVSNGGSGGGGQMSGQEAYGWAQARSGF

SEQ ID NO: 419 - DNA, 1050 bp, Arabidopsis thaliana
  G2155
ctcatatataccaaccaaacctctctctgcatctttattaacacaaaattccaaaagattaaatgttgtcgaagctccctacacagcgacacttgcacctctctccctcctctccctccatggaaaccgtcgggcgtccacgtggcagacctcgaggttccaaaaacaaacctaaagctccaatctttgtcaccattgaccctcctatgagtccttacatcctcgaagtgccatccggaaacgatgtcgttgaagccctaaaccgtttctgccgcggtaaagccatcggcttttgcgtcctcagtggctcaggctccgttgctgatgtcactttgcgtcagccttctccggcagctcctggctcaaccattactttccacggaaagttcgatcttctctctgtctccgccactttcctccctcctctacctcctacctccttgtcccctcccgtctccaatttcttcaccgtctctctcgccggacctcaggggaaagtcatcggtggattcgtcgctggtcctctcgttgccgccggaactgtttacttcgtcgccactagtttcaagaacccttcctatcaccggttacctgctacggaggaagagcaaagaaactcggcggaaggggaagaggagggacaatcgccgccggtctctggaggtggtggagagtcgatgtacgtgggtggctctgatgtcatttgggatcccaacgccaaagctccatcgccgtactgaccacaaatccatctcgttcaaactagggtttcttcttctttagatcatcaagaatcaacaaaaagattgcatttttagattctttgtaatatcataattgactcactctttaatctctctatcacttcttctttagctttttctgcagtgtcaaacttcacatatttgtagtttgatttgactatccccaagttttgtattttatcatacaaatttttgcctgtctctaatggttgttttttcgtttgtataatcttatgcattgtttattggagctccagagattgaatgtataatataatggtttaat

SEQ ID NO: 420 - protein, 225 aa, Arabidopsis thaliana
  G2155  (conserved domain in AA coordinates:18-38)
MLSKLPTQRHLHLSPSSPSMETVGRPRGRPRGSKNKPKAPIFVTIDPPMSPYILEVPSGNDVVEALNRFCRGKAIGFCVLSGSGSVADVTLRQPSPAAPGSTITFHGKFDLLSVSATFLPPLPPTSLSPPVSNFFTVSLAGPQGKVIGGFVAGPLVAAGTVYFVATSFKNPSYHRLPATEEEQRNSAEGEEEGQSPPVSGGGGESMYVGGSDVIWDPNAKAPSPY

SEQ ID NO: 421 - DNA, 3004 bp, Arabidopsis thaliana
  G2192
cggaaagagatcaaccaacgatagaggagaagaagaacttgcatacgcaaaaaaactttcccgggaaaattccagaaactgctttggaaaaatgtgcgagcccgatgataattccgctagaaacggcgtcactactcaaccttcgaggtcaagggagcttctaatggatgttgacgacttagatcttgacggttcatggccactagatcaaatcccttacttatcctcatcgaatcgcatgatttctccgatttttgtctcctcttcctctgagcagccttgctcgcctctctgggctttctccgacggtggaggaaatggttttcaccacgcaacctccggtggcgatgatgagaagatcagctctgtctccggtgttccttctttccgtctcgccgagtatcctctcttcctcccttactcttctccatcagcagctgagaacacaacagagaagcataacagtttccagtttccgtctccattgatgagcctagtcccaccagagaacacagacaactactgtgtgatcaaagagaggatgactcaggcgcttcgatacttcaaagaatcaaccgaacaacacgttttggctcaggtctgggctcctgtgagaaagaatggtcgtgatttgctgacgactttgggtcaaccttttgttcttaatcctaatggtaatgggcttaatcaatacaggatgatctctctcacatatatgttttctgtggatagtgaaagtgacgtagagctcggactcccgggtcgagttttccgtcagaaattgcctgaatggactccaaatgttcagtactattccagcaaagaattctcgcggcttgatcacgccttgcactacaacgtgcgtggtacactggccttgcctgtctttaatccctctggtcagtcctgcataggtgttgtggaacttataatgacctcagagaagattcactatgcacccgaagtggacaaagtttgcaaagcccttgaggcggtaaatctgaaaagctcggaaatacttgatcaccaaacaacacagatatgcaatgagagtcgccaaaacgcgcttgctgagattctcgaagtgctgacagttgtatgtgagacccataacttgcctctcgctcagacttgggttccatgtcagcatgggagcgttcttgccaatggtggcggtctaaagaaaaactgcaccagctttgacggtagctgcatgggtcaaatctgcatgtctacaaccgacatggcctgctatgtcgtggatgctcatgtctggggctttagagatgcctgtcttgaacaccatctccagaaaggccagggagtcgctggacgagcttttctcaatggtggctcatgtttctgcagagacatcaccaagttctgcaaaacgcagtacccactagtccattatgcgctcatgttcaagttgaccacttgttttgcaatatctctccagagctcttacacgggcgacgacagttacattcttgaattttttcttccttcgagtataacagacgaccaagagcaagatttgctgttgggttctattttggtgacaatgaaagaacattttcagagtctgagggttgcatctggggttgactttggtgaagatgacgacaaattgtctttcgagatcatccaagcattaccggacaagaaggttcattcaaaaatagaatccattcgagttcccttttctggttttaagtcaaatgcaacagagacgatgttgattcctcagcctgtggttcagtcttctgatccagtaaatgagaaaatcaacgtggccactgttaacggtgtggttaaggagaagaagaaaacagagaaaaagcgtgggaagactgagaaaacaatcagtctagatgtacttcagcagtatttcactggaagtctcaaagacgctgcaaagagcctaggagtttgcccgacgacaatgaagcgaatttgcaggcaacacggaatctcgcggtggccatcgaggaagatcaagaaagtgaatcgttcaatcacaaagctgaaacgagtcatcgaatctgttcaaggtactgatggaggcctcgacctgacttccatggccgttagttccatcccttggacacacggtcaaacatcagcacagccactaaactcacccaatggttccaaaccacctgagctaccaaacaccaataattcacctaaccattggtcaagtgatcacagtccgaacgagccaaatggttcgcctgagttaccaccaagcaatggtcacaagcgatcacgaacggtggatgagagcgctgggactccaacctctcatggctcatgtgacggtaaccaattagatgaaccgaaagtcccaaatcaagatccgctcttcacggttggtggatcacccgggctcctttttccaccttattctagagatcatgatgtatctgcagcttccttcgcaatgccgaacaggcttcttggttctatagaccatttccgaggaatgctcattgaagacgctggaagttcaaaagatctgagaaatctctgccccactgcagcatttgacgataagtttcaagacacaaactggatgaacaatgataataatagcaacaacaacttatacgctcccccaaaggaagaggccattgcaaatgttgcatgcgaaccatcaggctcagaaatgagaacggtaacaatcaaagcaagttacaaagacgacataatacggttcagaatatcctcgggttcaggtataatggaattgaaggatgaagtggctaagaggctgaaagttgatgcaggaacgttcgatatcaagtatcttgacgatgataacgaatgggttttaatagcttgtgatgctgatcttcaagaatgtctcgagatccctagatcctcccgcacgaaaatcgtaaggctcttagttcatgatgtaacgacaaatctagggagctcctgcgagagcactggagaattgtgacctgataattcattcgaactcttttgtaaatag

SEQ ID NO: 422 - protein, 959 aa, Arabidopsis thaliana
  G2192  (conserved domain in AA coordinates:600-700)
MCEPDDNSARNGVTTQPSRSRELLMDVDDLDLDGSWPLDQIPYLSSSNRMISPIFVSSSSEQPCSPLWAFSDGGGNGFHHATSGGDDEKISSVSGVPSFRLAEYPLFLPYSSPSAAENTTEKHNSFQFPSPLMSLVPPENTDNYCVIKERMTQALRYFKESTEQHVLAQVWAPVRKNGRDLLTTLGQPFVLNPNGNGLNQYRMISLTYMFSVDSESDVELGLPGRVFRQKLPEWTPNVQYYSSKEFSRLDHALHYNVRGTLALPVFNPSGQSCIGVVELIMTSEKIHYAPEVDKVCKALEAVNLKSSEILDHQTTQICNESRQNALAEILEVLTVVCETHNLPLAQTWVPCQHGSVLANGGGLKKNCTSFDGSCMGQICMSTTDMACYVVDAHVWGFRDACLEHHLQKGQGVAGRAFLNGGSCFCRDITKFCKTQYPLVHYALMFKLTTCFAISLQSSYTGDDSYILEFFLPSSITDDQEQDLLLGSILVTMKEHFQSLRVASGVDFGEDDDKLSFEIIQALPDKKVHSKIESIRVPFSGFKSNATETMLIPQPVVQSSDPVNEKINVATVNGVVKEKKKTEKKRGKTEKTISLDVLQQYFTGSLKDAAKSLGVCPTTMKRICRQHGISRWPSRKIKKVNRSITKLKRVIESVQGTDGGLDLTSMAVSSIPWTHGQTSAQPLNSPNGSKPPELPNTNNSPNHWSSDHSPNEPNGSPELPPSNGHKRSRTVDESAGTPTSHGSCDGNQLDEPKVPNQDPLFTVGGSPGLLFPPYSRDHDVSAASFAMPNRLLGSIDHFRGMLIEDAGSSKDLRNLCPTAAFDDKFQDTNWMNNDNNSNNNLYAPPKEEAIANVACEPSGSEMRTVTIKASYKDDIIRFRISSGSGIMELKDEVAKRLKVDAGTFDIKYLDDDNEWVLIACDADLQECLEIPRSSRTKIVRLLVHDVTTNLGSSCESTGEL

SEQ ID NO: 423 - DNA, 962 bp, Arabidopsis thaliana
  G2295
gtaatatataacaataactcaggttacaaaggatggttccgaaagtggtcgacctacaaaggatagcgaacgataagacaaggataacaacttacaagaagaggaaagctagtctttacaagaaggcacaagagttctcaactctctgcggcgtcgagacatgtctcatcgtctacggtcccacgaaggctaccgatgtggtgatttccgagccagagatatggccgaaggacgagaccaaagtcagggccatcatacgcaagtacaaagacacagtgtcgaccagctgcaggaaagaaaccaacgtggagactttcgtcaacgatgtagggaaaggaaacgaggtggtgactaaaaagagagtgaagcgtgagaataagtattctagttgggaggagaagctagacaagtgttcacgagagcaactacatgggattttctgtgccgtggatagcaagttaaatgaagctgtaacgagacaggagcgtagtatgtttagggttaatcatcaagccatggacacaccattcccgcagaatttaatggaccaacaattcatgccacagtattttcatgagcagccacagtttcaaggcttccctaataatttcaataatatgggtttctcgttgatttcacctcatgatggtcagattcaaatggacccaaatctcatggagaagtggaccgacttggctttgactcaaagcttgatgatgtcaaagggaaacgatggtactcaattcatgcagaggcaagaacaaccatactataatcgtgaacaggttgtatcgaggtctgcaggtttcaatgttaacccgtttatgggatatcaagtcccgtttaatattcctaattggagattatcgggaaatcaagttgaaaattgggagctttcagggaagaaaacgatatgatttgaattacggagctttattagtttttagggttttatagttttg

SEQ ID NO: 424 - protein, 294 aa, Arabidopsis thaliana
  G2295  (conserved domain in aa coordinates: 1-57)
MVPKVVDLQRIANDKTRITTYKKRKASLYKKAQEFSTLCGVETCLIVYGPTKATDVVISEPEIWPKDETKVRAIIRKYKDTVSTSCRKETNVETFVNDVGKGNEVVTKKRVKRENKYSSWEEKLDKCSREQLHGIFCAVDSKLNEAVTRQERSMFRVNHQAMDTPFPQNLMDQQFMPQYFHEQPQFQGFPNNFNNMGFSLISPHDGQIQMDPNLMEKWTDLALTQSLMMSKGNDGTQFMQRQEQPYYNREQVVSRSAGFNVNPFMGYQVPFNIPNWRLSGNQVENWELSGKKTI

SEQ ID NO: 425 - DNA, 1406 bp, Arabidopsis thaliana
  G2340
atacaaaactccctcttctctatcttcttcatcttaaagaaaaaataagagatattcgtaaagagagaacacaaaatttcagtttacgaaaagctagcaaagtcgagtatcgaggaataacagaataagacgtatctatccttgccttaatgttcttaccaaaagatctagtcctttctttgtatgatcgatccatcacaagcccacaacaacaacaactacatctctttctctatctctagcttctatttttaatacattcaagaatcaagaatggtacggacgccgtgttgtagagcagaagggttgaagaaaggagcatggactcaagaagaagaccaaaagcttatcgcctatgttcaacgacatggtgaaggcggttggcgaacccttccggacaaagctggactcaaaagatgtggcaaaagctgcagattgagatgggcgaattacttaagacctgacattaaacgtggagagtttagccaagacgaggaagattccatcatcaacctccacgccattcatggcaacaaatggtcggccatagctcgtaaaataccaagaagaacagacaatgagatcaagaaccattggaacactcacatcaagaaatgtctggtcaagaaaggtattgatccgttgacccacaaatcccttctcgatggagccggtaaatcatctgaccattccgcgcatcccgagaaaagcagcgttcatgacgacaaagatgatcagaattcaaataacaaaaagttgtcaggatcatcatcagctcggtttttgaacagagtagcaaacagattcggtcatagaatcaaccacaatgttctgtctgatattattggaagtaatggcctacttactagtcacactactccaactacaagtgtttcagaaggtgagaggtcaacgagttcttcctccacacatacctcttcgaatctccccatcaaccgtagcataaccgttgatgcaacatctctatcctcatccacgttctctgactcccccgacccgtgtttatacgaggaaatagtcggtgacattgaagatatgacgagattttcatcaagatgtttgagtcatgttttatctcatgaagatttattgatgtccgttgagtcttgtttggagaatacttcattcatgagggaaattacaatgatctttcaagaggataaaatcgagacgacgtcgtttaatgatagctacgtgacgccgatcaatgaagttgatgactcctgtgaagggattgacaattattttggatgagttatattgatgatgatgaaaatttgcatttggcatgtaaatcaattagagtttgatttgctatggtgtttttagtttgtgtgtgtagtgtgtttcgaccgtcaaaaaaaaaaaaaaaaaaaaaaaaaaaa

SEQ ID NO: 426 - protein, 333 aa, Arabidopsis thaliana
  G2340  (conserved domain in AA coordinates:14-120)
MVRTPCCRAEGLKKGAWTQEEDQKLIAYVQRHGEGGWRTLPDKAGLKRCGKSCRLRWANYLRPDIKRGEFSQDEEDSIINLHAIHGNKWSAIARKIPRRTDNEIKNHWNTHIKKCLVKKGIDPLTHKSLLDGAGKSSDHSAHPEKSSVHDDKDDQNSNNKKLSGSSSARFLNRVANRFGHRINHNVLSDIIGSNGLLTSHTTPTTSVSEGERSTSSSSTHTSSNLPINRSITVDATSLSSSTFSDSPDPCLYEEIVGDIEDMTRFSSRCLSHVLSHEDLLMSVESCLENTSFMREITMIFQEDKIETTSFNDSYVTPINEVDDSCEGIDNYFG

SEQ ID NO: 427 - DNA, 1113 bp, Arabidopsis thaliana
  G2343
atgggtcatcactcatgctgcaaccagcaaaaggtgaagagagggctttggtcaccggaagaagatgagaagcttattagatatatcacaactcatggctatggatgttggagtgaagtccctgaaaaagcagggcttcaaagatgtggaaaaagttgtagattgcgatggataaactatcttcgacctgatatcaggagaggaaggttctctccagaagaagagaaattgatcataagccttcatggagttgtgggaaacaggtgggctcatatagctagtcatttaccgggaagaacagataacgagattaaaaactattggaattcatggattaagaaaaagatacgaaaaccgcaccatcattacagtcgtcatcaaccgtcagtaactactgtgacattgaatgcggacactacatcgattgccactaccatcgaggcctctaccaccacaacatcgactatcgataacttacattttgacggtttcactgattctcctaaccaattaaatttcaccaatgatcaagaaactaatataaagattcaagaaacttttttctcccataaacctcctctcttcatggtagacacaacacttcctatcctagaaggaatgttctctgaaaacatcatcacaaacaataacaagaacaatgatcatgatgacacgcaaagaggaggaagagaaaatgtttgtgaacaagcatttctaacaactaacacggaagaatgggatatgaatcttcgtcagcaagagccgtttcaagttcctacactggcgtcacatgtgttcaacaactcttccaattcaaatattgacacggttataagttataatctaccggcgctaatagagggaaatgtcgataacatcgtccataatgaaaacagcaatgtccaagatggagaaatggcgtccacattcgaatgtttaaagaggcaagaactaagctatgatcaatgggacgattcacaacaatgctctaactttttcttttgggacaaccttaatataaacgtggaaggttcatctcttgttggaaaccaagacccatcaatgaatttgggatcatctgccttatcttcttctttcccttcttcgttttaa

SEQ ID NO: 428 - protein, 370 aa, Arabidopsis thaliana
  G2343  (conserved domain in AA coordinates: 14-116)
MGHHSCCNQQKVKRGLWSPEEDEKLIRYITTHGYGCWSEVPEKAGLQRCGKSCRLRWINYLRPDIRRGRFSPEEEKLIISLHGVVGNRWAHIASHLPGRTDNEIKNYWNSWIKKKIRKPHHHYSRHQPSVTTVTLNADTTSIATTIEASTTTTSTIDNLHFDGFTDSPNQLNFTNDQETNIKIQETFFSHKPPLFMVDTTLPILEGMFSENIITNNNKNNDHDDTQRGGRENVCEQAFLTTNTEEWDMNLRQQEPFQVPTLASHVFNNSSNSNIDTVISYNLPALIEGNVDNIVHNENSNVQDGEMASTFECLKRQELSYDQWDDSQQCSNFFFWDNLNINVEGSSLVGNQDPSMNLGSSALSSSFPSSF

SEQ ID NO: 429 - DNA, 1011 bp, Arabidopsis thaliana
  G2346
atggagttgttaatgtgttcgggtcaggccgagtcaggtggttcttcttccaccgagtcttcttcactcagtggtggactcaggtttggtcagaagatctacttcgaggatggatccggatccagaagcaagaaccgggtcaataccgttcgtaagtcgtctaccacggcgaggtgccaagtggaaggttgtagaatggatctaagcaatgttaaagcttattactcgagacacaaagtttgttgcattcactctaaatcatctaaagtcattgtctctggtcttcatcaaaggttttgtcaacaatgtagcaggtttcaccagctttctgagtttgacttggagaaaagaagttgtcgcagaagactcgcttgtcataacgaacgacgaagaaaaccacaacccacaacggctcttttcacttctcattactctcgaatcgctccatctctttacggaaaccccaatgctgcaatgattaaaagcgttttgggagatcctactgcgtggtcaaccgcaagatcagtgatgcagcggcctggaccgtggcagattaatccagttagggaaacccatccacacatgaatgttttatcacatggaagctcaagctttactacatgtccagagatgataaacaacaatagcacagattcaagctgtgctctctctcttctgtcaaactcatacccaattcatcagcagcaacttcagacaccaacaaatacatggcgaccatcttctggtttcgactcgatgatctcattctccgataaggttacaatggctcagccaccgcccatttcaacccatcagccgcccatctcaacacatcagcagtacctcagccaaacttgggaagtcatcgcgggcgaaaagagcaattcacattatatgtctcctgtgagtcaaatctcggagccagcagatttccagataagcaatggcagtgtgtcgccctattctcctccgtccttactatctcttgtgtgctacttgcggccgctatag

SEQ ID NO: 430 - protein, 336 aa, Arabidopsis thaliana
  G2346  (conserved domain in AA coordinates: 59-135)
MELLMCSGQAESGGSSSTESSSLSGGLRFGQKIYFEDGSGSRSKNRVNTVRKSSTTARCQVEGCRMDLSNVKAYYSRHKVCCIHSKSSKVIVSGLHQRFCQQCSRFHQLSEFDLEKRSCRRRLACHNERRRKPQPTTALFTSHYSRIAPSLYGNPNAAMIKSVLGDPTAWSTARSVMQRPGPWQINPVRETHPHMNVLSHGSSSFTTCPEMINNNSTDSSCALSLLSNSYPIHQQQLQTPTNTWRPSSGFDSMISFSDKVTMAQPPPISTHQPPISTHQQYLSQTWEVIAGEKSNSHYMSPVSQISEPADFQISNGSVSPYSPPSLLSLVCYLRPL

SEQ ID NO: 431 - DNA, 850 bp, Arabidopsis thaliana
  G2347
agcccatccttcaacattgcttcctaaccagaaatccaccatcatcttcccacgaatacaacttaaagctttaccagaaaatggagggtcagagaacacaacgccggggttacttgaaagacaaggctacagtctccaaccttgttgaagaagaaatggagaatggcatggatggagaagaggaggatggaggagacgaagacaaaaggaagaaggtgatggaaagagttagaggtcctagcactgaccgtgttccatcgcgactgtgccaggtcgataggtgcactgttaatttgactgaggccaagcagtattaccgcagacacagagtatgtgaagtacatgcaaaggcatctgctgcgactgttgcaggggtcaggcaacgcttttgtcaacaatgcagcaggtttcatgagctaccagagtttgatgaagctaaaagaagctgcaggaggcgcttagctggacacaatgagaggaggaggaagatctctggtgacagttttggagaagggtcaggccggagagggtttagcggtcaactgatccagactcaagaaagaaacagggtagacaggaaacttcctatgaccaactcatcattcaagcgaccacagatcagataaaccctcccgctctctctcttctgtcatctacatatgctctatctacactcttattagacaaataatggcatctaacaatgtcaagaaaagttggtcatggtattaaatcctacacggatatataactataaacctctagtcccctctatgctgtcctgtaatgaatatctatccggaaatgtattcgcatagtcttgcgtctaataatgtttattgattttgta

SEQ ID NO: 432 - protein, 181 aa, Arabidopsis thaliana
  G2347  (conserved domain in AA coordinates: 60-136)
MEGQRTQRRGYLKDKATVSNLVEEEMENGMDGEEEDGGDEDKRKKVMERVRGPSTDRVPSRLCQVDRCTVNLTEAKQYYRRHRVCEVHAKASAATVAGVRQRFCQQCSRFHELPEFDEAKRSCRRRLAGHNERRRKISGDSFGEGSGRRGFSGQLIQTQERNRVDRKLPMTNSSFKRPQIR

SEQ ID NO: 433 - DNA, 799 bp, Arabidopsis thaliana
  G2379
cgccgtcactctcctcccggtgccgcacattagcaacactactcccgacgaatggagacgacgacgccgcagtcaaaatcaagtgtgtcccaccgaccgccgttgggaagagaagactggtggagtgaggaagcgacggcgacgctggtagaagcctggggcaatcgttacgtcaagctgaaccacggaaatctccggcagaatgactggaaagacgtcgccgacgccgttaactctagacacggtgataacagccgtaagaagaccgacttacagtgtaagaaccgggtcgatactttgaagaagaagtacaaaacagagaaagctaaactctcgccgtcgacttggcgtttctataaccgcctcgatgttctaatcggtcccgttgtgaagaaatcggctggcggagttgtcaaatcagcgccttttaagaatcatctgaatccaactggatcgaactctactggaagctctcttgaagatgatgatgaggatgatgatgaggttggtgattgggaattcgttgctaggaagcatcctcgtgtggaagaggtagatctgagtgaaggatcaacgtgtagggaactagctacggcgattctcaagtttggagaagtttacgagagaattgaagggaagaagcaacagatgatgattgagttggagaagcagagaatggaagtgacaaaggaggtagagttaaaacgaatgaacatgttgatggagatgcagttagagattgagaaatcaaagcaccggaaacgcgcaagtgcttcaggtaagaagaactcacattagg

SEQ ID NO: 434 - protein, 248 aa, Arabidopsis thaliana
  G2379  (conserved domain in AA coordinates:19-110, 173-232)
METTTPQSKSSVSHRPPLGREDWWSEEATATLVEAWGNRYVKLNHGNLRQNDWKDVADAVNSRHGDNSRKKTDLQCKNRVDTLKKKYKTEKAKLSPSTWRFYNRLDVLIGPVVKKSAGGVVKSAPFKNHLNPTGSNSTGSSLEDDDEDDDEVGDWEFVARKHPRVEEVDLSEGSTCRELATAILKFGEVYERIEGKKQQMMIELEKQRMEVTKEVELKRMNMLMEMQLEIEKSKHRKRASASGKKNSH

SEQ ID NO: 435 - DNA, 1997 bp, Arabidopsis thaliana
  G2430
aacttcaacatacacataatctctcacttaaaaatatctctctctctctctctacaaaatcaattccaatgttggtgggaaagataagtggatatgaagataatactcgctctttggagcgagaaacatctgaaatcacttctcttctcagccaatttccggggaatactaatgtccttgttgttgacaccaatttcaccactctactcaacatgaaacaaatcatgaaacaatacgcttatcaagtgtctattgagacagatgcagaaaaagctcttgcgtttttgacaagctgcaaacatgaaatcaatattgtgatttgggattttcatatgcctggaattgatggacttcaagctctcaagagcattacttcaaagttggatttacctgtagtgattatgtctgatgataatcaaacggaatctgtgatgaaagcaacattttacggtgcttgtgactatgttgtgaaaccggttaaagaagaggtaatggccaatatatggcaacacattgtacggaagaggctgatctttaaaccggatgttgctccaccggttcaatcagatccggctcgctctgaccgtttagaccaagtcaaagctgatttcaagatcgtagaagatgaaccaataatcaatgagacaccgctgatcacatggaccgaagaaattcaaccggttcagtcagatctggttcaagccaacaagttcgaccaagtgaatggctattccccaatcatgaaccaagataacatgttcaacaaagcaccacctaaaccgcgaatgacgtggacagaagttattcaaccggttcaatcaaatctggttcaaacaaaagagttcggccaactcaatgactattcccaaatcatgaaccaagatagcatgtacaacaaagcagcaaccaaaccacaattgacgtggaccgaagaaattcaaccggttcaatcaggtctggttcaagccaacgagttcagcaaagtgaatggatattcccaaagcatgaaccaagatagcatgttcaacaaatcagcaaccaacccgcgattgacatggaacgaattacttcaaccggttcaatcagatctggttcaatccaatgagtttagccaattcagtgactattctcaaatcatgaacgaagataacatgttcaacaaagcagcaaagaaaccgcggatgacatggagtgaagtatttcaaccggttcaatcacatctggttccgactgacggtttagaccgagaccactttgattccataaccataaacggaggtaacggcatacaaaacatggaaaagaaacaaggaaaaaaaccacggaagccgcggatgacgtggaccgaagagcttcaccaaaaatttctggaagccatcgaaataattggtggtatcgaaaaagctaacccaaaggtacttgtcgaatgcttgcaagaaatgaggatagaaggaattactagaagcaatgtggcaagtcatcttcagaaacaccgtatcaatcttgaagaaaaccaaattcctcaacaaacacaagggaatggttgggccactgcgtatggtacactagctccctctctccaaggttcagacaatgtcaacacaacaataccatcgtaccttatgaatggtccagccactttgaaccaaatccagcagaatcaatatcaaaatggtttcttgacaatgaacaacaaccagatcataaccaatcctccgcctcctttgccctatttggaccatcatcaccaacagcaacatcagtcttctcctcaatttaattacctgatgaacaatgaagaacttcttcaagcctctggcctctctgcgacagatcttgaactcacttatccaagtttaccatatgatccacaagagtatctaatcaatggctacaattataattagtcatatagcccttctctttacttaaggcagtctatgtatgacaaataatatgcgacttcccttgtgagtcacaatattgtttcattattc

SEQ ID NO: 436 - protein, 612 aa, Arabidopsis thaliana
  G2430  (conserved domain in AA coordinates:425-478)
MLVGKISGYEDNTRSLERETSEITSLLSQFPGNTNVLVVDTNFTTLLNMKQIMKQYAYQVSIETDAEKALAFLTSCKHEINIVIWDFHMPGIDGLQALKSITSKLDLPVVIMSDDNQTESVMKATFYGACDYVVKPVKEEVMANIWQHIVRKRLIFKPDVAPPVQSDPARSDRLDQVKADFKIVEDEPIINETPLITWTEEIQPVQSDLVQANKFDQVNGYSPIMNQDNMFNKAPPKPRMTWTEVIQPVQSNLVQTKEFGQLNDYSQIMNQDSMYNKAATKPQLTWTEEIQPVQSGLVQANEFSKVNGYSQSMNQDSMFNKSATNPRLTWNELLQPVQSDLVQSNEFSQFSDYSQIMNEDNMFNKAAKKPRMTWSEVFQPVQSHLVPTDGLDRDHFDSITINGGNGIQNMEKKQGKKPRKPRMTWTEELHQKFLEAIEIIGGIEKANPKVLVECLQEMRIEGITRSNVASHLQKHRINLEENQIPQQTQGNGWATAYGTLAPSLQGSDNVNTTIPSYLMNGPATLNQIQQNQYQNGFLTMNNNQIITNPPPPLPYLDHHHQQQHQSSPQFNYLMNNEELLQASGLSATDLELTYPSLPYDPQEYLINGYNYN

SEQ ID NO: 437 - DNA, 1026 bp, Arabidopsis thaliana
  G2505
atgggttcttcgtcgaacggaggagtgccacctggtttccggtttcatccgacggacgaagagcttctccattactacttgaagaagaaaatctcttaccaaaagtttgagatggaagtcatcagagaggttgacttaaacaagcttgagccttgggatttgcaagagagatgcaagataggatcaacaccacaaaacgaatggtacttcttcagccacaaggacaggaaatatccgacggggtcaaggaccaaccgtgctactcatgcagggttctggaaggcgacgggacgtgacaagtgcataaggaactcttacaaaaagataggaatgaggaagacacttgtgttctacaaaggtagagctcctcatggccaaaagactgattggatcatgcatgagtaccgtcttgaagacgctgatgatcctcaagccaaccctagtgaagatggatgggtggtatgtagagtgtttatgaagaaaaatttgttcaaggtagtaaatgaaggtagctcaagcattaactcattggaccaacacaaccatgacgcatctaacaacaaccatgcacttcaagctcgtagctttatgcaccgagacagtccataccagctagtacgtaaccacggagccatgacattcgaacttaacaagcctgaccttgctcttcatcaatacccaccaatcttccacaagccaccttcacttggatttgactactcttcaggacttgcaagggacagtgagagtgcggctagtgaagggttacaataccagcaagcgtgtgagccgggtttagacgttggtacatgtgagacagtggctagtcataatcatcaacaaggtctaggtgaatgggcaatgatggatagacttgtgacttgtcacatgggaaatgaagattcctctagagggattacgtatgaggatggtaacaacaattcgtcctctgtggttcagccagttcccgcgacgaaccagctaacattgcgtagtgagatggatttctggggttattctaaatag

SEQ ID NO: 438 - protein, 341 aa, Arabidopsis thaliana
  G2505  (conserved domain in AA coordinates: 9-137)
MGSSSNGGVPPGFRFHPTDEELLHYYLKKKISYQKFEMEVIREVDLNKLEPWDLQERCKIGSTPQNEWYFFSHKDRKYPTGSRTNRATHAGFWKATGRDKCIRNSYKKIGMRKTLVFYKGRAPHGQKTDWIMHEYRLEDADDPQANPSEDGWVVCRVFMKKNLFKVVNEGSSSINSLDQHNHDASNNNHALQARSFMHRDSPYQLVRNHGAMTFELNKPDLALHQYPPIFHKPPSLGFDYSSGLARDSESAASEGLQYQQACEPGLDVGTCETVASHNHQQGLGEWAMMDRLVTCHMGNEDSSRGITYEDGNNNSSSVVQPVPATNQLTLRSEMDFWGYSK

SEQ ID NO: 439 - DNA, 1000 bp, Arabidopsis thaliana
  G2509
atatattccctctttcattctccttcttcgtcttttctttgtttctcatattcaagacatcctcaattccaaatcttaaaccctaaatttacagacacaatcgagatcacctgaaaaaagaggtttaaagattttagcaaagatggcgaattcaggaaattatggaaagaggccctttcgaggcgatgaatcggatgaaaagaaagaagccgatgatgatgagaacatattccctttcttctctgcccgatcccaatatgacatgcgtgccatggtctcagccttgactcaagtcattggaaaccaaagcagctctcatgataataaccaacatcaacctgttgtgtataatcaacaagatcctaacccaccggctcctccaactcaagatcaagggctattgaggaagaggcactatagaggggtaagacaacgaccatggggaaagtgggcagctgaaattcgggatccgcaaaaggcagcacgggtgtggctcgggacatttgagactgctgaagctgcggctttagcttatgataacgcagctcttaagttcaaaggaagcaaagccaaactcaatttccctgagagagctcaactagcaagtaacactagtacaactaccggtccaccaaactattattcttctaataatcaaatttactactcaaatccgcagactaatccgcaaaccataccttattttaaccaatactactataaccaatatcttcatcaaggggggaatagtaacgatgcattaagttatagcttggccggtggagaaaccggaggctcaatgtataatcatcagacgttatctactacaaattcttcatcttctggtggatcttcaaggcaacaagatgatgaacaagattacgccagatatttgcgttttggggattcttcacctcctaattctggtttttgagatcttcaataaactgataataaaggatttgggtcacttgttatgaggggatcatatgttttctaa

SEQ ID NO: 440 - protein, 263 aa, Arabidopsis thaliana
  G2509  (conserved domain in aa coordinates: 89-156)
MANSGNYGKRPFRGDESDEKKEADDDENIFPFFSARSQYDMRAMVSALTQVIGNQSSSHDNNQHQPVVYNQQDPNPPAPPTQDQGLLRKRHYRGVRQRPWGKWAAEIRDPQKAARVWLGTFETAEAAALAYDNAALKFKGSKAKLNFPERAQLASNTSTTTGPPNYYSSNNQIYYSNPQTNPQTIPYFNQYYYNQYLHQGGNSNDALSYSLAGGETGGSMYNHQTLSTTNSSSSGGSSRQQDDEQDYARYLRFGDSSPPNSGF

SEQ ID NO: 441 - DNA, 931 bp, Arabidopsis thaliana
  G2517
tcctcactctctctctttttctctaaccataaaatctctttgatctctttctctgtgttttgataatggaaaatgttggtgttgggatgccgttttacgatttagggcaaacaagggtttacccactcttgtctgatttccacgatttatcggcggagaggtatccggtagggttcatggatttactgggtgttcatcgtcatacacccacccatacgccgttgatgcattttccgaccacacctaactcgtcctcgagcgaagctgtgaatggagatgacgaagaagaagaagatggagaagaacagcagcataagacaaagaagcggtttaaattcactaaaatgagtagaaagcagacgaagaagaaggtgccaaaagtgtcattcatcacgaggagtgaggttcttcatctagatgatggttataagtggagaaaatacggtcaaaaacctgtcaaagacagcccttttccaagaaattattaccgttgcacaacaacttggtgtgacgtgaagaagagagtagagagatcattcagtgatccaagcagtgtaatcaccacttacgaaggtcaacatactcatcctcgtccactactcatcatgcccaaagaaggcagctctccatccaatggctcagcttctagggcccacattggcctccctacactccctcctcagcttttagattacaacaaccaacaacaacaagcgccgtcttcttttggaaccgagtacattaacaggcaagaaaaaggaattaatcatgatgatgatgacgatcatgttgtgaagaagagtcgaactcgggatctgctggatggagctggtttagtcaaagatcatggccttcttcaggatgttgttccctctcatatcattaaggaagagtattagttaatcgcataattatgtagctagctagctag

SEQ ID NO: 442 - protein, 277 aa, Arabidopsis thaliana
  G2517  (conserved domain in aa coordinates: 118-174)
MENVGVGMPFYDLGQTRVYPLLSDFHDLSAERYPVGFMDLLGVHRHTPTHTPLMHFPTTPNSSSSEAVNGDDEEEEDGEEQQHKTKKRFKFTKMSRKQTKKKVPKVSFITRSEVLHLDDGYKWRKYGQKPVKDSPFPRNYYRCTTTWCDVKKRVERSFSDPSSVITTYEGQHTHPRPLLIMPKEGSSPSNGSASRAHIGLPTLPPQLLDYNNQQQQAPSSFGTEYINRQEKGINHDDDDDHVVKKSRTRDLLDGAGLVKDHGLLQDVVPSHIIKEEY

SEQ ID NO: 443 - DNA, 1197 bp, Arabidopsis thaliana
  G2520
aaggagttttgcatactcaccaagccacaatcatttctctcttctctatctctctggttttgaatcggcgacgactgagtcaactcggtgttgttactggtttcgtcgtatgtgttgtaactgattaagttgatggatccgagtgggatgatgaacgaaggaggaccgtttaatctagcggagatctggcagtttccgttgaacggagtttcaaccgccggagattcttctagaagaagcttcgttggaccgaatcagttcggtgatgctgatctaaccacagctgctaacggtgatccagcgcgtatgagtcacgcgttgtctcaggcggttattgaaggtatctccggcgcttggaaacggagggaagatgagtctaagtcggcgaagatcgtctccaccattggcgctagtgaaggtgagaacaaaagacagaagatagatgaagtgtgtgatgggaaagcagaagcagaatcgctaggaacagagacggaacaaaagaagcaacagatggaaccaacgaaagattatattcatgttcgagctagaagaggtcaagctactgatagtcacagtttagctgaaagagcgagaagagagaaaataagtgagcggatgaaaatcttgcaagatcttgttccgggatgtaacaaggttattggaaaagcacttgttctagatgagataattaactatatacaatcattgcaacgtcaagttgagttcttatcgatgaagcttgaagcagtcaactcaagaatgaaccctggtatcgaggtttttccacccaaagaggtgatgattctcatgatcatcaactcaatcttctccatttttttcacaaaacaatacatgtttctatcgaggtattctcggggtaggagtctcgatgtttatgcggttcggtcatttaagcattgcaataaacggagtgacctctgtttttgctcctgctccccaaaaacagaacttaagacaactatattttcacaaaacatgacatgtttctgtcgatattctcgagtaggagtcgctattagttcatctaagcattgcaatgaaccgtttggtcagcaagcgtttgagaatccggagatacagttcgggtcgcagtctacgagggaatacagtagaggagcatcaccagagtggttgcacatgcagataggatcaggtggtttcgaaagaacgtcttga

SEQ ID NO: 444 - protein, 354 aa, Arabidopsis thaliana
  G2520  (conserved domain in AA coordinates: 135-206)
MDPSGMMNEGGPFNLAEIWQFPLNGVSTAGDSSRRSFVGPNQFGDADLTTAANGDPARMSHALSQAVIEGISGAWKRREDESKSAKIVSTIGASEGENKRQKIDEVCDGKAEAESLGTETEQKKQQMEPTKDYIHVRARRGQATDSHSLAERARREKISERMKILQDLVPGCNKVIGKALVLDEIINYIQSLQRQVEFLSMKLEAVNSRMNPGIEVFPPKEVMILMIINSIFSIFFTKQYMFLSRYSRGRSLDVYAVRSFKHCNKRSDLCFCSCSPKTELKTTIFSQNMTCFCRYSRVGVAISSSKHCNEPFGQQAFENPEIQFGSQSTREYSRGASPEWLHMQIGSGGFERTS

SEQ ID NO: 445 - DNA, 1167 bp, Arabidopsis thaliana
  G2555
ctgtttttgtatccgtgtaaattaatcacacggtagtttttgatgaaaagacaacaatcggagaacaatctggtctgctgctaaaatttaataaattgttttgtctaattgtctccacccataaaaaagcgcgaattcaattcaccgactaaagacattctccggtggagaccccgatgcaatccactcatataagcggcggaagtagcggtggtggtggtggaggaggaggagaggtgagtcgaagtggattatctcggatccgttcagctccagctacttggattgaaaccctactcgaagaagatgaagaagaaggtttaaaacctaacctttgtttaacagagctgcttactggtaataataactctggaggagtgataacgagtcgtgacgactcgttcgagttcctgagttctgttgagcaaggattgtataatcatcatcaaggtggtggctttcaccgtcagaatagttctccggctgattttcttagtgggtctggttctgggactgatgggtatttctctaattttggtattccggcgaattatgactatttgtcgaccaacgttgatatttctccgactaaacggtctagagatatggaaacacagttttcttctcagctgaaagaagagcaaatgagtggtgggatatcaggaatgatggatatgaacatggacaagatttttgaggattcagttccttgtagggttcgtgctaaacgtggttgtgctactcatcctcgtagcattgctgaacgggtgagaagaacgcgaataagtgatcggattaggaggctgcaagagcttgttcctaacatggataagcaaaccaacactgcagacatgttggaagaagctgtggagtatgtgaaggctcttcaaagccagatccaggaattgacagagcagcagaagagatgcaaatgcaaacctaaagaagaacaataatgtatcctttaggatttgatatatctgtattttatttttgtactatctaaaaatggtgatgatctgttcgaaaattcgaaacatgatcttatatattgaactagaaaaaatagatatatatgaattttagctgtaaaatttttgtacaataaggagaaaaagatttagaagagtcaataaaaagatgatgtttacaagtcaaaaaaaaaaa

SEQ ID NO: 446 - protein, 259 aa, Arabidopsis thaliana
  G2555  (conserved domain in AA coordinates: 175-245)
MQSTHISGGSSGGGGGGGGEVSRSGLSRIRSAPATWIETLLEEDEEEGLKPNLCLTELLTGNNNSGGVITSRDDSFEFLSSVEQGLYNHHQGGGFHRQNSSPADFLSGSGSGTDGYFSNFGIPANYDYLSTNVDISPTKRSRDMETQFSSQLKEEQMSGGISGMMDMNMDKIFEDSVPCRVRAKRGCATHPRSIAERVRRTRISDRIRRLQELVPNMDKQTNTADMLEEAVEYVKALQSQIQELTEQQKRCKCKPKEEQ

SEQ ID NO: 447 - DNA, 1502 bp, Arabidopsis thaliana
  G2557
tcgacttcctgtgaactcatctgtttgttctcttcttccggtttcactttttcatgtcctgccgttattacaacgaggattgtgtttgatccgatggaaggattggaatctgtgtacgctcaagctatgtatggaatgacacgagagagcaaaatcatggagcatcaaggatcagatttgatttggggaggaaatgagctaatggctcgagaactctgttcttcttcttcttatcaccaccaactcattaatccgaatcttagcagctgtttcatgtctgatcttggagtcttaggtgagattcaacagcagcaacatgttggcaacagagctagctcgatagatccatcatcactcgattgtttgttatctgcgacgtcgaatagcaacaacacctcgacggaggacgatgaaggaatatctgtgcttttctcagattgtcagactctttggagctttggtggagtctcatctgcagagtctgagaacagagagatcactactgagacgacaacaacgataaagcctaagcctttgaagagaaacagaggaggagatggaggaactactgagactacaacaacaacaacaaaacctaagtctttgaagagaaacagaggagacgagacaggaagtcactttagtcttgttcatcctcaagatgattcggagaaaggaggtttcaagcttatatacgatgagaatcaatcgaaatcaaagaaaccaagaacagagaaagaacgaggcggttcttcgaacattagtttccaacattcaacttgtttgtctgacaatgtcgagcccgatgctgaggcgattgcacaaatgaaggagatgatatacagagcggctgcatttagaccggtgaatttcgggttagagattgtggagaagcctaagaggaagaacgtcaagatatcgacggatcctcaaacggttgcagcgagacagagaagggagaggataagtgagaagattagggttttacaaacattggttccaggtgggacgaagatggatactgcatcaatgcttgatgaagctgctaattatctcaagttccttagagcacaagtaaaagctttagaaaacttgagacccaagcttgaccaaaccaatctctctttctcttctgctcctacatcgtttccattattccacccatcttttcttccattgcaaaatcctaatcaaatccatcatccagagtgttgacagattataaacttttgagtttcatcatcatcaacagaatcatggcgtcttgattgttttagcagttctcaagaaaggcaacttctgtgacaagggtggtgtcgggcagtgttgtttacactttccagtctttgttttgcatttctttttatataaagtttgtattttatatagaatctgtggaattcgagggttgaaatattgtgaaaaacagagccgcaagaggttaattacagtctctgcaatattttcaaccttttattactttattagagtaaagatagcgt

SEQ ID NO: 448 - protein, 373 aa, Arabidopsis thaliana
  G2557  (conserved domain in aa coordinates: 278-328)
MEGLESVYAQAMYGMTRESKIMEHQGSDLIWGGNELMARELCSSSSYHHQLINPNLSSCFMSDLGVLGEIQQQQHVGNRASSIDPSSLDCLLSATSNSNNTSTEDDEGISVLFSDCQTLWSFGGVSSAESENREITTETTTTIKPKPLKRNRGGDGGTTETTTTTTKPKSLKRNRGDETGSHFSLVHPQDDSEKGGFKLIYDENQSKSKKPRTEKERGGSSNISFQHSTCLSDNVEPDAEAIAQMKEMIYRAAAFRPVNFGLEIVEKPKRKNVKISTDPQTVAARQRRERISEKIRVLQTLVPGGTKMDTASMLDEAANYLKFLRAQVKALENLRPKLDQTNLSFSSAPTSFPLFHPSFLPLQNPNQIHHPEC

SEQ ID NO: 449 - DNA, 653 bp, Arabidopsis thaliana
  G2583
caaatcagaaaatatagagtttgaaggaaactaaaagatggtacattcgaggaagttccgaggtgtccgccagcgacaatggggttcttgggtctctgagattcgccatcctctattgaagagaagagtgtggcttggaactttcgaaacggcagaagcggctgcaagagcatacgaccaagcggctcttctaatgaacggccaaaacgctaagaccaatttccctgtcgtaaaatcagaggaaggctccgatcacgttaaagatgttaactctccgttgatgtcaccaaagtcattatctgagcttttgaacgctaagctaaggaagagctgcaaagacctaacgccttctttgacgtgtctccgtcttgatactgacagttcccacattggagtttggcagaaacgggccgggtcgaaaacaagtccgacttgggtcatgcgcctcgaacttgggaacgtagtcaacgaaagtgcggttgacttagggttgactacgatgaacaaacaaaacgttgagaaagaagaagaagaagaagaagctattattagtgatgaggatcagttagctatggagatgatcgaggagttgctgaattggagttgacttttgactttaacttgttgcaagtccacaaggggtaagggttttc

SEQ ID NO: 450 - protein, 189 aa, Arabidopsis thaliana
  G2583  (conserved domain in AA coordinates:4-71)
MVHSRKFRGVRQRQWGSWVSEIRHPLLKRRVWLGTFETAEAAARAYDQAALLMNGQNAKTNFPVVKSEEGSDHVKDVNSPLMSPKSLSELLNAKLRKSCKDLTPSLTCLRLDTDSSHIGVWQKRAGSKTSPTWVMRLELGNVVNESAVDLGLTTMNKQNVEKEEEEEEAIISDEDQLAMEMIEELLNWS

SEQ ID NO: 451 - DNA, 866 bp, Arabidopsis thaliana
  G2701
gtgtttgtagttgaaacttattcttccctttttttgtttttaggtatggagactctgcatccattctctcacctacctatctctgaccaccggttcgttgttcaagagatggtgagcttacacagctcgagtagcggtagctggactaaagaagagaacaagatgttcgaacgagctcttgcgatatacgctgaagactcgcctgatcgctggtttaaagttgcttccatgatccctggaaagactgtttttgatgttatgaagcaatatagtaagcttgaagaagacgttttcgatattgaagcaggacgtgttcccattcctggttatcctgcagcttcttctcccttggggtttgacacggacatgtgtcgtaaacggcctagtggagctagaggatctgatcaagatcgaaagaaaggagtcccttggacagaggaagaacacaggagattcttgttaggccttctcaagtacggtaaaggagattggagaaacatatcgagaaacttcgtggtgtcaaagacgccaacgcaagtggcgagccacgcccaaaagtattaccagagacagctctccggagccaaggacaaacgcaggccaagtatccatgacatcacaaccggcaatcttctcaatgccaatctcaaccgttccttttccgatcatagagatattctccctgatttagggtttatcgataaggatgatacggaggagggagtaatatttatgggtcagaatctctcttcagaaaatctgttttctccatcaccaacttcattcgaagctgccattaacttcgccggagaaaatgtcttcagtgccggagcttaaggcaacatagaatccccaaactcagcggc

SEQ ID NO: 452 - protein, 263 aa, Arabidopsis thaliana
  G2701  (conserved domain in AA coordinates: 33-81, 129-183)
METLHPFSHLPISDHRFVVQEMVSLHSSSSGSWTKEENKMFERALAIYAEDSPDRWFKVASMIPGKTVFDVMKQYSKLEEDVFDIEAGRVPIPGYPAASSPLGFDTDMCRKRPSGARGSDQDRKKGVPWTEEEHRRFLLGLLKYGKGDWRNISRNFVVSKTPTQVASHAQKYYQRQLSGAKDKRRPSIHDITTGNLLNANLNRSFSDHRDILPDLGFIDKDDTEEGVIFMGQNLSSENLFSPSPTSFEAAINFAGENVFSAGA

SEQ ID NO: 453 - DNA, 1200 bp, Arabidopsis thaliana
  G2719
atggaaggagaaactcatcaatcggagccgttacctttagcatctggagattccgatgaagggatcagtgctgcgattgaggcggagcttgctgagttagctgctggagattcaagcggcggtggtggttgcggcggcggaggaggagggattaggagtaaagtcaaaggaccttggtctacggaggaagacgcggttcttacgaagcttgtgaggaaactaggaccgaggaattggagtttgatcgctcgtggaatccctggtcgttctggtaaatcttgtcgattgcgttggtgtaatcagcttgacccttgtctcaagcgtaaacctttctctgatgaggaagatcgtatgataatttctgctcacgcggttcacggaaacaaatgggcagtgattgcgaaactgttaactggaagaacagataacgctatcaagaaccattggaactcaactcttagacgtaaatacgcagatctatggaataatggtcaatggatggctaattcagttactaccgcttccgtcaaaaacgaaaatgtcgatgaaacaactaatcctccatcctcaaaacaacagttgcctcaaggagatatcaattcctccccgccaaagcctccacaagtgagtgatgttgtaatggaagaggcagctaatgaacctcaagaacctcaagaacaacaagaacaagctccaccggtagtgagtaacgttccaacagaaaataacgtgtttcgccccgtggctcgcgttggtgcattcagtatctataacccaaccagccagaaaaatggttacagagactacaatatagttccatgtgagggaccgttgattcaagcagctaaacccgattcattggctggtaaatttctacaatctctttgtgatgaacctcaaatcccgtcaaaatgtggtcacggctgctctactcttccagctgaaactaagttctcacgtaactcggtgttgggacctgagtttgtggattatgaagagccttctgcggttttcaaccaagaactaatatctatagcaaccgatttgaacaacattgcatggataaagagtggccttgacaatgctgttgtcagagaagcagaacagagtttgaagatggataattacaattataatgatcctcgaatcaagtttactggaatgatgcctagacaagatttcttctgtgcaagaagctga

SEQ ID NO: 454 - protein, 399 aa, Arabidopsis thaliana
  G2719  (conserved domain in AA coordinates: 56-154)
MEGETHQSEPLPLASGDSDEGISAAIEAELAELAAGDSSGGGGCGGGGGGIRSKVKGPWSTEEDAVLTKLVRKLGPRNWSLIARGIPGRSGKSCRLRWCNQLDPCLKRKPFSDEEDRMIISAHAVHGNKWAVIAKLLTGRTDNAIKNHWNSTLRRKYADLWNNGQWMANSVTTASVKNENVDETTNPPSSKQQLPQGDINSSPPKPPQVSDVVMEEAANEPQEPQEQQEQAPPVVSNVPTENNVFRPVARVGAFSIYNPTSQKNGYRDYNIVPCEGPLIQAAKPDSLAGKFLQSLCDEPQIPSKCGHGCSTLPAETKFSRNSVLGPEFVDYEEPSAVFNQELISIATDLNNIAWIKSGLDNAVVREAEQSLKMDNYNYNDPRIKFTGMMPRQDFFCARS

SEQ ID NO: 455 - DNA, 1040 bp, Arabidopsis thaliana
  G2789
ctttagggacaccaaatctattcaacctaaaagccttcttttcccctatattgaccaactttttagcgaatcagaagaggaatggatgaggtatctcgttctcatacaccgcaatttctatcaagtgatcatcagcactatcaccatcaaaacgctggacgacaaaaacgcggcagagaagaagaaggagttgaacccaacaatataggggaagacctagccacctttccttccggagaagagaatatcaagaagagaaggccacgtggcagacctgctggttccaagaacaaacccaaagcaccaatcatagtcactcgcgactccgcgaacgccttcagatgtcacgtcatggagataaccaacgcctgcgatgtaatggaaagcctagccgtcttcgctagacgccgtcagcgtggcgtttgcgtcttgaccggaaacggggccgttacaaacgtcaccgttagacaacctggcggaggcgtcgtcagtttacacggacggtttgagattctttctctctcgggttcgtttcttcctccaccggcaccaccagctgcgtctggtttaaaggtttacttagccggtggtcaaggtcaagtgatcggaggcagtgtggtgggaccgcttacggcatcaagtccggtggtcgttatggcagcttcatttggaaacgcatcttacgagaggctgccactagaggaggaggaggaaactgaaagagaaatagatggaaacgcggctagggcgattggaacgcaaacgcagaaacagttaatgcaagatgcgacatcgtttattgggtcgccgtcgaatttaattaactctgtttcgttgccaggtgaagcttattggggaacgcaacgaccgtctttctaagataatatcattgataatataagtttcgtcttcttattctttttcactttttacctttttcactttcttaggttttgttttaacgtttgattaatacctgaaggtttttggaaaattttcgatcggataaaaggatttatgttgcgagccgaaacgcggcc

SEQ ID NO: 456 - protein, 265 aa, Arabidopsis thaliana
  G2789  (conserved domain in AA coordinates: 53-73, 121-165)
MDEVSRSHTPQFLSSDHQHYHHQNAGRQKRGREEEGVEPNNIGEDLATFPSGEENIKKRRPRGRPAGSKNKPKAPIIVTRDSANAFRCHVMEITNACDVMESLAVFARRRQRGVCVLTGNGAVTNVTVRQPGGGVVSLHGRFEILSLSGSFLPPPAPPAASGLKVYLAGGQGQVIGGSVVGPLTASSPVVVMAASFGNASYERLPLEEEEETEREIDGNAARAIGTQTQKQLMQDATSFIGSPSNLINSVSLPGEAYWGTQRPSF

SEQ ID NO: 457 - DNA, 1111 bp, Arabidopsis thaliana
  G2830
gccaggatttgaaattaactaaataacaaatatattgactttgaattcatgaatttcaatatattaccttttttgcacttcaaaaatatataaaaggatacatagggaaataatttagatacacttagagctacaaaatgtcttccatcccaaataggttcaatatttatggtggtgataccacaaaccatcgtgaatcgcttcccatcgaaatgaatcacaactctcgaatggttcgatccatgttcattacatctgatcgcatgaatcatagagatttgttttcttctcctccttctttctcttcttatcaaaattcacatatctcttcatcttctgttgggtttaataattcacatatgacttatcatatgctgaaaagaaattatgattctgtttcccgtgctgattatttctctactaaagatcattctcattttactcaagtatctttcactcaaaccatcacaaataagtatactactattgttccttccaatatatttgacactgttcactatgatattggtcgtgtcaaacgtgccatagattttagaaatatttggaatcctaaatctcatcttccaaaaaaatttaataggcaatgcgagattttgaatcctacccctcttaatatcgtctttccgcaccaggattcagctgatcgtcaacatttagacattattttctcgtcatcaaagcacaaccatgttttccaagatggtcgatccttgaagaaaatttccgaaccaaccaatctgtttgaaaaatctaattcttatgattctcaagaagatgagaaaatcgatgcttatcaatatgatggtcgtacacatagtctaccgtatacgaaatacggtccatatacatgtcccaggtgtaacggtgtgtttgatacttctcaaaaatttgctgcacatatgttatctcactacaataatgagacggacaaagaaagagaccaaagatttcgtgcaagaaataaaaaacgatatcgtaagtttatggacagtcttaaaatatcaaaacagaagatatgatccgtcgcgatgggacgatccgcggccgccggtggtgaggcagatttcagcgtgctggggcgatcgcggcc

SEQ ID NO: 458 - protein, 300 aa, Arabidopsis thaliana
  G2830  (conserved domain in AA coordinates:245-266)
MSSIPNRFNIYGGDTTNHRESLPIEMNHNSRMVRSMFITSDRMNHRDLFSSPPSFSSYQNSHISSSSVGFNNSHMTYHMLKRNYDSVSRADYFSTKDHSHFTQVSFTQTITNKYTTIVPSNIFDTVHYDIGRVKRAIDFRNIWNPKSHLPKKFNRQCEILNPTPLNIVFPHQDSADRQHLDIIFSSSKHNHVFQDGRSLKKISEPTNLFEKSNSYDSQEDEKIDAYQYDGRTHSLPYTKYGPYTCPRCNGVFDTSQKFAAHMLSHYNNETDKERDQRFRARNKKRYRKFMDSLKISKQKI

SEQ ID NO: 459 - DNA, 1915 bp, Glycine max
  Predicted polypeptide sequence is orthologous to G8
ggtacttgtttgtgccttattccctctgattctggaacaagttcccgttctttcttatctttctccactgttttattttctccctgatcttcctctaccttaatttcagtcctatttgttcttctgacagatactcttttaccttcaccagctcattcttcttctatcttcttctgctatatatgctcaacctttaaagggtatttctctctctctctctcaactagtttgagtttcattgtactttgatatcactgcagaagtacatgagactcttaaaagagggtatgctttaaagaccagaatcagaagctgattaaaggagagaacctttccaagacatggctatgtttgatctcaatgttgacatcaaccactgtgatgctgatgctgactcaagctgtgatcaaaagggattggtgctgcaaagtttcccacctgaaatctcagattccaggacctccagctcctctgtgtggaaccctgtagaggaagattcctcaaacaattcctctcccttgatttttgacatactcaagaaagagagggatgagtcagagtttgatgcagccactgaaagggtcaataaggagcaaaacatggcaccacaagaggcagagatagtggcaaggacacttttccctgtgactgctgctgctgataaaggagttagagtgcctgatttcaaattggggctgtgggggaagactgaatgcttgaacttgtccttacctgcggctcgaggacaaaatggactcagaaccttacagcagaaggtacctcctgtgaggaaaaataggagaggaccaaggtctcgcagctcgcagtaccggggtgtcaccttctaccgcaggactggtagatgggagtcacatatttgggattgtgggaagcaggtttatttgggtggatttgacactgctcaagctgctgcaagagcatatgatagggctgctataaagtttcgtggagtagatgctgatataaactttagtttgagtgattatgaggaggatttgaagcagatgagaaatttgagtaaggaagagtttgtgctcttacttcgtcgacaaataaatggaatctctaggagaagttcaacatacagaggtgcattagcccttcgcaaagatgctcaaggagaaccacgaatgggaccatttgttggcatgacatgttatcctaagccatccatcaattgtgatgatggaaaagcggaggcaagttttaagccctgttcctataagggagaaataattgtgaattccaacatgacaggcacttgccataatcttgatttgagcctaggaatttctccgtcttctaaaagattgaagaataatgactatagtggagggtattcctttggatgtatgacttgtaagatacccgaggaaagaggaccaatggagaaggtcatggtggacagaataaaaaatgttcctttgcaaaaaatttccaacttggcttggcaactttgcagcaatggcagcattgtcccaaggccattccaaccaaatgcagcatcatcaggattcgtctcttcttctagctgtctcatcacccgcacttccaatcagcacacatattaattatgccaacaatttggcattaattggctcaaccacagtactactactagttgaaaccaccagaaacaaagcatatttaccctgcttttttgaagattagatgagcaagagtacttcataaccacatgtacctatagtataagattctattgatttcatcaagcatgatggtatttaataatattgctaagcattgcttacaatggctacccgatattttctgtattcattatcgtgatgtagaacacaatattgccttgtgtaaaagacccttgttgaagtatgtatatatttgttggttcttgttaaaaaaaaaaaaaaag

SEQ ID NO: 460 - DNA, 1682 bp, Glycine max
  Predicted polypeptide sequence is orthologous to G8
attcggctcgagattatttggtgtagggattgcgggaaacaagtctatttgggtatggatttttaatttatgaatttatgaatttcagtgtttattttagggtacatagtttttgtactatctgaaatcgtattctatggtttactattttaagcatcttttgacaaaattggtatttgagcttgtaggtggatttgacacggctcatgctgctgccagagcctatgatcgagccgctattaagttcaggggagttgatgctgatatcaatttcaatctgagtgattatgaggatgaccttaaacagatgcagaatttgtccaaggaggaattcgtacatatactgcgtcgccaaagtactggtttctcaagaggaagctctaaataccgaggagtaacactccacaagtgtggccggtgggaagctcgaatgggacaattccttggcaaaaagtgaggacatatttttatatatcaacttacgtagtgatctactgtggttatgaaatattatgaatttaagcacctattgggctgcaaagtgaaattggtttcagcttaattctcaatgcatctttatgcttttttccatgtttggagaaacatgtctaagatagtaatatagagatgcgttttggttatagagattgcaatgctttcatgcaggtatatatatcttggactattcgacagcgaagtagaagctgcaaggtcctagtgatacatgaattacattctacccgcactgaatttatttacatgaattatcaaagctcattaggctccatccaacacgtatctcccttttgattttctggaaatcagggcttatgacaaggcagctatcaaatgcaacggacgcgtgggcggacgcgtggggcagtgaccaactttgagccaagtacttatgaaggagagatgaaacccgcagccattaatgaaggtggcagtcagaatcttgatctcaatttgggcatagcaaccccaggacctcccaaagaaaattgggggcaacttcagttcccctccatcccttacaacacacatggtggaagaagttcaatgatggaaaccaatgttaattctggaattggtaatccatctttgaaaaggatggttgtaactgaagatcgtccttcattatggaatggcatgtctcctaatttctttcccaatggggaaagagcagagagaatcggcattgatccttcaaaaggactccccaactgggcgtggcaaacacatggccaggtcaatgctaccccagtaccaacgttctctgctgcagcatcatcaggattctcaatttcagctacctttccatcggctgccatctttccaacaagttctatgaactcaattccccagagtctctgttttacttcatccagcatgcctacccgcaatgcatctgaatattattactaggttaagcccccacaggcaccaccatagctgattttgcagtacagattaaagacaaactaaaacaaaagtgttttcggtccaaattctttttataattcagccactgattggtgtatactgagattcgacaccttattgctgtctcttgcttaaactataatgccccatgtttggatacatcgccccatgtttggatacatctttgaagcaaatgctatttttagtgcactagcacagcgatgtttctgttttcc

SEQ ID NO: 461 - DNA, 2155 bp, Glycine max
  Predicted polypeptide sequence is orthologous to G8
  misc_feature (2149)..(2149): n is a, c, g, or t
aattcgcctggttcttctcttctctctctctctctctctcttccatggaatccaatagtcggcgacgctttcactctctccggcgacgatgaactcatcgccgacgaaatgagtttgcgccggtttcttctctctcctcgttccgtgagttccttcctctcactccttctccgttctccggtcgccggaaaatttatccggtgttagcgatacggaaaactcatcgcgattccgttttcttcttcgcttcgttttctacttctctttatctttcacttacattacctctctcattcggttgtttccgatcggatccatttcgccgtcgccggcgaagttagttggaacaggctttagctaagttgtaaacctcagaaattataaaaatagataatcggaatttagtagttagttcggtttttagttacttaaccgcttaacgatataaataaataaataaaaagaagcgcgacgatgttagatcttaatctcaatgcggagtggaccgattcgtttagtaacggtgagtcgccgttaccgttagagaagtttccagacggtttgaggaaccaaatggccgagtcagggacttcgaattcctccgtggtgaatgcggacgggtccagtaacggcggcggcgacgaggactcggactccacacgagctgctgatgacgtgtacaccactttcaatttcgatatccttaaagtcgaaggcgcgaacggcttcgtaacgaaggagctctttccggtgatgagtgaaggagctaaaggacacgctacgtcgtcgttttcagggacgaatggtttcgtggatctctcgttcgatggcgatggagggaacactagtgagatgaagatgcttcagcctcagaatcagaatcagactcaaacgcgaactcagacacagcaaccagcgaaaaagagtaggagaggaccgaggtctcgaagctcgcaatacagaggggttactttttacagaaggacgggaagatgggaatcgcatatctgggattgcgggaaacaagtctatttgggtggatttgacacggctcatgctgctgccagagcctatgatcgagccgctattaagttcaggggagttgatgctgatatcaatttcaatctgagtgattatgaggaggatctaaaacagatgaagaatctttccaaggaggagttcgtgcacatactgcgccgccacagtaccggtttctcaaggggcagctcgaaataccggggagtgacacttcacaaatgtggccgttgggaagctcgaatgggacaattccttggcaaaaagtatatatatcttggactattcgacagcgaagtagaagctgcaagggcttatgacaaggcagctatcaaatgcaacggaagggaagcagtgaccaactttgagccaagtacttatgaaggagagctgaaatctgcagccattaatgaaggaggcagtcagaatcttgatctcaatttgggcatagcaaccccaggacctcccaaagaaaattgggggcaacttcagttcccctccttcccttacaatacacatggtggaagaagttcaatgatggaaaccaatgttagttctggaattggtaatccatctttgaaaaggatggttgcaactgaagatcgtccttcattatggaatggcatgtctcctaatttctttcccaatggggaaagagcagagagaatcggcgttgatccttcaaacggactccccaactgggcgtggcaaacacatggccaggtcaatgctaccccagtaccaacgttctctgctgcagcatcatcaggattctcaatttcagctacctttccatcggctgccatctttccaacaagttctatgaactcaattccccagagtctctgttttacttcatccagcatgcctacccgcaatgcatctgaatattattactaggttaagcccccacaggcaccaccatagctgattttgcagtacagattaaagacaaactaaaacaaaagtgttttcggtccaaattctttttataattcagccactgattggtgtatactgagattcgacaccttattgctgtctcttgcttaaactataatgccccatgtttggatacatcatctttgaagcaaatgctatttttagggcactngcacag

SEQ ID NO: 462 - DNA, 1096 bp, Glycine max
  Predicted polypeptide sequence is orthologous to G8
gcagaaggacgggaagatgggaatcgcatatctgggtattgcggagaaacaagtctatttgggtgagatttgacacggctcatgctgctgccagagcctatgatcgagccgctattaagttcaggggagttgatgctgatatcaatctcaatctgagtgattatgaggatgacctcggcccgaggcagaatttgtccaaggaggaattcgtacatatactgcgtcgccaaagtactggtttctcaagaggaagctctaaataccgaggagtaacactccacaagtgtggccggtgggaagctcgaatgggacaatttcttggcaaaaaggcttatgacaaggcagctatcaaatgcaacggaagggaagcagtgaccaactttgagccaagtacttatgaaggagagctgaaatctgcagccattaatgaaggaggcagtcagaatcttgatctcaatttgggcatagcaaccccaggacctcccaaagaaaattgggggcaacttcagttcccctccttcccttacaatacacatggtggaagaagttcaatgatggaaaccaatgttagttctggaattggtaatccatctttgaaaaggatggttgcaactgaagatcgtccttcattatggaatggcatgtctcctaatttctttcccaatgggcaggaaagagcagagagaatcggcgttgatccttcaaacggactccccaactgggcgtggcaaacacatggccaggtcaatgctaccccagtaccaacgttctctgctgcagcatcatcaggattctcaatttcagctacctttccatcggctgccatctttccaacaagttctatgaactcaattccccagagtctctgttttacttcatccagcatgcctacccgcaatgcatctgaatattattactaggttaagcccccacaggcaccaccatagctgattttgcagtacagattaaagacaaactaaaacaaaagtgttttcggtccaaattctttttataattcagccactgattggtgtatactgagattcgacaccttattgctgtctcttgcttaaactataatgccccatgtttggat

SEQ ID NO: 463 - DNA, 605 bp, Oryza sativa
  Predicted polypeptide sequence is orthologous to G8
gggcgggagcctcaggcattcactccagcccctgacaccaacacagcgcccacaacacccaagacaatcaagaatcctcagccacacgcagcacatcacccacaggcagccaccagcacagcacagcacagcacagcaagcacagcaagcacttcaggcaggcacaaagaaaagccagcacgcagggccacagcagcatcttcgcaagcatcgcaaataccagcaggcagtcaacacattctaccagcacagcaccaggccgctgggaatcccacatctgggattgcggcaagcaagtctacctaggtggattcgacactgctcacagcagctgcaagggcgtacagacagggcggcagatcaagttcaggggagtagaggctgacatcaacttcaacctgagcgactacgaggaggacatgaggcagatgaagagcttgtccaaggaggagttcgtgcacagttctccggcgacagagcaccggcttctcccgcggcagctcaaagtacaggggtgtcaccctccacaagtgcgccgctctagaggatccaagcttacgacgcgtgcatgcgacgtcatagctcttctatagtgtcacctaatc

SEQ ID NO: 464 - DNA, 2313 bp, Zea mays
  Predicted polypeptide sequence is orthologous to G8
aattcggcacgaggtccttctcctattctatctatatatcacccgcctcttttcccgacttcgccacgacgcaccttccctcttcttcctcagctccgtcgcccaccgccggagctccgaaaggccccgcgctcgccgcctttcctgtaaaaaacccaacctttagctagctaaccgctcctcttctccccctacgtactccccttgcccaaatcagagaagatatttaacggaggaggggaaggagaggatatttagctgattgttgattggtggtccggggtacggtgttcttgagtcgtgaagcgaccgtacggtggctagggccgtctccgggttgcgtgcaggatggtcgtcagagatcgggagtgaggaggcagctcgtggtcgtggaggctaaatgtaccgcaagaacgactcggcactctcctgtttctacctcttcctcctctggttcttcttcttgaaatagaccagcgccagccaccaggtagctacctactagctagcagcccagttgcgactggggacgggctgctgcttgcaagttggaatcttggagcaggagcagaggagcgggagatggagctggatctgaacgtggccgaggtggcgccggagaagccagcggcggcgctggaggcgagcgactcggggtcctcgggctcgtcggtgctgaacgcggaggcggcgtcggcgggcggcggggggcccgcgccgggggaggaggggtccagctcgacgccggccgtgctcgagttcagcatcctcaggagcgacagcgacgcggccggcgcggacgccgacgacggcgacgccacgccgtcgcctcctcgccaccaccaccagcagctcgtcacccgggagctcttcccggcgccgcagcattgggccgagctcggcttcttccgcgccggcccgcagcagcagccggacatcagggtcctgccgcacccgcacccgcacccgcccccgccgccgcccgcgcagccgcagccggccaagaagagccgccgcggcccgcgctcccgcagctcgcagtaccgcggcgtcaccttctaccgccgcaccggccgctgggagtcccacatctgggattgcgggaagcaggtgtacttaggtggattcgacactgctcatgccgctgcaagggcgtacgaccgagcggcgatcaagttccgcggcgtcgacgccgacataaacttcaacctcagcgactacgacgacgatatgaagcagatgaagagcctgtccaaggaggagttcgttcacgccctgcggcggcagagcaccggcttctcccgcggcagctccaagtacaggggcgtcaccctgcacaagtgcggccgctgggaggcgcgcatggggcagttcctcggcaagaagtacatatatcttgggctattcgacagcgaagtagaggctgcaagggcgtacgacaaggccgcgatcaaatgcaacggtagagaggccgtgacgaacttcgagcccagcacgtacgacggggagctgctgctgactgctgaagctagcgcagaagttgctgacgacgttgatctgaacttgagcatctcgcaaccggcatcgtcccagagccccaaaagagacaagaactgccttggtccgcagctccaccaccaccatgggcggccgtttgacggctccgccgttctgaagaaaaccaagatcgatgctccgtctgagctgtcgtcggcgggccgccctcaccggtcgttcctccctcatctcgtggctgccgagcatctaccgcctcggtctcaccccttcttcatcacacaccatgagagtgatgcatcaagaagagatcccagctgggcagcagcagcagcatggaaggtgaccgcagctgcacctcctcctcctaccaccaccctgttgccgttgccgctgccgtcgacgtcgtccgctgcagcatcatcaggattctccaataccgccacgacagctgccgccgccccatcggccgcctcctcccgccggttcgacccgccgccaccgtcgtcgtcctcctcctcgagccatcaccaccaccaccaccgccgctgagaatcgaagaagccacactgtaaatctgccgggaagcggctggtggcatccggcccgctcctccctccggggcgccgcaacttttttcgatcggttttgcgccgcccgggacgggttgtagttgatcgattggattcttcataactgtatttgcgtactgcttacactacacccaagtgaaatcgaaaatggcgccttctctcgttgaataaaaaaaaaaaaaaagcgcccccaaaaaactcgagg

SEQ ID NO: 465 - DNA, 823 bp, Zea mays
  Predicted polypeptide sequence is orthologous to G8
gcggcattgggccgagctcggcttcttccgcgccgacctgcagcagcaacaggcgccgggccccaggatcgtgccgcacccacacgccgcgccgccgccggccaagaagagccgccgcggcccgcgctcccgcagctcgcagtaccgcggcgtcaccttctaccgccgcacaggccccgcgcgggcccgccgctgggattgcggcaagcaggtgtacctaggtggattcgacaccgctcacgccgctgcaaggcacgcactggactggacgcccagaattcttcgtcatgtgagtctctgaccgaattgattgattaacgagtctctggctcctggaactcgcagggcgtacgaccgggcggcgatcaagttccgcggcgtcgacgccgacatcaacttcaacctcagcgactacgaggacgacatgaagcagatggggagcctgtccaaggaggagttcgtgcacgtcctgcgccgtcagagcaccggcttctcgagaggcagctccaggtacagaggcgtcaccctgcacaagtgcggccgctgggaggcgcgcatggggcagttcctcggcaagaagtaagaaccaaccaacgcttcttttctttttcttttttttatagcatgcagtgatgattcaaccttagttgtgcctttcctcctaatcctatatatgtaggatttagtactggttgacatataagtatatatgtattgttcagtaaaagttacataggttagctgcatgtttatgtatgtagcttggttgtttcaatcagaagataaaaaaagggaaagtagtggctagggaattcctccaatc

SEQ ID NO: 466 - DNA, 589 bp, Zea mays
  Predicted polypeptide sequence is orthologous to G8
gtgcagggggacgcctctgtacctggagctgcctctcgagaagccggtgctctgacggcgcaggacgtgcacgaactcctccttggacaggctccccatctgcttcatgtcgtcctcgtagtcgctgaggttgaagttgatgtcggcgtcgacgccgcggaacttgatcgccgcccggtcgtacgcccttgcagcggcgtgagcggtgtcgaatccacctaggtacacctgcttgccgcaatcccagatgtgggactcccagcggcctgtgcggcggtagaaggtgacgccgcggtactgcgagctgcgggagcgcgggccgcggcggctcttcttggccggcggcggcgcggcgtgtgggtgcggcacgatcctggggcccggcgcctgttgctgctgcaggtcggcgcggaagaagccgagctcggcccggacgcgtgggcggacgcgtgggtccaagtgcaactacacaccactgccaaacttcgaatgataaagagtgcagactaacaagtagtacaactcatgacatcgtactctccagtcctgaattctggtctggagtagtgatagcagcaagcaactttac

SEQ ID NO: 467 - protein, 509 aa, Oryza sativa
  Orthologous to G8
MELDLNNVAEGVVEKHETAARSDSGTSESSVLNGEASGAAIAPAEEGSSSTPPSPPPPPAAVLEFSILRSSASASGENDADDDEEEEATPSPPPHHQHQQLLVTRELFPSAAPSPQHWAELGFLRPDPPRPHPDIRILAHAPPPAPPPPPPQPQPQAAKKSRRGPRSRSSQYRGVTFYRRTGRWESHIWDCGKQVYLGNFIEHIIFLLSIQRDIAMNNLTNTFIFSQTITGGFDTAHAAARAYDRAAIKFRGVEADINFNLSDYEEDMRQMKSLSKEEFVHVLRRQSTGFSRGSSKYRGVTLHKCGRWEARMGQFLGKKAYDKAAIKCNGREAVTNFEPSTYDGELPTDAAAQGADVDLNLRISQPAASQQSPKRDSGSLGLQIHHGSFEAPSELASRPHRFPLLTEHPPIWTAQPHPLFPNNEDASRSSDQKRKPSEGVAVPSWAWKQFGASYQVASRANTRDGNCARLPVYPRVKTLLGLGLFSILYPWVSYWFKSYARWVNGHGYG

SEQ ID NO: 468 - DNA, 659 bp, Glycine max
  Predicted polypeptide sequence is orthologous to G19
acaaaaacccattctttatgctcactcgtctgcttagcgtagattaatcattatgtgtggcggtgccatcatcgctgacttcataccccgccgtggaggccgccgcctcgcggcctccgagctctggccaaactccttcgccataggcgatgcctttgacttggattactcccacgtcgctacccaacaaccctccactctcaaaaggtcgccaacctcccaaaggttagtcttgttcactaactcactcgctcattttcaccctgaaggttttgtaaacatgttaagatttttttctttttcgactgtgagtttgttcgaacagtcagcgagcaggttgagaataagccggtcaagaggcagagcaagaatctcttcagaggcattcggcagcgtccgtggggcaaatgggcagcggagattcgcgatcctagagaaggggttagtgtctggttgggcacctttaacaccgcagaagaatgccgcgagcagcctacgatcgtgaagctcgaaaacatctgagggccaaaaaggctaaggtgaatttccccaacgaggccgacgaatattccattcaagctcgtaatccaattccaccccttcctttcgctccgcagcaccctcccctgtaccagcaacagtaccgttgcgatctcaac

SEQ ID NO: 469 - DNA, 1285 bp, Glycine max
  Predicted polypeptide sequence is orthologous to G19
tcgcgattataagtttggtcttgtggatagaaatgaagggcaaagcacttcaaaataaggctgtttggattgatgtaaaaaggaacaatactatgttctattgtttgaattgtttacaatagaattttacctcgtaaaaaaaaaaaaaaaaaaaaaaaaaaaaaaacctatgaagaaccccaaagactgacgccccccccccccggcctctcacgagcccgcattaatgtgtgtttgtcacgagacccatagtgctgccaaattatagtaactctctttctctatctgaagaagaagaagttctgaagaagcatgtgtggaggtgctatcatctcagacttcattggtgtgaagcgtggccgcaacctcgccgcgcaggaactgtggtccgagcttgaccctttctctgacctccttggcttcgataccaccaccaccaccaccaaccaaccaccccttccagacaaaaaagtggtgtcatcatgtgagaagaagaagaagaaaagtgtgagtgcagaaaagaagagtggtgggcgagctcggaagaacgtgtacagaggaatcaggcaaaggccgtggggcaagtgggccgcggaaataagggacccacataagggcgtccgcgtctggctcggcaccttccccaccgccgaggaagccgcccgagcctacgacgacgccgccaagcgcatccgcggcgacaaggccaagctcaacttcccggccaccgctccgccaccctccaaaaaacaacgctgcctcagccctgacaccaccaccgaacaaagcagcagctcacaatccaccactggatccaccggatcgccgccttccgccgccttccacggcggaggagatgaactcgacctgaaacaacttgaacggtttctagggttggacaacatgggtgctgagtgggacaacatggatgacctgtggatgctggacgacgtcgttgtgcccaaccgtcacttaatttactagaagggagataattaattaattaataaatggcgttttcttaagttatagttttataaaactatgttggtgtatgtgttcttagttttctgttttgtcttgtcctctcgctttggtaatttctgttttgtacggtcgaatgatttcaaaattatgtgcaacgtatcatgagagggatgattatatgttatgattatgattataaataaaggccaattagggtgtgttagcgtttgggtcgtgcatgtttatatgtagtttatgcgttgtatataatatatttggcatgacattatttggttct

SEQ ID NO: 470 - DNA, 1129 bp, Glycine max
  Predicted polypeptide sequence is orthologous to G19
tccccgagccgaatcggctcgtggtttgtttgtctgtcacgagactcatacattgtgctgccaattatagtaactctctatttctctttccatctctcaagttctgaagaagaaacatgtgtggaggtgctatcatctcagacttcattggtgtgaagcgtggccgcaacctcgccgcgcaggaactatggtctgagcttgaccctttctctgacttccttggcttcgataccaccaattccaaaaaccaaccacccctgcagaaaattccagacaaaaaagtggtgtcatcatgtgagaagaagaagaaaagcgtggtgggtgcagaaaagaagaagagtgatagtgggcgagctcgtaaaaacgtgtacagaggaatcaggcaaaggccatggggcaagtgggccgcggagataagggacccacacaagggtgttcgtgtctggctcggcaccttccccaccgccgaagaagccgcccaagcctacgacgacgccgccatacgcatccgcggcgacaaggccaagctcaacttcccggccaccaccatttccgccgccgccgctccgccaccttccaaaaagcaacgctgcctcagccctgacatcatcactgaagaaagcagcagcagcagctcacattccaccactggatccaccggcgaaagcggcggaggaaacgacgaactcgacctgaaacaaattgaatggtttctaggtttggagaatgagctgcctgttagcaacaacattggtgctgagtgggacaacatggatgacctgtggatgctggacgacgtcgttgtgcccaaccgtcacttaatttactagaaggctaataattaataaatggcgttttcttaagttttagttttactttataaattgtagtataaaactatgttggtatttgtgttcttagttttcttctgctgttttgtctcttctctggctttggtaatttctgttttggacggttgaatgatttcaaaattaggtacttaattacaccctatcatgattgggatgatgattatatattatgattatgatgattatatataaataaagggtgattaagttacggcgcgtgagtgtttgcgactttgcgccgtgcatgtttttataaa

SEQ ID NO: 471 - DNA, 570 bp, Glycine max
  Predicted polypeptide sequence is orthologous to G19
cccacgcgtccgcaaaaacactcatcactctatctctctcaaaagtgaaaatgtgtgggggtgctataatttctgatttcatagacgtgaatttgaacagtggtcggaaattgaccacccacaacacccatcatcagcttcacactttctctgatttccacgccacctcttcttccaaacatcaaccatcctaccaggatccaaacctccctaggcctcctccgcttccaaacaaccaaggagtgaagttgaaggctttgactttgaacactggtcgagtacggaagaacgtgtacagaggaataaggcaaaggccatgggggaagtgggctgcagaaataagggacccacgtaagggtgtgcgtgtgtggctgggtactttcaacactgctgaagaagctgctcgtgcttacgacaatgccgccaagcgcatccgcggagacaaggccaagctcaactttcccgacagcaagaacccatgtcttaatccctttcaactcaaacacctcttttccaacctcgaatccttccttggttgggcctcgctctaatcactcccattcttgtctg

SEQ ID NO: 472 - DNA, 750 bp, Oryza sativa
  Predicted polypeptide sequence is orthologous to G19
cccacgcgtccgcccacgcgtccgcccacgcgtccggagccagcgactgtgccaatgtactactcctaccccctctcctactcctgttaacaagttgtgctgctatatagaggagcagccgagcaagtgtgttgccccgggtcgacccgcgtcggtgggtaattgatagtagcaagacaatgtgtgggggagcgatcatcgccgacttcgtcccgcccgccggcgcccgccgcgccgctgcctccgacatctccgacaacgccgtcctctccgctgccggtgccggtgacgagtcgttcgcggcggccaaggcgccggcgccggggaggaagacggcgtaccgcggcatccggcgccggccgtggggacgctgggcggcggagatccgcgacccgaggaagggcgcccgcgtctggctcggcacctacgccaccgccgaggaggccgcccgcgcctacgacgtcgcggcgcgcgacatccgcggcgccaaggccaagctcaacttccccccgaccatcggcgccgccgccgcgccaccgccgcccaagaagcgacgcaaagccgccgccgcggcgaaccaccaccaccaccaccaccagcaggagagctcaggctcctcgtcggcgtcgtcgctgcctcccaccccgccgccggccgccgagcaccagctccgcgagtgcatgtccgggctggaggcgttcttgggcctcgaggaggaggaggacgacggcggcgccggtgagccatggg

SEQ ID NO: 473 - DNA, 395 bp, Oryza sativa
  Predicted polypeptide sequence is orthologous to G19
  misc_feature (316)..(316): n is a, c, g, or t
cccacgcgtccggtccatttctttgcagtcctcgcatgcgcaacgtgtccactgtttagatggatgcacacggtgacgagtcgttcgcggcggccaaggcgccggcgccggggaggaagacggcgtaccgcggcatccggcgccggccgtggggacgctgggcggcggagatccgcgacccgaggaagggcgcccgcgtctggctcggcacctacgccaccgccgaggaggccgcccgcgcctacgacgtcgcggcgcgcgacatccgcggcgccaaggccaagctcaacttccccccgaccatcggcgccgccgncgcgccacccggcgccaagaagcgacgcaaagccgccgccgcggcgaaccaccaccaccaccaccaccagcaggagagc

SEQ ID NO: 474 - DNA, 467 bp, Oryza sativa
  Predicted polypeptide sequence is orthologous to G19
gtttccttcgcgtgagcggcagcaagtgttcagggcgggcttcttctcgatttagctttcttggtttcttgatctgtagcttattagcggccatgtgcggcggagcaatcatctccgggttcatcccgccgtcggccgctgcggcggcgaggaggaggaggacgacgacgacgtggtcgtggtggtccccccgccggcggcggcgaggttcgtcgtccgtgccgcggccaaggcggcgcccccaactgcagatgggatgttgactacaaagcttgtccaacatgatggacctactgctagatcagcaaagcacaagaggaagaatcagtacagggggatccgccagcgtccctggggcaaatgggcagctgaaatccgagaccccacaagggtggccgtgtttggcttggaacatataacactgctgaggaggcagctagggcatatgacgctgaagcccgcaagat

SEQ ID NO: 475 - DNA, 1536 bp, Zea mays
  Predicted polypeptide sequence is orthologous to G19
gaggctggccgggatctcccaactccgcctccaagtcccacccccactccctcgctcaccagaggaactggcggaccaggcaaagccgagccgcaccgcaaccgcgaagatcttgcgtggcctccttttcccagctcgtcactgtgccgctcgtgccctacactcccggtccgcccaaccaataatccatccatccatccatccaccaccaccccgctgcggcgatgtgcggcggcgccatcctctcgggtttcatcccgccgtccggggtggcggcggcggcggcggcggccaagaagcagcagcagcagcagcagcggtgccgtgtgactgcggacctgctatggccgggggcccggcagtaagggagctccccaggacaaggaggaggacttcgaggccgacttccgcgagttcgagcgcggcctcggcgaggatgacgtggacagcgccggcgaaggcggcgaccccgaggtccaggagcttcctccgccggagccgacgaggtttgccttcgccaccgcggccaaggcggcagttgatggcgtgatgactcctcctccaaaggatgtccaaggagatagagcagtaaaaaagcgcggcccggaagaaccagtacaggggaatcaggcagcggccttggggcaaatgggcagctgagatcagggaccctaacaagggcgtccgcgtctggctcggaacctacaacaccgcccgaggaggcagctagggcatacgacgccgaagctcgcaagatccgcggcaagaaagcgaaggtgaattttcccgatgacgcgacaggcactcgtcacaggccaacgaccgatgagatctttaacaacctgaagaacgacgacaacaacaacaacgatgatctgtttgcgatgtttgcgttcggtgacaataagaagaaggttcctgcagcgaagccagccgccgccgagggtggcagtggcagtggcagcttcctcgtccctgcgccctgcggtggcggtggtgcccggtaataagaggaggtcgtccgcgaccaacactatgctctccgtctccgacgaccagcgcagcaactcctacggctccggctcctccgccgacttggtggggtcgtgggtcgtgggacgacgacgacgccgccgccgccgccgccgccgccgccatgacctcggactacacctcctcggtcttagctccggcgtcttactcttacatgcaaggcggagcgccgaagagaatgaggcacagctacagcggcgcaccgcaccaacctcgcacatgacgcggccatgcctggttttggccttgataaagtgagctaccactaccagccgttgccgttgcctccttattacgtcgggagcagcagcggctcgtcagacgacgcgtcggtgggcagccttggtcttctgcaggctgatggtgctccacaggatggggcgagcgccggggatatctggagcctcgacgagctgctcatgctggcaacagctggtgcttattgagaacgcaaaaaaaacaaaaaaaaagggccctaaggcc

SEQ ID NO: 476 - DNA, 990 bp, Zea mays
  Predicted polypeptide sequence is orthologous to G19
aattcggcacgaggcggcaccaaaaccacgcgctacttcaccagcctagctagccctttcgccgtcgctgcggctcctgcccactgactcgtaggtttcgttgtttcgacaatgtgcggcggagccatcatcgccgacttcgtccccgccggcgcccggcgcccggcaacagacgacaccatgtccgcctccatcctctccggtagcgaggaccatccggagctgccgctgccgctgccggcgccggcgccggggcgcaagacggcgtaccgcgggatccggcgccgcccgtggggccggtgggcggcggagatccgcgacccgcggaagggcgcccgcgtgtggctcggcacctacgccaccccggaggacgcggcgcgcgcctacgacgtggcggcgcgcgagatccgcgggcccaaggccaagctcaacttcccgcccgccgtgggcggcggcggcggcgcgcgcgcgccggcgccggctgcggccaagaggcgccgcaagtccccggcggccgaggagagctcggcctcgtctcctccggcggccgtcgtcgtggcgggcggcggggaggaggcgctgcgcgactgcatgtccgggctcgaggcgttcctggggctgcaggacaccgatgagggtggcggcgtcgaggcgtgggacgccgtggacctcatgttggcgtaggccggagtacgccgtagcagggctgcaggggggcccagccccagccccagcgcgcgcgtgccgtcgctgtgaacggccgccgcagctgttttggatcgagtaataatattattagtagtataatgtttctccaagcagctaagctaattgcatgcccttgctgggtgggtggtattactagcactgctatctaggagtatgtactagcaggatgggtttatctagcttgttgctaaacagataattaatctaagaaaacagagatatggtctgttaaaaaccgcctctaaataatgcccggcgatt

SEQ ID NO: 477 - DNA, 1049 bp, Glycine max
  Predicted polypeptide sequence is orthologous to G22
cctttttttttttttttttttttttttttttttttttttttttccatcaatttgttatatattcttcattattttcattgtcatgagatacaactattcatattacaaagaaaaaggaaaaaaaaaatactatgacaaactatcctcacacttctgcaatgccataagaatggcaagatagtagtaatacatttcatatatatatatatatatatatatatatatatatatatatatatatatatatattcccttttattattgccacctcgtgtctattgaaaactgccacatatttgaatcatatatccagctccaaatctgtcaaggagctatctttactccgctttatggctaccgtggatgacaaaggacactataaagaaacatccgacaaatgtttcaatgtttctttagcgtaaccttaattggctcatgatccgagccaattaaatgaggaaaattcagcttagcttttgagccccgcatcttaaatgcagctcgatcataagctaaagctgcatcctcagcggtttcgtaggttccaagccacactctcacaccattcctcttagtgtccctaatctccgccgcatacttcccccacggcctcctccgcacgcctcggtagctcaaccccttctttggaggcgtgcgagtgccacgcgcggctgtagttttactattttgaccctcattttccattttcacagctacactaacattactcacctcatttccattggcggggaaccatccggtggcagcagcatcacgcaaagcaccgtagatgaccatgtcattggtgtcgttctccttcaacggcagctccgcccaattctctgtcaagaaaatgttccggaagctagaactccggcagaacgctgctatggacggcaccgatgcagaaacgtcctgaaacggcgtcgttacgggtatctcaaagtgatcaagagcattcacattggtgtttaaagcatgagagctcattgctccgtacaagtttgatgtttcgttgctttcgtaggttgtgtggcgcgcccgcgtgg

SEQ ID NO: 478 - DNA, 515 bp, Glycine max
  Predicted polypeptide sequence is orthologous to G22
agccgatgagtatgataaatcagactctagcaaattttgcttcaaagtctttgtcaatactcttatcggcttcagaggcgcgtgagaaccaatgaggtgaggaaaatttaacttagctttgctgccacgcatctcaaaagcagctctatcataagctaaacccgcttcttcttcagtttcgtaagtcccaagccatatcctagcaccattcttcttcggatctgttatttccgccgcgaacttgccccaaggtctacgcctcacaccccggtaacgcttccatgctggtggcgcgtgaacttcacgctccaccttagggtgttctcttttgcatgctaacgacccttctgcatcatggacaccttccaagcggaacgtagtagagcttgggaatgaattgtacgttggagaatagcaaatttcgtgattggaagcgttcatgagtgtgttggaatcgtgctcaagctcaagacgacagtggtgaatagattccactgaagagaaatcacaagata

SEQ ID NO: 479 - DNA, 475 bp, Glycine max
  Predicted polypeptide sequence is orthologous to G24
gacgaaccaaagttaactactttagagagagagagagagagagagagagatggagagtgaaggaagaagagaaggaggagagagagaaacaacagcagcgacgaggaaggtggagggtgctgagagaagatacaaaggaataaggatgaggaagtggggcaagtgggtcgctgaaattagagaacccaataagcgttcaaggatttggctcggttcctattctacccctgtcgccgccgcacgtgcctacgacacggccgtcttttacctccggggaccctccgcacgcctcaacttcccggagcttctcgtcagagaaggcccggccgccctagtcgccggctgcgacatgtcagcggcttctattaggaagaaggccaccgaggtctgtgctagagtcgatgctcttcaggcaacccttcaccaccactacgtgcccccgcggcaacttctctctggcggtggtggtgggtcc

SEQ ID NO: 480 - DNA, 1471 bp, Glycine max
  Predicted polypeptide sequence is orthologous to G24
ccacgcgtccgaatacaacagcaacatgatggtttcagtttcttgagggtactaatatgaacagaatctcctctcaacacctttgccttgctgcagttcgcaactgcaactgcactcaaatataaatatatatacatatatatatatatatatatatatgtattacttcatggtcacacatagttaagtttattaattactaggtagctggttttgaatagggtagttggtagttatagttgttgtcccagatatggaagaagcaggtttaggagattgttgttcctcgaattcgacgattacgaggaagagcgataagcgaaagcagcaacaccaacaacaagagaagccatacagaggaataaggatgaggaagtggggcaagtgggtggcggagattagagaacccaataagcgttcgaggatctggctgggttcttacgccacccccgtcgccgccgcacgcgcctatgacaccgccgtcttccacctccgaggcccttccgctcgcctcaacttccccgaattgctgtcccaggacgacgacgtttcgacccaacaacagggcaacatgtccgccgattcaattcgcaaaaaagccacccaagtcggcgccagagtcgacgcgctccaaaccgcgcttcagcaatcctcgtcctcacactccgctaattccagccacgtcagcagctctgacaaaccagacttgaacgagtatcccaaacctgaagattagtaatttccttcaaccttcaagattaatattgatccaccaatcatgggttctgatgtgacttatatatagggcttcaacttgccctcttcacctatgctaatttgaaaagaaaaaaattttatatttgtcatatgatttatctgagtaaatatttttttccagtttatttaattaatattagaaagtgtaggaagaaatagacacacctgatgagaattgagatgaggctaattaacttgttaatgaggtgagtaactcctttaactatatataaattaaggggtatatatattattagttgctcacctcatgttgttgctcatctcacgaagaaactcattttagattacttttttcctttcattatgtgtatgctggagcggtggactggtagctacatagattctcgctatgatggggcatatgatcatgaggtcttttctcaggtcggttgtgtgttgtaatttgtaacgagatatccgtaacacaataggatcaaattaaccgtgttttgttgtttcagattatcttttctacgttcccgttcattgctccaatctgatatcctacataatctccactactttatatataaggccggccgttttttaagacccaagttaccttcccttgccttcaaagcaaatacttttctattgtgtcccctaaaatcaatttcattggccgtctttttccaaacctctgcttggaaaaaccttggctttccccaactta

SEQ ID NO: 481 - DNA, 1419 bp, Glycine max
  Predicted polypeptide sequence is orthologous to G24
  misc_feature (832)..(832): n is a, c, g, or t
  misc_feature (868)..(868): n is a, c, g, or t
  misc_feature (870)..(870): n is a, c, g, or t
cccacgcgtccgtaccaatatgaacagaatctcctctcgacacctttgctttgctgcagctcgcaactgcaacttcccacaaatataaatatatattacttcatggtcacacatagttaattttattaattactactaggtagctggtttttaataggtagtaggtaggtgtaatcgttgtcttcctgcagatatggaagaagcgggtttaggagattgttgttcctctaatacgactattacgaggaaaagcgagaagcgaaagcagcagcaccaacaacaagagaagccatacagaggaataaggatgaggaagtggggcaagtgggtggcggagattagagaacccaacaagaggtcgaggatctggttgggttcttacgccacccccgtcgccgccgcacgcgcctacgacaccgccgtcttccacctccgaggcccttccgctcgccttaacttccccgaattgctgtcccaggacgacgacgtttcgacccaacaacagggcaagatgtccgccgattcaattcgcaaaaaagcgacccaagtcggcgccagagtcgacgcgctccaaaccgcgcttcagcaatcctcgtcgacacactccattagttccagccacgtcagctatgagaaaccagacttgaacgagtatcccaaacctgaagatttagtaatttccttcaaaccttcaagattaatattgatccaccaatcatgggttctgatgtgacttatatatagggcttcaacttgccctcttcaccctaggctaattggaagaagaagaaaaaaccctttttatatttgtcatatgattatatatatatcntagtagatatttttcttccagtctatttattttaanantagaacgtgtaggaagaaatatacagacacacctgagaattgagatgaggctaattaacttgtttatgaggcgagtaactcctttaaatatatataaattaaggggtatatatactattacttgctcatcaccacatgaagaacaacgtttgacctttaaccaaatgagatcgtgtaattcatgctgttgacctgattttgctgttgttgctcatctcacgaagaaactcattatagtttttttttttctttcaatatgtgtatgttagctggagtcgtggactggtagctacgtaggttctcgctatgatggggggcatatcatgtggtcttttctcaggtcggtggtgtgttgtaatttgtaacgagatatccgttacacaatcggatcaaattaaccgtgttttgttgttttagattaataaaaatacatatgttctgatgaattcgataatttcacatacatgtggtgaaaatgatttcatatataagttgtatgcatagttcatgtgtgtgaactatattaattcgaccgatcctgtttatgtt

SEQ ID NO: 482 - DNA, 973 bp, Glycine max
  Predicted polypeptide sequence is orthologous to G24
gcttagtgcgcgagtcgcatgaccctctctcccttataacccttccgtgtcttttacgagttagatttctcattcgtcattgaacagattcactctctctctctttagagatttgattgacaaacacaactaattccaaagctaacaactttatagagagagagagagagagagagagagatggagggtgaaggaagaagaagagaaggaggagagagagaaacagcaacagcagcagcaacgaggaaggtggtggagggtgctgatcagagaagatacaaaggaataaggatgaggaagtggggcaagtgggtcgctgaaattagagaacccaataagcgttcaaggatttggctcggttcctattctacccctgtcgcagccgcacgtgcctacgacaccgccgtcttttaccttcgaggaccctccgcgcgtcttaacttcccggagcttctcatcggagaaggcgccgccgccctcaccggcggctgtgacatgtcagcagcttctattaggaagaaggcctccgaggtcggtgctagagtcgatgctcttcaggcaacccttcaccaccatcaccaccatgttgtgccaccacggcagcttctctctgccagctgtggcggtgggtccggtgattttgcagtgcgggttgttgacctgaataagatgcccgaacccgagagctccgactgtgagtggaacgtgaattgaaggaaaaagaaaaaaggtgcatgttttcatattcaggtgatggtggttgttaacgtgcgccggctgaggcaaaatgatgttgttgatgaggcctgtggtggtggtggtggtggtgcggagtactgtactgtatctttttttccttcaaccttctctcttgggtagtttttttttaaaatttttagatattacaaaagaatttttggcttgtaaaaatatgttaaatgtaaattaactagtccggtagcagtttcttttt

SEQ ID NO: 483 - DNA, 1021 bp, Glycine max
  Predicted polypeptide sequence is orthologous to G24
cccacgcgtccgtacggctgcgagaagacgacagaaggggataccaaggtggaggcttacccagatgacaagcttagtgcgcgagtctctctcccttataacccttcttccacttccgtgtcttttacgagttagatttctcattcgtcatggaacaacacattcactctctctctctttagtgattttttcgatttgattgacaaacacaacgaaccaaagttaactactttagagagagagagagagagagagagagagagagagagagatggagagtgaaggaagaagagaaggaggagagagagaaacaacagcagcgacgaggaaggtggagggtgctgagagaagatacaaaggaataaggatgaggaagtggggcaagtgggtcgctgaaattagagaacccaataagcgttcaaggatttggctcggttcctattctacccctgtcgccgccgcacgtgcctacgacacggccgtcttttacctccggggaccctccgcacgcctcaacttcccggagcttctcgtcagagaaggcccggccgccctagtcgccggctgcgacatgtcagcggcttctattaggaagaaggccaccgaggtcggtgctagagtcgatgctcttcaggcaacccttcaccaccactacgtgcccccgcggcaacttctctctggcggtgatggtgggtccggggatttcccggtgcgggttgttgacctgaataagatgcctgaacccgagagttcggactgtgagtgggatgtgaattgaaggaaaaaaaagtacatgttttcttattcggttgctaagcgcgggttgaggcaaagtgatgttgttgatgaggcctatggtggtgtggagtactgtactgtatcttattccttcaattttctctcttgggtcttggctagttttttttttttagatattacaaaagaaattttggcgttgtaaaaatatattaaatgtaaattaactagtccagtagccaaaaaaaaaaaaacccccaaaaac

SEQ ID NO: 484 - DNA, 1285 bp, Glycine max
  Predicted polypeptide sequence is orthologous to G24
ccttttttttttttttttttcagaaccaaactgttattaaattacttatactttaacctacatcttttaaataaaataagaaataatatctacagcggatcacaaaacaaatataaaacacaacctttgggggagatgtttgtaatagttaattgtggaacaacgatcgaggtttgaggagctacaattttggtttcacattgaagacacatctctttctttcttacattttcggttgcttttctttcatattttctggttttctattttccaatttgttggatacaatgtcgtttgagatttgactccaactagacaaaaatctgagacgcagaaccgattaaccgaccccatgcatcacccatcgttatcatcgaaacagagtagtgaccacaacagcgtcttccctccccaatggtcccttctcttcacatatacaactcataaaaacacctaacatccatctttttttactcttcagtagaatagtagctattataatattataattacttgagtggttaacatggctcactccctctttttcaacccaactccctggcatcataggccattgctgtgccctctaaccccttttccccaataaaaaaaaaattaattaaaacaaggttataattttatatttgtttttgaaaaactccaaattaacaactaaacaacactcctaatccctgtcccagtagtcacaatccgaattctcgggttcgggcatcttattaaggtcaacccggtcggcgaattctccagcaggcagcgcgtgggggtgctggcggtggagagcgtcgactctggcgccgacctcggtggccttcttcctgatggaggctgcggacatgtcggcggcggggccctccgcggcaacaagctcggggaagttgaggcgcgcagaggggccccggaggtggaaaacggcggtgtcgtaagcacgcgccgccgcgacgggcgtggagtaagaaccgagccaaatccttgaacgcttgttgggttctcgaatctcagcgacccacttgccccactttctcattctgattcctttgtagcgcgtcgtctcagtttcaccctctttccctctcttctttgttgcaattcctccttcttctccttccataactactctctccctctctctctctctgaaaattcccttaatttttcatgaagagtataaataaatgaaataaaagaatgaagtgcgaggaagggaagggttataggggttttgcagtgcagagagacactgagccgaggttgtcgcgcgcgctgg

SEQ ID NO: 485 - DNA, 400 bp, Glycine max
  Predicted polypeptide sequence is orthologous to G24
  misc_feature (319)..(319): n is a, c, g, or t
gttttgaatagggtagttggtagttatagttgttgtcccagatatggaagaagcggggttaggagattgttgttcctcgaattcgacgattacgaggaagagcgataagcgaaagcagcaacaccaacaacaagagaagccatacagaggaataaggatgaggaagtggggcaagtgggtggcggagattagagaacccaataagcgttcgaggatctggctgggttcttacgccacccccgtcgccgccgcacgcgcctatgacaccgccgtctttcacctccgaggcccttacgctcgccttattccaattgtgcanacacactttgaccacacagcacattcgcgttcatcgaaaagcaccagtcggccgatcaccctcaacgccttacatctgtct

SEQ ID NO: 486 - DNA, 457 bp, Oryza sativa
  Predicted polypeptide sequence is orthologous to G24
  misc_feature (3)..(4): n is a, c, g, or t
  misc_feature (7)..(8): n is a, c, g, or t
  misc_feature (11)..(11): n is a, c, g, or t
  misc_feature (16)..(17): n is a, c, g, or t
  misc_feature (19)..(19): n is a, c, g, or t
  misc_feature (21)..(22): n is a, c, g, or t
  misc_feature (38)..(38): n is a, c, g, or t
  misc_feature (45)..(45): n is a, c, g, or t
  misc_feature (47)..(48): n is a, c, g, or t
  misc_feature (50)..(50): n is a, c, g, or t
  misc_feature (62)..(62): n is a, c, g, or t
  misc_feature (67)..(67): n is a, c, g, or t
tannatnnttngttanncnannaaaatctccttcgtgnaagtttnanncnccgtctgaccgntcctnggaggtagaacaccgccgtgtcgtaggcgcgcgccgccgccacgggcgtcgcgtacgaccccagccagatgcgcgtccgcttgtgcggctcccggatctccgccacccacttgccccacttccgcatccgcacgccacggtactgccgcctcggctgctgctgctgcagaagcagccgagtcctcgctggaggagcggtggtactcgccctgcatgagcgaagcgcagccgccgccgcagccgccctcttctctctctctctctctctctctctctgccctctcctgtgcaagcagcagtagcttttggcgttggttgggcggcttcttcttctcttctcttttctttctcgctatgtttgatgggtggtatttgtattgggcctcgtgc

SEQ ID NO: 487 - DNA, 1149 bp, Zea mays
  Predicted polypeptide sequence is orthologous to G24
ggcggtgaagatggaggcggagcaagcggcgatggcggcgccgcagctgggggcggcgcaccagcagacgcagccgcggcggcagtaccgcggcgtgcgcatgcgcaagtggggcaagtgggtggcggagatccgggagccgcacaagcgcacgcgcccccgcctccggtcctacgccacggccgtggcggcggcgcgcgcctacgacacggccgtgttctacctgcccggcccgtcggcgcggctcaacttccccgaggagatcccctcgttcgggctggcggatggcgtggacgtgggggagcacgcgcgcgacccggccgccgccgccgccggcggcggcggcggctgcacgctgtccgcggcgtccatacggaagaaggccatcgaggtggggtcccgcgtggacgcgctccagaccggcatggtggtcccgccgccgcaccaccgcgagcgccataggcaccacaaccacctgccgcagctgcgggtgcacgcggaggagcagcaggaggaagaggagcagaagccgcagcggcctgcgtggagcgggcgcgtcaagaacccggatctgaaccgtgcgccgagccccgagagctccgacgccgagtgacaagcgagcgagagcgcagcagcagccaccgcaaggcgaggttcaacgacgacgtccgttatcggttattcccaatcccacgacgcagcatgccgttgtcgtctccgtccgaccgtccccacgtacgtacgtacgtacgtacacgacgatccagctgaccctgccgcctgcctatcctatccgtcctcgacgacgaccggatggtcggcgggcgggagggagggcggtgcggcgagggttttgggtacgttgtggataagcacgagggcagcagcagcaggggcggcgtgcgcgggcaggcaggcgaagacggagggaggcggccacaagcggcggtctttccaaacgtcaaaaaggacagctgtaacagcgataagaaaaaacaagtcatcatcaccctcgtctcactactagttctactactgttcccgagagtagtagtaacgattagcactccactagcagtatgattattcgaatcggccttgcttgacagcgattaaaaaaaaaaaaaaaaaaaaaaaaaaaaaaaaaag

SEQ ID NO: 488 - protein, 233 aa, Oryza sativa
  Orthologous to G24
MQGEYHRSSSEDSAASAAAAAAAAAAAMAPLAAAAAAVAAKEEQAAAAAVLPLQQQQPRRQYRGVRMRKWGKWVAEIREPHKRTRIWLGSYATPVAAARAYDTAVFYLRGRSARLNFPEEISSLASLSEGGGASEPREPDGGTLSAASIRKKAIEVGSRVDALQTGMMVAPTTHHRERQKHHHHHHHHHPHLQPHGEEQHHHHEQKHQRTAWSGRAKNPDLNQAPSPENSDAE

SEQ ID NO: 489 - protein, 184 aa, Oryza sativa
  Orthologous to G24
MDRREATVFLPPPPPPQPTQPQQQPAAAAVRAPVGGRGGGGGRQYRGVRMRKWGKWVAEIREPNKRSRIWLGSYSTAVAAARAYDTAVFYLRGRSARLNFPDQLDGAGGGGAGAGGAEDHRELTAAVIRKKAAEVGARVDAQHSVVGAAAPVPLQPPQPPPPQRRRTKNPDLNREPTPDTSDDE

SEQ ID NO: 490 - protein, 206 aa, Oryza sativa
  Orthologous to G24
MAPLAAAAAAVAAKEEQAAAAAVLPLQQQQPRRQYRGVRMRKWGKWVAEIREPHKRTRIWLGSYATPVAAARAYDTAVFYLRGRSARLNFPEEISSLASLSEGGGASEPREPDGGTLSAASIRKKAIEVGSRVDALQTGMMVAPTTHHRERQKHHHHHHHHHPHLQPHGEEQHHHHEQKHQRTAWSGRAKNPDLNQAPSPENSDAE

SEQ ID NO: 491 - DNA, 1186 bp, Glycine max
  Predicted polypeptide sequence is orthologous to G28
cattcctataaataccccctaattcataaccctctgagttccagtccgtaatatctccaccttttggggagaccaccggagatatgtacggacggagtgattcttacgaatccgatttggcgcttctggattcgattcgccgccacttgctgggagagtccgaattgatattcggagccccgaatttcggttcgggtcggagctccagtttcagcagcttggactcgtgtttgagtgatgattggggagagcttccgtttaaggaggacgattcagaagatatggtgttgtacggcgttctccgtgacgcagttaatgtggggtgggtcccatccctcgatgccggctcgcccgagagcgtctcgtcgggttttccggcggtgaagctggagcctgatgtcatgccggcgttgattaatccgtgtccgcctccggcgccggcggtggaggagaagaaggttgttccgccgaaggggaagcactaccgcggcgtgcggcagcggccgtggggaaagttcgcggcggagatccgggacccggcgaagaacggggctagggtttggctggggacgtttgagacggcggaggacgcggcgttggcgtacgaccgcgccgcctaccggatgcgagggtcgagggcgctgctgaattttccgttgagggttaactccggcgagccagatccggtgagggtgacgtcgaagcggtcgtcgtcgccggaaagtatggcggcggcggcgccgaagagaaagaaagttatggtggtggggacggtgcaagagcaagtggggagtcaagtggtggagtgtacacgtggcgaacagttattggttagctgagagagattctaaaattggtattgtgtttattaaatacaaaaaatacaatactcttttgtaattatgtgaggtgcgtgtgtagtcctatacccatcatccaactcaatcttgcaacagagaaaaaaaaaaggtgaaagatgagacaggtgattttagtatatcaaatttcaaatggtgagtggtgaacccaccacgggaagaaaaaaattaaaagatgatgatgagtgatgacagaggtgaggatatgtaatttagctttgtgaatactaccaaatttgtttgttcaacattatgaattatgaatgggttaaatgtgacaaatgagttgagcccttaagaatccttct

SEQ ID NO: 492 - DNA, 727 bp, Glycine max
  Predicted polypeptide sequence is orthologous to G28
gcgtgcgcgcgctcgtaatccggctcgagtgatgtgttcggattgcggcggaggagaagaaggttgttccggcgaaggggaagcactaccgcggcgtgcggcagcggccgtgggggaagttcgcggcggagatccgcgacccggcgaagaacggagcaagggtttggctggggacgtttgagacggcggaggacgcggcgttggcgtacgaccgcgccgcctaccggctgccggcgaagagaaagaaagttgtggtggtggggacggtgcaagagcaagtggggagtcaagtggcagagtgtacacgtggcgagcagttattggttagctgaggtggattctaaaactggtgttgtgtttattaaatacaataaatacaatacacttttgtaattatgtgatgtgcgtgtgtgtgtaaagcacttagctatattatagccatcatccaactcaattttggaacaaagaaaaaaaggtgaaggatgaggatagatgattttagcacatcaaatggtgagtggtgtgaccccacgggaagaaaaaaaaaaaagagggggagaaaaaaattcaaagaagttatggaatttggaagatgatgaggaatgacgggggtgaggaactgaggatatgtaatttggctttgtgaatactaccaaatttgttatttgtttgttcaacattatgaactataaaaaaaaaaaagaatgggttaattgttaattgcttg

SEQ ID NO: 493 - DNA, 1181 bp, Glycine max
  Predicted polypeptide sequence is orthologous to G28
  misc_feature (1169)..(1170): n is a, c, g, or t
ggccggagtttaagtttatcttccaagttcacgtaccatcgcttttataaataccctcatccagtttcccttccaagttcgaatattcaattcaacaccttccctcattctcttctccaaacacgacacaaacattaagaagaagaaacataccacgaaatgtacggacaaagtagctatgagtccgatttggcccttttggactccattcgccgccacttacttggcgactccgaggagcacaaattcggagccccgaatgttagttcgggtaacactccagcgtactctcggagctcctgtttcagcaggttgtacccttgcttgagtaacgattggggagaacttcctcttaaggaagacgattcagaagacatgcttctttacggtgttcttcgcgatgcaataaacgcagggtgggtcccatctctcgatgcatcctcaccggagagtttctcgtcgggtttcatcccggcggtgaccgtgaaatccgaaccggatctatttccggcgccagagcctgtctatattcctccggcggctcagaaggctgagccggcggtggttccggcgaaggggaagcactaccgcggcgtgcggcagcggccgtgggggaaattcgcggcggagatccgcgacccggctaaaaatggggctcgggtttggcttgggacttttgagacggctgaggacgccgcgctggcttacgatcgagccgcgtatcgaatgcgcggctcgcgggctttgttgaattttccgctccggattaattcgggcgagccccgaccggttcgggtcacggcgaagcgggcttcagcagaaccgtgttcttcgtcggagagtggatcttgggtgaagaagcggaagaaggtggtgggttgagaacggggcacgtggagagcagttgttggtgaagtaatttgtgatgctaaaaaggggtggaataaatgggttggcatgctcactcattgctcaagtgggactgtgggactgatcaaatctaaagctaaaaaagaaaacaaaccacatttggaaaaactgattagggtcgaggttctgtttggctttgtgaatacagttacaagatttcttattttttggttcaattctataataatatctgtaacatagttgggtagggcacccaccctgtgctgaactaagtgatnncaataaaatat

SEQ ID NO: 494 - DNA, 767 bp, Glycine max
  Predicted polypeptide sequence is orthologous to G28
agcccacgcgtccgcccacgcgtccgcccacgcgtacgcctcctcttccaaaatatccacgtttcttttcccacacactatcttaaatcttaaaaacattttttttttcaaagcaattagaatttagaccacaaaaggaacaccgaagagatgtacggacagagtagtagtagcagtagttcttacgaatcggatttggcgctgttggattcgattcggcaccacttgctgggcgagtccgaatccatattcggcgccccgaatttcgggtcgggtcggagctccagtttcagcagcttggactcgtgtttgagcgacaattggggcgagcttccgtttaaggaggacgatacagaagacatggtgttgtacggcgttctccgtgacgccgttaacgtcgggtgggtcccatctctcgatgccgggtcgcccgagagcgtgtcgtcgggttttccggcggtgaagctggagccggacttgatgccggcgctgataagtctcgtgtccgcctccggcggctgcggcggaggagaagaaggttgttccggcgaaggggaagcactaccccggcgtgcggcagcggccgtgggggaagttcgcggcggagatccgcgacccggcgaagaacggagcaagggtttggctggggacgtttgacacggcggaggacgcggcgttggcgtacgaccgcgccgcctaccgggtggggacggtgcaagagcaagtggggagtcaagtggcagagtgtacacgtggcgagcagttat

SEQ ID NO: 495 - DNA, 561 bp, Glycine max
  Predicted polypeptide sequence is orthologous to G28
  misc_feature (12)..(12): n is a, c, g, or t
  misc_feature (84)..(84): n is a, c, g, or t
gggggaagttcncggcggagatccgcgacccggcgaagaacggagcaagggtttggctggggacgttttagacggcggaggacncggcgttggcgtacgaccgcgccgcctaccggatgagggggtcgagggcgttgctgaattttccgttgagggttaactccggcgagcccgatccggtgagggtgaagtcgaagcggtcgtcgtcgccagagagtgcggcggcgctgccggcgaagagaaagaaagttgtggtggtggggacggtgcaagagcaagtggggagtcaagtggcagagtgtacacgtggcgagcagttattggttagctgaggtggattctaaaactggtgttgtgtttattaaatacaataaatacaatacacttttgtaattatgtgatgtgcgtgtgtgtgtaaagcacttagctatattatagccatcatccaactcaattttggaacaaagaaaaaaaggtgaaggatgaggatagatgattttagcacatcaaatggtgagtggtgtgaccccacgggaagaagaaaaaaaaaaagagggggag

SEQ ID NO: 496 - DNA, 784 bp, Glycine max
  Predicted polypeptide sequence is orthologous to G28
tacggctgcgagaagacgacagaagggggaagtaacatagaaacaaacatgggaagcaacaaaacctacgaggaagaagaaagcacggttctattttcccattcccaaacacaaacagagttgttacccttcaacgagaacgacccgcaggacatggtcatataccaagtcctcaacgaagccaatgctctcaccaacacatttctccctcagaggcttcaccaacctcagttgtgcctcgagcccaccagaaacataacaaagaagcactacagaggagttcggcgccgcccctggggaaaatacgccgctgagattcgcgactctgcccgccacggcgccagaatatggctcggcaccttccaaaccgctgaagaggctgccatggcttatgaccgagccgcgttcaagatgaggggctccaaggctttgctcaatttcccagctgaaattgttgctgcaacggagttatctttcaataatactaatagtaacaatcacgatgctgtttctgattccagtgctggtagctcttgcacgaacaattccgttcagctaaataggaatcagtcagaaagctgcacaagtagcacaggttagctaaatggggttcaacaattaattgtagaaatctttttttttttttttcgcaattgggttggtttgttataattattataattatttgtatctgtctgtcttacaggacaccgaaaattaattcatttaatgtgataccatgttcatgaatgggttaaaaaaaaaaaaaaaaaaaaaaaaaaag

SEQ ID NO: 497 - DNA, 819 bp, Glycine max
  Predicted polypeptide sequence is orthologous to G28
ggctcgagccaaaaccacttgacacaccgggccgacttgcccttccttcaaaaaccaaagccagaccgaccctaagaagaaaccaacaaacatgggaagcaagaaaacctacgaggaagaagaaagcacggctctattttcccattcccaaacacaaacagacttgctgttacccttcaacgagaacgacccacaggacatggtcatataccaagtcctccacgaagccaatgctctcaccaacacattcctccctcagcccaccagaaacataacaaagaagcactacagaggagtccgccgccgtccttggggaaaatacgccgctgagattcgcgactcggcgcgccacggcgccaggatatggctcggcaccttccaaaccgctgaagaggctgccatggcttatgaccgagccgcgttcaagatgaggggctccaaggctttgctcaatttcccagctgaaattgttgctgctgctactgcaacagagttatctttcaaaagtagtagtaataataataataataataataataacaatcccgatgctgtttctgattccagtgctggtagctcttgcacgaacaattccacttgggtaaataggaatcagtcagaaatcacaagtggcacaggttagctaaatggtgttgaagttgaacaattaattgtagaaatctttttttgtttctttttctcaatcgttttggtttgttataactattataattatttgtatctgtctgtccaactggacaacaaaaattaattaattgaatgtgataccatgatcatgcatgggttaaaattataaaa

SEQ ID NO: 498 - DNA, 736 bp, Glycine max
  Predicted polypeptide sequence is orthologous to G28
  misc_feature (11)..(12): n is a, c, g, or t
  misc_feature (14)..(15): n is a, c, g, or t
attctatgaanncnngattacattacaatcgttgaagtctcatattaatgattgatcaaattgtacaacatgcatattcctctagccacttcaacattccaccttgacttggcttctattcttggctaatttattcagtagttcagccaggctcttcctcctctttgtcccttgtgattctgagctatcatctgaacacgaggacgacggtgatgaaatttctaacaaacttcgcttggaagttgtcatcattactggctccgacaattcatcggaattgtcggaatcaataagatgaggaaaattcagcttggccttttggcctcgcattttgaaagcggctttgtcatatgccaaagcggccttctcttcggtatcatacgtgccaagccaaaccctagctccgttcttctttggatccctaatctcggccgcaaactttccccacggtctacgcctcacccctctgtaatgcttccatgttggtggcgcatgatcacgcgctaccacagccgttgcatcctcacttcggaaagcaatgttccctgaatcaccatcacatttattagggtctgaaaatggatcatgagatgcagcttggtgggtttcagacatgagattgatggaatcatgtccaagtaggtattgttgaacagattccaagaatgcaaaatcggaatccacggtggcggaaaccatgttttaattttcagctaactttgctcaccgcgtttgg

SEQ ID NO: 499 - DNA, 1079 bp, Oryza sativa
  Predicted polypeptide sequence is orthologous to G28
gcaggaattcggcacgaggcaaaatcaaattcaaattcacgggataattcaaagatgctgcttaatccggcgtcgagagaggtggccgcgctggacagcatccggcaccacctcctggaggaggaggaggagacgccggcgacggcgccggcgccgacgcggcggccggtgtactgccggagctcaagcttcggcagcctcgtggccgaccagtggagcgagtcgctgccgttccggcccaacgacgccgaggacatggtcgtgtacggcgccctccgcgacgccttctcctccggctggctccccgacggctcattcgccgccgtcaagccggagtcgcaggactcctacgacgggtcctccatcggcagcttcctcgcgtcgtcgtcgtccgaggcggggacgcccggggaggtgacgtcgacggaggcgacggtgacgccggggatcagggagggcgagggcgaggccgtggcggtggcgtcgagggggaagcactaccgcggggtgaggcagcggccgtggggcaagttcgcggcggagatcagggacccggccaagaacggcgcgcgcgtgtggctcggcacgttcgactccgccgaggaggccgccgtggcgtacgaccgcgccgcctaccgcatgcgcggctcccgcgcgctcctcaacttcccgctccgcatcggctccgagatcgccgccgcggccgccgccgccgccgcggggagggagcggccatatcccgacccggcgagctccggctcttcttccccttcatcctcttcctcctcgtcgtcgtcttcctcctccgggtcaccgaagcggaggaagagaggcgaggccgcggccgcgtccatggccatggcactggttccaccaccgacaccaccggcgcaggcaccggtgcagctcgccctcccggcccagccatggttcgccgccggtccgatccagcagctggtgagctaagtggcgatgtggtagtggtagtggtgatttagccatcttgtgcgactgtgcgtgatcgattgctgcttgatgggtcgagcaagttcagaacagagcatcactctctgcagaat

SEQ ID NO: 500 - DNA, 1429 bp, Zea mays
  Predicted polypeptide sequence is orthologous to G28
gcgcgcgggcggacgcgtgggcttccattccaatttccacacacacacgtctcagctcactccctcctccagtttcgtcagctcgtcatcataaaccgaacacagagctctcgattccattccaggatgctgctgaacccggcgtcagagacgtcggtgctagacaccatccggcagcacctcctcgaggagccagcggcggcggaggcgcggccggccgacgagagcttcgggagcctggtggcggaccagtggagcggctcgctcccgttccgcaccgacgacgccgacgacatggtggtgttcggggtgctgcaggacgccttcgcctacggctggctgcccgacggctcattcgtgcacgtgaagcccgagccagtgcggtcccccgactcgtcctcctaccacccctgctcctacgacggctcaccctgcttcggcctcctggacccggagccgccgctgacgcccggcaccaccacgcccgggagggggcaggaggaggccgcggcggccatggcccggggcaagcactacaggggggtgaggcagcgcccgtggggcaagttcgcggcggagatcagggaccccgccaggaacggcgcgcgcgtctggctcggcacgtacgacaccgccgaggacgcggcgctcgcctacgaccgcgccgcctaccgcaggcgcggctcgcgcgcgctcctcaacttcccgctccgcatcggctccggggacaagcgcccgtcgccggcgccgcccgagcccgccacctcctcggactcctcctcgtcttcggccagcggctcgcacaagaggcggaagcgaggcgaggccgcggctgccaacatggccatggcgctggtgcccccgccctcccagcttaaccggccgccccagccgtggttccctgccgcgccggtcgagcaggcggcgatggctccgcgcgtggagcagctcgtcgtctagccatgcgtgcaacgatggatgcgccggcgaaagcgggggacggacagggcaaggccctgcgctgcacttgcgtgacagctccaccggatggaatgcgaatatgcgataaagctcgtgatgccgctgttgctccgtgcaactggcgcaagtggaagaagctgtctctgtgtgtaatcaagtgtcttgtctgcggacgaattttcggtatgtgcgtcgttgtcactgctcgggattgtgctgctgctgataagttcggaaaactgtacacccacgtagggagagagacgatccgtgatcaagaacagcccgctttgttctttctctgataaaaaaaatatccagcggccaaacaggcgcgcaagtcaacagaacagcgacctgagctcgtgacacgagatcgagatcgaaatcgcccccactgaaaccagaactgcagagccgagcggtaatccaacgctgacgacgtaac

SEQ ID NO: 501 - protein, 259 aa, Oryza sativa
  Orthologous to G28
MLLNPASREVAALDSIRHHLLEEEEETPATAPAPTRRPVYCRSSSFGSLVADQWSESLPFRPNDAEDMVVYGALRDAFSSGWLPDGSFAAVKPESQDSYDGGKHYRGVRQRPWGKFAAEIRDPAKNGARVWLGTFDSAEEAAVASDRAAYRMRGSRALLNFPLRIGSEIAAAAAAAAAGNKRPYPDPASSGSSSPSSSSSSSSSSSSGSPKRRKRGEAAAASMAMALVPPPPPPAQAPVQLALPAQPWFAAGPIQQLVS

SEQ ID NO: 502 - protein, 237 aa, Oryza sativa
  Orthologous to G28
MSLSLGFSAGAGVGADRLAAAPALQAAGALPPRVDVSLSLARAANGQPSSYLPLNENDSLDMVLFDVLREASAVAALSSSSSSSPELGARTTAPVVAGHPAGRKGGGGGGGGRGAAARGGAAGGRHYRGVRRRPWGKYAAEIRDPTRHGARLWLGTFGTAEEAAAAYDRAAFRMRGAKALLNFPPAVAGDGARRGAAAAAKQVGMSDVVPRACHVVCYSVLSAHIFYDIFRGVIPIP

SEQ ID NO: 503 - protein, 282 aa, Mesembryanthemum crystallinum
  Orthologous to G28
MSLIANFESDFAVLESIRRHLLEDWDPRAGAPAITTGSGPVYHRNSSFSSLYPCLTDNWGELPLKEDDSEDMVLFGVLRDAVHTGWSPQSGSESGSGSPAPVTVKPEPVDSPVSSPAPVRVAGGEAPVAAAPARGKHYRGVRRRPWGKFAAEIRDPAKNGARVWLGTFETAEDAALAYDRAAFRMRGSKALLNFPLRVNSGEPDPVRITSKRSSPERSVSSSSSESASPKRRKKEEVVVGPVAGQARPGLQQVGNVVEGMQVGVGCQVGVGTMPLGDQLLVT

SEQ ID NO: 504 - DNA, 1082 bp, Glycine max
  G3643 Predicted polypeptide sequence is orthologous to G47, G2133
ccacgcgtccgcttcttctctcagaatacacaacacaaagtcaatataattatagtatatccctatgagtaggagttcggcgatgcatggaattacaagcacaaacaacaagttgaagggagttcggcgtcgaaaatggggcaaatgggtgtcggagattcgtgttccgggcacgcaagagcgtttgtggttgggaacctacgccacgccggaggctgccgcggtggctcacgacgttgccgtctactgtctaagtaggccttcttcgttggacaaacttaacttccccgaaaccttgtcttcgtacagtgttcagctcagggacatgtctccgaggtctgtgcagaaggtggcttccgatgttggcatggatgttgatgcaagaaacattgttgcgggcaaaacttcaacggtgggggcagaaactaattgcgagagtgatgagaggactagtactgcgtctgtgtgtaatgttgttggagaaggtggtgctgatcattcggatgtgttttggtgggatgatgatggtgggtcttggcatggaagtggtggagattctacggaaagggatgccttgagcatttccattgaagattatctttagctgttctaggtttcaactttagttatctttttttttttttttttgagttatgatcgatgcgcatagttagtagttacagataattactgctagtgttgggtgtttaaacggtcagagatgatgatatataaatttgatgtgcgctagctgcctttttgaagaaactaaaaaaaggtaaaacaagaaagattgtacccccaaaatgaacttggtcaatttcacactttcacgccatttgcattttgtgcacgttgttagttttcaaattgttaattcccttgctaaacccactcaaacttgagtgcgttcaccttttattaccacgtagtaactgagagttaacgaaaatatttctttataaaaattatttaccatttagtgtctttcgtttacttgtaattattcaacttgtcaataagatgaaagttctaattttagatataataaaattcagctagtatttgtgaattactcactt

SEQ ID NO: 505 - protein, 165 aa, Oryza sativa
  Orthologous to G47, G2133
MSRAECGGGEEEERCRYRGVRRRRWGKWVSEIRVPGTRERLWLGSYATPEAAAVAHDTAVYFLRGGAGDGGGGGATLNFPERAAATYGGGAAVARLSPRSVQRVASDAGMAADAQLLSARDAAPAPAPATANARPDHCTGCDDRAVRLAGTPRGCTVLTSHAIVF

SEQ ID NO: 506 - DNA, 889 bp, Glycine max
  Predicted polypeptide sequence is orthologous to G157, G859, G1842, G1843
ggtatataatatgtcactaatttaattaggcacagactagtagctgaagcaaacttccccacggcaacattatgtttaagagcttctctagatggtccatgtttcaaccagaatagaaataacagaaggcaagtagctaaaccatggcatagttccctatgcatgtattaagcacacaattggaaaattcgtgcaagttatatccatagtggtggctttcagctgcatttacaaaccagggagcagattatgcgtcacccgatctgtttgatcatagtcaataaaccgtgtcaccacgttattgccgcccccaccccttttctggccctccatccgcttcccccaaacctcaccctcatttctcaagatatgttcctttttcttaagattctctccagattccatcatcaatcgcatctttgctgatctgattcgcgaaagagcagaatgaaccagtttctctagttccataaggtcagtcacactcagatgctcaagttcagaaacaccaaagtggctttggaccaattgagaaaacgcttcatcagaccagatatctgcaatttcaaagcggagtccctttgtgtcagtaccgctcgctcctaagttatcccaatatcgctgcacgacctcggccaaactgtcaccgttgcaaagctcgtagagcttgccggtgctggagaagatgagcagcgccaacttcgcatcgcagagaatggataactcgcgggctttcttcatcaatcctttgcgcctcttggagaatgttatctgccgattgcttttgttctcgattcgctttatctccagcttcttcttccccattcttcttcgcgccaaaaccctagctagctaccttcttttctattcggttttctcggacgcgtgg

SEQ ID NO: 507 - DNA, 1995 bp, Glycine max
  Predicted polypeptide sequence is orthologous to G175, G877
gggaaaaatgtaaagataatggctttgatgatatctacatatcatcctttgctttcaagcgtgcaacagattcaggctctttttatcatggtgctggaagaaaaatgataaatcctactacacttcctcaacagtcccttcctggtattgaggtttcggctcagtctgaaaattcttttcaatctcaaagtgttgatgctgtcaaagctcaaactgagaacaaaagtggttttcgtcttcaggccgactttgctgaatcacctcctcaaaaagataatggaattaagatgttctcagctgatcaaagggcttttgatgttgttggcggtggcaatgaacattctacaccaattgaagagcaagtagatgaaggagatcaaagaggcaatggagactcaatggctagtggtgttggtggtgcaccatctgaagatggatataactggagaaaatatggccaaaagcaagtgaagggcagcgagtaccctccggagttactacaagtgtactcatccgaactgtcaggttaagaagaaagtagaacgatctcatgagggccacataactgagatcatctacaagggaacgcacgaccatgcaaaacctcctccaaatcgccggtcaagtataggttcggttaaccttcatactgacatgcaagtggaccaccctgaacacgttgaaccacacaatggtggtgatggtgacttgggctgggctaatgtacaaaagggaaatatagctggagctgctaattggaagcatgaaaacattgaagccacatcatcagcatctgttggccctgaatactgcaaccagtcccccaatttgcaggctcaaaatggtactcacttagattcaggagaggcggtggatgcctcatctactttttctaatgaagaagacgatcaagtcactcatggtagtgtatcattaggttatgatggggaaggagatgaatctgagtctaagagaaggaaactggaatcatatgcagagttgagtggagctactagagccattcgcgagcctagagttgttgtacagactaccagcgaagtagatatcctcgatgatggttatcggtggcggaaatatgggcaaaaagttgtcaaaggaaatcccaacccaaggagttactacaagtgcacgaatgcagggtgcacggtcaggaagcatgtggagagagcatcacatgaccttaaatctgtaatcacaacatacgagggaaaacataaccatgatgttcctgctgctcgtgccagcagtcacgtcaacgctaatgcttccaatgccgttcctggccaagcttctcttcagactcatgttcatagacccgaaccatctcaagttcacaatggcattggaaggcttgagaggccttctcttggctcattcaacctacccgggaggcagcaactaggaccatcccatggcttctcctttggtatgaaccaatccatgctatcaaatctggtgatgtcagggttaggccacgcgcaagcaaagcttcctgtcatgcctgttcatccgttcttggcagcgcaacaacaacatcaacagcgacaacaacatcaacagcagcagcaacatcaacagcagcagcaacaacatcaacagcaacagcaacatcaacaacaacaatgcgctgcaaatgatttgggtttcatgttgccaaagggagagccaaatgtggaggctattcctgaacatggtggccttaacctgtcaaatggctcatcagtgtaccaagaaatgatgagtcgcatgcctcttggacctcatatgtaaaattttattccctgattctttaaagaaaaaactaatgtttacatctgataacatacatatatagatttatacatatatgtaatgccaaggcatacataggcggacttttcattattagactcattgtaatgtttgacattcttcatcacatgtcaaaggtatatgttattttgctcatttattgcattggtcctggccggccgc

SEQ ID NO: 508 - DNA, 845 bp, Oryza sativa
  Predicted polypeptide sequence is orthologous to G175, G877
gaactagtggatccccgggctgcaggtttggtccaagtctggtcaggccacagcaacttcatgggagaatgccgcaaatggacacctccaagatgtcggtagtgaagttctgacaaaactgtctgcttctcttacgacaacagaacatgctgaaaaatctgttatggacaaacaagaagctgtggatatctcatcgacgctctccaatgaagaggatgatagggtaacgcatcgtgccccgctttctctgggctttgatgcgaacgatgactatgttgaacacaagagaagaaagatggatgtttatgccgctactagcactagcaccaacgccatcgacataggagctgtggcgtcaagagctatccgggagcctcgcgttgttgttcagaccacaagtgaggttgacatccttgatgatggttaccgttggcgcaagtatgggcagaaagttgtcaaaggaaacccaaatccaaggagctactacaagtgcactcatccgggttgctcggtgcgcaagcatgtggagcgatcatcgcatgatctgaaatccgtcatcacgacgtatgaaggaaagcacaaccatgaagttccagctgccaggaacagtggccacccaagctcaggctcagccgctgcaccacaggctaccaatggtcttcttcaccggagacctgaaccggcacaaggtggtggtggtggtagccttgctcaggttggctatggctcagctggtcacagaccagcaaagcagtttggtgcagcagcagctggtttctcctttggaatgcttgctcgtagcatttgcaacttcggggccgtcttcggcgatcgccgttgccgcg

SEQ ID NO: 509 - DNA, 984 bp, Zea mays
  Predicted polypeptide sequence is orthologous to G175, G877
  misc_feature (651)..(651): n is a, c, g, or t
cgcgcagctacttcaagtgcacgcatcccaactgcctggtgaagaagaaggttgagcgctcgcacgaggggcacgtcacggagatcatctacaagggcacgcacaaccacccgaagcccacgcagagccgccggccaggcgcaggcgcgcacccgttgggcggcggtgcgcaggcggacgcagccgacaacctgcaggggtcacaggcaaacgcggcggaagccaaccagccgtggcgtgcgggtgtccaggatggcgtggacgcgacgtcgcccccgtcggttcccggtgagctctgtgactcggcggcgtcgatgcaggtcgactgcgcggcccggtttgggtcccccgagggcgcggacgtgacgtctgccgtgtctgccgaggtggacggggacgacagggggactctgactcatggcggtgccaacgcggcggagggcgacgaactggaatctaaacgaaggaagctggaggcatacgccattgacatgagcactgcgtcgagagctgttcgcgagcctcgagtggtgatccatacgacgagcgaggtggacatgctggatgacggctaccgctggcgcaagtacgggcagaaggtcgtcaagggcaacccgaatccaaggagcttctacaagtgcacgcaacctntctgtatggtgcggcctcttttttccgcgcgctttttacgctcttatgctcttctttccttttttccgtccctcggcctcctttttttttttttttccttggcttcttccccttttttttttttctcctctttccctcttttcccccccccgctttttcccttctttcccccctttttccgtcccttttccctcccctttccccttttcttcccttttcctccctccccgtttcgccttttctctcgtttccctcccttttccttcctttcctcccctttctctcccgttttccttccccttttcctccccgttcctttccgtttctttcttt

SEQ ID NO: 510 - DNA, 1367 bp, Zea mays
  Predicted polypeptide sequence is orthologous to G175, G877
ccacgcgtccgtgccaccccttccttcccctaatcccctcctcggtcaaaccgcctcactctcctactcttctctccctagtccctacccggctctctccctcccccctctctctaaaaaaagtagcgcccgcagaaccgagaggctggagaaataaaggcggaaagagggaggcaaatctcactttgttggggattctttcctccgtttccgactcctttgttctcttaagtgttcttggttagtggaatggaagctcagcagccccatttatgcccccgagagcctcgtcgttcccctcgtgtgtaggtgtagcctttcactcggttggtggaagggcagaggcacagtagaacatcgataaagggggggtcgtctattttttagctcttcgtgttcttgtaggaggaattcccgttcacatgatccgtgcctgcatcctcaagagctgtccgggagcctagggttgttgttcagaccacaagtgaggtagacattcttgacgacggttatcggtggcgcaagtatgggcagaaggttgttaagggcaatccaaatccaaggagctactacaaatgtacaaacccgggctgttcagtgcgcaagcatgtggaaagagcatcgcacgatctgaaatcagtcatcacaacgtatgagggaaagcacaaccatgaagttccagcagccagaaatagtgggcaaggcagttccagcgctccatctgcatcacaagctggtggttctcaccgtaggcaagaacctgcacaggccagctttgctcactttggtacggcttctttcagctcgttcggtctcccaccgagtggtcagttgggaccaacaactggcaatttcggcttcgggatggttcccccaggcatgacgatcccagtgccctctctaggatcgcttgcccctgtaaagatggttggaaattcatcagctatgcaggggtacccagggcttatggtgccgggagaaccaaaggtagagcctgtctcgcaaccactcatccaaatggcaaatgcatctccaccagcttaccaacagatattgagcaggcctcctttcggtcaccagatgtaaataataggaaagagaaaggggataatagatttgcttcagcttgtatacatgatagctacgctgcaacatggctttagtgttcatggatcgtccaattttttatttctattttatttttctgcccacgcatgtctttgaagcaaagaatgctgaggatgataccctgtcgtgcctgttgtaatcacgtaaaggatacctttcgtctttttgagactcgaaattggaaaacgatcaatcaaaatttctggttgcgaatgcaaaaaaaaaaaaaaaaaaaaaag

SEQ ID NO: 511 - DNA, 3267 bp, Zea mays
  Predicted polypeptide sequence is orthologous to G175, G877
gagctcacttttccgggggccgcccttttttttttttttttttttttttttttttttttttttcaccaaacctcaatgaagaggggcagtaaataaataaatagttgctgagctaaaaatgaagtggaagggtgaaaaaaaaacagaaagcaacgggtgtttgttcccacgttataacaattatcacgaactcatcctaatacgactggtaagaaactaataacttgagaatcactaatcctctccacatttatttatgtatctacatctgctggcgcaaccgcagcccgctgcacatcatctgctggtacaccgacggggcagcgccgccggcaacgttgccctcgacctttacgtcgtccttgggcgccacgaggccagcggcctgcatcgcctgccggtgcctcagcagcgggtgctgctgcagggacgacggcgccagcatcgggagcttcagcccatcgacggcgctgagggtccccgccggcaccggcaggctcggcagtgacgtggggccggcgccgccaaggggaatggaggaggcatacgtcgggtaattgcccatcggcgccagcggatccctaggcggcggcaggccgaacggcacgccgcagccgcccaagtgccccatcaggccgtcgcgcagcgacgggtgctccagcctgcgcgggccacccgcgcctgtcgccgccgcggtgcccgggtggccgctgttcctggcggcggggacctcgtggttgtgcctgccctcgtacgtggtgatcacggacttgaggtcgtgcgacgcgcgctccacgtgcttccgcaccacgcagcccgggtacgtgcacttgtagtagctccttggattcgggttgcccttgacgaccttctggccgtacttgcgccagcggtagccgtcatctaggatgtccacctcgctcgtcgtctggatcaccacgcgaggctcgcgaacagctctcgacgcggtgctcatatcgatggcgtacgactccagcttccttcgtttacattccagctcgtcaccctccgcgtcggcaccgccctgagacatactgccacgagtcaccctgtcgtccccgcccacctcgtcggacacagacgtcacatccgcgccctcgggggatccaaaccgggctgccgagtcgacctgcatcgaggccggcgagtcacagcgctcaatgggaactgagggcgacgacgtcgcgtccatgccatcctgaacacccgcacgcctcggctggttggcgtccactgcgtttgcctgtgaccccaggttgtcggctgcgtccgcctgcgcactgtcgccaaacgggtgcacgggctggacgcctggacggcggctctgcgtgggcttcgggtggttgtgcgcgcccttgtagatgatctccgtgacgtgcccctcgtgcgagcgctcaaccttcttcttcaccaggcagttgggatgcgtgcacttgaagtagctgcgcgggtactcgctgtgcttcacctgcttctgcccgtacttcctccagctgtacccgtcctccgctggcgctgtaacggccattgccgccgggtagtcttccctcgcatcagcttcctcggctctctggccgtaatccgggggtgatgcgtgttcattgcctgcaccggtgccagacgcaagacggctgagcttggagtcacgagcaccgtcactatccatgttggtctgcccatcgtgattctgctggttcagttggcccagcaaactagcctcttgtactgtcagaatcttggtttcagtcttgacagaagacttcgtattttgttcctgacggagcaattatgaactaactcgtaaggaaatggtatcaaaaggtattggatcatgaatagaaaaaaaaatgttcattgacattttgaaatgtacaattagaacgatgttcttatatgtttagttggaactcaaggaagactaacctgttgtttagttgccagtgagaattatttttattgaacttctaaactatctaacactagctggtctctggtctttctccaattagtatgaacaatatgcagcaaaacagccactttgtgtcactaacactcagagaatagacaaatgtgcttcaagcctcaaccattccaaaaagacaaactagtctgttacaggtagtgcaacagataaaagacttacagagcaaaaccatttggatttaaccgatttctcatctagactcggggcaaaatttcagaaacaaacatcactgcaaactgcacgtttatacgaatactttctaagttaagagatccttttaccattagcgcacaagcaaatgttatcatgaataacctatgaagtattcaaatgttaccttcaatcattaccacgcaagcgtcgcaggaataacctatgaactattcaaatgttgctaaccttcattgcttcagcagtgtagtgtgaggatttcagatctaagggcttgaaaggaaaagcattagggccatctccaactgaaggaggaccacctccaaatctaataggatcattgtcatttgtgctaccaaacatgaatagcgtccccgtggttggcgaggcctggccctgaagaattgcaaggaaacaaaaaacattgctgtcaggtacgaaatagcttcagtatcggagtttattaaaataattgtcctagttgatacctccttagttaatttacatatgaaataacatgatgattcaaaatacagatatgaatatgaagagagcaaacacatgaaattcctatgcagctttgacaacattaacagctattatattggagttccaagtagtacataagggggaagtttggacctgaagtgtgggggcatacattgccacataactatggaaagaacagagatttgatcatcatattcctgctttcaagaaaactttgaaatatttgaatggtacgatactatttttctgcttttgagaaaacaaacagaagcctgtttggaaagaagagactggatgctacaaaacaaggcagaactgatcatcatggaactgaagtagagctttcacgaactccctggagaggtcaaaagcttattaaagcaagcattcttgaactgccagtttagcatccatagacgaaagcaatactgattctggtaacgcgtccacaccctatcataacctagagaagagcacataccatggaattagaaacgaagactggtgactccagcagcgttgctgggctcaggccaggcgggatcgtgaggtagggcgatggaacttcgctcgagccgaat

SEQ ID NO: 512 - protein, 996 aa, Oryza sativa
  Orthologous to G175, G877
MTTATLDPPPPPLLIAGSLLDDDRDAGSAASSSPRWLPRARGSTVGSPPRRGGEERGGEAATRRKGNSSCPDDDDDCRNDEDDCRNDDDYRDDDVGATTDGGGDAAALLPMAMMTATTMAPMPVEAAVDGGGELSSAGEGGQRRVNLLPTKILSAYENHLFSQALACREDEWIIEKLAVIAARRSSFVSEESLCSVPAAALVSLAIAHLAFSPMLVYGVLDRLCSVCHLGEMEGDIAMEEWKDSNHRGADYLMTMPMQNFLADAFPPPELLEGEGGFEKHGLSVAVGSPPPTPPPPEDGCSPLPLTPQFGQKFGSGGGGGGSLADRRARGGFSNVARISVPYNQPAADVSSAGAPSPYVTIPPGLSPTTLLESPVFSNAMGQASPTTGKLHMLGGANDSNPIRFESPRIEEGSGAFSFKPLNLASSHYAAEEKTKSLPNNQHQSLPISVKTEATSIQTAQDEAAANQLMQPQFNGGKRSRAAPDNGGDGEGQPAEGDAKADSSSGAAAVAVVAAAAAAVAEDGYSWRKYGQKQVKHSEYPRSYYKCTHASCAVKKKVERSHEGHVTEIIYKGTHNHPKPAASRRPPVHPPPPSPATTTTTPLPPGDAQADHAPDGGGGSTPVGAGQAGAEWHNGGVVGGEGLVDATSSPSVPGELCESTASMQVHEGAAAAQLGESPEGVDVTSAVSDEVDRDDKATHVLPLAAAAADGESDELERKRRKLDSCATMDMSTASRAVREPRVVIQTTSEVDILDDGYRWRKYGQKVVKGNPNPRSYYKCTHPGCLVRKHVERASHDLKSVITTYEGKHNHEVPAARNSGHPAGSASPGGGAGSSSQPHGVGVGGRRPEVPSVQESLMRLGGGCGAAPFPPHFGLHLPPPPPRDPLAPMSNFPYSLGHAPSPALRGLPPPPPPPPSASALAVAGLGGVVEGLKYPMLAPPSVHSLLRHRQGGGMEAVVVPKAEVKQEAMRPAAAVAGAGRGAAVYQQAMSRVSLGNQL

SEQ ID NO: 513 - protein, 631 aa, Oryza sativa
  Orthologous to G175, G877
MSSFLNEEFSSGPFSDIFCDNGSNKHQDGLGKSKAFIDSSREETAQLAKKFESNLFGANQKSSSNGCLSERMAARTGFGVLKIDTSRVGYSTPIRSPVTIPPGVSPRELLESPVFLPNAIAQPSPTTGKLPFLMHSNVKPSIPKKTEDETRHDRVFFFQPILGSKPPTCPVAEKGFSVNHQNQPSVTDNHQELSLQPISTASNDFTSPTIVKPKTSDSMLDNDDHPSPANDQEENASHKNEEYSSDLIITPAEDGYNWRKYGQMRVRTVERSQDGQITEIVYKGSHNHPLPPSNRRPNVPFSHFNDLRDDHSEKFGSKSGQATATSWENAANGHLQDVGSEVLTKLSASLTTTEHAEKSVMDKQEAVDISSTLSNEEDDRVTHRAPLSLGFDANDDYVEHKRRKMDVYAATSTSTNAIDIGAVASRAIREPRVVVQTTSEVDILDDGYRWRKYGQKVVKGNPNPRSYYKCTHPGCSVRKHVERSSHDLKSVITTYEGKHNHEVPAARNSGHPSSGSAAAPQATNGLLHRRPEPAQGGGGGSLAQFGYGSAGHRPAEQFGAAAAGFSFGMLPRSIATPAPSPAIAVPAMQGYPGLVLPRGEMKVNLLPQSGNAGAAASQQLMGRLPKQHPQM

SEQ ID NO: 514 - protein, 650 aa, Oryza sativa
  Orthologous to G175, G877
MSSFLNEEFSSGPFSDIFCDNGSNKHQDGLGKSKAFIDSSREETAQLAKKFESNLFGANQKSSSNGCLSERMAARTGFGVLKIDTSRVGYSTPIRSPVTIPPGVSPRELLESPVFLPNAIAQPSPTTGKLPFLMHSNVKPSIPKKTEDETRHDRVFFFQPILGSKPPTCPVAEKGFSVNHQNQPSVTDNHQELSLQSSSTAAKDFTSATIVKPKTSDSMLDNDDHPSPANDQEENATNKNEEYSSDLIITPAEDGYNWRKYGQKQVKNSEHPRSYYKCTFTNCAVKKVERSQDGQITEIVYKGSHNHPLPPSNRRPNVPFSHFNDLRDDHSEKFGSKSGQATATSWENAANGHLQDVGSEVLTKLSASLTTTEHAEKSVMDKQEAVDISSTLSNEEDDRVTHRAPLSLGFDANDDYVEHKRRKMDVYAATSTSTNAIDIGAVASRAIREPRVVVQTTSEVDILDDGYRWRKYGQKVVKGNPNPRSYYKCTHPGCSVRKHVERSSHDLKSVITTYEGKHNHEVPAARNSGHPSSGSAAAPQATNGLLHRRPEPAQGGGGGSLAQFGYGSAGHRPAEQFGAAAAGFSFGMLPRSIATPAPSPAIAVPAMQGYPGLVLPRGEMKVNLLPQSGNAGAAASQQLMGRLPKQHPQM

SEQ ID NO: 515 - protein, 490 aa, nicotiana tabacum
  Orthologous to G175, G877
MQTQSEKGLHQSSDFPRFSAEKGVRSSNVTPESRNFQSVGSNMEHSPPLDEPQDEEIDQRVGGDPNVVGAPAEDGYNWRKYGQKQVKGSEYPRSYYKCTHPNCPVKKKVERSHEGHITEIIYKGAHNHPKPPPNRRSALGSTNSLGELQLDGAEQGVSGSNGDLGRANIQKAPDAGGLDWRNNNLDVTSSAHLGSAYCNGSASFPVQNNTQLESGGAVDVSSTFSNDEDEDDRGTHGSVSQGYDGEGDESESKRRKLETYSTDMSGATRAIREPRVVVQTTSEVDILDDGYRWRKYGQKVVKGNPNPRSYYKCTSAGCNVRKHVERASHDLKSVITTYEGKHNHDVPAARNSSHVNSGASNTLPAPVTAPPAQSHLHRPEPAQLQNAMARFDRQPSLGSFGPTPGYSYGINQQGLASLAMAGFHPNQSKSQQQIPVHSYLGQPRPMHDEGFMFPKEEPKAEPMSDPGLDLSNGSSIYQQFMSRSPLGPQM

SEQ ID NO: 516 - DNA, 964 bp, Glycine max
  Predicted polypeptide sequence is orthologous to G180
tgtcgagccgattcggctcgagaagaccaaagaaaaaaccaaaatcatcgtgtggtttttcaaggaccaaattcaaatcagtcataaaaagggggggtatggaaggaggagagagaggtgttaatcccaatatttatgagtctccaagtttcagtcgcaaacacccctcaagccatccaggaaatgggttttgttcaatttgaagaaaaccaggttcttagcttcttggcaccctctgctcaatcccaatcttctcagctctctcaatctctaaacgcctgcaacggtggcagcaatactgctgttgctgccgctaccacaaccgccaccgccaccacctccggatccggagcaacaattggtttcagccataatgaccttgtatccagaacttgttggtataataatgaacaggtgcgaacactggatcccaaagctgtcaatgatgaaaattgcaccggatatactagtgatggtggcaacaactcatggtggagaagtgctggctcagagaagaacacgatgaaagtgaggaggaagctgagggagccacggttttgtttccgaattcggcttgaggtagatgtgcttgatgatggttataaatggaggaagtatggtcagaaagttgtcaagaatagccttcacccaagaagctactaccgctgtacccataacaactgtagggtgaagaaaagagttgaacgactctctgaagattgtcgtatggtaataactacctatgaaggcagacacaaccactctccttgtgatgactcaaattcatcggaacatgaatgtttcacctctttttgaacaatgtcgtttcaataattattatgtattattaataattaattagctgtacgtgacattttcatgaaggatattgcattgtacttatattgttactatttgttattgagctcagtcactctttcatggaataaaaaaaaccaaaccc

SEQ ID NO: 517 - DNA, 609 bp, Glycine max
  Predicted polypeptide sequence is orthologous to G180
actgcaaagatcaagatatcttatacacgatattaaagtccatgacatccctacacatggtcatcttatctagctaaaaaataataatctatatattgacaacaaaaaaagcttccaaatatatggacaagataaaatatttttttgtggggtaatgtggttccctccaaataggaaaaatatggagaaagaaatctagggaaatgttttaacaagcatatcgatactgagagttctgaataatgacatgactgagttcatctttgaagcacactgaactctgtggcaaagtacatggcaatctatcaataatatcatagtgccttaattgagttcataattaaatacatgctgatcatcattataagcaaatgacattgaccttactagaaagaggtaaagcattcattctcggatgaatttgagtcgtcgcaaggggagtgattgtgtctaccttcataggtggttatcaccatacgacaatcctctgagagtcgttcaaccctcttcttcaccctacagttgttgtgggtgcaccggtaataacttcttggatgaaggctattatgacaactttctggccatatttcctccatttgtaaccatcac

SEQ ID NO: 518 - DNA, 589 bp, Oryza sativa
  Predicted polypeptide sequence is orthologous to G180
  misc_feature (544)..(544): n is a, c, g, or t
aagcttcctactacattttcattcataattagactgaatatcatgcaacgtgttgatcgatcggctagctgattgaccaggaaattaaatagcatccataagagttctaaaagctttcctagaacatttttattttacatcgatccctgctttttcgatttcccaattgcccccatcagatcagaaaacaataatccatcaccgatccatgtacataagcatgcgttcgtcaaaaggaggggaaggcccacctggcggggtggtccccggcggcgcccgggggggcgtcctcccttcaggggggggggggggggcggccctcgtagggggggatcaccatgcgggaattctccgacaggcggtccacccgcttttttacgcggcagttgttgggggtgcacctgtagtaactccttggggggaggctgttcttgacaaccttctggccatacttcctccacttggagccgggggccagacatccacattgttcctggtgtggaagcagaacctcggctccctcatcttcctcctcaccttcatnttccccttctccggccccttccaccatgaattaggcccatggcaa

SEQ ID NO: 519 - DNA, 509 bp, Zea mays
  Predicted polypeptide sequence is orthologous to G180
ccccttttcgagttttttttttttttttttttttttttttaagggaacaaatggcagtgtagctttatttgatacaacactacacatgaccgcctacaccgatggacgatggaccctctatcacatcggattacatgatgagtacactacgcatgcatgactagctagggttcatcgaccacacgctctgtcattcattcggcaagattgaagaccgtgatcaccaacaacatctatcgtggtcgtgggacgacagaacagatacggttcatcaaaaggagctgaagcaatcggtgtggtcgccggaggaagcgtcgtcgctgcagggagagtgcgtgtggcggccctcgtacgtggtcatcaccatgcggcagtccgtcgacagccgctccacccgtttcttcacgcggcagttgctgtgggtgcaccggaaatagctccttggatggaggctgttcttgacaaccttctgcccgtacttcctccacttgtagccatcatccagtaca

SEQ ID NO: 520 - DNA, 612 bp, Solanum tuberosum
  Predicted polypeptide sequence is orthologous to G180
gctgtgaacaacaacgaacaggtggaaacactagatcccaagggtataaatgacgaaaattgcagcggtaatgccagtgagggtaacaattcatggtggaagagttcatcttcagacaaaggaaaagtgaagataagaagaaagctaagagaaccaagattttgtttccaaacaaggagtgacattgatgttcttgatgatggatataaatggagaaaatatggccagaaagttgtcaagaatagccttcatcccaggagttactatcgatgtacgcatagtaattgtagagtgaagaagagagttgaaagattatcagaagattgtcgtatggtaataactacgtatgaaggtagacataaccattctccttgtgatgattctaactcttctgatcatgattgtttcacctctttctagaattaatattattattattattattattacatccaccaatattctgtatatagcacgtacctagctacccatatatattattgataattattatattatatagttttataaggaacaacaataacaatgtcacaacgaatcatatatatattgtgagctagctgcatgttgctatggtggattttatattcg

SEQ ID NO: 521 - protein, 344 aa, Oryza sativa
  Orthologous to G180
MVNFLKLSDIQSTDAESVDVGFISSVHKTTRKKGFTTCLLGRNSILFGKTTVVIGEKVEHCCRWSQEEEITGIAGVDSCYGEPGGVLSGRLGVNGEKGSTQFQISYGVSSAFGFRCDFGTGFITHGMGDHHGMPLPPPLQLPCHPKLLQMPFDQEDQPGIHGVMLSSDHCGLYPLPALPLSNSAAAAAATVALGKHSAAAGSMPNIGGAEEVATTVTKAGNESTTCNGSTTWWRGSTMAAAGEKGKMKIRRKMREPRFCFQTRSEVDVLDDGYKWRKYGQKVVKNSLHPRSYFRCTHSNCRVKKRVERLSTDCRMVITTYEGRHTHSPCDDNSSGEHTNCFSSF

SEQ ID NO: 522 - protein, 513 aa, Capsella rubella
  Orthologous to G183
MSDFDGNFNESTSCWAPPFSPSPRAILAMIDQAEDDGLDLISEMFPHTNLPRDHSAQSSEQRSGLGQRLAARVGFSPPPLDTENISPSAASLRSSTTVPPPVSAIPPGFIPSTLLQSPNMVTDSSQMIPAPSSDTNYGPQGMVETSGEGNAPTLIFNNDHPYQPVNADLPLLDVFDDVPTEESVYLPTYETDHVEPIGDSLVPNSFEHEFVGDANVNFISNEGTESVKDSESDDELDFDFEFEDEDEAEAEAEDNDEDKAEDEDEDNDEDGNEDEDEDDEEDENDEEEADHDDEADFDDAEPSSPKRRKFEASSNMIGATRTNKAQRVILQMESDEDNPEDGFRWRKYGQKVVKGNPNPRSYFKCTNNDCNVKKHVERGADNFKILVTSYDGIHNHPPPPARCRINSGPRNRSGTTTTTQNQSYRTDRLGRFPAPSSVITPMEMMPLSSFTPPLDMSKVYMTGLNKLPNFSVFQNPGYMYRNDEPMMNVVPNGSGIYGGIRHRLFAEFGVNLM

SEQ ID NO: 523 - DNA, 375 bp, Glycine max
  Predicted polypeptide sequence is orthologous to G188
ggaattccgcacgaggcaaaaaccaattaagggttctccatatccaaggaattactataggtgcagcagttccaaaggttgtatggctcgaaaacaagtcgaacggagtaacactgaacccgacatgttcgtcgttacgtacaccggagaccactcgcatccccggccaactcaccggaactcgctcgccggaagtacccggagtaagactctggtaaccaatccgccaccgtcacctgggtcactctcctgcttccaagccacccctttttcttcttcttcttcatcgccaccacactctccaacgtcgccggaggaagatccacggaaaccgccgatttagaacccgacccggatatggaaaccgacgggaac

SEQ ID NO: 524 - DNA, 723 bp, Zea mays
  Predicted polypeptide sequence is orthologous to G188
cattgggtacctcgaggccggccggtatctcctccgccactttcctccatttcccacacccccgccactccacgtcgtcgtcgtttgctgccgctgcgcaatggaggaggagcgctgcttcaacaactgggatctggacgccgtcgtccgcctgggctgccgccgccgcctctccccgccacggcagcccgacccgtttgcttcgcttctccctccgaccctgccgtcgccgtcgccgtcgccgccgcagaaggagaagcccgtggtgccagcgctggctaaaggaccagagccagagccatacgccgggtggcgctttcctaacctcggtgctggcggcgggcaagacggcgacgagctcatgagggccatgttagcagtccagccttccctgcctcagcctctgccaacgacaacgccaacgccaacgccaacgcttcccccggcagcaggagagcatcgacagtcgactgttacagccgtggacgtgccgctaccccaggtgcgccccgctccggccgccagagcgcagccgagcgggcggcaggtgcccggttccgtgccaagatccaagagaaggaagaaccaggtgaagaaggtggtctgccacgttccggcggacggctcgtcgtcggacatgtgggcgtggcgcaagtacggccagaagcccatcaagggctccccctacccaaggggatactaccggtgcagcagctcccaggg

SEQ ID NO: 525 - protein, 361 aa, Oryza sativa
  Orthologous to G188
MEEELCGNNWDLDAVVRLGCCRRRISPAAVAQQVDPFASFLQQGVAMEVAAEKEVGVEAAWSFPELTVRDGGGGGLGRDADELLKAFCAAFPSSSSSKSSPLPTPPPPPPTQPQPEQQKPVTVQENLPAPTTAPARASQPAAARQVPAGGVPRSKRRKNQQKKVVRHVPADGVSADVWAWRKYGQKPIKGSPYPRGYYRCSSSKGCPARKQVERSRSDPNTFILTYTGEHNHSAPTHRNSLAGTTRNKLPSSSAASAASAQPQPPPPSVVVVGAGGGGAEAAGLSPTTPLRTPSMEEDEEEEEEEELLVEDMEMAGEDELLFLNGGDDNAALDGTPMSSLFDIADEPFLPSPWTEPTAAGS

SEQ ID NO: 526 - protein, 386 aa, Oryza sativa
  Orthologous to G188
MDGDAWWYPGGGGGGGSNNWDLGAVVRFGCGGGRVSPAAALLGEAWEYDDDPFSSFLAPPMTAQQAALPAVWEEGDDGDAAWMAPLPGLQTGGGWGDQAPMVVDELCGALVVAPPPPPKQQEVLQVQQQPPPADNTQPTTYQQGSGGDGESTRAGGSRSARRKYAASAIYIVSVCFSDSCIMWIRSLADDRGVRHACRKKQTRKEVVRVAASGPAPDLWAWRKYGQKPIKGSPYPRGYYRCSSNKNCAARKQVERCRFDPSFLLLTYTGAHSGHDVPLHRNSLAGTTRHKPPPPPPLPSAADKSPATAAEAATASQSPGLSPTTPLRASSMELHGEDDAEAELQVEEDDMAIDDEDDDDVADETISTVPWGTPISDAIIAASYEWR

SEQ ID NO: 527 - DNA, 1683 bp, Glycine max
  Predicted polypeptide sequence is orthologous to G189
aaagtaaaaaaataaaattatattcggacataagggaggaacttactgataaaaaaattaaaaaagtattcttgaataaaattggttggcagtaatagaaaagagcgtattttccgtatgatgagagtgtgtgagcattcacatttgacggaaacagggtagcgtgagagtcgagtcacctgccgaaatcctatagcaccattttgaccaaggcgatatagctaacagctattcgcccccccatactttctttaattttctccttctcccatggtgtaattgctccaactatggccgtggacctcatgacgaccggttacacccgaaacgacaacatcagtagtttcacaaccaaagccgaggaaaatgccgtccaagaagccgcttctggtctagagagcgtcgagaagctcatcagactcctctcccaaacccaagcccaagcccaagcccaccatcaattcaacaacaacaatagctctagtaatgaaatcgccatcgccatggactgcaaagccgtcgctgacgtggcagtctccaagttccagaaggtcatttccctcctcggccgaacccgtaccggccacgccaggttccgacgcgcccctctccccaaccaacaccaacacacccaacctccctccgaaccgcccgttctccacgctaccccgctgcaccagatcccacctccctcccttcaccaaatccccaaaaccgagaaacacctcaacgattcatcgtctaagacgcttcatttctcatacccctccgccgttacttccttcgtctcctccctcaccggcgacgccgccgacaacaaacaaccatccccggcggccacgaccacgacctcccactttcagatcacgagcctctctcacgtgtcgtccgcggggaagcctccgctttcgtcttcctctttcaagagaaagtgcagctctgagaatttaggttctggaaagtgcggtagctcctctagccgctgtcattgttccaaaaagaggaaaatgaggttgaagagggtagtgagggtaccagctataagcttgaagatggctgatattccaccagatgattattcttggaggaaatatggacagaaaccaattaaaggatcgcctcatccaaggggttactacaagtgcagtagtgtgagagggtgtccagcgcgaaaacatgtggaaagagctttggatgatccagctatgctggtggtaacatacgagggagagcacaatcacactgtctctgctgccgatgctactaatctcattctagaatcgtcttgaaattcgtagccaaaatcatcttttttccgtgacaaggtttagaaacgcaagccatcatttaatcaacgttacaagttttcaacggggtgcaattatggcgtgttgaattgaattgcaactttactactctagtcagtcaggggggcattaaaatctccaaagaaattagtagtgggtgttgttccctttccctgtacactattggattcttttttatctttattttttttttctcgttctcttcaaggctaaatggaacattgtgaatccgttgcatcattaaaaaaaatattgtcaaggatgattgtgatggtggatttggtaagggatttgaatctcgatttttttttattttttttttataaaaaaagcaagtgggtgttggttttaaaaa

SEQ ID NO: 528 - protein, 350 aa, nicotiana tabacum
  Orthologous to G189
MAVELMTSGYSRRDSFSTKMEENAVQEAATAGLQSVEKLIRLLSQSHQNQQQQQQKLDQNPSVSADYTAVADVAVNKFKKFISLLDKNRTGHARFRKGPISTPLPPPPKPQQQRLNQNSIKNQNLQIEETEKPQINTPKIYCPTPIQRLPPLPHNHLQLVKNGSIERKESSTTINFASASPANSFMSSLTGETESLQQSLSSGFQITNLSTVSSAGRPPLSTSSFKRKCSSMDDTALKCNSAGGSSGRCHCPKKRKSRVKRVVRVPAISMKMADIPPDDYSWRKYGQKPIKGSPHPRGYYKCSSVRGCPARKHVERALDDPTMLIVTYEGEHNHSHSITESPAAHVLESS

SEQ ID NO: 529 - DNA, 1581 bp, Glycine max
  Predicted polypeptide sequence is orthologous to G192
gtcgacccacgcgtccgcccacgcgtccgtacggctgcgagaagacgacagaaggggatacctctctgtagcgaaaagtcagcgccttcttttgtctctctctctcaaaaaaaaaattccacacactgcagagtttgtctctctatggcggaagattgggatctacatgcggtggttagaggctgctccaccgttacatcatcctcagtgtcttcttcttcatctccttcttcctctggttttgcctcttcttacttccaccctgaagctgcagtttcttcttcttcttcttcctattctggcttcaacatcttcaagggtgaacaaggaataagccaagttttgtcgctctctgcgtacccctttgaggcaaggagctccattgaggaattgcatgagctttgcaaacctttcttctccaaatctcagcctctaacgttgcaagcctcttcacctttgtcctcactctcttcctattcctctgcgccacccaaatctgtttcaacgcaagagaaacaacaacagaggagcaagcaggcacatgctgtcaccaccccacgatctaaaagaagaaagaaccagcttaagaaagtttgtcaagtgccagttgagaatctctcctcagacatatgggcatggaggaaatatggccagaaacccataaaggggtctccatatccaagggggtactatagatgtagcagctcaaaggggtgtttggcaaggaaacaggttgaaagaaacagatcagacccaacaatgtttatagtgacttacactgctgagcacaaccaccctgctcctactcacagaaactctcttgctggctccacacgtcagaagccattggtacctcaaacagccaccaccactgaagaagactctgacaagagcaagagcctcacaaaacccacttcccctgccacctcaggggcagaagaagaggctccaacaccatcacaaggggaaaagtctgagagcagagaagagaaagaggatgtgatggatgatgaggaagaagatgaatttggcttgtctgatatggtgctttcagatgacttctttgaaagtttggatgaactgagccaacttacggctccttctgttgtcactggagactgtttcagtgaccccttttcagcaattgcaatcccttcttgggtggctagtggtgctgctactgctagtgggtgtagatgattctttcgggcaaatcatcacaatgcttttcattgatgacaatagggaccttttctttttggtttttgtttgtagaggaaatggaacattttggaggaatctttactaacaatggtttgtggatgggaggaaaagttttccttagtagagtagtagtgactagtaaggtagatcaagcattaatcttgttaaaaatcaatgattattattaggcattcatagttttattatttatgtcatcatacctatgtgttaatgtaaaaacaatttattttagtaagctttttgtatgctccttgagttgtggttgagttcattgtatttgacattggttttgtgatataaattggcaaaagcacttttgggttgacttgtggccgc

SEQ ID NO: 530 - protein, 336 aa, Oryza sativa
  Orthologous to G192
MEHFNDWDLQAVVRSCSFPQSEPPRVGVGVPAAPGAGGAPVVVAPPARAPDGPDQMARASASALYDLEYLDLDHKPFLLPGSSSSSSSSRAVARARGEDDGKGRHEVMISFPAAAAASTSGAQPRSPSGRKPGIRTPRPKRRSSKKSQLKKVVYEVPVADGGVSSDLWAWRKYGQKPIKGSPYPRGYYKCSSMKGCMARKMVERSPAKPGMLVVTYMAEHCHPVPTQLNALAGTTRHKSAPTGDDDKPTSPGPAAGRAAAGEGVVKCEDVDGNELSAMAADGGAEDTAAAADDDGELWPEGMGLELDEFLGPMDDDVFEFDHVLEDDGVLGRRLSL

SEQ ID NO: 531 - DNA, 1258 bp, Glycine max
  Predicted polypeptide sequence is orthologous to G196
gctttgctattatctcttcccttgtccttcttcctactatactatattttctctctctaatcaatcatagttctgatcttcatacacttaccccggaaacctccatttctcagatcaagcttgcacgaagacattaaaaaatagaaatacatacatagctatggacaataatacttgtgcctcctcccaacttgagtcagaagaagcatcttttgagcacaaatcagaaactcaaacatcaaagaaaaggaaaatggttgagaaaacagttgtggcagtgaggacaggagagaatgttggcaagctgaagaatgaagggctaccttcggatttttggtcttggaggaaatatggacaaaaaccgatcaaagggtctccatatccaaggggctattacaagtgcagcacatccaaaggttgttccgccaaaaagcaagtagagagatgccgaactgatgcttcaatgctcataatcacatatacctctacacataaccatccatgccccactgccatcaccacaaattcaccccaacaaccaaaagaattatccgaatccgaaaccacccaagacctctcagctaccacaaaggaggaagaccaagaacatatagaactagaagaagagcaaagggataataataagcccagtgatgaagttacaaatgaagaaaattttcattacttgcaatctcctatacgttgctccggccaagacatcattatagaacaagaagatcctttcaaactaaacacggagaaaagccatgatcgaatggatctcctcttagaggaagagcctctttgttttgcacagctcaagaacttgtctgcttccaaaaacgaagaacttgactttttcgatgagcttgaggagttacccatgtcttcatctttgttgcactttacgaggaacattttttccgatgaaaggattcccgttggcccttcttgattctagtgttgttttctcggtgcttgctatgctagtgacagtgtatgtattgttttcatccatgttatatatccattaatttcagctagtttttcaattcggaacttttctttttcttttgtaccctttatttatatgattatatcctatacttttaattaattattggttcacaactaagcatagttcatcactttggcgtgagcagggttagtgtgtagacaaaatcatcagctcttgcaattaaaattaaagaatgatggtttggctcacaatcaatggtatattgttcattctgtattc

SEQ ID NO: 532 - DNA, 1119 bp, Zea mays
  Predicted polypeptide sequence is orthologous to G196
actgctcatatatccgcctcccctcgccctccctctctctctctctctcactcacaaacaaacaaacaaacaagcctggatcgagcgaattcagccgagcttcagaaacccttgcaagctcgtagcaacttctctcaaccttattcggctttcttctagctatataacgaccctaaattagtctgcttcattcggttcttgcgaattgccaagaccgaaagaacagcttattactcttctgttagaaagactcgaagaggccggccgagatagactatcagctagctagagggagctaactacctacctagctagccatgtgtgactacttcctgcaaaggatggatcagggcgaccaccaccaccaccaccaggccggagacctcacggacgtcgtccgagccggcggcggcgcgatgcatcaggcagctgtcgcggagctctcctccgcggacacggggtggcagctcccggccgagccagcagctggagcaagcctcttcccgccaccccagccctcgtcgtcggactgcgacggcttcgcggacgcgttcgccggcctcccggacccgtttgccagcgactttcgcacctcctcctcctccctccggcgtgggccttggccctgccgacttcttcgacttcgaggcgcctgctgctgctgctgctgccggtggcggcgctcgaagaggcggaggcgtactggcgggcgcgcagatgcccgcgctgtcgccgagagagatacggccgtacccggtgacgatgggcggcgacaccgtgaagatcggcgcgccgacgatgatgcccgggctggccgttgggccgccctgctgtgcgttcgacgctgtcgccgggatgcagatgccgagcgcgcacgcgcacggtgaggggatgaagcgcaagaaaaaccaggcaaggaaggtggtctgcatcccagctcctgcaccatgatcgggaggaggaaggaccactggggagggtgttcgttctgatctctgggcttggaggaagtatggacagaagcctattaaaggagcacgctacccaagagggggctacagatgcagcagctctaaaggatggccggcgcggaagcaagtggagcgcaagcgaaccgac

SEQ ID NO: 533 - DNA, 780 bp, Zea mays
  Predicted polypeptide sequence is orthologous to G196
ttgggtacctcgaggccggccggggccttgctcagcctcagccctcaggcctcagccagcgtgcgcgcccacaacccctcacgtcgtccccgccaatcacaccgcacgaaccgaggacgacgggacaccaccgtcaccgcgacgtagtagtagtactacatgcatagcatagcctcgtggagtcgtggtagtagtagtttagttttgctcgcttccacaccgcaccgccgttcccttttttatatcccgcggatgcgcctgcctctgcctcggggtcgggggggcagctggtgacatcggattcggatcaggccgagaagatcgaactgctccgatccggcgcttaatttctctctctctctctcgggctagctgcccgggcaaatggacgccgagtggagcggcgacgagagcaaggctggcgctgcgggcggagtttcgtcggctgattgcccaggttcgccaccgccggtgtcgccggcgccaccgtcgacgtcgccagctgctaccggtgccgggaggaggcggtcggcgaacaagcgggtggtcaccgtgccgctggcggacgtcagtggcccacggcccaagggcgtcggcgagggcaacacgccgacggacgcgtgggcgtggcgcaagtacggccagaagcccatcaagggctcgccttttccgagggcttactacaggtgcagcagctccaaggggtgcccggccaggaagcaggtggagcggagccgggcggagccggacaaggtgatcgtcacgtactcgttcgagcac

SEQ ID NO: 534 - protein, 514 aa, Oryza sativa
  Orthologous to G196
MPPCVWGSHTPLSLLSPPAAWAGERMEGDQAGGDLTDIVRAGGGAMPGSVVVDLPSTAAEWQLPAEPMLFPPPPSLSSTTDGCGAGGAAGADIFGGGGGDLFSGLVDPFSSDYSSGADFLDAMPDAMAKVGFDTAVGGGCGGGGGGGGGSGGHLLDMSRKPLLPRGMPMAAVGGLAAPRVMPSPLSPRAIRPYPPISAGDMMKLGITAGQAAGCAIDAAVAGMQMSSPRSGGIKRRKNQARKVVCIPAPTAAGGRPSGEVVPSDLWAWRKYGQKPIKGSPYPRGYYRCSSSKGCSARKQVERSRTDPNMLVITYTSEHNHPWPTQRNALAGSTRSHHSKNSGGGGGSGSKGSQNDKSQQQPSVKEEQKDQATTATTTTTSTITTTNSASPVVVKEEEAALAGSSEALELERVMDTTAAGVVDHSELMDHVFSESYKPMIPETGQPDDFFADLAELESDPMSLIFSKEYMEAKPSGGDHAQEKAMAKELDPFDMLDWSTTTNSSAGSSFEQGKRG

SEQ ID NO: 535 - protein, 299 aa, Oryza sativa
  Orthologous to G196
MCDSLFWQSSADQGDLSDVVRASLQLQTAPRHQAASPPYVHLLGGGGGGGEDQLAAVSQHAEQQQQSMVDASAACDLLHALLPPPPVVQVQQQGASRTRTTIEEDTTGDGEELFAGAHYVVPPIKRRKSQTKKVVCIPAGASGGGGGEVVPSDLWAWRKYGQKPIKGSPYPRGYYRCSSSKGCSARKQVERNRADPTMLVVTYTFDHNHQWPTHGNAFAGSTRPSSSNSSNIRLQDSTPVHHQSQTGHDRLTTTHLKQEDVIISPSLLQPDHHQLCTIIDTKHHLLFHQDYPHSFGLFD

SEQ ID NO: 536 - protein, 299 aa, Oryza sativa
  Orthologous to G196
MCDSLFWQSSADQGDLSDVVRASLQLQTAPRHQAASPPYVHLLGGGGGGGEDQLAAVSQHAEQQQQSMVDASAACDLLHALLPPPPVVQVQQQGASRTRTTIEEDTTGDGEELFAGAHYVVPPIKRRKSQTKKVVCIPAGASGGGGGEVVPSDLWAWRKYGQKPIKGSPYPRGYYRCSSSKGCSARKQVERSRADPTMLVVTYTSDHNHPWPTHRNALAGSTRPSSSNSSNIRLQDSTPVHHQSQTGHDRLTTTHLKQEDVIISPSLLQPDHHQLCTIIDTKHHLLFHQDYPHSFGLFD

SEQ ID NO: 537 - protein, 299 aa, Oryza sativa; identical to SEQ ID NO: 536
  Orthologous to G196

SEQ ID NO: 538 - DNA, 1061 bp, Glycine max
  Predicted polypeptide sequence is orthologous to G211
tttttttttttgtagttaaattaataatatttaaaatttaaaaaatattctaaataaatgatactaatctgaggaataaataatacaatatgttcacgtgctagcaggagcaaacttaatttgttttatttgttccaaccatatattttcaccattatttgtacgtttacaccaataaagattgagcaaaagaatctaattcatctggtttctcctcaacattcaagagctgcaagtactcttcatagagcttttctagcgtatcatgatcatcagtgtgaacatcagaatagcattcctcgtaagaggcagtattgttgactaggtcatggtcttcaccaaagaatatttcaatcccaccattgtctccaatattgtcacttaccccccaaaccatgttcacctcttttgtttctgcttctgggctttgaactttctcttggcttgttgatgcagtcgtagctgaattcgaatcaagggttaaggtgctatccgttctgggtatacatgacgataaagccttaaccctgattggttttggtagataaactaaggtcttctctgaccctttgttattctcagtactcttttgcttattcttctttttacccttcttcttctctggtgcctcagttaacttgtcgtgtgtctttggatcggttccttgatttctcagcttcttgctgagatgggtattccagtagttcttaatctcattatctgttcgtcctggtaatctccccgcgatgagggaccatctatttcctaaaagcgaatgcattctaactataagatcatcttcttctggggttatgtttcctctctttatatcgggtctcagatagttcatccatctcagtcggcaactttttccgcatctaagaagcccggctctttttggtagtgatctccactggccttctccatgagtttgaatatacttagtgagcaatgcatcttctcgaggagtccatggacctctatgcaaccctactttagagcaacaaggagctcttcccatcttcagaagcttctctagcgaactctgaaaggaagcagag

SEQ ID NO: 539 - DNA, 1014 bp, Oryza sativa
  Predicted polypeptide sequence is orthologous to G211
tctgcgaggaggccaagctagtcgcgcgcaaattaatcgccgatcgatcctacgatgaagcggaagcggccggcggcgctgcgcggcggggaggaggcggcggcggcggcgctgaagcgtgggccgtggacgcccgaggaggacgaggtgctggcgcggttcgtggcgcgggaggggtgcgaccggtggcgcacgctgccgcggcgcgcgggcctgctgcgctgcggcaagagctgccgcctccggtggatgaactacctccgccccgacatcaagcgctgccccatcgccgacgacgaggaggacctcatcctccgcctccaccgcctcctcggcaaccggtggtcgctgatcgccgggaggttgccggggcgcacggacaacgagatcaagaactactggaactcgcatctcagcaagaagctcatcgcgcagggcatcgacccgcggacgcacaagccgctgacggccgccgccgatcactccaacgccgccgctgccgtcgccgccacttcttacaagaaggcggtgccggccaagccgccgaggacggcatcctcgccggccgctggcattgagtgcagcgacgatcgtgcccgaccggccgacggtggcggtgacttcgcagcgatggtgagcgccgccgatgccgagggattcgaaggaggatttggcgatcagttctgtgccgaggatgcagttcatggtggcttcgacatgggttccgcttccgccatggtgggtgacgacgacttctcctcgtttcttgattctctgatcaacgacgagcagttaggcgatctcttcgtcgtcgagggcaacgatcacgagcatggcaatggtgagattggtcatggagacgtcatggaatccaaacagtaatctttcgggagattgatcagggaataagttgaccatgagaaaacatgtaagaacagcttgtctgctgagtcatgaccggtgatgtgtatgtgatggaagaaaacgtatgtacgacttaatgcttgcacctat

SEQ ID NO: 540 - protein, 275 aa, Oryza sativa
  Orthologous to G211
MKRKRPAALRGGEEAAAAALKRGPWTPEEDEVLARFVAREGCDRWRTLPRRAGLLRCGKSCRLRWMNYLRPDIKRCPIADDEEDLILRLHRLLGNRWSLIAGRLPGRTDNEIKNYWNSHLSKKLIAQGIDPRTHKPLTAAADHSNAAAAVAATSYKKAVPAKPPRTASSPAAGIECSDDRARPADGGGDFAAMVSAADAEGFEGGFGDQFCAEDAVHGGFDMGSASAMVGDDDFSSFLDSLINDEQLGDLFVVEGNDHEHGNGEIGHGDVMESKQ

SEQ ID NO: 541 - DNA, 3245 bp, Glycine max
  Predicted polypeptide sequence is orthologous to G214, G680
acactttcgggcgtagtgtgtgtgtagcagtttctggttctgtttttggtttcgtttcagcaaaacctctcttcttcttctgattgattccacctcgcgatttttcgattttcgtttgttttcttctttttcggtttctgatctgaactcgattcgattcgctattgccggaaaatgagtcctccggcaagtgtccggtgatgatcgctccctcgagaggttgttgaggttatcgttgttgttcttcgaagtcatggtttcgatctgaggtgctgtcagtgctcacagcgcgacgctgttgagttgaaatttcgctggttttgagttgctttgtgactaattttttttctcggcaaccaaacaggaggattcaaaatttgcactgattaattagtaaagttttggcgctctcgagttcgttttggtgaggattctgattaaggaaaattttcttttattcattcggaggagaagcgtctcaaactctctctctttctccctcgtagcatcatcatcatcaccataccttgttcagattctgctcactttcaccacaacggctttactatttaccgcgtttcgttttcgtgtcaccgcaaataatgaaaggaggtgttccctgtatccactcctcgtcagggaagatctgaagcagtgctagctgctcacgtcctgtaatggacgcatactcctccggcgaagaagtggttgttaagactagaaaaccatatacaatcactaagcaaagggaacgatggacagaggaggagcataataggtttctagaagctttgaaactacacgggcgagcatggcagcgcatagaagagcatataggaacaaagactgccgtgcaaataaggagtcatgcacagaagttctttacaaagctggagaaagaggcccttgtaaagggtgttccaattggacaggctcttgatatagacattccccctccacggcccaaaagaaagccaaacaatccttatcctcggaagaccaggattggtaccacatcattacatagtggagcaaaggatggaaaactcaatttagttgaatcttcacatgttaatcaagcactggacttgaaaaaagaaccacttccagagaaacatgatttagacgaagggctaacaactgtaaaagaaaataaggatgagaaccacgcaaaagtatttactcttctccaggaggtaccctgttcctctgtatcttcagcaaatgagagttcaataacaatgtctgtgccactgggaaatccatgtgccttcaaggagattacaccttccgtgaaagaggtaatagcacgagatgaaaaaactgaatcttttgtcactgttgaacctgaaaatgggaagttggagatcaatgatggaaaacagactaatggcactagtaaagactccaggttagaggattctgatgctttacatatgaaattggttcaaaatgagaaaccagatggtcttgattgtgaattaacaatagatgggatgcaaggcaatcagaattaccctaggcatgttactgtgcacgttgttgatgggaaccttggaacaaatactcaaaatccatcacaagatatgttgtttcgagattccatgtttcagccaataggaggggttaacgggcaacgaaatgtttttaccaatacagctccatcgaacacaagtgaaagtcaaaataacactgcacgatcttctgttcatcaatcatttcttccttatcctcccttcacacaacacaaccaagacgattaccaatcatttcttcacatgtcttcaacattttcaaatcttattgtctctaccttgatgcaaaacccagcagctcatgctgctgcaagtttcgctgctacattttggccgtatgcaaatccagaaacttcagcaaattctcctaggtgctcccaaggaggttttacaaatagacaaattggttcccctccaagcgttgcagctattgcagctgctactgtagcagctgcaactgcatggtgggcagctcatggattgcttcctttgtgtgctcctcttcatacttcttttgcctgtcctgcatcagtgactacagttccatcaatgaataccggtgaagcaccggctctgaaggcagagcaagaaaaaactactctacaaaatcctcctcttcaagatcagatgctggatccagaatactcggaagctcaacaagctcaacattcagcttcaaagtcaccagctgccattttatcagattctgagagtggagatgccaagttaaatacttcatcaaaggttactgatcatgagacgaacaaaacaatttctgagcaccttgattccaacaaaacaaagggaagaaaaccggttgaccgttcctcatgtggttccaacacggcctctagcagcgatgtggaaactgatgcactagagaagggtgagaaagggaaggaagagcctgaaatacctgatgctaaccaattagccattgagtttagtaatcgtcgtagaagcgttagcaaccttactgattcttggaaagaggtttctgaagaggggagactggcctttcaggctctgttctccagagaggtgttgcctcaaagcttttcacctcctcatgctttgaagaatacggatcatcaaatggacaacgccaatgataacaagcaaaacatagatgacaaagatgaagatcttgacggcaagaaatgcagttctaattatgaagcgatgcagaaaaacctgctatttgtagaaaataacgagggactgttaaccatagggcttggacaaggaaagcttaagactcatcgaacaggttttaaaccctacaaaagatgttccatggaggccaaggaaaatagggttggagcaagcagcaatcaaggtgaagagcaaggttgtaagagaatacgtttggaaggggagacttcgacttgaggtttgatatatgcagtaacataaaggcaacctttggtttttgcatatcatttctttatccctccaacggtgtacctatattgtatgtttatttctaattctgcagctcacgaaacttgtcgtgtagatgtgtgtaccgtattaaattactgtgtacgctcttttactatctttgtatgatgttaatgctgtttaaaactccgctaaatagacttagataagaaacattaagtattgtttgagccatgaacatcaagtaatttatgatccttcattcagccactttccacgttttacatatgaactattttttctttt

SEQ ID NO: 542 - DNA, 614 bp, Glycine max
  Predicted polypeptide sequence is orthologous to G214, G680
gcaaaacctctcttcttctgattgattcacttctcgatttttctgttttcgttttcattttcggtttccgatctaatatcgatgcgattcgccattgccggaaaatgagtcctccggcgagtgtccggtgatgatcgctctcgagagaggctgttgttgttgttcttcttcgacgtcatggttttgttctgagattctgctcactttcaccaaaacggctttactatttaccgcgtttcgctttcgtgtcaccaaaaataatgaaaggaggtgttccctgtatccactccttgtcagggaagatctgaagcagcgctagctgctcacgtcctgtaatggacgcatactcctccggcgaagaagtggttgttaagacgagaaaaccatatacaatcactaagcaaagggaacgatggacagaggaggagcataataggtttcttgaagctttgaaactacacgggcgagcatggcagcgcatagaagagcatataggaacaaagactgccgtgcatatcaggagtcacgcacaaaagttctttacaaagctggagaaagaggccctttgtaagggtgttccaattggaaaggctcttgatttagacattccccct

SEQ ID NO: 543 - DNA, 3130 bp, Glycine max
  Predicted polypeptide sequence is orthologous to G214, G680
gctcgaggcttctgctggctttgttgtagttgaagtcgctcccctcattcttctttcgttgctacttctactgtttcttcctccgatccctcattgccgcaaatgactcctcctgctagtgttaggtgaattccctcgcttcacatgcatgatcgcaccttcaactctcttcttcttcttcttctccatggctttttttcaaggttttggcgccgtggagttcgttttgtagcatcaccgtatcatcagcttcagcttgctttcaccaaaacggctttactatttggtgtgttccatgtcacaaaaaacgaaaggagatattccttttacccactcctcgtcagggaagatctgaagcagcgctagcagcacacgtcctctaatggacgccgactcctctggagaagaagtggttattaaaacaagaaaaccatatactatcacaaagcaaagagaacgatggacagaggaggaacataacagatttctagaagccttgaagctatacgggcgagcatggcagcgcatagaagagcatataggaacaaagactgctgtacaaatcaggagtcatgctcagaaattctttacaaagttggagaaagaggcctttgtaaaaggtgttccaataggacaagctcttgatatagacatcccccctccacggccaaaaagaaaaccaagcaatccttatccccggaagaccaatgttggtgccccaacattacatagcgaagcaaggcatggaaagcctctcatttcaattgtatcttcacttggtaaacaagcactgggcttggagaaagaaccccttccagagaagcatgatgtcgacctaaggccatcgactgtaaaagaaaataaggaccgaagctgctcaaacgtatttaccattatccaagaggcaccctgttcatctgtatcttccgccaacaagaattcaacatcaatattagtgccgctgagaaattcatgtgccctaagggagtttataccttcggtgaaagaggtgataactcgagatgaaaccaacgaatcttttgttactgatgagcttgaaaatcagaagttggagatagatgatggcaagcacactcaaaagtctaatggcacttgtaaagtctctaagtcggagaattctggtgcttcagaattggttcaaactgagaaaacagatggtcgtaattgtgcattaacaattgatggggtgccaggcaatcagaattacccaagacatgtccctgtgcacgttgttgatgggaaccttggaactagtactcaaaatctatccccagatatggtgtttcaagactccatatttcagccgaaaggaggggttaatgggcaacctaaccttgtcaccatttctgctacatcacacataagtgaaagtcaaaacaacaccgcacggtcctctattcatcaatcatttcctccttgtcctcctttcgcacaggatgattatcattcatttcttcacatgtcctccacattttcaagtcttattgtctctaccttgctgcaaaaccctgcagcccatgctgcagcgagttttgctgctacattttggccatatgcaaatgcagaaacttctgcagattctcccgtgtgcactccagattttccatcaagacaaattggctcgcctccaagtgtgacagctattgcagctgctacagtagctgctgcaactgcatggtgggctgcccatggactgcttcctttatgtggtccactccatacagcttttgcctgtcctcctgcatcagcaactacagttccatcaatgattattgatgaatcaccacaaaaaacagaacgaggagagattaaaccacaaaatcctcctctgcaagatcagataccggatccagaacactcggaagctcaacattcagctcctaagtcaccagctgtttcttcatccaaatctgaggataggggagatgccaatttagatacttcaccaaaggctactaatcatgagatgaaccaagcaatttctgagaaccccgattccaacaaaatgaagggcagaaaacctgtagaccgttcctcatgtggttccaacacaacctctagcagtgaagagactgagttactagagaaggatgagaaagaaaaggaagagcccaaaacacctgatgcgaacgttttagataccgagcttagtaatcgtcgaagtagaagcattagcaaccttactgattcttggaaggaggtctctgaagaggggcgtgcttgcctttcaggctctattctccagagaggtgttgccacaaagcttttcacctactcatcatttgataaatgaggataatcagatagacagcatcaaggataacgagctaaacacagactacaaagatgaagaccttgaaagcaagaaatgcagttctatttgtgatggggtgcagaaaaatctgctatttgtcaaagataacaatgaggaggagggactgctaaccataggtcttggaccaggaaagctaaagactcgtcgaacagggtttaaaccttacaaaagatgttcggtagaggccaatgaaaacaggatcggaacagcctgcatccaaggtgaagaaaaaggtcctaagagaatacgcttgaatggggaggcttcaacttgatgcttgatatatccatgcaaccacacaaagaaaatctctagttttgcatatattatttcttagtttccttgttcattgtctgtattgcttattttctaattctgcagctcacgaaacttgtcgtgtaggtgtgtgtaccatattaaattactacattacactctttttactttcttggcctgatgttactgcagttaaaaactccgctaaaatagacttagacaagaaacattaagtaccgtttgagcatttgatcatttaagtaatttatgatgcttcattcagtcaaaaaaaaaaaggaaaaaagggactaattctctctgctggtgccacattctgcactacgtggtatgcagatcaccctcacgactattactgttaacactattgtgctgaacgtggacacgctcgacactatggacgatatgatggagaaaatgcaagacatcgaaggagtccaaccgaagctgcttatgcttgtcttacctgtcgaagatcta

SEQ ID NO: 544 - DNA, 3062 bp, Glycine max
  Predicted polypeptide sequence is orthologous to G214, G680
gtttcgtttcagcaaaacctctcttcttcttctgattgattccacctcgcgatttttcgattttcgtttgttttcttctttttcggtttctgatctgaactcgattcgattcgctattgccggaaaatgagtcctccggcaagtgtccggtgatgatcgctccctcgagaggttgttgaggttatcgttgttgttcttcgaagtcatggtttcgatctgaggttttggcgctctcgagttcgttttgtactgttttacgtgtgacatgtgaattggaatgcttattccagcttatacaaaacagagacggatctctttcctattgtttctcgctttgtttcttttgtttgcaagtagcatcatcatcatcaccataccttgttcagattctgctcactttcaccacaacggctttactatttaccgcgtttcgttttcgtgtcaccgcaaataatgaaaggaggtgttccctgtatccactcctcgtcagggaagatctgaagcagtgctagctgctcacgtcctgtaatggacgcatactcctccggcgaagaagtggttgctaagactagaaaaccatatacaatcactaagcaaagggaacgatggacagaggaggagcataataggtttctagaagctttgaaactacacgggcgaccatggcagcgcatagaagagcatataggaacaaagactgccgtgcaaataaggagtcatgcacagaagttctttacaaagctggagaaagaggcccttgtaaagggtgttccaattggacaggctcttgatatagacattccccctccacggcccaaaagaaagccaaacaatccttatcctcggaagaccaggattggtaccacatcattacatagtggagcaaaggatggaaaactcaatttagttgaatcttcacatgttaatcaagcactggacttgaaaaaagaaccacttccagagaaacatgatttagacgaagggctaacaactgtaaaagaaaataaggatgagaaccacgcaaaagtatttactcttctccaggaggtaccctgttcctctgtatcttcagcaaatgagagttcaataacaatgtctgtgccactgggaaatccatgtgccttcaaggagattacaccttccgtgaaagaggtaatagcacgagatgaaaaaactgaatcttttgtcactgttgaacctgaaaatgggaagttggagatcaatgatggaaaacagactaatggcactagtaaagactccaggttagaggattctgatgctttacatatgaaattggttcaaaatgagaaaccagatggtcttgattgtgaattaacaatagatgggatgcaaggcaatcagaattaccctaggcatgttactgtgcacgttgttgatgggaaccttggaacaaatactcaaaatccatcacaagatatgttgtttcgagattccatgtttcagccaataggaggggttaacgggcaacgaaatgtttttaccaatacagctccatcgaacacaagtgaaagtcaaaataacactgcacgatcttctgttcatcaatcatttcttccttatcctcccttcacacaacacaaccaagacgattaccaatcatttcttcacatgtcttcaacattttcaaatcttattgtctctaccttgatgcaaaacccagcagctcatgctgctgcaagtttcgctgctacattttggccgtatgcaaatccagaaacttcagcaaattctcctaggtgctcccaaggaggttttacaaatagacaaattggttcccctccatgcgttgcagctattgcagctgctactgtagcagctgcaactgcatggtgggcagctcatggattgcttcctttgtgtgctcctcttcatacttcttttgcctgtcctgcatcagtgactacagttccatcaatgaataccggtgaagcaccggctctgaaggcagagcaagaaaaaactactctacaaaatcctcctcttcaagatcagatgctggatccagaatactcggaagctcaacaagctcaacattcagcttcaaagtcaccagctgccattttatcagattctgagagtggagatgccaagttaaatacttcatcaaaggttactgatcatgagacgaacaaaacaatttctgagcaccttgattccaacaaaacaaagggaagaaaaccggttgaccgttcctcatgtggttccaacacggcctctagcagcgatgtggaaactgatgcactagagaagggtgagaaagggaaggaagagcctgaaatacctgatgctaaccaattagccattgagtttagtaatcgtcgtagaagcgttagcaaccttactgattcttggaaagaggtttctgaagaggggagactggcctttcaggctctgttctccagagaggtgttgcctcaaagcttttcacctcctcatgctttgaagaatacggatcatcaaatggacaacgccaatgataacaagcaaaacatagatgacaaagatgaagatcttgacggcaagaaatgcagttctaattatgaagcgatgcagaaaaacctgctatttgtagaaaataacgagggactgttaaccatagggcttggacaaggaaagcttaagactcatcgaacaggttttaaaccctacaaaagatgttccatggaggccaaggaaaatagggttggagcaagcagcaatcaaggtgaagagcaaggttgtaagagaatacgtttggaaggggagacttcgacttgaggtttgatatatgcagtaacataaaggcaacctttggtttttgcatatcatttctttatccctccaacggtgtacctatattgtatgtttatttctaattctgcagctcacgaaacttgtcgtgtagatgtgtgtaccgtattaaattactgtgtacgctcttttactatctttgtatgatgttaatgctgtttaaaactccgctaaatagacttagataagaaacattaagtattgtttgagccatgaacatcaagtaatttatgatccttcattcaaaaaaa

SEQ ID NO: 545 - DNA, 1430 bp, Oryza sativa
  Predicted polypeptide sequence is orthologous to G214, G680
cgtcgaattttggatccacaggaagtgttggatggatgcattgattcatagttccgctggctcctcccatttgatcacttgtttgatcaggatggcttccttcagttccagtggcttgaaagccagtaaccccatttctgtccatttggtagtgtgaagcttttgcagcagaccaatccacatatgttgtctccacagagtttgattttggcttaaattgttggcttgaggtatccaaacagttttcatgagaatgatcaggcttcgagctgatgtgtatcccattgagcctttccatttcttgatcattgatatcttttgcatccttccctgcaccattggaaatagaatccctttccaagatgaccacatctttgacttctgttttagtcggttccagccccctggatgcaccatgatttgaagagcttttgttaactgaagaaaatgatgccgatgggacttctcgaaagagattaagaacttcggagcaacttcctttttcagatatctcctttctttgaagtttctcaagagctgcatcacctgccatttgtgcagtgctattgttcgtcatatttgatattgttgccttatcattttgaacttccctggtggatgtctcagagctgagacaactttttcgaggatatggactgttaggttttctttttggtcgtggtggaggtatgtcgatgtcatgagcttgtcctggagaagtgccattgttgatagcttccttttccaacttggtgaagaacttttgagcatgacttctgatctgcacagctgtctttgtcccaacatgctcttctatgcgctgccaggctctcccatacagtttcaaggcttcaaggaacctgttgtgctctgcctcagtccaacgctccctctgctttgtgattgtgtatggcttcctcacctttaccaccgcttcctcaccagaggaattaatctccattcccaattcaagaaaaagaagaaatataacagaagtgttggcaattggtcgctttgtcagttagagttgaggtcttccacaaacaaaagcactcctccttccatatctccaaccaaacgctggacctgacacaagtagtacctcatacctcctcctagacctctatatcacgccaacactcccagtatttcaaatttgtgcggccaaccacaaaagagcagccaaattagtgttacaaacccaaggtagaacctaaagaattcacaattctacttgtgaattggacttgggtcaaaatcttcaagaggatcaattccactcacctacttgaattgatccaattgcagtcaatctactaaatcctcagctgcagttggtctgtgcacacaaaaaccaagtcagcagagttcacccttgctcctttcgttatcttcaactctagaatcagattaaaactcgcagttctcac

SEQ ID NO: 546 - DNA, 1078 bp, Oryza sativa
  Predicted polypeptide sequence is orthologous to G214, G680
ggcttgaggtatccaaacagttttcatgagaatgatcaggcttcgagctgatgtgtatcccattgagcctttccatttcttgatcattgatatcttttgcatccttccctgcaccattggaaatagaatccctttccaagatgaccacatctttgacttctgttttagtcggttccagcccgctggatgcaccatgatttgaagagcttttgttaactgaagaaaatgatgccgatgggacttctcgaaagagattaagaacttcggagcaacttcctttttcagatatctcctttctttgaagtttctgaatgtaagtgagtttctcaagagctgcatcacctgccatttgtgcagtgctattgttcgtcatatttgatattgttgccttatcattttgaacttccctggtggatgtctcagagctgagacaactttttcgaggatatggactgttaggttttctttttggtcgtggtggaggtatgtcgatgtcatgagcttgtcctggagaagtgccattgttgatagcttccttttccaacttggtgaagaacttttgagcatgacttctgatctgcacagctgtctttgtcccaacatgctcttctatgcgctgcccggctctcccatacagtttcaaggcttcaaggaacctgttgtgctctgcctcagtccaacgctccctctgctttgtgattgtgtatggcttcctcacctttaccaccgcttcctcaccagaggaattaatctccattcccaattcaagaaaaagaagaaatataacagaagtgttggcaattggtcgctttgtcagttagagttgaggtcttccacaaacaaaagcactcctccttccatatctccaaccaaacgctggacctgacacaagtagtacctcatacctcctcctagacctctacttgaattgatccaattgcagtcaatctgaacagtggggccacatcattttaaattcataagcatctccaaatggtcaaactactaaatcctcagctgcagttggtctgtgcacacaaaaaccaagtcagcagagttcacccttgctcctttcgtc

SEQ ID NO: 547 - DNA, 618 bp, Zea mays
  Predicted polypeptide sequence is orthologous to G214, G680
gttgcataatttgaaaacttgcgagttttaatatgattctagagttgaagataaggagtggagctaggtttaaactctggtgacttggttgttgtgtgcaacgaatcaactatgctgagtttttctgtagagtaacagaaattggatcaattcaagtagaggtctaggaggagatatgaggtactacttgcgtcaggtccagcgtttggttggagatatggaaggaggagctctcttgtttatagacgacctcaactccaagtgacaaagcgaacagctgttgaacgtttcccttctatttctgtttctttttgccggatttggagatggagatgaattcctctggcgaggaaactgtggtaaaggtaagaaagccgtacacaataacgaagcagcgggagcggtggacagaggctgaacacaaacggttccttgaagccttgaaactttatggcagagcatggcagcgcatagaagttgctccatagagcatgttgggacaaagacagccgtgcagatcagaagtcacgctcaaaagttcttcactaagttggaaaaggaagctatgaacaatggtacttctccggggcaagcgcatgacattgacatacctccacc

SEQ ID NO: 548 - DNA, 2815 bp, Zea mays
  Predicted polypeptide sequence is orthologous to G214, G680
tctttgggtctgggggcacaaatttgaagtgtgggggagtgctggtgtgatatagaggtctaggaggagatatgaggtactacttgcgtcaggtccagcgtttggttggagatatggaaggaggagctctcttgtttatagacgacctcaactccaagtgacaaagcgaacagctgttgaacgtttgccttctatttctgtttctttttgccggatttggagatggagatgaattcctctggcgaggaaactgtggtaaaggtaagaaagccgtacacaataacgaagcagcgggagcggtggacagaggctgaacacaaacggttccttgaagccttgaaactttatggcagagcatggcagcgcatagaagagagcatgttgggacaaagacagccgtgcagatcagaagtcacgctcaaaagttcttcactaagttggaaaaggaagctatgaacaatggtacttctccggggcaagcccatgacattgacatacctccaccacggcctaaaagaaagccaaacagtccatatcctcgaaaaagttgtctcagctccgagacacaaaccaaagaacttccaaatgacaagtcaacaaaaccaaatatgcccttgagcaatgggcatgtaaaaatggtaggcgatgcatctcttcagaattttcaaaggaaggagttgtctgaaaaaggaagtcgctcggaagttcttaatctcttccgtgatgccccatctgcatcattttcttcagttaacaaaagctcttcaaatcatggggcacccaggaggaccgaggcaagtaaaacagaaagccgagatatgtccatcatggaaaataattcttttaaccccaacacccaagaggatgtaaaggtgatcagtgatcaggaaatggaaaggcttaatggtatccagatcagatctaaatgtgaacattctcatgaggggtatttggacatctcaacgcaacaaatgaagctaatgccaaagtctgtggagacaacatatgtggatgaacaaactgcaagagcttcacacaccctagcagagagcaacgggacagctagcattccagtgactgtacctgaaggaactcatcctgatcaaacaagtgatcaagtgggaatcaatggaagcatgaacccatgcatccatccaatggtttctgcagacccaaaatttggtagtagtgccacaccacagacttttcctcataattatgctgcctttgctccaatgatgcagtgcaactgcaaccaagatacgtacaggtcattcaccaacatgtcatccaccttctccagcatgcttgtttccacgttgttgtcaaaccctgccatccatgcagctgccaggctcgcagcatcatactggccagcagctgaaggtaacactcctattgatccgaatcaagaaaaccctgcagatggcgtccaaggaaggaacataggctctcctccaagcatggcttctattgtagcagctacagttgctgcagcatctgcatggtgggcaacacaaggtcttctccctttcttcgctccacccgtggcttttccatttgtaccagctcctagtgctgcctttcccacagttgatgttccacgaccttcagagaaagacagagattgcccagttgaaaatgcacagaatgaatgccaagaagctcgaaaacaggtacagttcgaaggtttaagagttgctgcttcttcagagtctgatgggagtggaaaaggcgaggtgtctctccatacggagttaaagctatctcctgcccagaatgctgatgccacacctaccacaggagctggcacaaatgatgcattcaggaataagaaaaagcaggatcgctcttcatgcggttctaacacaccttcaagtagtgatgtagatgcgggcaatgttcctgaggaggacaatgctaatgagaaggcgaagcaagcctcctgcagcaactcttcagctggtgacactaaccaccgcagatttagaagcaatggaagcacaagtgattcatggaaggaagtttccgaagagggtcgtctggctttcgatgcgctgttcagtagggaaaagcttccgcaaagcttttctcccccacaagcagtagactcgaaggaggttgccaaggaggaggaagatgaagtgaccacagtggcagttgacctcaacaagaatgccacaagcattgatcatgatgacctcgacacaatggatgagcccagggcttcctttcccaatgaattgtcgcacctgaagctgaaatcgcgccgtacaggcttcaaaccatacaagagatgttctgtggaagcgaaggaaaaccgggtgccgactagcgacatggttggtaccaagaggattcgtcttgatagcgaagcatccacataattgatttcttcaaagttatatttacatctaagctactataggacttcagatcttgcaatgcagtgcttcattaaaactcaatctgttgtgtgctgtattttaatgcttgtcaagcagcccgctagactgctttaaaaccttatctcgtagactctgatttaagcatcatgcaactatcaaacttttttttttggtcaaaatgtattttccttatgttttatatttttggaaaggaaaataattgaaatattatttattttgaaggctcacgcaaaagtttatttgatcaaggtgtaggggaataggctgagcgagagggtgaacattatgactaatatagggcagaaaatatttgaccattgtcatgtttgctgttgctagaagattgtgtagagaaagtactcacataaatgtttcacttctatttt

SEQ ID NO: 549 - DNA, 1038 bp, Zea mays
  Predicted polypeptide sequence is orthologous to G214, G680
  misc_feature (13)..(13): n is a, c, g, or t
  misc_feature (33)..(33): n is a, c, g, or t
  misc_feature (1022)..(1022): n is a, c, g, or t
tcgccgactcggnagtcgcggcgaggagccganaaccttctcattcatcttcctcttccatccatcctgcctgcctgcttgcctccgtattccagctagatctccgggcagccgattggccgagaagtttgtggttgtggcggcggcggagagggaaacggggagcgggagggcggcgcggatgccactgctgcgccggcgccggcggggccggtgatgcccgccgtggcggtcgcttgaggccgccgtgcgtgggaggtggacgggggagcgaggcggtgcggaccgaggttgcgttgggttggattcgattgggctgcgtctgctgagagtaaggacaattggatcaatttaagtaggtctgggcacacaaatttgaactattaacgcattgggagtgcttgtccgtagtaattggatcaattcaagtagaggtctaggaggagctatgaggtactacttccgtcaggtccagcgtttggttggagatatggaaggaggagctctcttgtttatagacgacctcaactccaagtgacaaagcgaacagctgttgaacgtttcccgtctatttctgtttctttttgccggatttggagatggaggtgaattcctctggcgaggaaacggtggtaaaggtaaggaagccgtacacaataaccaagcagcgggagcggtggacagaggctgaacacaaacatggcagagcatggcagcgcatagaagagcatgttgggacaaagacagccgtgcagatcagaagtcacgctcaaaagttcttcactaagttggaaaaggaagctatgaacaatggtacttctccggggcaagcccatgacattgacatacctccaccacggcctaaaagaaagccaaacagtccatatcctcgaaaaagttgtctcagctccgagacacaaaccaaagaacttccaaatgacaagtcaacaaaaccaaatatgcccttgagcaatgggcatgtaaaaatggtaggcgatgcatctcttcagaattttcaaagnaaggagttgtctgaaa

SEQ ID NO: 550 - DNA, 821 bp, Glycine max
  G3450  Predicted polypeptide sequence is orthologous to G226, G682
  misc_feature (804)..(804): n is a, c, g, or t
  misc_feature (806)..(812): n is a, c, g, or t
  misc_feature (815)..(818): n is a, c, g, or t
gaagctcggaatcggtcgaggcagtctctgcacccctccctccttgtttgtatcatatcaggcagctcagaaggcaaagatagatccatgtccaccaccgcaactacaacctctgaagaagttagcagcaatgagtggaaagtcatacacatgagcgagcaagaggaggatctcattcgcaggatgtacaagctagtcggggacaagtggaatttgatagctggtcgcattcccggtcgtaaagcagaagaaatagagagattctggattatgagacacggcgatgctttttctgttaaaagaaacggaagtaaaacccaagactcgtgattttctctggtcatgtatcttttctgggcataattctgctaaatatataaaattgggttaaatatatttttggtgtctataaaatttcttttttttttttggtctctgtgaattattttgtatatttttagtctcttgtttatttttttgttatcaatatcagtttcttaaattttttatacttttttctgccatttttaatctctttgatagactgatatttatgacgaaaaaattaataaatgatttgaaatagtaaaaaaatgaaatttcattagagttaaaaatatatttaaccctataaattctgttctaaatcttacagaattatcgtcaattgtatttcttgtcgttgagatgagaattaatgtacactttcgttaatcggtcatgagtatctcatatagaagctatggaaaagtttgcatgttggtttgtataaaagaaaaaggtgtgactagtcggtcaattgangnnnnnnnagnnnnata

SEQ ID NO: 551 - DNA, 917 bp, Glycine max
  Predicted polypeptide sequence is orthologous to G226
ggcatgcaagaaaagttccgcttgcaaattcaatgctataggccaaggccaagcaagttgtagccacatgacaattgttgaaccattagcaagaagctaaatgaaccagaaatacacatgcacatgcaggtggtctgcattaagtacatactgcccttgacgtacatcaacagatctgaatcatagattgccttaaaacacttgggaacattacaaagataaattaagtagcattatacataagggcttttagaatggcatgcccctttttggttaccctaaaatgcaaatataagtacccatatataataggatcaacttccatttcatatcccgcaaattaagtcactgtataatgagttgcaggcacccaaaattgtcttgcttcgtttaatttctgccacttcattggctagtcgaaaatcttgaagtccaatatttctctatttcttctgcagttcttccaggaattcttccagcaatcaaagaccacctttctccaaccagattatacaccatggcaataaggatttcctcagcttcagaaaattcaacatcagaaacttggcttgatttctctacaaaacacaaatcaattctgtatgtttatgtggataacaacgagtgagccaatcattgaaataaaactgcatagagatcgatcatcattgtgtactctcaagtttgtaggtgcatgttatattataatattatagacccatcaaaaactaatctcaagatatattcttatctagctatcagaattgattattgaagacaaatggattttaaaagggtaccaatagaatcagaagaaacattattatcaaaggagcgatctatgtcagccattgcaataacaagttctcaaaagagctttgaaagtttcagtcttgtatattgaagatgcctggtgc

SEQ ID NO: 552 - DNA, 735 bp, Glycine max
  Predicted polypeptide sequence is orthologous to G226, G682
aaagatgccttacgaatacacttaatgtatgtgtatacatgcaaagaaaaaatccgcttccaaatccaatgctttaggccaaggcaaagcttgttgtaaccattagcaagaaggctaaatgaaccagaaatacacatgcccatgcaggggatctgcattaattaagtacatactgttcttgccatgatcgaacagatctgaatcatagattgcctaaaacacttgggaacattacaaagataaaattaagtaacattaaacataagggcttttaaaatggcatgcccctttttgttggttaccgcaaaatgcaaatataagtccccatatgattaataggatcaatttccatttcatatccccacaaagtcactgtaatgacttgtaggcaccaaaaatttccttgcttcgttttctgccaccgatcattggctagtcgaaaatcttgaagtccaatatttctctatctcttctgcagttcttccaggaattcttccagcaatcaaagaccacctctccccaaccagattatacaccatggcaataaggatttcctcagcttcagaaaattcaacatctgaaacttggcttgatttctcagtagaaacagcagaaacattattatcaaaggagcgatctatgtcagccattgcaataacaagttctcaaaagagctttgaaagtttcagtgttgtatattgcccacgcgacacgcccacgcgtccgcgggcgcgt

SEQ ID NO: 553 - DNA, 728 bp, Glycine max
  G3448  Predicted polypeptide sequence is orthologous to G226, G682
tcgggattcttctctgtttcactccctccctgccacccaatcttcacgagcaaccatgttgtcctagcaatgaccttcttctattaataccacccaaataaccttgtccgggaaaccacttaattctccacgcctccttgcaatggctgactcggatctctcttcaagtcaaatttctacacattctactgattcaggaaatcgagggtcttccaaagttgaattttctgaagatgaggaaaccctcatcatcaggatgtataaactggtaggggagaggtggtctataattgctggaaggattcctggaagaacagcagaggaaatagagaagtattggacttcaagattctcgggctctagtgaatgaagctccggagtactacgattggtgttcagtctaggacgagcaagaagattttgggtgcaagattagtgtgattttgtgggacataaaaactgaattaaagttggcatagtttataggtatttgtattggctataaaaaaagaagtggggcagcaactatagaagctggtttgtgttatatttctccatcttgaaatgttccttggtgtgatattttccatcttgaaatgttccttggtgattggtcttttctgaattgtacttagtgctgttcatcttcgtgtatcttattcatttaccattttggctttttatcttgcgtctgaaatctgtattggaaatgagaattaattagagac

SEQ ID NO: 554 - DNA, 680 bp, Glycine max
  G3449  Predicted polypeptide sequence is orthologous to G226, G682
ttcgggatcgcgcccttaatttttccacgccttcaatacaccacactcttctagctccttgcaatggctgactcggatcgctcttctagtgaagtttctacacattctactgattcagggaagcgagggtcttccaaagttgaattttctgaagatgaggaaactcttatcatcaggatgtataaactggtaggggagaggtggtctttaattgctggaaggattcctggaagaacagcagaggaaatagagaagtattggacttcaagattctcaggttctagtgaatgaggtgccaagagttctactaccattggtggtcagtctaggatgagcaagaagattttgggtgcaagattagtgggattttgtggggcataaaaactggattaaaggtggccctattttatagggatttggatttggattggctataaaaaaaaaaagtggggcagcaactatagaagctgggttggggaatattttccatcctgaaatggtgcccggtgggatattttccatcttggaatggtacttggtgggtgggcttatctgaattggacttattgatggccaccttcgtgtatttttcttattcatttaccattttgggtttttatcttgtgtctgcaatctgtattggaagagtccaactatggaaatgagaattaattagagat

SEQ ID NO: 555 - DNA, 652 bp, Oryza sativa
  Predicted polypeptide sequence is orthologous to G226, G682
gagaaaagttcaaagcattttttcgtctattcacataaaggtttaagacggggtgtatggtgacccaactctgatgtacctttctttacgtttcgatgaagctcaagattcgatgaaccatggtctttcacatttggtgaaattgggcataggtttggactatctctttcgatgttctttaggaatatctcacgtgtgttctttttattttgggagcaatgtcagttagaccacaactattgcaaagtattacaaggtcacccgtggacattatttgtttagcatcaaaactgtcacttcataactgattacatccttctgggaaatgtttccaaacaccaaatttccccttcagtgtactgctcttttgctgttcttccagggattcttccagctataagttcccacctgttcccaacaagcctgtgcattctgaaaacgagatcttcctcttcttccgtgaaatgaacaaaattctgtgcagtgttattaacttcttttgtttcacaaccatcactggttttggaattctttccctggctaccactgctgctatccattaggcgtgaaaaactccaatgaaatgccgagttgagatcttgtgctagctaagatcctcagacccttgttatgaccttatgttttctagggc

SEQ ID NO: 556 - DNA, 895 bp, Zea mays
  G3431  Predicted polypeptide sequence is orthologous to G226, G682
  misc_feature (819)..(819): n is a, c, g, or t
attgggaccattgggtacctcgaggccggccgggaccttgtccagggactcaataggccagtaggcgattacaagggtggaagaaacatctagccttaacattccaggctacagcctaacccctctaatggatagcagcagtggtagccaggacaagaaattcagagacaatgatcgccctgaagcaaaagaagctaatagcaccgcacagcatcttgttgacttcacggaagcagaggaagatcttgtttccagaatgcacaggcttgtggggaacaggtgggagattatagcaggaagaatcccaggaaggacagcagaagaggtagagatgttctggtccaaaaaataccaggaaagatgaaaccgaggccttagatttatatagatgatatatgcaagcatgtgctgataaataatgttaaactgggcctacgatgttaccggtttttcagcctgtgcacatcttgttatgacatgatgctaattttgcaaaagcacagtaagaaaatttacagaacgtcagaaaatatcaatcatgttttagaagatgtgtaacagtatagtatgccttaagaaaagatgaattttgcctcttgcaaaaaaaaaaaaaaaaaagcggccaacttcagtaacgcagcttctcatggaggatgtgagctgttaccagcggtctttagatttctccccggcctgtatggaaaagaaagattcagcatcagaaacaaattcttaactagtcaactaccagcgaaagttgtccacaagtaatttgaggagcatggcgctcacaatggctagcgccctggacatccaggncattaacctatactggtcaggttcgttctttctgaggctttgaccacccggatcgtatatgacatgtgttttgcat

SEQ ID NO: 557 - DNA, 1372 bp, Zea mays
  Predicted polypeptide sequence is orthologous to G226, G682
ccggccgggatcttgtccagggactcaatagatcagtaggcgattacaagggtggaagaaacatctagccttaacgttccaggctactgcctaacccctctaatggatagcagcagtggtagccaggacaagaaattcagagacaatgatcgccctgaagcaaaaggttcaccattttcttgctttgctttgttttgctttacctttgctcgctgcctcttctgaagtctgaacttgtagctttttagttagtaccattgtgttcaagataatagctcatatgactttgttatttcaagagatctcacaccaacatatattctaatcctccgtgctttattttctctccgtcccaaaaagaatacaattctagcacagtgttatgtcatagtatcgtaaatttgatcaattatagataaaaaaagtaccaatatctatgataacaaataaatacgattagattattataagatgtgttttcataataaatttatttggagccataaatctaaatactattcactaaaaacgtgatcaaacatgaaccaatttagccggcatgtaacccatagttgcattctttttgggacagagtgaatacatgaaaactaaaacagatggtaaacagtgaccatttaggatacactataactgacaaaaactgtggggacaaacaggacgccatgtgatttaccatctgaccagcctaatgaagtgcagaggatttagccccttcgaaatagggggaaattattcctaggaaaattgcaaattctcttggcgaacataggattggcaaaccataatatatttctatatgggttggttaatggttttttttttcttactctcgtgatcaactatatcctttcacaattattgcagaagctaatagcaccgcacagcatcttgttgacttcacggaagcagaggaagatcttgtttccagaatgcacaggcttgtggggaacaggtgggagattatagcaggaagaatcccaggaaggacagcagaagaggtagagatgttctggtccaaaaaataccaggaaagatgaaaccgaggccttagatttatatagatgatatatgcaagcatgtgctgataaataatgttaaactgggcctacgatgttaccggtttttcagcctgtgcacatcttgttatgacatgatgctaattttgcaaaagcacagtaagaaaatttacagaacgtcagaaaatatcaatcatgttttagaagatgtgtaacagtatagtatgccttaagaaaagatgaattttgcctcttgcaacttcacttgtgtaccggcagaaaacttcagtaacgcagcttctcatggaggatgtgagctgttaccagcggtcttt

SEQ ID NO: 558 - protein, 107 aa, Oryza sativa
  Orthologous to G226, G682
MESSGGSQLGKNSKTSDGRETKATSSLLLLITAIHFVALCPKGENEDARKEVNSTAQNFVHFTEEEEDIVFRMHRLVGNRWELIAGRIPGRTAEEVEKFWAIKHQAT

SEQ ID NO: 559 - protein, 78 aa, Oryza sativa
  G3393  Orthologous to G226, G682
MDSSSGSQGKNSKTSDGCETKEVNNTAQNFVHFTEEEEDLVFRMHRLVGNRWELIAGRIPGRTAKEVEMFWAVKHQNT

SEQ ID NO: 560 - DNA, 1422 bp, Glycine max
  Predicted polypeptide sequence is orthologous to G241
tacggctgcgagaagacgacagaagggggaagttgaaggggaaagagagaaaagaactagctagctggagtctgagaactctagcatgtactagtactactcctacattcctccatcttcctttgtactattttttttttaaccataaaagcaagagcacaaagatggtgagagctccttgttgtgaaaagatgggtttgaagaagggtccttgggctcccgaggaagatcaaatcctcacatcttacattgacaaacatggtcatggcaattggcgtgccctcccaaagcaagcaggcttgttaaggtgtgggaaaagctgtagactccgctggattaactatttgaggcctgatattaaaagagggaatttcacaattgaagaagaagaaactatcattaagctgcatgacatgctggggaacaggtggtcagcaattgcagccaaattgccaggaagaactgacaatgagattaaaaatgtttggcacaccaatttgaagaagaggctgctgaaatcagaccagtccaagccaagttccaaaagagccactaagccaaaaatcgaacgttctgattccaattccagcatcataactcaatcagaacctgacaattttaatttcagagaaatggacacaataacatcatcagcatgcactacttctagtagtgatttttcatcggtcacggttggtgacagcaaaaatatcaagagtgaagacacagagtctacggaaacaatgcctgtgattgatgagagcttttggtcagaagctgcaattgatgatgaaacccccaccatgtcatcatctcagtctttgacaatctcaaatgagatgcgacttcaatacccttttgctaactatgaggaaactttccagcagggtcatcatgcttatgattcaaactttgatgatggcatggatttctggtatgacatatttaccaggaccaatgattcaatagaattgctagagttctgaagttttcatgtgacacgttgaacgagggcattattgaatttggcagatagagtagtttaaatggcatggtataacttgaatttgaccgttacaacaaaagggtacgataatttctggtgtggggacagcattatcaccagctgcaagatctagaggcataatccattgacaaagaaactagccagggtaatgcgaaaggctaatgaatgatatgtaatgtacacatgtaatcaagtagtgaaacactgactttctttctttttagtggaaaacagcaatgctctaacatttttgtattttacaaattagagtttaattaggctagagttacttgattgtaatatcaataaatgatgtattatgtgaattattcaaaaaaatttatgcccttgttgagctctcttttctaaaaaagaaaaaaaaaaaaaaaaagaaa

SEQ ID NO: 561 - DNA, 1102 bp, Glycine max
  Predicted polypeptide sequence is orthologous to G241
ctcgagccgcaagagagagctagcagtgcaagctttcaacatccaaaacaacagagagtttttggctttagaagctgaaggaatatagttatcacaatggggagagctccatgctgtgagaaaatggggttgaagagagggccatggactccagaagaagatcaaattctcatcaattacatcaacacttatggccatgctaattggcgtgcactgcccaaactagctgggctattaaggtgtggaaagagttgtagactccggtggataaattatctgagaccggacatcaaacggggcaactttaccagagaagaagaggacactataatcagtttgcatgaaatgttgggaaacagatggtcggctattgcggcaaggttgtcagggagaacagacaacgagataaaaaacgtgtggcacacccacttgaagaagaggctgccacaaaattaccaacaaagccatcacactaaaaaacgaagcaaaaaacaaccaccaaagttggatgcggacgcctccaaatccaaccaagacgccaaactagaacaacaagaccccgttaatattcatggatcgaactctgaggacatgatgatgccactatctcctcctcattgttctagcgacatgtcctccttcctcaccaccagtgacaacaataggaacgttaatattattaataataatcatgatatgtccttaaatgttaatgattatgatattgacaccccagagaataatcttgcattggacgaggatttctggtcggaagttttgtcatctgataattccggcgtgacaagcggatttccgacccttgactatgatcagtttcaaccaatgtctcctctagtgacagaagaaggggtccttatagattgttcgtcgagtacgtgcgacgatggcatggatttttggtgcaatgtttactcgagagctgaggaatttacccagttactggaattgtgatgttagctattgttgttgttcttaaatagagaccaagtccttcattcaacatgtcgttgttcttctgctgtttggacttgaattaattcccttgttagaaattaataaatcgtgtacattgatgattgcc

SEQ ID NO: 562 - DNA, 492 bp, Glycine max
  Predicted polypeptide sequence is orthologous to G241
cggctgcgagaagacgacagaagggggaagttgaagcggggaagataaaaagaactagctagcttgctagagtgtgagaactctagcatatactaggggtactacattccttcatcttcctttttatttttcaccataaaaaaacaagagcacaaagatggtgagagctccttgttgtgaaaagatgggtttgaagaagggtccttgggctaccgaggaagatcaaattctcacatcttacatccaaaaacatggccatggcaattggcgtgccctcccaaagcaagcaggccttctaaggtgtgggaaaagctgcagactccgctggattaactatttgaggcctgatatcaagagagggaatttcacaattgaagaagaagaaactatcattaagctgcatgaggatgtgtggaacaggtggtcagcaattgcagccaaattgtcaggaagaactgacaatgagataaaaaatgtttggcacaccaattt

SEQ ID NO: 563 - DNA, 643 bp, Oryza sativa
  Predicted polypeptide sequence is orthologous to G241
ggaattcggcacgaggagcatcagcaacacacacacacaccgagcagtcaatccatcacacacaaacacaaacaaacgcacagggcgcgagagctcgaacgagaggaggaaaggtcggcaatggggagggcgccgtgctgcgagaagatggggctgaagagggggccgtggacggcggaggaggacaggatcctggtggcgcacatcgagcggcacgggcacagcaactggcgcgcgctgccgaggcaggccggccttctccgctgcggcaagagctgccgcctccggtggatcaactacctccgccccgacatcaagcgcggcaacttcacccgcgaggaggaggacgccatcatccacctccacgaccttctcggcaaccgatggtccgcgattgcagcgaggctgccggggaggacggacaacgagatcaagaatgtgtggcacactcacctcaagaagcggctggagccgaagccgtcgtccggccgggaagccgccgcgcccaagcgaaaggcgaccaagaaggctgcggcggtggcggtggcgatcgacgttccgaccaccgtgccggtgtcgccggagcagtcgctctcgaccacgacgacgtcggccgccaccaccgaggagtactcgtactcga

SEQ ID NO: 564 - DNA, 1344 bp, Zea mays
  Predicted polypeptide sequence is orthologous to G241
ccacgcgtccgcccacgcgtccgcccacgcgtccgggacagtgctccctcccgtccccaaagacaaacaggcgagcagcaaacacacacgctcgaaccgagacaagccaatccaataatggggagggctccgtgctgcgagaagatggggctgaagaaggggccatggacgcccgaggaggacaaggtcctggtcgcccacatccagagcttcggccacagcaactggcgcgcgctgcccaagcaagccggcttgctgcggtgcggcaagagctgccggctccggtggatcaactacctgcgcccggacatcaagcgcggcaacttcagcaaggaggaggaggacgccatcatcagcctccacgagcagctcggcaacaggtggtccgccatcgccgccaggctgcccgggcggacggacaacgagatcaagaacgtctggcacacgcacctcaagaagcgcctggatcccaccaagcaggaacagcagcagcagcacgggacgacgccggtggctggcgccggcaagaagcacaggcccgcggcggcggcgaagcgcgggggcggcggagccaggaaggcgacggccgacgccgtcgtcgtcccggccaccgctgcgccggcgtcgcccgaacggtccgcggcctcgtcgtcggtgaccgagtcgtccatgacggagcaggagcaggagcacggcaacacggggagctcgcccgcgttccccaaggaggagagcttcaccacctcctcctcggacgccgaggagttccagttcgacgacagcttctggtccgagacgctgtcgatgccgctggacagcctcgacgacgtcgtccccatggagccctccgacgacgcgttcggcgacgtcgacgtcgacgtggccgccgcctcctcctcgtccgtcggcgccgacggcgacctggactactggctcagagtgttcatggagtccggcgacgcgcacccagaactgccgcagatttagaccgctcgcgcgagaattttcggctcctaattgattcatcgttcttttctctctctctctctctctctgcacgtcttgcatcagaggggacggacaaggacagcatcagctgattaacagagaaggaaatcaggcaggaacaacgcgacacgccgttgcaacttggatcgatcttgtttgccttcttgttgtatagatactagaatccatccaagtctatgcgttctgagaacagaagcacgctgtgctgtgcatgcagattcccatgtatgtacagtagccacggccgccgccagaacagaaatggatccggcctcttccaaattccaaaaaaaaaaaaaaaaaaaaaaaaaaaag

SEQ ID NO: 565 - DNA, 662 bp, Zea mays
  Predicted polypeptide sequence is orthologous to G241
attactccgcggcatcaggcaggcaggctagccgtgctccctcccatctcttctcttctctcctctcccccgaagagtcaaagacacagggagagagaggactcctccgcatctgcatccgcgcacacgaattcgagagggagaggagcgataatggggagggctccgtgctgcgagaagatgggcctcaagaggggcccctggacgccggaggaggacaagatcctggtcgcccacatccacagccacggccacagcaactggcgcgcgctgcctaagcaagccggcctgctgcggtgcggcaagagctgccggctccggtggatcaactacctgcggccggacatcaagcgcggcaacttcaccgacgaggaggagcagtcaatcatccagctgcaccagctgctcggcaacagatggtccgcgattgccgcccggctgccggggaggacggacaacgagatcaagaacgtgtggcacacccacctcaagaagcggctcgaccccagcgcgcaggagcagcaccaggaggccaagaagcgcgagaagccggcggcggcggcgcggaagcgcgagggcaaggtcaagatgaggaagctcgacgcgctgaccgccaaggcggcgcccgtgctgtcctcgcccgagcgctccgtctcgtcacg

SEQ ID NO: 566 - DNA, 1084 bp, Zea mays
  Predicted polypeptide sequence is orthologous to G241
gtgtccacacagcaaaccacccgcgctccgccaatccagagagccagccagcccgagctcacacagcagcgagctcggtcttctcgccaggacacgaacacgaccccagcaggcggcaggcaagccacgctctctcgacggacggacgttaatcgagacatggggcgctctccgtgctgcgagaagatggggctgaagaggggtccgtggacggccgaggaggacaggattctggtggcgcacgtcgagcgccacggccacagcaactggcgcgcgctgcccaagcaggcgggcctgctccgctgcggcaagagctgccgcctccgctggatcaactacctgcgccccgacatcaagcgcggcaacttcagccgggaggaggaggacgccatcatacagctccaccaaatgctcggcaacagatggtcgacaatcgctgccaggctgccggggaggacggacaacgagatcaagaacgtctggcacacccacctcaagaagcgcctggagccacagccagccagccagcaggcgcccaagcgcaagcccacgaagaagcagcagccgcagccggagcccgagcccgtaacgacgctcgaggggccggccggggccgtgccgccggtgtcgccggagcggtcactctccacgacgacgtcgaccaccaccagcaccgcggactactcggccgcctcgtcgctggagaacgcgggcgacagcttcacgtcggaggaggactactaccagatcgacgacagcttctggtccgagacgctggcgatgacgacgacggtggacagcttccagtccggggtgcagcaggcggagggcagcttccgcgcgtcggcggcggcgccgtcgtcgaccaacgacgacatggacttctggctcaagctgttcatgcaggccagcgacatgcagaatttgccccagattatttaggcgggaaacggacctagacggtttgttatctctcggctgatgatgatattctttggcgcgcgctcacgattctttgaatctttgttctgctccgttttcggtggatgtatatatcccactgaaaccttgtgaagcggaaagc

SEQ ID NO: 567 - DNA, 1492 bp, Zea mays
  Predicted polypeptide sequence is orthologous to G241
gggacctcgagccgcccccctttgcttcgcacagcacgaccaggacacagtgctccctccccaaagacaaacaggcgagcagcaaacacacacgctcgaaccgagacaagccaatctaataatggggagggctccgtgctgcgagaagatggggctgaagaaggggccatggacgcccgaggaggacaaggtcctggtcgcccacatccagagcttcggccacagcaactggcgcgcgctgcccaagcaagccgggctgctgcggtgcggcaagagctgccggctccggtggatcaactacctgcgcccggacatcaagcgcggcaacttcagcaaggaggaggaggacgccatcatcagcctccacgagcagctcggcaacaggtggtccgccatcgccgccaggctgcccgggcggacggacaacgagatcaagaacgtctggcacacgcacctcaagaagcgcctggatcccaccaagcaggagcagcagcagcagcacgggacgacgccggcggctggcgccggcaagaagcacaggcccgcagcggcggcgaagcgcgggggcggcggagccaggaaggcgacggccaacgccgacgccgtcgtcgtcccggccccggccccggccaccgctgcgccggcgtctcccgaacggtcggcggcctcgtcgtcggtgaccgagtcgtccatgacggagcaggagcaggagcacggcaacacggggagctcgcccgcgttccccaaggaggagagcctcaccacctcctcctcggacgccgaggagttccagttcgacgacagcttctggtccgagacgctgtcgatgccgctggacagcctcgacgacgtcgtccccatggagccctccgacgacgacgcgttcggcgacgtcgacgtggctgccgcctcctcctcgtccgtcggcgccgacggcgacctggactactggctcagagtgttcatggagtccggcgacgcgcacccagaactgccgcagatttagaccgctcgcgcgagaattttcggctcctaattgattcatcgttcttttgtctctatctctctctgcacgtcttgcatcggaggggacggacaaggacagcagcagctgattaacagagaaggaaatcaggcagaaacaacgcgacacgccgttgcaacttggatcgatcttgtttgccttcttgttgtatagatactagaatccatccaagcctatgcgttctgagaacagaagcacgctgtgctgtgcatgcagattcccatgtatgtacagtagccacggccgccgccagaacagaaatggatccggcctcttccaaattccaattcgttgagttaattcaaacaaaaaaaaaaaaaaaaaaccccaaaaaaaaaaaaaaaaccaaaaaaaaaaaaaaaaaaaaaaaaaaaaaaaaaaaaaaaaaaaaaaaaaaaaaaaaaggggggggcccccgcttaggggcctcgcccccccggttttttt

SEQ ID NO: 568 - DNA, 1352 bp, Zea mays
  Predicted polypeptide sequence is orthologous to G241
cattgggtaccccgcgccccccggacagtgcagtgctccccgaggtccccaaaagacaagcaggcaagcagcaaagacacgcctccctgcttgcactccccacacgcccagtcgcccacacctccaacagacaaagacaatctagcaagcacacacagcatcaggaggaggagatcgagtaggagcagaagcaaagaatggggagagctccgtgctgcgagaagatggggctcaagagggggccatggacgccggaggaggacaagatcctggtcgcgcacatccagagcttcggccacagcaactggcgcgcgctgcccaagcaagccgggctgctgcggtgcggcaagagctgccggctccggtggatcaactacctgcgcccggacatcaagcgcggcaacttcagcaaggaggaggaggacgccatcatcaccctccacgagcagctcggcaacaggtggtccgccatcgccgccaggctgcccgggcggacggacaacgagatcaagaacgtctggcacacgcacctcaagaagcggctggagcccaccaccaagcagctggagcaggagcagcacggggcgcatgcaggtggtgacgccgccaggaagcgcagcaggcccaagcgcgcgggtgccaggacgaagacgacgacggccgccgtcgccccggccaccaccgcgccggcgtcgcctgaacggtcggcggcctcgtcgtcggtgaccgagtcgacggagcaggagcagggaaacacggggacgagctcgcccgggttccccaaggaggagagcttcacctcgtcctcggaggccgccgaggagttccagttcgacgacacgttctggtcggagacgctgtccatgccgctggacagcttcgacgacgtccccacggagccctgcagctccggcgcgttcggcgacgtggccgcctcctcctcctcctcgtccgttggcgccgacgccgacttggactactggctcggagtgttcatgaagtccggcgacgcgcaccaacaactgccgcaggtttagagcgcgcacgcgcgcccgagaattttcagttccctggctaattgattcatcgttctttctctctccctgcacgtcttgcaatcggaattcggaggggacagtcacaatagcagctaattaatagaggggtgtgtgtgttgaggaccacgacgagattaggaagaaacaacgcgacatgccattgcatctatctcttgtttgccttcttgtatataaagatcgatcgatcgacaagatatcggtgatcgaaacctatatatgctacccattttgagaggaattcttctgcacgcgcgcgcccgcctccgcggtgga

SEQ ID NO: 569 - protein, 277 aa, nicotiana tabacum
  Orthologous to G241
MGRAPCCEKMGLKKGPWTPEEDQILISFIQQNGHGNWRALPKQAGLLRCGKSCRLRWTNYLRPDIKRGNFTKEEEDTIIQLHEMLGNRWSAIAAKLPGRTDNEIKNVWHTHLKKKLKDYKPPQNPKRHSKNHDSKGPTTSESSNNSHLTFIYTQKHIIDSSVPAPNSPQISSSTEMSTVTLVDDHQMVIKQEEMESSEYFPEIDESFWTDKLSTDNNWSNTHDHVMVTADQELQVQLPFSSLKEENVDMLTTKMEDDMDFWYNVFIKTDDLPELPEF

SEQ ID NO: 570 - DNA, 694 bp, Glycine max
  Predicted polypeptide sequence is orthologous to G254
tttgagagggcgagcaaatcgaaagacaagagtcacagcgcacccccaaacagaaacagagttattgggagcacgaaacactaactgattcgattcgattgaggttacaaaacactaaactgattcgattcgattcgattgaggtttcggtttggtcttgatggtgtcggtgaacccaagccctgctcaaggcttctacttcttcgatccctccaacatggtccttcccggcgtcaacaatcttccaccgcccccgccgcctgctccgccttctcacgccgccgtggaggatccgagtaagaagatcaggaaaccctacacgattaccaagtccagggagagctggactgagcaggagcacgacaagtttctagaagctctccaattatttgatcgggactggaaaaagattgaagcatttgttggttcaaaaacagttatccagatacgaagtcatgcacagaagtattttcttaaagttcagaagaagggaacaagtgaacatgtacctcctccccggccaaagagaaaagctgctcgctcataccctcaaaaagctcctaaaactcctactgtatcccaagttatgggcccattgcaatcttcatcttctttcattgaacctgcatacatatatatcccggattcttcatctgcgcttggaactccattactaacatgccttacgtcatct

SEQ ID NO: 571 - DNA, 555 bp, Glycine max
  Predicted polypeptide sequence is orthologous to G256
gaaataaaaagagaagaaagaaaacacgatagtatcatcatatcaccaccacacacatagatagagagaggaaaacgacctatattttttttcctttgagagcttcaggggctaggaaaattagaaggacagccacaagtataaaggcggtgaaataaaagagaaagacaagaaggagacatgggaagaccaccttgttgtgacaaagaaggggtcaagaaagggccttggactcctgaagaagacatcatattggtgtcttatattcaggaacatggtcctggaaattggagggcagttcctgccaaaacagggttgtcaagatgcagcaagagttgcagacttagatggacgaattacctgaggccatgaatcaagcgtggtaacttcacagaacaagaggagaagatgataatccatcttcaagatcttttaggaaacagatgggctgcaatagcttcataccttccacaaagaacagacaatgacataaagaactattggaatacccatttgagaaagaagctgaagaagatgcaagcaggcggtgaaggt

SEQ ID NO: 572 - DNA, 583 bp, Glycine max
  Predicted polypeptide sequence is orthologous to G256
ccaaaagagataaaagaagagagggagatagatattatagctagctagatagagattagaagctatataatatacataaaattgtattatagtgaactaaaagaaaagggtacaagggaagatgggaaggccaccatgttgtgataaagaaggtgtaaagaaaggaccttggactcctgaagaagacatcattttggtgtcttatattcaggaacatggtcctagcaattggaaagctgttcctgccaatactgggttgtcaaggtgcagtaagagttgtagacttagatggactaattacctgagaccaggaatcaaaaggggtaacttcacagaccaagaggagaagatgataatccatcttcaagcacttttagggaacagatgggctgcaatagctgcttacctaccacaaagaacagataatgacataaaaaactattggaacacctatttgaaaaagaagctgaacaaattggaagcaggttctgatcagggacataatattggggtatcagtttctcagccaatgtcaagaggccagtgggaaagaaagcttcgaacagatatgtcgatgggtaaa

SEQ ID NO: 573 - DNA, 662 bp, Glycine max
  Predicted polypeptide sequence is orthologous to G256
ggcagaaccttgtctctgcatcatcataattctctcaattgaggagcccaaagggatcaaatctcttcaacccagaagaagaaaaacaaaagagaaattatagaattaagttgctatagctaatagctataactggcttagatataccatttttattttatttttattttggggtgtacaaaatgggaagaccaccttgctgtgataaaattgggattaagaaagggccttggactcctgaggaagacatcatcttggtctcttacattcaagaacatggacccggaaattggagatcggttcccagtaacacaggtttgatgagatgcagcaaaagctgcagactcagatggaccaactatctccgacctggtatcaaacgaggcaatttcaccgatcatgaagagaaaatgataatccacctccaagctcttttgggtaacagatgggctgctataacttcctaccttccacaaaggacagacaatgacataaagaactattggaacacccatttgaagaagaagctgaagaagatgcaaaattggaggtggtaatgagatgataataatgatggacagagaaactcttctaacaattcaccaaattagggttcaatgcgaagaagaacttatacagatttccacatggcaagacatgct

SEQ ID NO: 574 - DNA, 1342 bp, Glycine max
  Predicted polypeptide sequence is orthologous to G256
ccccgcgcccccaccagtccgtaagaagaaaatcatgaaaagagagaaaagaagagagggagatagatatattatagctagctagatagagattagaagctatattattatatacataaagttatattatttatattgaactaaaagaaagggtacaagggaaagatgggaaggccaccatgttgtgataaaggtgtgaagaaaggaccttggactcctgaagaagacatcattttggtgtcttatattcaggaacatggtcctggcaattggaaagctgttcctgccaatactgggttgtcaaggtgcagtaagagttgtagacttagatggactaattacctgaggccaggaatcaaaaggggtaacttcacagaccaagaggagaagatgattatccatcttcaagcacttttagggaacagatgggctgcaatagctgcttacctaccacaaagaacagataatgacataaaaaactattggaacacatatttgaaaaagaagctgaacaaaaaattggaagcaggttctgatcaaggaagcttgttgggaggaggacataataatattgggttttcatcagtttctcaaccaatgtctagaggccagtgggaaagaaggcttcaaacagatattcacatggccaaaaaagcacttagtgaagcactctcaccaaacaaggcatcatcatcatcatcaaccttgttagctgaatcaaattcaaacctctccaatgaaaatagtaccttctataatagtaacactaataaaccaacaacaacacaatctatgtgctatgcttcaagtgctgataacatagctcgtttgttgaaagggtggatgaaaaacacaccaaaatcagcctcatgtgctgcctcggctgtgactcaaaattcctgttcttctagtgaaggaattacaacaacaaagggaagcacaacaagcactagtactgttgaattgtctgagacttttgagtccttgtttggttatgagtctttcgataattactcttcaaattctgagttctcaccatctctttctcctgaggctactcttttccaagatgagggcaagccagatataactacaggattaatagacatgcctttctctttgcttgagaaatggcttctagatgttgatgctggtagtcaagagaaacttggcttctagattattagttcaatttgatatgttttttcttagttacaggagagtaagttaaatctctctctcactttggccctcaacccttcttttggttctagaagtgtatattccaatccaatgttcacattattatatgataaatctataataccactatcctataatt

SEQ ID NO: 575 - DNA, 1671 bp, Glycine max
  Predicted polypeptide sequence is orthologous to G256
catcgcaggatcaactttacatcttagttgcttgttttccagtgtggcatctaacacagtatgataacaataatcataatttcaatagttattaacatatacacgtctagcaccaaaggcttgaaaaacttctctctctaaggccaaagcgaagattaattgatgaggccctacctataacttatgaaataaaataaaaaattccacagtctcatatatgtcacaaaatgaacccaacttagaaaaacttggcatcatcaccacaaccaactaatttctcttggcaaccagcctcatcaagaagccatttctcaagcaaagagaatggcataatttctgcaccaataacatcaggcttgctttcatcttgcaaaacagtggcctcaggagacaatgaccgagagaattcatcagagtttgaagactccaaagactgatcaaaatcaaacaatgattcaaaattgttttcagacaattcagcactgcttggtggtccctttgctccaatactagaagcagtatcagcacctgctgcagcaaagttgttgaaggagttctgagtcacagatgatgagtttgttcttgaggactttggtgggtttttcatccaaccctttagcattctagctatgttgtcagcacttgaggcatagcacacagtttgtgttgttgttggttttgtggaagagaaggagctgctactatctgaagggtttgagtttgaggcagataaattacaagatggcttctctggtgaaagagcttcactgagggctctctttgccatttggatatcagtttggagccttctttcccactggcctctagggatttgccttgaggctgaaaacccttctccaaagctaccaccttcacaacctacttgcatcttcttcagcttctttctcaaatgggtgttccaatagttctttatgtcattgtctgttctctgtggaaggtatgaagctattgcagcccatctgtttcctaaaagatcttgaagatggattatcatcttctcctcttgttctgtgaagttgccccgtttgattcctggcctcaggtaattagtccatctaagtctgcaactcttgctgcatcttgacaaccctgttttggcaggaactgccctccaatttccaggaccatgttcctgaatataagacaccaatatgatgtcttcttcaggagtccaaggccctttcttgaccccttctttgtcacaacaaggtggtcttcccatgtcttcttcttgtctttctcttttatttcaccgcctttatacttgtgtgtccttctaattttccttagccccttcaggtctcaaggaaaaagaatattaagtcgttttcctctctctatctatgtgctgtcggctttctctttttatttctctaaccctctttacttgatagggttctaatcggacgctcggagcctaacctttgcttgatgcacatttatagctaaaaatgaaaggggtaaggatatgtatggtgtggggtgtgatgagaagctgacttaaactagtaaaccaggtagccaagtcaaaagttgacagcaagagcattaactgaaggagtaaggaccaaaattattcacctcatagatacctctctctcgaaaccgcgtgacattcaatgtagctgcactgggaaaagctcaattatc

SEQ ID NO: 576 - DNA, 1537 bp, Glycine max
  Predicted polypeptide sequence is orthologous to G256
cctttttttttttttttttttttttttactttaaaaacaattaattcataaagcaagatctcgtcgcaagatcaactttacataagagaagcaagtttgccagtgtatggcaactaacacagtatgataataatcatcataatgtcaataataattaacatatacacgtctagcaccaaaggctggaaaacttctctctctaataaggccgaagcgagattaattgatgaggccctacctataacttatgaaataaaataaaataaaataaaaaaatcccacaggctcatatgtcacaaaatgaacccaacttagaaaaacttggcatcaccacaacaaccaactaatttctcttggcaacctgcctcatcaaggagccatttctcaagcaaagagaagggcataatttctgcagcaatattaatatcaggcttgctttcatcttgcaaaacagtggcctcaggagacaaggactgagagaattgatcagagtttgaagactccaaagactgatcaaaatcaaacaaggattcaaaattattctcagacaattcggcactgcttagtggtccctttgctccactactacaagcagtatcagcacctgctaagttgttgaatgagttctgagtcatagacgagttggttcttgaggactttggtgggttcttcatcccacccttgagcattctagctatgttgtcagcacttgatgcatagcacacagtttgtgttgttgttggttttgtggaagagatggagctgctcctatctgaagggtttgagtttgtgccagataaattacaagatggctttttctctggtgaaagagcttcactgagggctctctttgccatttggatatcagtttggagccttctttcccactggcctctagggatttgccttgaggctgaaaacccttctccaaagctaccaccttcacaacctacttgcatcttcttcagcttctttctcaaatgggtgttccaatagttctttatgtcattgtctgttctctgtggaaggtatgaagctattgcagcccatctttaacatagccaatgtgatccagttaagttaagcatgtggatccaaaagatagaacttcccaaatcaaaatactcaaaaacagttataaaaaataaatcttcaaaacaaagtttttttcttttttataagctaaaagatttcattagtaacttaattgcttgaattgaacacaaaactccaagtaagtaggtgcttggaagattgacttgtacctgtttcctaaaagatcttgaagatggattatcatcttctcctcttgttctgtgaagttaccacgcttgattcctggcctcaggtaattcgtccatctaagtctgcaactcttgctgcatcttgacaaccctgttttggcaggaactgccctccaatttccaggaccatgttcctgaatataagacaccaatatgatgtcttcttcaggagtccaaggccctttcttgaccccttctttgtcacaacaaggtggtcttccctcgagccgaat

SEQ ID NO: 577 - DNA, 1659 bp, Glycine max
  Predicted polypeptide sequence is orthologous to G256
attcggctcgaggaaggatggtaaaactcattagtttccttccatcaaggtcatggagtatataaagcactcacatgcattggtactatttgcaatacaagctcatctcttgggaagaaattagtttaagccttagctagaaaaaggagagtgagttagtgagttgagaggcagaagaaaagaagaagaaaggtggagtgagtgagtgaatagaaaaaaaaaacccaccatggggaggcctccttgctgtgacaaagttggcatcaagaaaggtccatggacacctgaggaggatattatccttgtctcttacatccaagaacatggtccaggaaattggagatcagtgcctactaatactgggttatcaaggtgcagcaaaagttgcaggcttagatggacaaattacctaaggccaggaatcaagagagggaacttcaccccccatgaggaagggatgataattcatttgcaagctctactgggtaacaaatgggcagccatagcttcctatcttccacaaagaacagacaatgacataaagaattattggaacacacatctaaagaagaagctgaagaaatttcaagcagctttggatcctcactcagcatcagactcaacagccagtggtcaatttctaccaaagagctttagtgacagaagaagtactttagacatcagcagcaacaacaacaataatcatggctcgtccattaggcttagtcatcatcaatctcagtcctcttccacaacaacatatgcctcaagcactgagaatatctcaagactcttggaaggttggatgagatcttccccaaagcaactcaacaagggatcatcaatatcccaagatgatgaagatcttcagctccaaggcatcaatgatgatgatgataataacaacaacaactttgtaagcactactaagctagtgaaccttcatcatcttcatcagcacaaagttagaaacaaagatcagcagcaagagggtggtggtggtggcgtagataataacatggtttctcatcatgaagagttcgattctattttgtcctttgagaaccaaaacaatgctgcttgggacaagtccacttgtgattccatgccagaaaagagttctgaagcttctgctgctgctgatcatcatcatcatcatcatcatgatatagctgctgctcatgagaggaacaatgtcaggcaaaaatctgagaatagtagtggtgctcctccattgtcatttcttgagaagtggctcttggatgaaaacgttggtcatcaagtggaggagatgatggagttgtctccgatgttctaaattaacatggaattgggtcaccaatttaatccctttaagtttgggatgtgacattcaaatgatcatatgatattagtcagatgaaagaagagatcaaaggaatgaaattcttttgaaatctgactagggtttaatccattacaatggtggagagattcacagaagctataagggatctctttcaacttgtaacttggaagtctatgaagaatggtttaattatttcaagtaatactatatgcttagtgcatgttgctctctttgtcttgtagaaaaattacaaattaatgttaacttcagctcaaataataatactacaataacagttatattttcaaaaa

SEQ ID NO: 578 - DNA, 553 bp, Oryza sativa
  Predicted polypeptide sequence is orthologous to G256
gcacgaggctctcactctccaccaccaaactctcctcctctcttgcaacatcaaactcatccatccatccatcgatctgagaaatccagctttccagttcttggatctccatcgaccatggtgaggccgccgtgctgcgacaaggacggcgtcaagaagggcccgtggacgccggaggaggacctcgtcctcgtctcctacgtccaggagcacggccccggcaactggcgcgccgtcccgaccagaacagggctgatgcggtgcagcaagagctgtaggctccggtggaccaactacctgaggcccgggatcaagcggggaaacttcaccgaccaggaggagaagctcatcgtccacctccaggcgctcctcggcaaccgctgggcggccatcgcgtcgtacctccccgagcgcacggacaacgacttcaagaactactggaacacccacctcaagcgcaagctgcagggcggcggcgccggcggtgacggagacggtggcgccgccggcgacgcggtctccccgaagcccgccgcgcagaggcccgcgtcgt

SEQ ID NO: 579 - DNA, 829 bp, Zea mays
  Predicted polypeptide sequence is orthologous to G256
ggaccccttgtcctcaacctcaagccgccacgcaccaccaacacgcgcgcgctggcttcttcaacctcggttgctcgctcgcaacaagacacggatcgtcagagcaagagctctggtgacctgacgattctgctcttgttctcgtacggcgccggtgcctagcgtctgtagcctttttgtgtgtgtgtttttcgcccatatctctccccaccaccaccaccaacctagctcagccgcagttcacccgcgtcaccgcacgagtacacgagcaatccgcaagcgataacctgcaagctgaggggccagctgttttgctcacggagaaagaggttctagctagtcgttcatcaacacggacacaccatggtgaggccgccgtgctgcgacaaggagggcgtcaagaaggggccatggacgccggaggaggacctcgtcctcgtctcctacatccaggagcacggccccggcaactggcgcgccgtcccggccagaaccgggctgatgcggtgcagcaagagctgccgtctgcggtggaccaactacctccggccgggcatcaagcgcggcaacttcaccgagcaggaggagaagctcatcgtgcacctccaggccctcctcggcaacaggtgggcggccatcgcgtcgtacctgccggagcggacggacaacgacatcaagaactactggaacacgcacctcaagcgcaagctgcagagcggcggcgacggggcggccaagccgccggcgcacaggccgccgtcgtcgtccaagggccagtgggagaagaggctgcagacggacatcaacctggcgcgccgcgcgcttcgcg

SEQ ID NO: 580 - DNA, 987 bp, Zea mays
  Predicted polypeptide sequence is orthologous to G256
gaatccccggggattatctagctcagctattcttcccggggatcaaactgtgttgccagcacgtgccagggtgtgtgtagccagccactactgtacaatagctctcttctttctctcgccgtagcttcgctcgtgctgtgcgtgtgtgtatatataagcatcctgcccccactccttttatctctctactcgtctccacgggatcgatcgatcggggcgtggatctctgagcctgagcaagcgggcgagctcaccaaccgccacgctcaagacaggtcgagtagctagctagctgccggagtggaaaaggaggcggtgcagtggcatggggaggccgccgtgctgcgacaagatgggggtgaagaaaggcccgtggacccccgaggaggacctcatgctcggctcctatgtccaggagcacggccccgggaactggcgcgccgtgccgaccaacaccgggctgatgcggtgcaccaagagctgccgattgcggtggacaaactacctccggccgggaatcaagcgcggcaactttaccgagcaggaggagaagctcatcgtccacctccaggctctccttggcaacaggtgggcggccatagcatcctacttgccgaagaggacggccaacgatatcaagaactactgcaccgcgcatcttaagaagaagctgaagaacatgcaggccggcgaagggggcgcgggagggaagcgcccggccgttcccaaggggcagtgggagcggcggctgcagactgacatccacacggcgcggcaggctctgcgcgacgcgctctcgctggagccttcggcagacgccgctggccaaggtggagcctctgccgacggctccggggtgcgcgacgtacgcgtctagcgccgacaacatcgcgcggctgctggaggggtggctgcgcccgggcagcggcaaggggccggaggcgtcgggttcgacgtcgacgacggccacgacgcgccagcggccgc

SEQ ID NO: 581 - DNA, 955 bp, Zea mays
  Predicted polypeptide sequence is orthologous to G256
ccacgcgtccgccacggaatcgatcgatcggtgctttgatctctgagcctgagcaagcggtcgagctcaccaaccgccacgctcaagacaggtcgagtagctagctagctgccggagtggaaaaggaggcggtgcagtggcatggggaggccgccgtgctgcgacaagatgggggtgaagaaaggcccgtggacccccgaggaggacctcatgctcgtctcctatgtccaggagcacggccccgggaactggcgcgccgtgccgaccaacaccgggctgatgcggtgcagcaagagctgccgattgcggtggacaaactacctccggccgggaatcaagcgcggcaactttaccgagcaggaggagaagctcatcgtccacctccaggctctccttggcaacaggtgatggtcactcgcctgtcgtcgtcttaaagcttttgttcccgttttgttttttccgctgtaacaaatggatcggacaaaccaaatcatccacggcacgaggtgatcgtgtgctgagcttgttgatctgcatgccgtgcacttgttgatgtgtcgtgcaggtgggcggccatagcatcctacttgccgaagaggacggacaacgatatcaagaactactggaacacgcatcttaagaagaagctgaagaacatgcagggcggcgaagggggcgcgggagggaagcgcccggccgttcccaaggggcagtgggagcggcggctgcagactgacatccacacggcgcggcaggctctgcgcgacgcgctctcgctggagccttcggcgacgccgctggccaaggtggagcctctgccgacggctccggggtgcgcgacgtacgcgtctagcgccgacaacatcgcgcggctgctggaggggtggctgcgcccgggcagcggcaaggggccggaggcgtcgggttcgacgtcgacgacggccacgacgcgcca

SEQ ID NO: 582 - DNA, 847 bp, Zea mays
  Predicted polypeptide sequence is orthologous to G256
cgtctgcaccgaatcgatcgatcggtgcttttaatctctgagcaagcgatcgagctcaccaacaaccaccgcgctcaagagtagcagccggccggagccgaaaacgacgaggcggtggcatggggaggccgccgtgctgcgacaaggtgggagtgaagaaagggccgtggacccccgaggaggacctcatgctcgtctcctatgtccaggagcacggccccgggaactggcgcgccgtgccgaccaacaccgggctgatgcgctgcagcaagagctgcaggttgcggtggacaaactacctccggccgggaatcaagcgcggcaactttaccgaccaggaggagaagctcatcatccacctccaggctctccttggcaaccggtgggcggcgatagcgtcctacttgccggagaggacggacaacgatatcaagaactactggaacacgcacctcaagaagaagctgaagaagatgcaggccggcgaagggggcgggggagacggcgacggcgcagcaggtgcctcggaaggcggcgccgtcgccaccgcaggcgcgggagggaagcgcccggccgtgcccaaggggcagtgggagcggcggctgcagaccgacatccacacggcgcggcaggctctgcgcgacgcgctctcgctggaaccttcgccttcggcgccgccgccggctaaggtggagcctctgccggcgaccgccccggggtacaagacgtacgcgtctagcgccgagaacatcgcgcggctgctggagggctggctgcgccccggcagcggagggggcaaggggcccgaggcgtcgggctcgacgtcgacgacggccacgacgcagca

SEQ ID NO: 583 - DNA, 1600 bp, Zea mays
  Predicted polypeptide sequence is orthologous to G256
ccggccggacctccggcgcccccctgtcctcaacctcaagccgccacgcaccaccaacacacgcgcgctggcttcttcaacctcggttgctcgctcgcaacaagacacggatcgtcagagcaagagctctggtgacctgacgattctgctcttgttctcgtacggcgccggtgcctagcgtctgtagcctttttgtgtgtgtgttttttcgcccatatctctccccaccaccaccaccaacctagctcagccgcagttcacccgcgtcaccgcacgagtacacgagcaatccgcaagcgataacctgcaagctgaggggccagctgttttgctcacggagaaagaggttctagctagtcgttgatcagcacggacacaccatggtgaggccgccgtgctgcgacaaggagggcgtcaagaaggggccgtggacgccggaggaggacctcgtcctcgtctcctacatccaggaccacggccccggcaactggcgcgccgtccccaccagaaccgggctgatgcggtgcagcaagagctgccggcttcggtggaccaactacctccggccgggcatcaggcgcggcaacttcacggagcaggaggagaagctcatcgtccacctccaggccctcctcggcaacaggtgggcggccatcgcgtcgtacctgccggagcggacggacaatgacgtcaagaactactggaacacgcacctcaagcgcaagctgcaggccggcggcggcgacggcgacggcgacggggcggccaagccgccggcgcacaggccgccgccgtccaactccaaggggcagtgggagaggaggctgcagacggacatcaacctggcgcgccgcgcgctccgcgaggcgctcaccccgctcggcgacctcaagccgcagccgcagccgcagcgcgacggcgctggcgtgggcatcgtcggcggtgacagcccggcggcctcgagcttgtcgtcgcagtgctccccgccgccagcgcctgccgccttggggacgtacgttctcaccgcggacaacgtctcccggatgctggacggatgggccggcttgaacgggaagcgccgcggcggggctccgggcacgcccggcggcgccgagaccgcgtccaccgggtcctcctcggaggtgtcgtacggcggtggcaccgccgtcgtcgcgccggccgctggtggcccggtgttcgagtacgagacgaagccgccggccgcgccgttccagctgatgatgccgctgtctgcgatcgagtcgtggctgttcgacgacgacacccacttccaccgtcctgtccagagcgccagcttgctggacgccgcccccatggattattacctgttgtagctagcgtgtccagcagctgatccagaccaagctaatccgttcaagcaaggaagtcggtggctgattagtcggctagctagctacctgtttctaaagttgttagttttcattatatttagccttttcttttctaggtgggtaaaagttgagtgcgtacttccccttgtgcaagctgcatgttgcatgggaaaataacatatatagctcttgcttgagacccaaaaaaaaattaccacggcggccgc

SEQ ID NO: 584 - DNA, 1632 bp, Zea mays
  Predicted polypeptide sequence is orthologous to G256
gaattcccgggtcgaccctcgcggccgcggacgcgtgggcggacccgtggggccacaactccggccagaagctagctagccaagttattagctagtacatactagtggccggccggacacgatcgatgggcaggccgccgtgctgcgacaaggcgggggtcaagaaggggccatggacgccggaggaggacatcgtcctggtgtcctacgtccaggagcacggccccggcaactggcgcgccgtgcccgtcagcacgggcctcatgcgctgcagcaagagctgccgcctccgctggaccaactacctccgccccggcatccggcgcggcaacttcacaccccacgaggaaggcatcatcgtccacctccaggccttgctaggcaacagatgggcggccattgcttcttacctcccacagagaaccgacaacgacatcaagaactactggaacacccacctcaagaagaagctccggaagcagcaagccatcggcgccatcttcgcgccacctcccccctccgaacccaccgccggccatgccgattgccgtcgtcacgacatggcccgctcctccaaggacagccacgcttgcctggccgacagcacaccagcggctgatgaggtcgtcacccagctcatcgcccagcagttcgccgccaccgacggtgacacctcgtcgtcgtcgtcgtactcgtacgcctccagcacggacaacatctccaagctgctcaacggctttcatgaagagcgcctcgccggcgcgggacgacgctaccgacaccatcaagacttcctcggccattgacatcgaccctttcgaccacaagtccggcggggcactactaccaccacccaagaagcggcagcagcagcagcatctgtcctccatagagaactggttgttcgacgatgccactgagcaggtcgttgtccagctgatggaggagatctccggcggctcatgctcagttcccatgctgctttattagcaccaagaaaaagaagcgaacatgcatgatagccgatcgatagatgtgacttggataggagaatgaatgtgtgcatgggtgcaagttacccagctgataggagaattttatatacacccatgcatgtttagttttatttacacaaccatgagccatgagataagaacaatatatatgcatagtcaatcaaaactcccaagcgagaggcacctcaaagagcgcggaaaaaaaaaaaaaaaaaaaaaagacaacgcctggtccaacaagtcttggtgacctggtccggccttccagatgagttggctacgtgggaggatcaggaagccttgcatcagcgctttccattggctcctgcttggggtcaagccggctttccagggtgagggaatgtcacgagctcatccacaccacacaagccacatgaacctgaagaagcagcaaggagaggagagcgtgtccgtcggacaaatgtgagaattactgggcctgaatgggtgtagtgcgttgaatgggccactgttgggctggctttgtaggattcctgtgtgacccttgtaatgggagatagttaaactctgcagtagccagggagatgaggaagaaagaaatagacactgctcctatctacctcctccttccttc

SEQ ID NO: 585 - DNA, 1377 bp, Lycopersicon esculentum
  G3500  Predicted polypeptide sequence is orthologous to G256
cccaagaaaagaagaattccacaaaacaaggcaaaaaaagggttgtgttccaatgggtagagtcccttgttgtgataaaatgggagtgaagaaagggccatggactcctgaagaagatataatgttagtctcttatgtgcaacaacatggtccaggcaattggagggcacttcccactaaaacagggttgcgtaggtgtagcaagagctgcaggctaagatggacaaactaccttaggccagggataaagaggggtaacttcacagatcaagaagaaaaaatgattatccagcttcaagcacttttaggaaacaaatgggctgcaatagcttcgtatctgccagagagaacagataacgacataaaaaactactggaatactcatctaaagaaaaagatgaaaaggcttgaccaatgtcatggatcaaatgatctattttctttagaaaatgggcttactcacttatcatcttcaaattcatcaacttctaggggacaatgggaaaggacacttcaagctgatattaacatggctaaaaaggctttacataatgctttgtcacttgaaaatccaacaagctcacacaataataatattaaacaagaaaatacacaagtttcttctacttctactatttatgcatcaagtactgaaaatatagctagattgctacaaggatggataggatcaagtacttcttccacaaataattctgaaagttcaaaaacttcatcaaacaacattgcaacaactgattcatcttcatgtgatgggactccaaatgctgaaaccaaaggtggaatggggttgatggaagcatttgagtcactatttggtttggaatcatttgaatcatcaagttcagatgagttgtctcaaacaacaactcctgaggctattaaaattgaaataaagaaggaagaaaatgaacatgatgttgaagtgccactatctattatcttagagaattggttgcttgatgaaaatacactcaatattcaaccaaaaaatgacttgactaccttgatatcttttgatgaaactccacaacttttctacaagtttttttttttgttgattcttttgatggaataattttgaaaaaattgtatgtttttgattgatttccccattgattgtttttattttgatgtggcgattttaacaagtcatgtatatttagccattattattatatttagactatatatagctcaatcaagacttaatctagagtggttttatcatatgactaagttgtatcctttttaaatttcgttttatagatttcaattattgtactaagttagggaattttatatctctttcaatacaaaattttgttttattttaaaaaaaaaaaaaaaaaaaaaaaa

SEQ ID NO: 586 - DNA, 1426 bp, Lycopersicon esculentum
  G3501  Predicted polypeptide sequence is orthologous to G256
tataaacatagctagagaaaaaaaaaaaaaacttcaagaaaatcaaaagtgcttttgttgttgaattaaatcaaagaagatttgtttattttgatttttagaaatgggaaggcctccttgttgtgaaaaaagtggggtgaaaaaagggccatggacaccagaagaagatatcattttggtttcatacattcaagaacatggccctggaaactggagaaatattccaactaatactggtttgctaagatgcagcaaaagttgtagacttcgatggactaattatctccggccagggatcaaacgtggaaacttcactgaacatgaagaaaaaatgatcatccatcttcaagctcttcttggcaatcgatgggcagctatagcttcataccttccgcaaagaacagacaacgatatcaagaattactggaacactcatttgaaaaagaagcttaataacaacaagaaggttgaaggtcatgatgatcatcaagaaggaacttcagcatcatcatcatcatctcaatcaaaaatcataaaaggacagtgggaaaggaggcttcaaactgacattcacactgctaaacaagctctttgtgatgctttgtcacttgatacaactccaaataacaaaaacaacaacaataatccacctcctcatgatcaggatcaacaaccaccatcagttcaaacacctactacctatgcttcaagtgctgaaaacattgctaagttgcttcaaaattggatgaaaaattcacccaaatcgacctcgtctagtagctcgaaaattactcctatgtcatccttgaacaacaatttatcaatcggtgcagtttcaagttctagccctagtgaagggacggtaaatgttactcctggacaaggtttggactctatctttagctttaattcatctaataattcggatgtttcgcaatccgtatcggtcgatgagggtggtaatttcagtacacctgagaatcataataataacaacaacaacaatgctgggatttatcaagttgaaagcaagccaaatttgcctgatttcaagccagaaaatgggaattttcaagaggagagtaagcaaaatatggagacacaacaagtgcctttaactatgctggagaaatggctacttgaggatgctaatgcacaagctgaacaagaagatcagttaatgggaattggaatgggaatgggaatgacctttagctgaaactaatgatttgttttgaagaaaaaaaaaattgtttactagtactcccttcgtttcaatttatctgccttgatttgaccgaacatgaaagtgaagaaaaaaaataagtaaaacggataaattgaagcgcagggagtagtaaatatttcttcaaacaacataggacagtttggggtaagtgggcttttggggtattttaatagttgg

SEQ ID NO: 587 - protein, 307 aa, Oryza sativa
  G3385  Orthologous to G256
MGRPPCCEKEGVKKGPWTPEEDMVLASYVQEHGPGNWRAVPPRTGLLRCSKSCRLRWTNYLRPGIRRGGFSHHEERLILHLQALLGNRWAAIASYLPHRTDNDVKNFWNTHLKKKLALTSSSSSPPTPTTPLVARGQWERKLQTDIDLARRALRDALSVDDAASPAMISSGPPAPAAAAAYALSERNISVMLSGWAAPPPARKGLSACNPAAATTTPGGAAAESASTAGTSLELTADCCSGGGDSSASNCLPSSMLLACDDGDATATAAGVAPLSAIESWLLLDDSGEPQLALDEQLLDVALRNYAF

SEQ ID NO: 588 - protein, 341 aa, Oryza sativa
  G3386  Orthologous to G256
MVRPPCCDKDGVKKGPWTPEEDLVLVSYVQEHGPGNWRAVPTRTGLMRCSKSCRLRWTNYLRPGIKRGNFTDQEEKLIVHLQALLGNRWAAIASYLPERTDNDIKNYWNTHLKRKLQGGGAGGDGDGGAAGDAVSPKPAAQRPASSSKGHWERRLQTDIDMAPRASREALTSLEDVKPPHQPDAANAAAGGGGATTGAAASAGADSPAASSTSGASQCSPSSAGYVLTTENISRMLDGWARKKGGGGGRRAAGSGPATPGATESASGSSEASEVSYGGTALSAAAAPASAFEYETKPTVTAAAAADAGDETQLSAIESWLFADADGIESGSLLDAAMDYTF

SEQ ID NO: 589 - protein, 341 aa, Oryza sativa
  Orthologous to G256
MVRPPCCDKDGVKKGPWTPEEDLVLVSYVQEHGPGNWRAVPTRTGLMRCSKSCRLRWTNYLRPGIKRGNFTDQEEKLIVHLQALLGNRWAAIASYLPERTDNDIKNYWNTHLKRKLQGGGAGGDGDGGAAGDAVSPKPAAQRPASSSKGQWERRLQTDIDMARRALREALTSLDDVKPPHQPDAANAAAGGGGATTGAAASAGADSPAASSTSGASQCSPSSAGYVLTTENISRMLDGWARKKGGGGGRRAAGSGPATPGATESASGSSEASEVSYGGTALSAAAAPASAFEYETKPTVTAAAAADAGDETQLSAIESWLFADADGIESGSLLDAAMDYTF

SEQ ID NO: 590 - protein, 321 aa, Oryza sativa
  G3384  Orthologous to G256
MGRPPCCDKVGVKKGPWTPEEDLMLVSYIQEHGAGNWRAVPTNTGLMRCSKSCRLRWTNYLRPGIKRGNFTEQEEKLIVHLQALLGNRWAAIASYLPERTDNDIKNYWNTHLKKKLKKMQAAEGGEDSGAASEGGGGRGDGDGGGKSVKAAAPKGQWERRLQTDIHTARQALRDALSLDHPDPSPATAAAAATPAGSSAAYASSADNIARLLQGWMRPGGGGGGNGKGPEASGSTSTTATTQQQPQCSGEGAASASASASQSGAAAAATAQTPECSTETSKMATGGGAGGPAPAFSMLESWLLDDGGMGLMDVVPLGDPSF

SEQ ID NO: 591 - protein, 385 aa, Oryza sativa
  Orthologous to G256
MAGGGGSLAVGGGLNGWRGVSGSVGAAGLEEGSGPAWWRGHLTANGSRMKKGGGSRRHAIPTGEAVGGGGAVVGIDGEAAVLREGGGEEGAVDAGGGPMLVAYVQEHGPGNWRAVPTNTGLMRCSKSCRLRWTNYLRPGIKRGNFTDQEEKLIVHLQALLGNRWAAIASYLPERTDNDIKNYWNTHLKKKLKKMSATGGGGDYGEGGGAGEVKTRAAAPKGQWERRLQTDIHTARQALRDALSLDPSPPAKPLDSSSGATAPPSSQAATSYASSAENIARLLEGWMRPGGGGGKTTTTPSSGSRSSAASVLYGEASHSGGATAPTPDGSTVTSKTKDEETAGAPSSSPPPAFSMLESWLLDDGMGHGEVGLMDVVVPLGDPSEFF

SEQ ID NO: 592 - protein, 310 aa, Oryza sativa japonica
  G3502  Orthologous to G256
MGRPPCCVKAEVKKGPWTPEEDLMLVAYVQEHGPGNWRAVPTNTGLMRCSKSCRLRWTNYLRPGIKRGNFTDQEEKLIVHLQALLGNRWAAIASYLPERTDNDIKNYWNTHLKKKLKKMSATGGGGDDGEGGGAGEVKTRAAAPKGQWERRLQTDIHTARQALRDALSLDPSPPAKPLDSSSGATAPPSSQAATSYASSAENIARLLEGWMRPGGGGGKTTTTPSSGSRSSAASVLSGEASHSGGATAPTPDGSTVTSKTKDEETAGAPPPPPPPAFSMLESWLLDDGMGHGEVGLMDVVVPLGDPSEFF

SEQ ID NO: 593 - protein, 347 aa, Lycopersicon esculentum
  G3500  Orthologous to G256
MGRVPCCDKMGVKKGPWTPEEDIMLVSYVQQHGPGNWRALPTKTGLRRCSKSCRLRWTNYLRPGIKRGNFTDQEEKMIIQLQALLGNKWAAIASYLPERTDNDIKNYWNTHLKKKMKRLDQCHGSNDLFSLENGLTHLSSSNSSTSRGQWERTLQADINMAKKALHNALSLENPTSSHNNNIKQENTQVSSTSTIYASSTENIARLLQGWIGSSTSSTNNSESSKTSSNNIATTDSSSCDGTPNAETKGGMGLMEAFESLFGLESFESSSSDELSQTTTPEAIKIEIKKEENEHDVEVPLSIILENWLLDENTLNIQPKNDLTTLISFDETPQLFYKFFFLLILLME

SEQ ID NO: 594 - protein, 371 aa, Lycopersicon esculentum
  G3501  Orthologous to G256
MGRPPCCEKSGVKKGPWTPEEDIILVSYIQEHGPGNWRNIPTNTGLLRCSKSCRLRWTNYLRPGIKRGNFTEHEEKMIIHLQALLGNRWAAIASYLPQRTDNDIKNYWNTHLKKKLNNNKKVEGHDDHQEGTSASSSSSQSKIIKGQWERRLQTDIHTAKQALCDALSLDTTPNNKNNNNNPPPHDQDQQPPSVQTPTTYASSAENIAKLLQNWMKNSPKSTSSSSSKITPMSSLNNNLSIGAVSSSSPSEGTVNVTPGQGLDSIFSFNSSNNSDVSQSVSVDEGGNFSTPENHNNNNNNNAGIYQVESKPNLPDFKPENGNFQEESKQNMETQQVPLTMLEKWLLEDANAQAEQEDQLMGIGMGMGMTFS

SEQ ID NO: 595 - DNA, 633 bp, Oryza sativa
  Predicted polypeptide sequence is orthologous to G278
gcacgaggacacagagcccttgactctgacgatgtagagctagtcaggatgctgctcactgaaggagagacaaatcttgatgatgcgtttgcactgcactacgccgtcgaacattgtgactccaaaattacaaccgagcttttggatctcgcacttgcagatgttaatcatagaaaccctagaggttatactgttcttcacattgctgcgaggcgaagagagcctaaaatcattgtctcccttttaaccaagggggctcggccagcagatgttacattcgatgggagaaaagcggttcaaatctcaaaaagactaacaaaacaaggggattactttggggttaccgaagaaggaaaaccttctccaaaagataggttatgtattgaaatactggagcaagctgaaagaagggacccacaactcggagaagcatcagtttctctttgcaatggcaggtgagagtctacgaggaaggttgctgtatcttgaaaaccgagttgctttggcgaggattatgtttccgatggaagcaagagtagcaatggatattgctcaagtggatggaactttggaatttaacctgggttcttgtgcaaatccaccttcttgaagacaacggacaactgttgatct

SEQ ID NO: 596 - DNA, 1773 bp, Zea mays
  Predicted polypeptide sequence is orthologous to G278
gtcgccgccctgcccaaggcggcctgcctctgcgtcgacgaggacgcctgcgcgcacgtcggctgccgccccgccgtcgccttcatggcgcaggtcctcttcgccgcgtccaccttcgacgtcgccgagctcaccaatctcttccagcggcggctccttgatgtccttgataaggttgaagtggacaacctcccattggtcttatctgttgccaacttatgcagcaaatcttgtgtgaaactgcttgagaggtgccttgatgtagtagttcgttcaaaccttgatatgatttctcttgaaaaaaagttgcctccagatgttgtcaaagaaattgttgatgcaagggtaagccttggattagtttcaccggaagacaagggcttccctaacatacatgtaagaagaatacacagagcactggattctgatgacgtggagctagtccggatgctactcaaggaaggaaaaactaatcttgatgatgcatatgcattacactatgccgtcgaacattgcgactcaaagatcacaacagaacttctggatctcgcgcttgcagatgtcaatcataggaacccaagaggttatacggtccttcacattgctgctatgaggagggaacctaaaatcattgtctctcttttgaccaagggagctcggccatcagacctcacatttgatgacagaaaagcagtgcagatctccaaacgacttacaaagcatggggattactttgggcctactgaggacggaaagccttctcctaaagatagattatgtattgaggtactagagcaagctgaaagaagggacccgcaacttggagaagcatcagtttctcttgcgatagaaggagactctgcgcgtgggaggctactctaccttgaaaaccgagttgctctagcaagaatactgtttcctatggaggcaagggtagcaatggacattgctcaagtcgatggaacactggaattcacccttgtttctagtgtgaatctgcctgccgagatacaacggacagttgacctgaacgatactcctttcacaatgaaggaagaacacctggctcggatgagagccctatccaagacagtggaagtcgggaagcgtttcttcccgcggtgttcgaaggtacttgacacgatcatggacgacgaagccgagatggcttccctcgggcgagacacatccgcggagaagaagaggaggttccatgacctgcaagacctggtccagaaggcattcagcgaggacaaggaggagaacgacaggtccgcggcgcggtcgccttcctcctcgtcgacgacgacgacgtcgatcggggccgtccggcctcggaggtgaaagggaaaacatgcatgggtcctgtttccgtcccgccattttggtagccgatgcggtggccacatagagaccgtaaccgtaatcatgctcacttttgctggcgtatagcattaatgcagaacacgtatactaactaactatataatatacgagtaggtgtagatcggtactggaggttgtaatggcagtagcgaaacatagtgcattctggcgggcgtgtgtgtcgagcaggtagctggctgctcttgattgtaatggcgttttgagcagctaactaggatccctcttcacttcactcgaaaagggtctggcatggcttgtggaattgtggtgtgctgaatagtgtcaggttcagtgtcccaaaccctgaagaaatgcaaacatgtagtgttgccctatctaccaaaagccaaggggaagtgtttgtcc

SEQ ID NO: 597 - protein, 615 aa, Oryza sativa
  Orthologous to G278
MEPPTSHVTNAFSDSDSASVEEGGADADADVEALRRLSDNLAAAFRSPEDFAFLADARIAVPGGGGGGGDLLVHRCVLSARSPFLRGVFARRAAAAAGGGGEDGGERLELRELLGGGGEEVEVGYEALRLVLDYLYSGRVGDLPKAACLCVDEDCAHVGCHPAVAFMAQVLFAASTFQVAELTNLFQRRLLDVLDKVEVDNLLLILSVANLCNKSCMKLLERCLDMVVRSNLDMITLEKSLPPDVIKQIIDARLSLGLISPENKGFPNKHVRRIHRALDSDDVELVRMLLTEGQTNLDDAFALHYAVEHCDSKITTELLDLALADVNHRNPRGYTVLHIAARRREPKIIVSLLTKGARPADVTFDGRKAVQISKRLTKQGDYFGVTEEGKPSPKDRLCIEILEQAERRDPQLGEASVSLAMAGESLRGRLLYLENRGNLHIYHNGFIMLVSLELTVFGLGNKRKFLYDVVALARIMFPMEARVAMDIAQVDGTLEFNLGSGANPPPERQRTTVDLNESPFIMKEEHLARMTALSKTVELGKRFFPRCSNVLDKIMDDETDPVSLGRDTSAEKRKRFHDLQDVLQKAFHEDKEENDRSGLSSSSSSTSIGAIRPRR

SEQ ID NO: 598 - DNA, 2261 bp, Glycine max
  Predicted polypeptide sequence is orthologous to G312
  misc_feature (525)..(525): n is a, c, g, or t
  misc_feature (646)..(646): n is a, c, g, or t
ctctactcctcgcttcaacggttcaatcaatcaactcttcatccgtccctttatacccccccttctgtgtgttgtacatatttatatcgtaacatagctaggctgctttactctagtgctctcctacactcaatgaaatgctgtgacgtgatttgcagaggagaagagggaatggcggcttacatgtgtgcagacagtggcaacctcatggcgattgcgcagcaagtcattaagcagaagcagcagcaagagcagcagcagcagcagcagcagcagcaacagcagcagcaacacttgctacaccaccaacagaaccctctctcccttcacactccaattccatggaacaacactcctcctctcggctaccctctacctcccaccacccatttcccccccgaccccttccaacccgatccccctttccacttccaacccgacccccactccttccgcttctccgacttcgactccgacgactggatggactccctcatcgccgccgccgacaccactgatttcccncttccccccctccgatctcaacccgctccctctccaacccactccccccttcccctccccctccaccggcccagtcccccgtggactccgactccgactcctccgtacatcccctcctcanagccctggccgagtgcgcctccctggccgaaacggagccggatcaggccgcggaatccctaagccgtttgcgaaaatccgtttcccagcacggaaaccccactcagcgagtgggcttttacttctggcaggccctctcccgcagagaagaaaagggccataatagcacttgggatgaggagttaacactctcttacaaagccctgaacgacgcctgcccttactccaagttcgctcacttaaccgccaaccaagccatccttgaagccacccaaaccgcctccaacatccacatcgtcgacttcggtatcgtccaagggattcaatgggccgcactcttgcaagctttcgccactcgtccttctggaaagcccaataagatcagaatctccggaatccccgccgtctcccttggtccctctcccggcccttctctctccgccaccggcaaccgcctctctgacttcgccaggctcctcgacttgaacttcgtgttcacgcccattctcactcccattcaccagctcgaccacaacagcttctgcattgacccaaacgaggtcttggccgttaacttcatgcttcagttgtataacctcttggacgagcctccctccgcggttgacactgcgctcaggttggccaagtctctcaaccctagaattgtcacccttggcgagtatgaagcaagtgtcacacgtgtcgggtttgtcaaccggttcaggactgcgttcaagtacttctctgctgtgtttgagtctctggagcctaatttggccgcggactcgccggagaggtttcaggtggagagtcttcttctcgggcggcgaatcgcggcggtcattggggggcccgggtcggtgaggagggagagtatggaggacaaagagcagtggagggttctgatggagcgtgctggttttgaatcagtgagtctaagccattatgcaattagtcaagctaagatacttctctggaattacagttacagttctctgttttcgctggtggaatctacaccaccggggtttttgtctctggcttggaaggatgttcctctcttgaccgtctcctcttggcgttagttaatgggttcgacttggttgattgttattggaaagggtttccacctggtccttttttccctggtgtggaacaactaattattattattattattattatttgtcgatatgccatggatgatcgatcatgttgtgctatgctagcctcttcaattactgaagttatgcagaagatttgatatgtgaattggctggcactacaagaaattgaggtttttgggagaattgccacctttagcagcagtttggtcctctactagttccacacctccttacttttgtttttttagttgatttttctatttcttatcagcgttttttttttcttctagtggcaatgatgttattattagcttcaagaattggctaggcaaactgtgacaatgaaaatagggagaaatgggatggagaaaagctttctttctcattgcttctagtcattgtgatttgtgactctgtaaattggattttgttgtatggatttaaattggtctgaatgaatgaaatgaatatcaaaggatttttatcttt

SEQ ID NO: 599 - DNA, 1024 bp, Zea mays
  Predicted polypeptide sequence is orthologous to G312
cgcgcttcgcccccgacgagctcacgctctgctacaagacgctcaatgacgcctgcccctactccaagttcgcgcacctcaccgccaaccaggccatcctggaggctacgggcgcggcgaccaagattcacatcgttgacttcgggatcgtgcagggtatccaatgggcggcgctgctgcaggcactcgccactcgcccgggggagaagccatcccgggtacgtatctccggcgtgccttcgccgtacctggggccaaagcctgcggcgtccctcgccgcaaccagtgcccgtctccgcgacttcgccaagcttctcggagtggacttcgagttcgtcccgttgctgccgccggtgcacgagctggatcggtcggatttcttggttgagcctgacgagaccgtagccgtcaatttcatgctccagttgtaccacctccttggcgactccgatgagcccgtgcgacgtgtcctccggctggttaagtcactcgatccatcggtggttacccttggggaatacgaggtcagcctgaaccgggctgggttcgtcgaccggtttgccaatgcactgctgtattacaagccagcgttcgagtcgctggacgtggcgatgccacgggactcaccggagagggtgagggtggagcgatgcatgtttggggagcgcattagaagggccattgggccagaggaaggagcagagaggactgataggatggcggctagtagggagtggcagacgctgatggagtggtgtggctttgagcccgtcagactcagcaactacgccatgagccaggctgatcttttgctttggaattacgattcgaagtacaagtattcgcttgttgagctaccaccagcgttcttgtctctggcttgggagaagcagccgctgctcaccgtgtccgcttggcggtgagtccctttttgtgtgtgtgtattggtgctgttgtatgtagcattgtcataggaccagggaagaaatgaatagactggttttgcattgtcttaaaaaaaaaa

SEQ ID NO: 600 - DNA, 509 bp, Euphorbia esula
  Predicted polypeptide sequence is orthologous to G312
gttaactagttccgaaagcaccagcgaagaatttactctctcttacaaggccttcaacgatgcctgcccttattctaaatttgctcatttaacagcgaatcaagcaatccttgaggctacagagagagcaagcaagattcacatagttgatttcgggatcgttcaaggtgttcaatgggctgctcttttacaagctctggctactcgttctgccggaaaaccagccagtatccggatctctggtataccggctcctgtactaggtaaatctcctgaagcttctctttttgctactggtaataggcttcatgattttgcaaagcttttagatttgaatttcgagtttgagccgattcttactccaattgaggatttgaaagaatcaagttttcgagttgatccagatgaggtattagccgtgaatttcatgcttcaattgtataatttattggacgaaactaatgattctgtagaaactgctttaagagtggctaaatcattggaaccca

SEQ ID NO: 601 - DNA, 2491 bp, Glycine max
  Predicted polypeptide sequence is orthologous to G325
ccacgcgtccggggaatttagaatgcttagaataaatgaatgaataaagttgagttccctctaacagttatgttagagtttagttgagttatcatgaataatcatcagtgacactgtaggagcatggatcctctatgtgagttttgtcgggtggtgagagctgtggtttactgtaagtcagattctgctcgtctctgcttgcattgcgatggctgtgtacactctgcaaattctttgtctcgcaggcattcgcgttccctcctatgcgataagtgcaattcccagccggcaatgatccgctgcatgaatcataagttgtcattatgtcaaggttgtgactggaatccaaatgactgttctgcattgggacataggcgccttgcattgaattgctacactggttgcccctctttggctgagttttctaggctctggtcttttgtgtttgatgctaattcctcacttggtggttgggaatcggttggtactttgccaaaaagtgagagctgcactagccagtgtttggagcaaactgatcataatggtggttattttggtttggtgagtgacaagttggatgaaattgaatcttgtgtcagatatcaacctcggatggatcagtctcaaatcattccatcaaatccaaattacacaccgtactgcaaagacgaagcatttttctttcctcaagactcaaaccagccaaagctgcaggaatgtcctaatctaggaattcatgatgggaatgaactttgtgaaggtttcaatgtggataacgttcaattaaactttgaaattgctgatgaaatattttactgttcacaagttgccacaagataccaccttgaagatggaggaatggactgtttattgatggataaaaacatagcagttacagaatctagttcacttattgagagtgccatggaggcatcatcatctatccaacaagattgtgtggcttttcaatcatcgagggctggtgggtcagctagtgtgatgcaggttatcaacagcaataccaattgtgcacttatgaatcctagctgcactaaaaacatcagtctgggatttcctcagggcctagttcattcaaacatgccacttcaatttcccaacatagttggtgaaaataattctactgaatatcaagactgcgggttatcgcgagtgggtgaatccccctgggaatcaaatttggagggtacatgcccacaagcaagggataaagctaaaatgagatacaatgagaaaaagaaaactcgaacctttggtaagcaaataagatatgcttctcgcaaagcaagggccgatacaagaaaacgtgtgaaaggtagatttgttaaagcaggtgaagcatatgattatgaccctcttgggacaagggacatctaagcatattatctacaataactatcttttccatgaaagatattcttctgactggtaaggtggtccctggaccttgtgagtacattgctttgttgccaattcttcatcaacagacgttttgtttatcttgtgaaagtgggagagttataatgcagctagatatttattcaaaacttgactgcttaggtgattgatacagatctattagagattttaacatatttagaagataacaaagatatgaaggtgttgcaattgggaattgcagaggaagggattggatgtatgccaagataatgcgtttaattatacataggaagtgtgagaggtaacaggcatgggacatagaggagcagaacatttgaacagatttcaaacagcatcacagtcattgtcaattcagacaaaaacagagggcctggatattcctccttgcatttagaggagatgtgcagagtgatccatcctgaatttcaaatgtgatattgtgagtctctgagcctatgtgttctatataaataaacactgcctagtgtaatgaataaaagagaaactggtgtttggcaagcaacaatagccaacctcacactttctgctttcagtttggtccttccgtcctcatggggatccttcacacgaccttattctgtcatcttaagccattgttcaaggacagcaacaccatattttggaacctcttcatttattccattttcatcagattagtgagcacgatcgactgttgattgagatactattgttcttgacttgctggaagccagttttacctgccgcaactattggcatctttgacattgcctcaactatttcatttgttgtattcctctatatttgctttgaggatggcacctatttcttcaataattgtacaaacattgtgtacaaactttcctgatttcaagggacgtttgtttctcctatgaaataggagatattaatgactgttttattgttttgtaatttgcacaaatctgttattattcattaaatttctgtagaatgttgataagaaagaaactacagtctttactgttccgagtaaaaaaaaaaaaaaaaaaaaaaaaaaaaaaaaaaaaag

SEQ ID NO: 602 - DNA, 1110 bp, Glycine max
  Predicted polypeptide sequence is orthologous to G343
caaacaaacacaactctctctatcaacaaaaccaaccaacacaagaaagaaagaaaaacaatggacttgtacggttccttttccaccccttcagattgcttacatattgatgattttctagatttctccaacatcaccaccgacacccaccaccaccttcctcctccgcaaaactctccattaatctcccacgacgacgccaatctcttcttcaatttcccttccgttccgaccgacgaagcggcggagctggagtggctctcccagttcgtggacgacgacgcgacgtcgtttcacagcttcccagcaaccgcatcgattggatcccactcgacgtcgtttctctccaacaataacaacagaaacgataataacgaatatcccaaatcttcattatcttcaaacattccatgttcttcagcggtggcgggaaaatcgagagcgaggagggaagggtcggttaccggcgacggcggcgtgcggcggtgcagccactgtgcctcggagaagacgccgcagtggcgcgcgggaccgctgggaccgaagacgctgtgcaacgcgtgcggggttcggttcaagtcgggtcggctcgtacccgaataccgacccgcggcgagccctacgttcgtgctgactcagcattcgaactcgcaccgcaaggtcatggagctccgtcgccagaaggagctgctccgcctccaacaacagcaacaattactacaagagcaatgccgccgtcacactcacaacctccgcgatttcaaagtttgctgacgtgtcctttgtatccatccatccattattatctaatgaattgctcaataaatgagtgccataaacggtgaagcagagatagcgctatttgtttcttggctgtttatttatgctctctctctgatctcaaattgagtgaagggttgatttttttttttttcttttttatgtcgaggagaagagaagtgcccttcgtgggaaaagggaaaaaaattgtctttactgttacggttttaaagcttcaactgtcatttgctgcattttcactaggagtgattgcaggagatacgttctgaatttgaattaatttgaataaattatttttatatttgagtt

SEQ ID NO: 603 - DNA, 857 bp, Glycine max
  Predicted polypeptide sequence is orthologous to G343
ggacttgtacggttccttttccaccccttcagattgcttacacatcgatgattttctagatttctccaacatcaccaccaccaccaccgacacccaccaccactttcctccgccgcaaaactctccatcaatctcccacgatcccaatttcttcctcaatttcccttccgttccgagcgacgaagcagtggagctggagtggctctcccagttcgtgaacgacgaggcgacgtcgtttcacaacatcccaccacccgcatccattggatcccacacgacgccgtttctttccaacaataacaggaacgataataataacgaatatcccaaatcatcatcatcttcaccggtgttggcgggaaaatcgagagcaagaagggaagggtcggtgaccggcgacggcgtgcggcgctgcagccactgtgcgacggataagaccccgcagtggcgcacgggaccgttggggccgaagacgctctgcaacgcgtgcggcgtgcggttcaagtcgggtcggctcgtacccgaataccgacccgccgcgagccctacgttcgtgatgactcagcactcgaactcgcaccgcaaggttatggagctccgtcgccagaaggagctgctccgccaccagcagcaagaacaatgctaccgtcacactcaccacgacttcaaagtctgctgacgtgtctcttgtctgtccttacttttttctttttttcttcttttgaataaataatcaaattcgaccagtgatgcactaataaattgatctttaaaaataaagaatttaaatgtaataagtataatgaatttatctttgaattttatattttaatgtcaatttttttaaaaataaaaaa

SEQ ID NO: 604 - DNA, 541 bp, Glycine max
  Predicted polypeptide sequence is orthologous to G343
ggttaccggcgacggcggcgtgcggcggtgcagccactgtgcctcggagaagacgccgcagtggcgcgcgggaccgctgggaccgaagacgctgtgcaacgcgtgcggggttcggttcaagtcgggtcggctcgtacccgaataccgacccgcggcgagccccacgttcgtgctgactcagcattcgaactcgcaccgcaaggtcatggagctccgtcgccagaaggagctgctccgccaccaacaacaacaacaattacaacaagagcaatgccaccgtcacactcacaaccaccacgatttcaaagtttgctgacgtgtcctttgtcggtgcttccttcttttataattaatgatgactaatgtcttcagaatattatcagtaaataaaaaaatgatttttttttccatttttactagtttcataaggagaaatgctggtaatctacatcacaatgtttttgccttaaaaaagaaatatcacgaagttttgtaaatctaatttgttatttaatgaattttactcgtaattttttaaaaa

SEQ ID NO: 605 - DNA, 582 bp, Oryza sativa
  Predicted polypeptide sequence is orthologous to G343
tttttggtgttttttttttttttttataccaacagaattgattgatctctctcatagaggaggaagaacttgcaagggaggtaggtaccaacaaattaattaacaaaaaagcattgaaaaatatctggaataaggcaaaaaagagaaaaaaagggagaggaaataaacaagagaaagggagacgggagaatttcgcaaaaggatctaagcccgcgcgtctgtgctgtgcatgcatccatccatgcatgcgatgtgatgcgtagctgcgcctgcatggctcgctctggacgccgcgtgcgccgcttgatcagcacacgccgtagtcgcggaacatgagctccggcctcccggtcgccgcggcggatcccgcggcggcggcggcggcggctgctgctgcggccgcggcggcgtcgcggtggctgccgcggatgatgaggagctccttctggcggcgcagctccatgaccttgcggtgggagttggagtgctgcgtcagcacgaacgtggggctcgccgccggcctgtactccggcatcagccgcccggacttgaacccctcgtgccgaattcctgcagcccggg

SEQ ID NO: 606 - DNA, 1475 bp, Oryza sativa
  Predicted polypeptide sequence is orthologous to G343
ggcacgagggagagagagagagagaactagtctcgagtttttttttttttttttttttttttttggttgttttttttttttttttttttttttttttttttttttttgcaagacaatggtgggataacaaaggtagcaaccacccattggtattaaactgatgatctccaacaactagcagattaatttctcaagttaaaaaacggctagagctaacaaagagttcatgacgcctaactagattctgctttcgttttctcagcatctaaggctgagagcccctaaaagctcaatgcagcagattgagatgtgattatcagctcacttctacgaccaaggagcccgcctaaaattcaatgagacagattaagatgttcttcactatcagcttacttctacaactgaagagttcctaaaactaaacgcaacagatcgagacgttcccgaccaccagttcacttccttgggtgtggaacagaattcctcagctgcatgaccttcttatgagaattggagtgtatgtcactcacaaaagttggactattagcaggcctgtattccggcagcagcctgccagacttgaacctcacaccgcaagcattgcatagcgtcttaggccccaagggaccggtcctccactgtggcgtcttgtaggacaagcaatgggtgcacctcttcattggctcctccgatagcagctcatcattcacataaacagccttcttgatcttcttcttatctcgccgctttcctatgtcctgttctttgtcaatctcttggccatagcgcttcttggaactggtggtgtgcccattcctcgcctcaatcctcagacgacaagcatcgcaggtaggccctgatggaccatcccaccactgtggtgattggctggacaaacaatagctacaagtgatcaccagttgctcctgctggaattgcattcctgcactcattttgtaattctcttcctcctcttgttcttgctcttggacaagttcttcatctttgtccttcttggggaggataagctcactctctgctagccagtccttatgatcgagcaggagtagcggtggctcgacaaacagcgtgatacaatgttggtcatcagtgtcgcttatgacagatgccaggctccttttcttttttcttgcattggtagatgagcgtggtggtaactttggttttgcagcaccttgacttgccattgtaataggcggtagttctgcagagacagggtttgtgcaggatgcagaggttgacaggcagtcctctacatagacagagagccactctatgccacttctatcactttccgtggcgggctggtgcgggaacaactcctccagcgaggaggcggccgcattcggcgggtgcacatccatgcccagcgacgaggaggagcagccgcacggttgaggagagagaaagaggagagagagagagagagagagaagcggaggaagaagaggggt

SEQ ID NO: 607 - protein, 387 aa, Oryza sativa
  Orthologous to G343
MASEWEMAMGVDLGMGMSTYHNASGGIAAAPMMGHHGGGGGGGGYSAAHHHHHHYYGMPHQAAMGDAMRVDDLLDLSNTPGAHDFFPASAAAAAAGDHGHHHHHHIGGMGEPSGATPSATSSDHQTSMLSFADDFYIPTEDAAELEWLSKFVDDSYSDMPNYQSSAHAAMAAAAASAANNGGGSSAGQDSCLTAAPGRGARSKRSRATAAAAAAWHSLVPRPPSQSSPSSSCSSSDFPSSNKPSGTARPNGSGGGSRGKKSPGPAGAEVGMEAGVRRCTHCASEKTPQWRTGPLGPKTLCNACGVRFKSGRLMPEYRPAASPTFVLTQHSNSHRKVMELRRQKELLIIRGSHRDAAAAAAAAAAAAAAGSAAATGRPELMFRDYGVC

SEQ ID NO: 608 - protein, 219 aa, Oryza sativa
  Orthologous to G343
MVGDKDAAALAGELTGDAGASLNGFFDHTGLESAVVGEGQGEGEEEEELEWLSNKDAFPSVDTMAAEVESAAPGAPARAAVGPRTKGLRRRRRVTAPWSLAPLLSRPRQAAAAAADAGAPRRRCTHCAVDETPQWRLGPDGPRTLCNACGVRFKSGRLFPEYRPANSPTFSPLLHSNSHRRVMEMRLQSEEDASAASRVNAKARRAERAAARLAGKDKK

SEQ ID NO: 609 - protein, 309 aa, Oryza sativa
  Orthologous to G343
MDVHPPNAAASSLEELFPHQPATESDRSGIEWLSVYVEDCLSTSASCTNPVSAELPPITMASQGAAKPKLPPRSSTNARKKKRSLASVISDTDDQHCITLFVEPPLLLLDHKDWLAESELILPKKDKDEELVQEQEQEEEENYKMSAGMQFQQEQLVITCSYCLSSQSPQWWDGPSGPTCDACRLRIEARNGHTTSSKKRYGQEIDKEQDIGKRRDKKKIKKAVYVNDELLSEEPMKRCTHCLSYKTPQWRTGPLGPKTLCNACGVRFKSGRLLPEYRPANSPTFVSDIHSNSHKKVMQLRNSVPHPRK

SEQ ID NO: 610 - DNA, 851 bp, Glycine max
  Predicted polypeptide sequence is orthologous to G353, G354
agcggattgaaaatggcttggtttgtgttctgttgcaaatatttttttcagtgactcagaatatcacgatgaagttctaattttgcccaagaaatgagcaatttttcatacagtatgataaacaaatatagacggtagattaaaaaaacaaaacattcacctatctatgatacacaaactataccttcctaagtttaattaacagtacactcaacagatcaatcaatacaaataatcaacaaaagtagttggctttccaatcttcaaaaactccaaatcattctcaaagggtgtcagattcaaatccaaaaccaaaactctcttgttgtcagctttcttcttgggcgatgaatcaaaactgctacccccactactactactcgtagccgtagcagaattgtacacgttgtttccattcaaattcgccgctctgtgcctcctcatgtggcctcccaaggcttgccctatagcaaactccaacccacaaatggaacactcatgagtcttaggctttgggggtgaatcatgaagcaattggccttcgatattatctcctgccatcaacctaggctttttgtggctagccctgtggccaccaagtgcttgaaatgaagggaattgcctattacatgtcttgcactcaaagacacgattgctcatagaagtgcttgagtaggtggcctcaaattcacttccacgagaaagcaacatcaaacaattcgccatggttaagctatcaacctctctttctctcttcatgacaactaaccaaaacaaaaattgaaatatggccgggtgcttggttttaaggtgtggaaaatgaatatgtgaatgtatgaaaagggacaaag

SEQ ID NO: 611 - DNA, 803 bp, Glycine max
  Predicted polypeptide sequence is orthologous to G353, G354
gtcgacccacgcgtccgtacggctgcgagaagacgacagaaggggagggcacttctccaatctcaacaactttcgtgtagtgcactgttttgctatagtaacccattaattaaaccgacctacgtagtagccatgaagagaggcagagaagagagtaagttagacatggctaattgcttgatgctattgacgaaagttggagagagtgaaaccaattacccaatatcaaagggtagtgatattggtgatttcaagtgcaagacttgcaatagaaggttctcttcttttcaagcccttggtggccatagagcaagccacaaaaaaccaaagctcatggtcacagatctttcgtgccatcaagagttaccgaacccaaccatgaaacaacaacctaggatgcacccgtgtccgatttgtgggcttgagtttgctattggacaagctttgggagggcacatgagaaagcatagaactgctattaatgatggcttgttgtgtggtaaaccttcttcttcgttgtccatcttgaaggaatcatcgaaagatggtgatcaaaagttgaatttgcgcttggacttgaacttgacgccattggaggaggatgatcttaagctcaacctaaggacgcccgtgctcaattgtttcatttgattggaaattaattttgtactaaaccagattctttttttcttattaatatagttaatgtgtatttttcgtaatttattattatacgtacgacctataggtagctcattttgtagtcatattgtgttcataatacgaaacttcttagttcttat

SEQ ID NO: 612 - DNA, 924 bp, Glycine max
  Predicted polypeptide sequence is orthologous to G353, G354
tgccgcccccgcggccctgcttccccattagagaacattttaccaattgagcactttcaaacaacgttgttgttttttgtacacaaccatcagagataaggagagtgaggtgggcatggctagttgtttaatgttactaaccaaagttagtgataccgaaaccccatcaagaaagagggttctaagtggtggtgattttaagtgcaagacttgtaacaggaaattccaatcgtttcaagcacttggggggcaccgagccagccacaagaagctaaagctcatggcttcaaacctttcgtgttcgaccgtgacacaaaagatgcaccagtgccccatttgtggaattgaatttgcgattggacaagcactgggagggcacatgagaaaacatagagcttccttaaacgatggtttgataactcatgatcatgttgtgccaacatctattggtactaaaaggcttcgcttgtgcttggacttgaacttggcaccgtacgagaatgatctcaacctcaatttaaggacacctactttaaatttgttcgtttgatcgatttgagtgttttttgggcgaattcttgttggaaattgttttatttttattttttgtttcttactttgccgtgctttttagtttatgacgtacgcgtgattctatagggttctatgtatattcatggtgctaacttgaaagtacagggaaaattttgctgactaccgttaagcaaagcatattaagcatactatcatggctcttttcaggaacatgttttgaaaagtcactttcaatatgaaggattcagttactgttagttgagggtagtaattattggttggatctgttatgatagataccattaactgtgagattaaaaacaaaatagaattgcccacacttatctttgtctaaaaaaaaaaaaaaag

SEQ ID NO: 613 - DNA, 760 bp, Oryza sativa
  Predicted polypeptide sequence is orthologous to G353, G354
ggtcaccctgcggggcccggcgcgggtatcgatctgcccccaaccaaaaatctctctctcaatccattgatccattaattcacaagcttatcgaatcggagatgaagcacccgaggcaggaggaggaggtgtcgctggcgctggcgctgagcacggactgctcgtcgacggcgtcggactcgtcggcggcggcggcgggcggcgcggcgaggaggaagagggcgcggcggaggagcgtggtggcgacgtcgggggaaggggagttcgtgtgcaagacttgcagccgcgcgttcccgaccttccaggcgctcgggggccaccggaccagccacctccgcggccggagcaacgggctcgacctcggcgccatcggcgacaaggcgatcaggctgcacagggcggccgacaaggagcacagggacaagcacgagtgccacatctgcggcctcggcttcgagatgggccaggcgctcggcggacacatgcggcgccaccgcgaggagatggccgccgccggcggtggatcctccgccgacgactgggtctggcgctgcgacgcgcggccggaggggatcgccgccgagccaccggtgttgctggagttgttcgcctagttaccgctggtctccattagtttcgtccaagttttgaactgacgcagtgtgtgtcaccattaattagttcatgtacatggtctagaaaaaaaagtcaggttcattcgatcttgtaactatgaataggggtttaatttttttttttc

SEQ ID NO: 614 - DNA, 568 bp, Zea mays
  Predicted polypeptide sequence is orthologous to G353, G354
ccccgcgtccgccaagtctcaccgccgtctctctcccagtcccaaatcttgagctcgatcgcaaaccctcagacacttcttcccccagccgacgtacatgaagcacccgagagacgccggcgccatgccgctctccctcgcgctgtccctcggcgccggcgtggcccccgggcacggcagcagcaagcggccccggcgcgcggcgggcggcggggacggcgagttggtctgcaagacgtgcagccgcgccttcgtctcgttccaggcgctgggcgggcaccggacaagccacctgagggccggccggcacggccttgcgctcgggatgcccgcgccggcgccggcgaaggaggcgccgccgcccgcgacgacccacctgtgccacgtctgcgggctcggcttccagatgggccaggcgctaggcggccacatgcggcgccaccgcgaggaggctgccgccaccaccgcgcaggcgccgcccgtcctcctccagctcttcgtgtagagttttgcccgtccacggagtctagctagtagaaggaattcttcgcgttccctgtcgtcactc

SEQ ID NO: 615 - DNA, 1503 bp, Zea mays
  Predicted polypeptide sequence is orthologous to G353, G354
acccacgcctccccccacgcccccggcacaaaacacatcaccgcatctttttccttccgagctgtacgtatctgcagagagagagagagagagagagagagagagaaagattaggtcagagaccatgaagcacccgaggccgacggagcaggatgtgtcgctggcgctgtcgctgagcacggactcgtccacgacgacgtccgactcggcggggacgccaccggcgaagcgggcgcgggcgcgggcgcggcggcggggcgccgtggtggccacgtcgggggagggcgagttcgtctgcaggacctgcagccgcgccttcccctcgttccaggcgctgggcggccaccgcaccagccacctgcgcgcgggccgccacggcctcgacctcggcgtcgtcggcgcccgggcgctcaagcagcacaagcagcaggccgccaacgccaacgccaacggctgcgaaggaggcaataagcagcagcggcggcacgagtgcaacgtctgcgggctcggcttcgagatgggccaggcgctgggcggccacatgcggaggcaccgcgaggaggagatgggcgccgccgacgcctgggtcaccctctggcgcaccgaggcgtcgcgcgccgccgacccgcccgtcttgctcgagctcttcgcttagatgattagatcgatccggccggcatcgggtcgggctaatccctccttgttatttggggggaggctaactcgtcatctagacatctagtagcgtcggtagtttaatccaggacatgtaaatcgtattggttcgttcgttgccttttttttgtaattacgctagtatagtactagcttctgctgtgtttagcggttcggtcatggggccggttggattcaaaaaaaaaaaaaaaaaaaaaaaaaaaaaaaaaaaaaaaaaaaaaaaaaaaaaaaaaaaaaaaaaaaaaaaaaaaaaaaaaaatggcaacgaccctttaaaaagatatcagagtttccgtggggcgcccccctctgttctttcccttttccccccccccccccccgtgccgccttctctttttcccttttttgcccccctttttactttttccccccccccgccttttccccccctttgccccgttggccccccctcccccccccccccctttcgcctcttcccccctttcccccccttttcacccgcgctttttaacagcacatgccccccccctgtgctcccttccccccccttttggtcccctttttggtaccgggcccccccccttcccccccccccacccccccccctttttttatagcccccctcccccggtcttttccctttttttcccccccctttgccccccccttttggggttttttcccctccgctttccggccccctgggccccctttttcccgcctatagtttttaagcttgggcgccccctttccgcctacactattttatgggttttgccccccttcccccccccgatacccctggttggtgggatcgcgggtccc

SEQ ID NO: 616 - DNA, 499 bp, Zea mays
  Predicted polypeptide sequence is orthologous to G353, G354
ccacgcgtcccactgcggcctgctgctttcacctccctctccctctcgggctctctcctaacatctcgagctcgatcgcaagccctcaccccctcagacactccttccccaccaccgacatacgtacatgaagcacccgagagacgccggcgccgtgccgctctccctcgcgctgtccctgggcggcggcggtggcgtggccaccaagcacggcatcagcaagaagccccggcgcgcggcgggcggcgagttcgtctgcaagacgtgcagccgcgccttcgggtcgttccaggcgctgggcgggcaccgcaccagccacctgcgggcccgccacggcctcgcgctcggcgtgcccgccgccgcgccggcgaaggaggataccgcgacgaagccggcagcggcggaacccgcgcccgcgagccacctgtgccacgtctgcggcctcggcttcgacatgggccaggcgctcggcggacacatgcgccgccaccgcgaggaa

SEQ ID NO: 617 - DNA, 798 bp, Zea mays
  Predicted polypeptide sequence is orthologous to G353, G354
gtcagcaaacttccgtcgatctctctcgatggtcatgacgcttacgagacacgactcgggagagagcaaggagatggagggcctccgtgcgcactccgaggccgcgctgctcacgctgtcgtcgacgacgacgggcggcaccggcaccggcaccggcaccggcacggccgcggcggcggagggcgcgttcgagtgcaagacgtgcagcaagcggttcccgtcgttccaggcgctgggcgggcaccgcaccagccacacgcggctgcaggcgcggacgctcgtcggcgacccggccgagcggtacgacgacaggccggcggcgcgggtgcacgagtgcgccgtctgcggcctcgagttctccatgggccaggcgctcggcggccacatgcgccgccacaggggcgagggcccgccgccaccggccgcgcacgacgacgacggcgacggccccgcccagccggaccgggacatgcccgacctcaacctgccgccgttggacgacgacgatggcagccaagcaggttcacggcagtcgggcggtggtcgcggctccgggcctcagctgctcaacctgctcgtatagcgtgcgtggcgtgcacagattgtggttcggatcgagatgtaaatgaatcgtggcttagattttggaacctactacacgtgagatggaattcttcgatgacgagcttatttagttccataggttgttcctggttttagttggtttgctccttcgtgtaatgcctattgttcggttcaattcatttgttgtgagtaaaatatactctcacattagac

SEQ ID NO: 618 - DNA, 570 bp, Zea mays
  Predicted polypeptide sequence is orthologous to G353, G354
acaccacctgcgcatcttctttccgagcagtacgtacgtagctgaattgctgaaaagagaggcagagatccgatccggaccgcgaagagacgatgactcacccgaggccggatcatgaaccgtcgggcgaggtgtcgctggcgctggcgctgagcacggactcgtccggctccgcgggtgccccggcggcgaagcgggcgcggcggaggggcgccgcggcggccacgtcgggggagggggagttcgtgtgcaggacctgcagccgcgccttcacctcgttccaggcgctcggcggccaccggaccagccacctgcggggccgccacggcctcgagctcggcgtcggcgccagggcgctcagccggcagcagcacaagcatcatcagcaggccggcggcggcggcggcggcggcggcggcggaggaggaggtggagacagggagccgcaggcgcagcacgagtgccacgtctgtgggctcggcttcgagatggggcaggcgctgggcggacacatgaggcggcaccgcgaggagacgacgacgggcgccgccgacgcctgggtctggggcg

SEQ ID NO: 619 - DNA, 788 bp, Zea mays
  Predicted polypeptide sequence is orthologous to G353, G354
  misc_feature (646)..(646): n is a, c, g, or t
  misc_feature (693)..(693): n is a, c, g, or t
gattcacccgcttccgagaaagaattaatagcactcgatcgatcgggctcaccacgtccagctctcggtcctcgtctttgctgctagcagctagctagcttcgcgatcgtgctcaagatcaacgacgatccatggcgtatggcaagaggtcacgccagaaggccgaggagatggtctggctgcccgacggcgccgatgtcgcgcgcttcctgctgctcttctcgggccaccagcactaccacggcgacggcatggcggcctcggcgcccgagcgggtgttcgagtgcaagacctgcaaccggcagttcccgtccttccaggcgctgggtggccaccgggccagccacaagaagccccgtctctcggacggcgtcgatgccgcagcggccgagccgcccaagcccaaggtgcacggctgctccatttgcggcctcgagttcgccatcggccaggcgctcggcgggcacatgcgccgccaccgggctgccgatcagacagacggcggcagcctcggcaccgggctcaccccgaaatacgacagcggcaagacggccgcatcgccggccgagctggttctggaccttaacgccgtgccggagctggagggggagcaggatcacgccaagctggagctctccatcgaatntcccgtagcagtagttgactttcacgcacgctaagaaataacgtggnaatagattgaatccttctcggtttcatttttccattattatttacataaattacaaaaatacacattaatcaaaaaaaaaaaaaaaaaggcccct

SEQ ID NO: 620 - DNA, 1132 bp, Zea mays
  Predicted polypeptide sequence is orthologous to G353, G354
gtaggccgcgaacctttttcccattatctaaaaaatctatctccaagccatgaactgcaaaagtcagaagaagcagctgagtcagtaacaataacaagtaatcctgatctgattcccagcagaagcttctttctgtccctccaacggaatctgtccatggttcatcaaccatgcgtgctgccgtggcacggcgtcgactcggcgcgaatcgacgccgtctgcacttgcctctgtgcccaatcatcgtcgctactgcacgccgtagctgcgaatcgatccacataaaacaactccgtctccagcctagctaatactaacagctatagagctgagtgactgacacccattggcggctggactattagtttatgcttggcgtttgtaatgctcggcctataaatacgcctgctcagtgatctgatgctccggcattcagatatatacagataagattttcttgctagcctcgaatcgcgatcgagtagctcatcagctgattcacaagtgcaagcatttgatgaagaggtttgcagttcaggagagcgagatggcgcgcatgctggtgctcatgtcgcgctcgcacggccaggaccaggcgctgccactgtcggcctgcctcgccggcggccagcaaggcgaggaccggcaggcgccggagcgcgtgttcgtgtgcaagacgtgcaaccgcgtgttcccgtcgttccaggcgctgggcggccaccgcgccagccacaagaagccgcggctggacggggacggcggcggcgacccctcgctcgccaagcccaagctgcacggctgctccgtctgcggcctcgagttcgccatcggccaggccctcggcggccacatgaggcgccaccgcgccatgacgggcggcgtgccggcggtgccgcccgcgacgacgaggatcgtcgtcgacgagaagccggacggcgacgtcgtcggcatcatccgccacgaccacgtccacgaccacggcggcgtcaagcagccccgcggcgggctgtggctcgacctcaactacccgccgtgcgacgacggccgcgacgcgggggaggcggagtgtggccgcaatgccgccgccgccacggggatcacgttccatcaatttcctcgacactgccaccat

SEQ ID NO: 621 - protein, 198 aa, Oryza sativa
  Orthologous to G353, G354
MKRFAFEDSDMARVLMLMSSHGQQEQALALPVPVQLPLAAARGDRAPERAFVCKTCNRVFPSFQALGGHRASHKKPRLDGDGDLSLSKPKLHGCSICGLEFAIGQALGGHMRRHRAMTGGMPRAIVVDKKPDVVDVHVHGHDDDGGIKRGGLWLDLNHPPCDDAGDDDAECGHNAAGAGITFHQFLDTGAMAVDCVGY

SEQ ID NO: 622 - protein, 187 aa, Oryza sativa
  Orthologous to G353, G354
MSVASPSPSWQTPYRIGDEAPEAGGGGVAGAGAEHGLLVTASDSSAAAAGGAARRKRARRRSVVATSGEGEFVCKTCSRAFPTFQALGGHRTSHLRGRSNGLDLGAIGDKAIRLHRAADKEHRDKHECHICGLGFEMGQALGGHMRRHREEMAAAGGGSSADDWVWRCDARPEGIAAEPPVLLELFA

SEQ ID NO: 623 - protein, 186 aa, Oryza sativa
  Orthologous to G353, G354
MKRLTFGAEPEMVDSASIAQEVMLLLARSGGGGAGYVVGHGGEAPRVFECKTCRRRFPSFQALGGHRASHKRPRGGGGGGAAAAVAAAAGEGEAGVALSLAAGTPAVKASRAHGCAVCGVEFALGQALGGHMRRHRIAGAEADEAVSARGGEPAPERNPREARGVVGLDLNAAPADDTGLLLVDCL

SEQ ID NO: 624 - protein, 206 aa, Oryza sativa
  Orthologous to G353, G354
MSKRQFGEMDGGIDTARVLMLLSRRRRQHGDVGHARAARVFECRTCGRRFPTFQALGGHRASHKRPRHGAERAPRPAGDDDVGAGAGAALRLVGAASSLSTDEARAGGGGRRTRGAGAAHGCPVCGLEFAVGQALGGHMRRHRAAAGDVAAPRVKTDDVVVGDECTGGICLDLNLTPSENCDKCRHAQLGVAVNSVQRTILLDRPL

SEQ ID NO: 625 - protein, 217 aa, Oryza sativa
  Orthologous to G353, G354
MSKRSRSMWDMQEFVGSVDTARVLMLLAQQSQHGLLGGGGFAAGAQPVVVRGGAHDRVFECKTCNRQFPTFQALGGHRASHKRPRQQQQHALGGGAGADDAGLCLGRQPTPPRPQPAKPRVHECPVCGLEFPIGQALGGHMRRHRAEAEAAATTTTTTTKNGDVGKAAAVKACDGGGVCLDLNLTPSENRAKCRNVVGLGAGGQGVHKALAMLDCFL

SEQ ID NO: 626 - protein, 159 aa, Oryza sativa
  Orthologous to G353, G354
MESLRVHASALLSLSSPAASASQPTSSSSTTEGVFECKTCSKRFPSFQALGGHRTSHTRLQAKLLSDPAAAAAAAAERDRARVHECAVCGVEFSMGQALGGHMRRHRGETGTTTVVLADADDSGGATVPQPPEPMPDLNYPPLEDAGDGSEPELLNLLV

SEQ ID NO: 627 - DNA, 1088 bp, Glycine max
  Predicted polypeptide sequence is orthologous to G361, G362
gtactaagtgaaataaataattcgcttgaaaaaataggaagtgaatatgaaaatgtacactatatgaagctgaaacagccatgatatgcctttaaacggcgcgtcaagcctgaacaaagagactactattagactcacagtcacagaatttcaagccgagccgagagatgagggcgcagctggcgcaagactaaggtgcaagtccaagccccatgcatcatcaaatttgggcccactgtcacctttggaaaacctactcaaagagggcccatcaatcctagcgtggtgggcccgggcctgaacctgcaccgttgacaaagctaatgacgaagaatctcctacaacgccaacatagggaaacatcccagcacccgcagatttcacacccgttgttatggtcacgttattactattattactactactgctgctgaagccgttgttgttgctgttgccaggcgccgacgggaacgcacaaccgtgcgacactgacacgtggaagggaggaggcgcggcacgtggtggcacgtacacccacgagggaggtgccgccgggaccaccacggtccccggcggagccagaaggtgcggcggaggggcgaaggcggagatcatcggattccgaacgaacgaaacggcggcgtttcgggaggcctgtaactgcgcccgcttcagctgctgacgctccttcttgtgcgcgttctggtgtccgccaagtgcttgtgaatttgcgaactctcggcagcagtattggcactcgtatttccggtcggcggaggaaggtggtccggcaccggcgacggaggagtccggcgagtcagacggggaagaaggggaagtggaagaagtgaccttggtggtggagtctgccacgtcatcatgcgccacctcgtcttcgtccatgatgtcttcgtggtgtacgctgaaaccgaagagcttcaagcgcgttggggaagtggggtttgtttttttagtgttgtagtcaagttgggtggtttccatgagaaggaaggaaggggtagtagtgaaagtgtggaacaagaaagaagggtagttaatgtgtttcccgagccggatcgggctcgagc

SEQ ID NO: 628 - DNA, 1020 bp, Glycine max
  Predicted polypeptide sequence is orthologous to G361, G362
  misc_feature (935)..(935): n is a, c, g, or t
cccacgcgtccgtacggctgcgagaagacgacagaaggggattgctaaacaaaagaagcatgtctaatcatcatcacgtagttcagacctcgccaccgaaactattcggtttcccactaacagagcaggaggaattgaattcagatgcagaaagaaaatacgaggttggagaggacagaaaattcagatgccactactgcaaacgagtattcggaaactctcaggccttagggggccaccaaaacgcccacaagaaagagcgtcagagggcgaggcgtttccaaatccacactcatagacgctccattgcagcaccatcttctgcttctgttctcaactcacatgcaataataagatcagtaccttcagttacagttactacgctaccctcctccatttacttacgaggaggccctcctactacttcttctcttctacccatcttccatcctcgtcaacccaataacactaagcacttcccatcacggcccattttgattccttcttccacctaccaccgtgctaattgcactccatcctttccttttcagctttatgcctcaccctctgtactgcaatctgctcctaacgtccgtgatttttctgctgagagcagggaagttgatgtccatctcaaattataactcttagattgattattattaatttttttagtgctagtttctagctgcttcagccttctttgctccaaatagatcttatctttttttctcgccccttcagattatgcgagcttgctttaccaattattggctcgaatagttaaacagtactttccagagtaggagctagacactgtagtgtggtaaatcccccagtccttatatttcattttactactatatagccaaaacttgcatgtaaatcagatcagcaaaaaaaaaaaaaaaatgaaacattagcattccctgctnaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 629 - DNA, 676 bp, Glycine max
  Predicted polypeptide sequence is orthologous to G361
tgccactactgctgccgcaacttccccacctcccaagccctcggcggccaccagaacgcccacaaacgcgaacgccagcacgccaaacgcgcgcacctccagtccacgatggtgcagggcagcaccttctccgacgcgcaccatgtctacaatctcatgaactaccgctacggttcttccattccaacaccaccaccaccaacaatgccttatccaacatggaacaacaacaacaacaacacgcgcttctacggaacaacaacaacgacgtcgttttctcaccaccaccaacaccaacaacaacctattaacggaagccccttagcattttggcgaattcctaatggcaccaccattaataataataaccctagtttcagccacgagcgttcttcgacgttgccgcctttgttcgcgactgaggaaatagcgaacgtgagagcctcctcgcaggttgttgtcggagcctcggggccgatgacgacgcaaaaccgctacgtgtatgactcgaaacaacgcgaccatgtgagtttggatcttcatctgtaatagtagtaacatgtttcatgttttcgtacatagtattatcatgagccagtaataacaactctattatgatgatgatgatggcatggcgctacgagagaatcgagggatttgcaggcagcgactcttt

SEQ ID NO: 630 - DNA, 882 bp, Glycine max
  Predicted polypeptide sequence is orthologous to G361, G362
tttttacttattaaataaaatttacattcacatacaattcagagtacaaaggttgctattaacaagtcgatacttttaaggaagattttatgtttgagtacctgaagaaaaaaaatatgaccgagaagagattcactaaagtgacttgtcaggttcaatctttatagcagagacacaccaacaacatggtgataaaaagaaaaaagaaaaaaaaaatagaaaagctgctacacatttggtgctaaattgaatgaaaaaactgattcacaaaactcacaggctaagatgcaaatccaaacctaaccctcgttcacgaccaccaccactaccttcacccccgttgaagccaccgaactgcggcagagggtggcggtgaccatggccatcagtgatggaggcaccagctgctgcaacatagattcgtcttccagaagccacaaaggcagctcctgaatgatatgcaccaccatgtggtgtgcataaccacgacaaaggtggctgagactgtggtgagaagcttgatatgattgtgttgtgaatctgtgaagaaacaaaaccacgagcagcttgcatttgggcacgtttcaagagctgtctttctttcttgtgcgcgttttgatgccctcctagtgcctgtgagtttgcaaattctctgcaacagtactgacactcgtactttcttgaactgaaaggctcagaattcgaacctgcttcatgagtttgatcttctggggacttgctaatgttgatgccaaagagctttaggggttgagtgttagtattggattttgcatggtattcaatttcagccatgatgaattgtgtgagggaaaaagaaaagatgcaccaaaatatgtggttaagtagtaacagcggctcgag

SEQ ID NO: 631 - DNA, 619 bp, Glycine max
  Predicted polypeptide sequence is orthologous to G361, G362
cggttcggaatttccggttttacttacgcgtccgccactcgtccgcccacgcgtccgcactaacagaggaggaggatttgaattcagatgcagaaggaaaatacgaggttggagaggacagaaaattcagatgccactactgcaaacgagtattcggaaactctcaggccttagggggccaccaaaacgcccacaagaaagagcgtcagagggcgaggcgtttccaaatccacactcatagacgctccattgcagcaccatcttctgcttctgttctcaactcacatgcaataataagatcagtaccttcagttacagttactacgctacccttctccatttacttacgaggaggccctcctactacttcttctcttctacccatcttccatccttgtcaacccaataacactaagcacttcccatcacggcccattttgattccttctttcacctaccaccgtactaattggcactcatcctttccttttaaagtttatgccttaccctttgtactgcaatcttgttctaacgtccgtgatttttctgctgagaagcagggaagttgatgtccatcttaaattataactcttaggatgatcattattaaattttttta

SEQ ID NO: 632 - DNA, 463 bp, Oryza sativa
  Predicted polypeptide sequence is orthologous to G361, G362
  misc_feature (439)..(439): n is a, c, g, or t
  misc_feature (452)..(452): n is a, c, g, or t
ccatttctcatcactgagctgagctcagttcagttcagttcatggaagtatatctccttcttggcttcatttgacaacttccaacacaagcagaacaaggtgatcaaatcatcctcaaggcttgtcttttttttccttctctggttatctccaatggaggctcccccttctctttccatcgtcgacgaagacggcttcgtcatcgacctctcgctgacgctgggcctgacatcgcctccgccctctccaggcggcgcgtctccttccattcctccgggaagaggcggcggcggcggcacgagtggtggtgacaacaacagaggcagcagaggtggtggcaatggtggtggtggtggtggtgtgaagctcttcccttgcctcttctgcaacaagaagtttctcaagtcgcaagcgctaaggggacaccagaatgcacacnagaaggagaagancgtcgggtgga

SEQ ID NO: 633 - DNA, 824 bp, Zea mays
  Predicted polypeptide sequence is orthologous to G361, G362
  misc_feature (731)..(731): n is a, c, g, or t
gccggccgggccgggatcagagcagctcgcaccatgccaacataccaccataaacgcaacagcagccgggcagtcgagagaactcctggagccgtgggtgcctgggtggctagctgtaggtcttccttcttgcttccctacacatccgatcccttaccctaggggcacatctcgcgctcttgcgctgcgacggcgaattggcaatgagtgagcaagacgggcagcacgtcgggggcagcccgccggacgcggccatcgagtccttctcacagctccccttcgtgcgccccaagcccccgcagccggcgtcctcgtccagtccgtcgtcgatccggctgttcggcttcgaggtcccacccgacgccgccacgtcctccaccgcaaccagtgacgctaccgccgccagcgccaccgtagcgggccaggcggcggcgtcgggcgcggcgggtgcaggtgcaggtgcaagcgatggcaccggcggagggcgcaagttcgagtgccactactgctgccggaacttcccgacgtcgcaggcgctgggcgggcaccagaacgcgcacaagcgggagcggcagcacgcgaagcgcgcgcagtaccagagcgcgatggccatgcatcacgcccactacccaggccacccccacgcggaccccgccttcactagctaccaccagcagcagcgcttcggcatggcgcgctacgagcccccaccgccgggaccgccgccgcantaacccctcgtggtccccgcaggctgctccgccagtggtgccagatactacgggaggggctgctccctgtcgcagcccatcacggcaccccat

SEQ ID NO: 634 - DNA, 1414 bp, Zea mays
  Predicted polypeptide sequence is orthologous to G361, G362
tacctcgaggccggccgggccttcagctcctcgctctcctcagtccttaccatccatcgatcgcgaaggaagggtgctgaggaggctttcccatgcaccctcgttcctactagccacaccagctatgagacaccccggctacttccttcttggtacgtactggtggcggtactgaaaactactccgcagagatacacgagaagacgtatagttctgtacctagccaagccaagctacctccctcgctcgctccacacctgcctgcatgggcggcggcggcgaaggcagagacagcggcggcggcggcggcgcggcgagctttcgggaggcggctcgtgacttcagcaacgtcgcgtccttctccgagcttccgttcctgcagcgctccgccgccccgccccgtggaagcccccacaactccggcatccgcatcttcggcatcgacgtcccgcactccccaccggagagaaactctaataaagatgccacggccgctactactactaccgccgccgcttccgccacgcagagcagcggcggcggcggggccaccaccgacagcagcagcagcagcagccgcaagttcgagtgccactactgctgcaggaacttcccgacgtcgcaggcgctcgggggccaccagaatgcgcacaaacgcgagcggcagcacgccaagcgcgtgcagatgcagtccgcgatggccgccgccgcagccgcggcggcggcggctggcggcgcgcaccaccaccacctactcggctacccgcagcaccgcttcggcgtcgcaggccccacggtggcgacattgtacccctcgtggccaacaatgaggcctccagctccagcaggcgccggtgccggtgccgtcgccatcggcggcccgcagttctacagcgggatcggctcgatcgcccagccgatcaacgggagccccctcctcacggctgccgggctctggaggggcccgccgccgcctgctgccgggcatgggaacgcgagcttgccgtcgtcaccaggcggagagcgccgccggccggtcgcgctctcgtcctcgtcccccgtgttccgcggagacgatccgagggcttccacttctcttttggcggcggcgtcgtcgccctcctcttcctcctctttgctgctatctccacaaggtcagtttgtctgtgagcagcctgctgccaccactgcggccgagggcgtgagcctagatttgcatctataattgtttccttttggtcgtctatgctgcttttagcggacgacggtggtgtgagcctagattttcacttgaattcagatcgtgccttgtttcctgacacgggtgcacaagaatttcatctatcgaagtttcggaactttttgtctgtgtgcatacacatatacagaaagattcagacaatatgttagggtt

SEQ ID NO: 635 - protein, 242 aa, Oryza sativa
  Orthologous to G361, G362
MAGVVQTVQCDQPSKQQLTEAAEAAAAAAAAASLRIFGYEVGGGGGGGGVAAAAGARREAADVVVGAGRRFECQYCCREFANSQALGGHQNAHKKERQQLKRARLQLAVAAAGTPAGMGFAAAQAPAPPPGHVIAVGHHAGSVASYALPRWVYLAAHHLQPPAVGLPFHATVQAAAGACHGGGDVETRLLSVAAAGRGSSTAGSSAHSYEVCAPAAPADDSDEEASAMGLDLHLSLAPASSA

SEQ ID NO: 636 - protein, 210 aa, Oryza sativa
  Orthologous to G361, G362
MEAPPSLSIVDEDGFVIDLSLTLGLTSPPPSPGGASPSIPPGRGGGGGTSGGDNNRGSRGGGNGGGGGGVRLFPCLFCNKKFLKSQALGGHQNAHKKERSVGWNTHLYLPAGVAAATTTTTTTTAMAVPDMVGMPTHQMSSMALHSCRPHQGSHVTAADIATLAAPPHYTVDHGVAGIASGGGDSSVGWRQRQREAGGEKQRQVDLNLKL

SEQ ID NO: 637 - protein, 267 aa, Oryza sativa
  Orthologous to G361, G362
MSMTSPRLKLFGFDVSEEETAEHEEQYSAEPESAPVCGGNGGGGGGGSDSSSSSTTTTTTATAGGDGRRYECQYCCREFANSQALGGHQNAHKKERQQLKRAQLQAAAAAAGRVAGGAAALYPRANPMVSAFAPTPHLLGGGEAGPTSWVYFSPRAAAVAGGAQGQQFHVSHGCVFPARGAGPAAVAAASPAVFSYTPATSAAAVAAASAPYVTTDEHHGRRIHASSAASLARYPGPAMVVAEPVATVPEDTCLGLDLQLSLAPAGL

SEQ ID NO: 638 - protein, 128 aa, Oryza sativa
  Orthologous to G361, G362
MSMTSPRLKLFGFDVSEEETAEHEEQYSAEPESAPVCGGNGGGGAVGSDSSSSSTTTTTTATAGGDGRRYECQYCCREFANSQALGGHQNAHKKERQQLKRAQLQAAAAAAGRVAGGAAALYPRANPM

SEQ ID NO: 639 - protein, 279 aa, Oryza sativa
  Orthologous to G361, G362
MAKPQDMRSVDSFSQLPFIRPAPPPQQQARDTIRLFGCEFSNDLQLRPTEAGAGSPDAANGSTVTSEGSNGGDGGTKNGGAATAAAERKFECHYCCRNFPTSQALGGHQNAHKRERQHAKRAHLQASLAMHRYMPGHMYGLFNYHHHIGGRFDHHPPPPPPPPPPAHYPMWTSAAPGAFAGPGSMAQPINGSPVQAGLWSVPPPTENFGSTAGRQGADKLATTVAGTPAAGEVACKDEMVPMSLLSSSPSLSSCSSTSPEMLGRCELGQKEGVSLDLHL

SEQ ID NO: 640 - DNA, 3416 bp, Glycine max
  Predicted polypeptide sequence is orthologous to G390, G391, G438
ccacgcgtccggaagaacaaccgctaactgtggttgcactaaaatatactcactctttttctctgtctccattcgtttctctccgctttaacgttgccccagttaagttttcttatgtaaaggcacaccctttacctaattactagtaccaacaccaaacaaccttgcctttttattctctccttcttgtgttacctttgttgtgtagtgagtgagtgaaagcatggctatggttgtggctcaacacagagaaagtagcagcagtggaagcattgacaagcacttagattctggtaagtatgtgaggtatactgctgagcaagttgaggctcttgaaagggtctatgccgagtgccctaagcctagttctctgcggaggcaacaattgatcagagagtgccccattctctccaacatcgagcctaagcaaatcaaggtttggttccagaaccgtaggtgtagggagaagcaaagaaaagaggcatctaggcttcagaccgtgaaccgcaaactcactgcaatgaacaagttgttgatggaggagaatgatcggttgcagaagcaggtgtcacagcttgtttgtgagaatggttttatgaggcagcaattgcatactccatcggcaacaactactgatgctagttgtgattcggtggttaccactcctcagcataccctgagagatgctagtaaccctgctggactcctatcaattgcagaggaaactttgacagagttcctttcaaaggctacaggaactgctgtagattgggtccagatgcctgggatgaagcctggtccggattcggttgggatctttgccatttcacaaagttgcagtggagtggcagctcgagcctgtggtcttgttagtttagaacctacaaagattgcagagatccttaaagatcgtccatcttggttccgtgactgtcggagcctagaagtttttactatgtttcctgctggaaatggaggaaccattgaacttgtttacacacagacatatgctccaacaacactggctcctgctcgggatttctggactctgagatataccacaagtttggaaaatggcagtcttgtggtttgtgagaggtccctgtctggttctggaactggccctaatccagctgctgctgctcagtttgtaagggctgaaacactccctagtggctacttgatccgaccatgtgaaggtggagggtcaatcattcacatagtagaccacctaaatctcgaggcatggagtgtgccagaagtgttgcggccactttatgaatcatccaaggtggttgctcagaaaatgacaattgcagcgcttcgctatatcaggcaaatagctcaggaaacaagtggtgaggttgtttatggattgggtaggcagcctgctgttctgcggactttcagccagagattgagcagaggcttcaatgacgctgtaaatggattcaatgatgatgggtggactgtattgaactgtgatggtgctgaggatgtaattattgctgttaattcaaccaagaatttgagtggcacttctaacccagcaagttcccttacattccttggaggaattctctgtgcaaaagcttctatgttgcttcaaaatgtccctcctgcagttttggttcgttttctgagggagcaccgctcagagtgggctgatttcaatgttgatgcttattctgctgcatcactgaaagctggcacctatgcctatccagggatgaggcctacaagattcactggcagtcaaataattatgcctcttggtcatacaattgaacatgaagagatgctggaagttattaggctggaaggtcactctcttgctcaagaagacgcttttgtttctagggacattcatctcttacagatatgtagtgggattgatgagaatgctgtgggggcttgttcagagctcgtatttgctccaattgatgaaatgttccctgatgatgctccattggttccttctggtttccgcattatcccattagattcaaaaccaggtgacaaaaaggatgctgttgctacaaatcggaccctggatttgacatctggttttgaagttggtcctgcaacaactgctggtgcagatgcatcatcaagtcaaaacactcgatcggtgttgactattgccttccagttcccttttgacagcagtctgcaagacaacgtcgcggtcatggcacgccaatatgtccgcagtgtgatttcctccgtgcagagggttgccatggctatatctccatctggtataaacccatcaattggagctaaactttctcctggttctccagaggctgttacactagctcactggatctgccaaagttatagttactatttagggtccgacttactgagatcagattctcttgttggtgacatgatgctgaaacaactgtggcatcaccaggatgccattctatgctgttcactgaagtcattgccagtgttcatatttgcaaatcaagctggccttgacatgttggaaacaaccctagttgccttacaagatatcacattggataaaatatttgatgaggctggacgcaaggcattgtgtacagactttgccaagttaatggagcagggttttgcttatctgccagctggaatctgcatgtcgacgatggggcgccatgtgtcatatgaccaagccattgcatggaaagttcttactggggaagacaacactgttcactgcttggctttctctttcataaattggtcatttgtatgaaaaatccaattcgtgtgccctgctttttcccacttgaacataaaaatgaaagggttaaaagggagacaagacaagtttggggggaaaaagaagtcgtaaatttttgtataacacatcaggatcaggtttgcatttaattcgatttaatttatttcttatttagtgcagagaccaaattgaattaatcttgtaaattatttagtgctagagtgaagttgagacttttgaatgacacatgttgagtactttgtttttgtctctactatctttccctcgaccttgagctcatacacagaagaacttgtgtgatgacaaagcgcgtttgtaatgtttattcttacacaatcacagttctgacttgtgtgtccaatgtagtactttgtttttgtatgtagtatgatcatatctttcaactcgagttaaatattagcacacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcccccccttttgggtctcgtccccccggaatttaattccggcccggtccctgggggggtcccagttttccttttaggggggcgttttaaagctgggggaaaaaagggaaatagttgt

SEQ ID NO: 641 - DNA, 2837 bp, Glycine max
  Predicted polypeptide sequence is orthologous to G390, G391, G438
cggacgcgtggccggccgcctgcgtgcttggcagatcgttgcacagattcctccatcctagtttagtgctagaaagagtaaagtatgtcctgcaaggatggtagcagaaacggaatcggaatggataacgggaagtatgtccgttacacgcctgagcaggttgaagccctagaaaggctctatcacgattgccccaaacctagttccattcgccgccagcagctcattcgcgagtgccccattctctccaacatcgaacccaagcaaatcaaggtttggttccagaacagaagatgtagagagaagcagagaaaggagtcgtcgcggctccaagctgtcaataggaagctgactgctatgaacaagctgctgatggaagagaatgataggttgcagaagcaggtgtctcaactcgtctatgaaaatggctattttcgtcaacacacccagattactacgcaggcaaccaaagacacaaactgtgaatcagttgtgacgagtggtcagcagcacaatttgataactcaacatcccccacgggatgcaagtcctgcagggcttttgtccattgcagaagagactttagcagaatttctttctaaggctactgggactgctgttgagtgggtccaaatgcctggcggctgcgagaagacgacagaaggggggaatcgttgctatttctcacagttgcactggagtagcagcaagagcttgtggtttagtgggactagaacccactagggttgcagaaatcctcaaagatcggcctttgtggtttcaggattgccgagctgttgatgttctcaatgtgctgcccacagcaaatggtggaaccattgagctgctttatatgcagctatatgcaccaaccacattggctcctgctcgagacttctggttgttgcgctacacttctgttttagaagatggcagcttagtgatctgtgagaggtcacttaaaaatactcaaaatggtccaagcatgcctcctgtgcagcattttgttagagcagagatgctgcctagtgggtacctgatcagaccttgtgaaggaggtggttccatcatccacattgttgatcatatggatttagagccatggagtgtgccagaagtgctacgcccactgtacgaatcatcaacagtactggctcagaagacaactatggcggccctacgtcatctaaggcagatttcacatgaagtttctcagtccaatgtcactgggtggggtagacgaccggcagcactacgagctcttagccaaagattgagcaggggtttcaatgaggcactcaatgggtttaccgatgagggatggacaacaattggcaatgatggtgtagatgatgttactattctagtgaattcatcccctgacaagttaatgggtctgaatctttcctttgccaatggatttccgtctgtcagtaatgcagtgctatgtgccaaagcatcgatgctattacagaatgtgccccctgccattctcctaaggttcctgcgggagcatagatcagaatgggcagacaacaatatggatgcttacacagctgctgctattaaagttggcccttgcagcctatcaggatctcgtgttggaaactatggaggtcaagttatactccccctagcacacacaattgagcatgaggagtttttggaagtcattaaattggaaggaatagctcattctcctgaagacacaataatgcccagagaaatgtttcttttgcaactctgcagtggaatggatgagaatgctgttggcacctgtgctgaacttatatctgctccaattgatgcttcctttgctgatgatgccccccttctaccttctggatttcgcatcattcctcttgaatctggaaaggaagcttccagccccaatcgcacccttgaccttgcatctgcccttgacgttggtcccagtggaaaccgagcttcaaatgaatgtgctggaaattccagctatatgagatctgtgatgacaatagcatttgaatttgcatttgaaagccatatgcaagagcatgtagcatctatggcacgtcaatatgttcggagcattatatcatcggtccaaagggtagcattagcactttctccttctcatttgagttcacatgcagggcttaggtcaccattgggtactcctgaagcgcaaacccttgctcattggatctgcaacagttataggtgctacttgggtgtggagctacttaaatctaataacgaggggaatgaatctttgctcaagtccttgtggcatcactcagatgcaatattgtgctgcactctaaaggcattgccagtgttcactttctcgaaccaggctgggcttgacatgctggagaccaccctagttgcattacaagatatacctttagagaaaatatttgatgatcatggacgaaaaattctcttttcagagtttccacagattattcaacagggttttgcatgtcttcaaggtggtatttgtctttcaagcatggggcgacctgtctcgtacgaaagagttgttgcttggaaggtgctgaatgaagaagagaatgctcattgtatttgctttatgtttgtgaactggtcttttgtttgacatcttgttctgagtacactagtgcttattgtaatctaaagtgttagataaagatttactccagacacttgtgctttgttggttggtgttttactgtatttgcactaaatacttggattgcacatttaatgactatttatgtgttattagcttatgtaacttgtttccttattcaacatccagctaatatttatgcattcttaagaagtgttgcagcttcttatgtgtgtgg

SEQ ID NO: 642 - DNA, 3118 bp, Glycine max
  Predicted polypeptide sequence is orthologous to G390, G391, G438
ccacgcgtccgctcttataagcaaccccatctctctgtcccaatcccaacataccccccactggtccttttccattctttatacagacacacacaataaagaaaaagaaaaactacgttttcctttcactattctttttcaccctctccctctctcccatatatgatccaatatattgctataatacaatagaaccaacaactgtgacagacaaactctgagtagtacctcttttattctcctcctccttctctttcattctcaaaccactctgccatagtcttttctttcacctcttaatgaaacctcttggtttgtgtggttgaaacaaacaaagataagtcataataataaatcgggttggattcggaagggatgatggcggtgagttcagcctgcaaagatgggagcaaggtggcactggacaacggcaagtacgttaggtacacacctgaacaggtggaagcactggagaggctctaccatgaatgtccaaaaccaagttctcttcgccgtcaacaactcatcagagagtgtcccattctctccaacatcgaacccaaacagatcaaggtttggttccaaaaccgaaggtgcagagagaagcagcggaaagaagcgtcacggctgcaagctgtgaacaggaagctaacagcaatgaataaattactgatggaggaaaacgacagattgcagaagcaggtgtcacacctcgtctatgaaaacagctttttccgccaacagacacacaacaacaacgctacgcttgccacaacagacacaaacacaagctgtgagtcggtggtgacgagtggtcagcggaacttgacaccgcagcagcattccgcgagggatgctagccctgcaggacttttgtccattgcagaggagactttagcagagtttctttcaaaggccactggaactgctgtcgagtgggtccaaatgcctgggatgaagcctggtccggattccattggaatcgttgctatttctcacggttgccctggagtggccgcacgtgcctgcggccttgtgggtctagaacctgccagggttgccgaaatcctcaaagataggctctcatggtttcgtgattgccgaactgtggatgttctaaatgtgatgtccactggaaatggtggaaccattgagctgctttacatgcagttgtatgcgccaacaactttggcacctggtcgtgacttctggttgctgcgctacacatcacttttggaggacggtagtcttgtggtctgtgaaagatcacttaacaacactcagaatggtcctgctatgcccccagtgcagcattttgttagagcagacatgctgccaagcgggtatttgataagaccctgcgaaggagggggatccattattcatattgtcgatcatatggttctagagccctggagtgtacctgaagttttgcgcccactgtatgagtcatcaatgctgctagctcaaaggacaactatggcggccttacgtcatttgaggcagatttctcaagaggtttctcagccaagtgtaactggatggggaagaaggcctgcagcttctgcgtgcgctgagccagagattgagcaagggctttaatgaagcagtcaatgggtttgcagatgatggctggtccatgttagagagtgatggcattgatgatgtcacccttcttgtgaattcctcacctagcaagatgatgggagttagccttgtctataacaacaatggatttccttctgtgagcagttctgtgctatgtgccaaagcatccatgttgctgcagaatgtccctccagcaattcttcttagattcttgcgggagcaccgatcagaatgggcagacagcagtattgatgcttactcagctgctgccatcaaagctggtccctgtagcttgccaggggcccgatcaggaggttttggcgcgcaggttattcttccactagctcacacaattgagcatgaagagttcatggaggttatcaagcttgaaaacatgggctactatagggacgacatgagtatacctggtgatgttttcctcttgcaactttgcagtggagtggatgagcatgcggttggcaccagtgcagaacttgtttttgctccaattgacgcatctttctctgatgatgcacccattttaccttctggttttcgcatcatacctctagattctggcacagatgctgctagtccaaaccgtacacttgatttggcttctgcacttgaggttggcacaacagcaaacaaagcagctagtgacaactcagctcattctgggagcacaaagtctgtgatgacaatagcattccagtttgcattcgaagttcaccttcaagagaacatagcaaccatggccaggcaatatgttcgtagcatcattgcatctgttcagagggtttcattagcactttctccttcgcgctttggttctcacaatgcttttcacttaccacctggcactcctgaggcacaaacacttgctcgatggatctgtaacagctatcggttctatcttggggtagaacttctaaaatgtgaaggcagtgagtccattctcaagtctctttggcatcactcggatgcagttttgtgctgctctttaaaggcattacccgttttcacgtttgcaaatcaagctggacttgacatgcttgagacaactttggttgcacttcaagacatcactctggaaaagatttttgatgacaatggaaagaaaactctgtgcactgagttcccccagataatgcagcagggtttcatgtgtattcaaggtggtatctgtttatccagcatgggaaggccagtgtcctatgagagagcagttgcatggaaagtgttaaacgaagaagaatccgcccattgcatctgttttatgttcatcaattggtcctttgtctaatatattaaacagtattaggatgtaggaaagaaaagtagagcacaagagtacctaactttggcgaatccctagaatgctttaaaactctagtgggcatatgcgccaccaagatctatctatggccccatttgttttatttttaaaaaaaaaaaaaaaaaaaaaaaaaaaaaaaaaaaaaaaaaaaaaaaaaaaaaaaaaaaaaag

SEQ ID NO: 643 - DNA, 1005 bp, Glycine max
  Predicted polypeptide sequence is orthologous to G390, G391, G438
  misc_feature (972)..(972): n is a, c, g, or t
ccaaaaaagacattgttgcttttcattttggcatcacagagtatcagagagaaagagagagagagcggttttgcagaaaaaatccaagtaaatttaaggagccaccactgttccaatcagcccctttcattttgcagtgcccgtttattttttcgtgtttgcattcaccgttccacagaaggaaaaaagagtgctttgttccatctctttctgtggtgtgtctcaagataaaaagctcactcactcacagcagcaacaacccttttaccttaactcttgaaactttgttcagagtttggattttgagagagcatgatctgatgaaggagtgtggaggctctcttgggggagagggcaaggaagaagaggactacacaaaacaagtgttgtctttttgaaccccaaaaaaaaacgtttttttttgttttgttgttatggcactttgtatgcagagtcagcagagagattcagcatcaaacaagctgctcatggattgtggcaagtatgtgaggtacacacctgaacaggtggaggctttggagagggtgtatgttgaatgtccaaagcctagttcttccagaaggcaacaaatcattagggagtgtccactccttgctaacattgaaacaaagcagatcaaagtgtggttccagaatcgcagatgtcgtgaaaagcagcggaaggaagcctctcgtctgcagacagtgaatagaaagctgtctgcaatgaacaagttgttgatggaagagaacgaccgactgcagaagcaggtctcacagttggtttatgataatggattcatgaaacaacaaatacatactgcatctgctactactactactgacaatagctgtgaatctgtggtagtgagtggtcaacgccaacatcaaaaccccaaaattcagcatccccagtgggatgccaacaacccagctggtcttcttgcaattgctcaggagaccctggcggctntcctttcaaaagctactggaactgctgtcaact

SEQ ID NO: 644 - DNA, 2252 bp, Glycine max
  Predicted polypeptide sequence is orthologous to G390, G391, G438
cctcgtgcccacgccgccgcctcgggagaccctggcggcgttcctttccaaagctactggaactgctgtcaactgggtccagatgattgggatgaagcctggtccggattctattggaatcgttgctgtttcccgcaactgtagtggcgtagcggcaagagcctgtggccttgtgagccttgagcccactaaggttgccgagattctcaaagatcgtccatcatggtatcgtgactgtcgatgcctcaatgtactgagtgtaatccccacagggaatgggggcacgatagagctcatgtacatgcagacatatgcaccaacaacattggcagctgcaagagacttctggactctgagatacactactagtttggaagatggaagtcttgtgatttgtgaaaggtccttgacttcttcaactggtggccccacagggcctgctgcttcaaacttcgtgagagctgaaatgcttcctagtggctatctaattagatcctgtgagggtggtggatctattattcacattgttgatcatgttgatttagatgtttggagtgttcctgaagtacttagacccctctatgaatcaccaaaattcttggctcagaaattgactactgctgccttgcgacatgtaagacagattgcacaagaatcaagtggagaagttcagtatggtggtggacgccagcctgctgttttaagaacatttagccagagactttgcaggggctttaatgatgctgtgaatgggtttgttgatgatggctggtcactgatgggtactgatggagtggaagatgtgactatagccataaactcatctccaaacaaatttttgggctccaattacaacgcatcaatgtttccagcatttggaggtggggtcttgtgtgccaaggcatcaatgctcctgcagaatgttcctcctgctttgcttgttcggtttttgagggagcatcgatcagagtgggctgattatggagttgatgcatactctgccgcatgccttaaagctagtccctatgcagttccttgtgcaagacctggaggcttccccagcacccaggtcattttaccccttgctcatactattgagcacgaggagttcctggaggtagttcgaatagagggtcatgcattttctcctgaggacgtagcgatggcacgcgatatgtatctattgcagctgtgcagtggagttgatgaaagtgcagttggggcatgtgctcaacttgtgtttgcacctattgatgagtcatttgctgatgatgctctgttactgccatctggttttcgtgtcattccgttggatcctaaatcagatggtccagctccaactaggacattagatttggcatcaacgatggaagtaggttctggtaatgcccgtccagctggggaagcagacttgaatgggtacaaccttaggtcggtcctcactattgctttccaatttacctttgagaaccatacacgggacaatgtggctgctatggctcgccagtatgtgcgtagtgttgtgggatcagttcagagggttgccatggctattgctccctccaggttcaatacccagctggggccaaagtcactttctggatcacccgaggcccttaccttagcgcgatggatctgtagaagctacagggttcacactggcacagagctttttaaagctgagtccacagctggtgatgcaatccttaagcaactttggcaccatcccgatgcaatcatatgctgttctgtgaaaacaaatgcatctccagtgttcaccttttcgaaccaggctggtttagacatgcttgaaactactcttgtttcccttcaagatataatgcttgataaagttcttgatgaatctggcaggaagattctctgctccgagttctccaagataatgcaacagggttttgcatctctccctgcaggaatatgtgtatctagtatgaatcggccagtgtcctatgagcaggttgttgcatggaaagtcctcaatgatgatgattctaatcactgcctagccttcatgttcatcaattggtcttttgtatgatggatgaaccatatctagagactactacttattttatctactaatcagatgatactatcacagacagatgtactgatgtcagcttttctttatgccctatgtatgaagtatgctaatgttacttattcgctatatatataaaatatctagttaatttggtgaaaaaaaaaaaaaaaaaaaaaaaaaaaaaaaa

SEQ ID NO: 645 - DNA, 1824 bp, Glycine max
  Predicted polypeptide sequence is orthologous to G390, G391, G438
ccacgcgtccgctctttctcctttctttttctctctttctctacaatctcgagattggtgtgccgcgcgcccgaaagaccactgtttcccccctttagtttctcttctaagttggattttgaaggaactgagcagcatctaatgaaggagagtggaggctctcttggagaagagagcctgcccgagactaacaccaagaacagtgaagaagaagaaccaattaactagttcctttttttctttctttctttctcactcactccctccctcccaatcccattttcttcaaatagtgtgcgtgtgtgtgttaagagaagaatagggtgtgtgtgtttagagtgatggcactttctatgcacaaggactcagccaacaaccagatggattcaagcaagtatgtgaggtacacaccagagcaggttgaggctttggagagggtctatgctgaatgccctaagccaagttccttgaggaggcagcaactcatcagagagtgccccatactttccaacattgaacccaaacagatcaaagtttggttccagaatagaaggtgtcgtgagaagcagaggaaggaagcttctcgcttgcagacagtgaacagaaagctgactgcaatgaacaagctgttaatggaggagaatgaccgtttgcagaagcaggtttctcatctggtgtatgagaatggttacatgaagcaacagatacacactgcttctgcaggtactaccacagacaatagctgtgagtctgtggtaatgagtggtcaaaaccaacagcaaaacccaacacctcagcatccggctcgaggattatttgtttgtttcagtcttctcgccatagctgaggagaccctggcagagttcctttccaaggctactggaactgctgtcgactgggtccagatgattgggatgaagcctggtccggattctattggaatcgttgctgtttcccgcaactgtagtggcgtggcagcacgagcctgcggccttgtgagcctagagcccactaaggttgctgagatactaaaagatcgacagtcgtggtatcgtgactgtcgatgcgtggatgtgttaagtatagtccccactgggaatgggggcaccatcgagctcctgtacatgcagacatatgcgcccacaactttggctgcagcacgggacttctggacactaagatacacgacaagtttggaagatggaagtcttgtgatatgtgagagatcattgacatcctcaactggtggccccacagggcctccttctacaacctttgtacgagctgaaatgcttcccagtggttttctagttagaccttgtgagggtggtggatccattattcacattgggctccaggttgatttagatgtctggagtgtccctgaagtactgaggcccctctatgaatcaccaaaattcttggctcagaaattgactactgctgccttgcgacatgcaagacaaattgcacaggaatctagtggagatgttcattatggtgggggtcgtcaacctgctgccttgaggacattaatgcaacggctacgcaaagggtataccgatgcctgcaacgggtttgtggatgatggttggtcactgatgggtaatgatggggtggaagatgtgaccatagccataaactcgtctcccaacacgatattcggttcccattacaatacatcaatgctttcagcatttggaggtggggtcatgtgtgccaaggcatcaatgctgctacagaatgatcctcctgctttgcttgttcgttttgtaggggagcatcgttcaaagtgggctaattatgaagttgatgcatactctt

SEQ ID NO: 646 - DNA, 1271 bp, Glycine max
  Predicted polypeptide sequence is orthologous to G390, G391, G438
  misc_feature (255)..(255): n is a, c, g, or t
ccccggcttttgcctttaaggtttcgggtcggattttttttgggaattggaacgggaaaccattttcccccgggaaaaggtaaggccatggttttgcccaggtttaattttaattcctataaggaaaaatgggacgccttcaggttccggttccggatttattttcgggttgggggggtccatatttggggggcgccccttttctttttttttttttttttctgtgttttttttctcagtatttcaatttttatnttttttttttaatttttttttattttgccagtgttggtttttttttaggaataagtaggctatacttcaacaaggagtttatatagtaagaaaggtacatccttggtaaaagcataaagcaaagctaatctaatggcacacacaaccatgagttcatgaaatccagtcattagttacattcgttgttggtgtgacaatatcttagtaaagtactcaaaatataaattaatagatataataaagtatctaaatgatggttcccccatcagacaaaagaccagttcatgaatacgaaggcaaggcagtgattggaatcatcatcatcgagaactttccatgcaatggcctgctcataagacactggtcgattcatacttgatacacatattcctgctggcagatatgcaaatccctgttgcattatcttggagaactcaatgcagagaaacttcctgccagcttcatcaagaactttatccagcattatgtcttgaagagcaacaagagtggtttcaagcatgtcaagtccagcttggtttgcaaaggtgaacactggagatgcatttgtttttacagaacagcacaatattgcatctggatggtgccaaagttgcttcaagattgcatcaccagatgtggactcaacgctgaaaagctctgtgcaggtgtggagcctgtagcttctgcagatccatcttgctaaggtaagagcctctggtggaccaggaaatgactttggccccaactgtgtactgagcctagagggagcaattgccatggcaaccctctgaacagatcgcacaacattacgcacatactggcgagccataacagccacattgtcccgcaaatggttctcaaaggtaaattggaatgcaattgtgaggaccgacctaaggttgtagttattcgagtcactttcaccagctgagcgggcattaccagatcctgtttccagtgttgatgctaagtccaatgtcctagttgaagccaaaccatctgtttatgcaaccaat

SEQ ID NO: 647 - DNA, 578 bp, Glycine max
  Predicted polypeptide sequence is orthologous to G390, G391
  misc_feature (8)..(8): n is a, c, g, or t
  misc_feature (39)..(39): n is a, c, g, or t
  misc_feature (41)..(41): n is a, c, g, or t
  misc_feature (363)..(363): n is a, c, g, or t
ggtccggnaattcccggcgtcgaccccacgcgtccgggngnaagttcagtatggtgggggtcgtcagcctgctgtcttgaggacatttagtcaaaggctttgcaaagggttcaatgatgctgtcaacgggtttgtggatgatggttggtcattgatgggtaatgatggggttgaagatgtgaccataggcataaactcatctcccaacaagtttttcagttcccattacaatacatcaatgcttcccgcatttggaggtggggtcttgtgtgcgaaagcatcaatgctgctacagaatgttcctcctgctttgcttgttcgttttctgagggagcatcgttcagagtgggctaattatggggntgatgcatactcttctgcatgtctcaaagctagtccttatgcagttccttgtgcaagacctagtggtttcccgagcagccatgtcattataccacttgctcatactattgagcatgaggagttcttggaggtagttcgtattgaggctaatgcatttccccctgatgatgtagctttggcatgtgatttgtatttaatgcagctgtgcagtgcaa

SEQ ID NO: 648 - DNA, 628 bp, Glycine max
  Predicted polypeptide sequence is orthologous to G390, G391, G438
ccacgcgtccggaatgccctaagccaagttccttgaggaggcagcaactcatcagagagtgccccatactttccaacattgaacccaaacagatcaaagtttggttccagaatagaaggtgtcgtgagaagcagaggaaggaagcttctcgcttgcagacagtgaacagaaagctgactgcaatgaacaagctgttaatggaggagaatgaccgtttgcagaagcaggtttctcatctggtgtatgagaatggttacatgaagcaacagatacacactgcttctgctggtactaccacagacaatagctgtgagtctgtggtaatgagtggtcaaaaccaacagcaaaacccaacacctcagcatcccaaccgggatgctaacaacccaactggtcttctcgccatagctgaggagaccctggcagagttcctttccaaggctactggaactgctgtcgactgggtccagatgattgggatgaagcctggtccggattccattggaatcgtagctggttcccgcactgtagtggcgtggcagcacgagcctgcgggcttgtgagcctggagccccttaaggttgctgaaattctcaaagatcgacagtccggggtttcgtgactgtcg

SEQ ID NO: 649 - DNA, 739 bp, Glycine max
  Predicted polypeptide sequence is orthologous to G390, G391, G438
  misc_feature (704)..(704): n is a, c, g, or t
catgcttggcagatcgttgcacagattcctccatcctagtttagtgctagaaagagtaaagtatgtcctgcaaggatggtagcagaaacggaatcggaatggataacgggaagtatgtccgttacacgcctgagcaggttgaagccctagaaaggctctatcacgattgccccaaacctagttccattcgccgccagcagctcattcgcgagtgccccattctctccaacatcgaacccaagcaaatcaaggtttggttccagaacagaagatgtagagagaagcagagaaaggagtcgtcgcggctccaagctgtcaataggaagctgactgctatgaacaagctgctgatggaagagaatgataggttgcagaagcaggtgtctcaactcgtctatgaaaatggctattttcgtcaacacaccacccaaaatactaagcagcagccaaccaaagacacaagctgtgaatcagctgtgacgagtggtcagcagcacaatttgacaactcaacatcccccacgggatgcaagtcctgcagggcttttgtccattgcagaagagactttagcagaatttctttctaaggctactggaactgctgttgagtgggtccaaatgcctggaatgaagcctggtccggattccattggaatcgttgctatttctcacagttgcactggagtagcagcaagagcttgtggnttagtgggactagaacccactagggttgcagaaat

SEQ ID NO: 650 - DNA, 2901 bp, Oryza sativa
  Predicted polypeptide sequence is orthologous to G390
cgttctgagtaaaccacccccaccacgagcacgagcacgagcaaccatggcggtggcagagggagctgcgactgcgagctacgggccatgactgcggcgagttcttgctgggttgttgttgtacaagcagcgacgaggaggatgggagcagaggaggaggaggcggagggatggcagcggcggcggtggggggaaggggggagaggctgtcgtcctcctccccgacggcggcggcgccgcaggtggacgccggcaagtacgtccggtacacgcccgtagcaggtggaggcgctggagcgggtgtacaccgagtgccccaagcccagctcgctccgccgccagcagctcatccgggagtgccccatcctcagcaacatcgagcccaagcagatcaaggtctggttccagaatcgcagatgccgggagaagcagcgcaaggaggcctcccggctgcaaactgtgaaccggaagctgaatgcgatgaacaagctgttgatggaggaaaatgaccggctgcagaagcaggtgtcccgtctcgtctacgagaacggctacatgcggactcaactgcacaatccttctgcagccaccacagatacaagctgtgagtctgtggtgacaagtggtcagcaccatcaacagcaaaacccagcagttctgcatccgcaaagggatgcgaacaacccagcaggtcttctcgctattgctgaggagaccttggcagagttcatgtcgaaggcgacaggaactgctgtcgaatgggtgcaaatggttgggatgaagcctggtccggattccattggaatcatcgctgtttcgcacaattgcagtggcgtagcagcacgagcttgcggccttgtgagccttgagcccacaaaggttgcggagatcctcaaggatcgcccctcttggtaccgcgattgccggtgcgtcgatatcatccatgttatccctacgggtaacggcggaaccattgagctaatctacatgcagacttatgcaccgacaactttggcggcaccacgcgacttttggactctccgctacacaagtggacttgaagatgggagtcttgtgatctgtgaaaggtcattgactcagtccactggtggcccatctgggcctaacactccgaattttatcagagccgaggtacttcccagtggttatctgattcgaccatgtgagggaggtggctccatgatttacattgttgatcatgttgatttggatgcttggagtgtgcctgaggttcttcgaccgctctatgaatctccaaagatccttgcacagaagatgaccattgcagcattgcgacacattaggcaaattgcacatgagtcaagcggtgaaatcccctacggtgctggtcgccagcctgctgttttcaggaccttcagtcaaaggctcagcagaggtttcaatgatgctgttagtggatttccagatgatgggtggtctttgttgagcagtgatggtagtgaggacattacaatttcagtaaactcgtctccaaacaagcttgttggatcccatgtcagcccgaaccctctgttttctactgttggaggtggcatcttgtgtgcaaaggcatcaatgctacttcagaatgtacctcctgctctacttgtgcgatttctgagggagcatcgttctgaatgggctgatcctggtgttgatgcttattctgctgcttctttgcgagccagcccatatgcagttccaggcttaaggaccagcgggtttatgggcagtcaggttatactacccctcgctcataccttagagcatgaagagttcttggaggttattaggctcgaaggacatggtttcagccatgatgaggtgcttctatcacgggatatgtaccttctacagctttgcagcggggttgatgagaatgctgcgggtgcatctgcccagcttgtctttgctcccattgacgaatcttttgctgatgatgcaccactgctaccctcaggcttccgtgtgataccactggatggcaagacggatgcaccatctgcgacacgcacacttgacctggcatctactcttgaggttggatcgggtgggactacacgggcttctagtgacacctcgagcacctgcaacacaagatcggtcctgaccatagctttccatttctcatatgaaaacccccctcgtggaagcgtagcggcaatggccaggcagtatgtccggaccgtggtggcatcagtgcagagagtggccatggcaatagctccttcacgtcttggtggacagattgaaacaaagaaccctccaggatctcctggggcccatacgcttgcaaggtggattgggaggagctaccgattccacactggagcggatctccttcgcacagactcacaaagcacggattcttccttgaaagcaatgtggcaacactctgattcaatcatgtgctgctccctgaaggctgctcctgtgttcaccttcgccaaccaagccggcctcgacatgctggagacgacgctgattgctctccaggacatctcgctcgagaagatccttgatgatgatggccggaaggcactatgtacagagttccccaagatcatgcagcagggtttcgcctacctcccgggcggcgtgtgcgtgtcgagcatggggcggccggtgtcgtacgagcaggcggtggcgtggaaggtcctgagcgacgacgacacgccgcactgcctcgccttcatgttcgtcaactggtcattcgtctgagaaccaccctagtagaatcgatcccccctcttgtttgtctgtcctaaagaccttatgtagtattgcttttgtgtatcatcaccatgaacatgtcaagaacctccccagtttctatcatcatgaacttccgtttgaatctagtactgctaaaaaaaaaaa

SEQ ID NO: 651 - DNA, 687 bp, Oryza sativa
  Predicted polypeptide sequence is orthologous to G390, G438
gagcaagaagccgaaaggtaaggatcaggctataacgttggggcattggcaactcaattaaaaggggtagggtagttgtctggttgttcatgttctgatttaactcattagtgttgtgctaaatggaaggtcaagctgctctacatgcaggcaagaacagacaagcctgaaaatttttgtggcaaattcttagctcaacctgaaattccgaagctgaaatctgtattcagtcttcaactctatgctccgacgacgctggcgccggctcacgacttctggctgctgcggtacacctccattctcggtgatggaagcttagtggtgtgtgagagatcactcagtagcaagcaaggaggcccaagcatgccacttgtccagccttttatcagagatgagatgcttcccagtgggttcttgatccgacctagcgatggtggaggcagcgtgatacacatcgttgatcatatggacctggagccttggagcgtgcctgaagttgtgcgacctctgtatgaatcttctgccttggttgcgcagaagatatcgatggcggttgcctacaaagatacccgttctgtgatcacaggatggggaaggaagcttgcggctttgcatgctctgagccaaaaagctcaccacaggcttcaatgaagttctcaatgggcttgcggatgatggatggtccgt

SEQ ID NO: 652 - DNA, 3498 bp, Zea mays
  Predicted polypeptide sequence is orthologous to G390, G391, G438
attgagccaagcagataaggtctggttccagaaccggaggtgccgcgataagcagcggaaggagtcttcgcggcttcaggctgtgaacagaaagttgacggcaatgaacaagcttctcatggaagagaatgagcggcttcagaagcaagtctctcagttggttcatgaaaacgcgcacatgcggcagcagctgcagaatacttcattggccaatgacacaagctgtgaatcaaatgtcactacccctccaaaccctataagggacgcaagtaacccttctggactccttgcgattgcagaggagaccttcacagagttcctctcaaaggctactgggacagctattgattgggtccagatgcctgggatgaagcctggtccggattcagttggtatcgtggccatttcgcatggttgccgtggcgttgctgcccgcgcctgtggtttggtgaatctagaaccaacaaaaggcatagagatcttgaaagatcgtccctcttggttccgtgattgccgaagtcttgaagtgtttacaaggtttccagctggaaatgggggaacaattgaacttatttacatgcagatgtatgccccaacaactttagtccctgcacgtgatttttggacactacgatacacgacaacaatggaagatggcagccttgtggtctgtgagagatccttgagtggttctggtggtggtccaaatgcagcctctacacaacaatttgttagggctgagatgcttccaagtgggtatttagttcgcccatgcgaaggtggaggatcaattgtgcatatagtggaccatctagatctcgaagcatggagtgttcctgaagtgcttcgaccactgtatgagtcttctagagttgttgctcagaaaatgactactgtggcactgcgccaccttagacaaattgctcaagaaacaagtggagaagtagtgtacgccttgggaaggcaacctgcagtcctacggacctttagtcaaagactaagcagggggtttaatgatgccattagcggtttcaatgatgatggctggtctgtaatggggggagatggcattgaagacgttgttattgcttgcaactcaaccaagaaaattaggaataccagcaatgctgggattacatttggagccccaggaggcattatttgtgcgaaggcatccatgttactgcagagcgtcccaccggcagtactggtacgatttctgagggagcatagatctgaatgggctgattacaatattgatgcgtatttggcttcatcattgaagaccagtgcgtgctcacttcctgggttgcgacccatgagattttctgaggggcagatgatcatgccacttgctcacacagttgagaacgaggagattcttgaagttgtccgccttgaaggtcagcctcttactcatgatgaagctcttctttcaagggacatccaccttctccagctttgcactggaatagatgagaaatctgtgggttcctccttccagcttgtgtttgcaccaattgatgagcatttcccagatgatgctccattgatttcttctggctttcgtgtcataccacttgatgtgaaaacagatggtgtatcctctggtaggacgctagatttggcatctagtcttgatgtgggctctgctgcaccccaagcctcaggggatgcatctccagatgactgcaatttgagatctgtgctgacaatcgcctttcaattcccgtatgagatgcaccttcaggacagcgttgcagcaatggcccgtcaatatgttcgtagtgtcatttctgctgtgcaaagagtgtcgatggctatatctccctcccaatctggtctaaatgctgggcataggatgctttctggcttccctgaagctgccacacttgctagatgggtttgccagagttatcactaccatctaggtatggaattacttaatcaatcagatggagctggtgaagcattgttgaaaatgctctggcatcatccagatgctgttctgtgctgctcctttaaggagaaacctatgtttacgtttgcaaacaaggcagggctggacatgttagaaacatctcttgttgccctgcaagacctgacgctagacaagatcttcgacgagtcaggaaggaaagcactattctcagacatctcgaaactaatggaacagggctacgcgtacctgccgtcaggcgtgtgcatgtcaggaatgggccgccatgtttctttcgaccaagctgtagcgtggaaggtgctcggcgaggatagcaacatccactgcctggcgttctgcttcgtcaactggtccttcgtgtgactgaagtccaacccgtcgggtggttatggcgagctgacccatttttttttttgtatggaaaatcatcagctgtgacaaaaggcatatgttgcatgcactagttgaagaaactggtccaattgcttttttggtctgtcattccattcagatgttgctaggtgtggagtggaaatggggcaatagtgatgcacggctacacatgacccagcattaaccaaacaaccgcgtcgccagtttctttctattcgatcagggagatgcatttttctggcaaaaatcttccattttttttcgttgcaaatttggtctgtatatggaactgctgctggacgccgagaaagcaaaacatatgcggaaactcactatggctcgaggaagatatatgcctacactgtcttcagaaaacataatgcagtaatgcttttcgaacccgaagcacactagacacaaaagccagatgagcaggtaggtccctcgcaaggctgatgccaacaattaaaccgacgacccttcacaacaaaattacgattctttcttctcatcctgctccagttgaggctccttctctgcagcctcctcaaatgtctctccttggacaagctcagggacgtcgtcatcatcctgtgcagctgcttcagcaccaggtacctgcctctggaaaatctcagccagcttcttaaggttgtccaggttatcaggacccagttggttgataattgatggcagaaggtcttgcagactttttgtctggggtactccactaaccacccatgtatttgcaggaatggatgcttgcactttagggttctgaaactggataacaacatcgtccttgaagatgttgacctcctcgataccaggaatggtgttccccccgatccttttcaaggtgctctgaagccgcttgtcatctgtggtcgtggtcttgtgaactgccttcttcttcctgcgcatgctgcccttccctccggtgcgtacagcgccagccatcttcttgagcttctccacattcatcttgcacaggcggcggcggcggcggcggatggagtggtggatggggaggcggaaggggtttgagctacagcaggaagcagatagagatagaagaaggagagtcgagtcggaaggccagtcactgtaacatttaggggctttttccggccgaacctcggggg

SEQ ID NO: 653 - DNA, 3126 bp, Zea mays
  Predicted polypeptide sequence is orthologous to G390, G391, G438
gtcgacccacgcgtccgcccacgcgtccgcctgctcccgcccctcaatcaatcacgacgccacagccgcacccccgcgaaccctagctcgcagtcgcaccgcgcgccggacgctgaccaggtgcctgctctatctcctgcggtggccgtcgcgctgccgccgccagacccgatccgtccgaccgtgccaagcgccccccctccggcgatcgatgcgaggcgccgcgggaggcggctcgggctcgggcaggctgtgagctggagcctgtccgctcgctgcgtcgtgcgcctgccttccctctcacggtcggcctcgccgcgcgtttgctttcccgcccacgcagggatcttcgcgggcggggagttgaagcgcgagatttgcgcggctacgattctgcgttgccgagggagcaagggaaccaatggctgcagcggtggcgatgcgagggggaagcagcgacagcggaggatttgacaaggttcccgggatggactcggggaaatacgtgcgctacaccccggagcaagttgaggtgctcgagcggctctacatcgattgccccaagccaagctcctcacggcggcagcaactgctgcgcgagtgtcctatactctccaacattgagccgaagcagatcaaggtctggttccagaaccgaaggtgccgcgataagcagcggaaggagtcttcgcggcttcaggctgtcaacagaaagctgacggcaatgaacaagcttcttatggaagagaatgagcgtcttcagaagcaagtctctcagttggttcatgaaaatgcgcacatgcggcagcagctgcagaacacttcattggccaatgatacaagctgtgaatcaaatgtcactgcccctccaaacgctataagggatgcaagtaacccttctggactccttgcgattgcggaggagaccttcacagagttcctctcaaaggctactgggacagctattgattgggtccagatgcctgggatgaagcctggtccggattcggttggtattgtggccatttcacatggttgccgtggcgttgctgcccgcgcctgtggtttggtgaatctagaaccaacaaaagtcatagaaatcttgaaagatcgtccctcttggttccgtgattgtcgaagtctggaagtgtttacaatgtttccagctggaaatgggggaacaattgaacttatctacatgcagatgtacgccccaacaactttagttcctgcacgtgacttttggacgttgcgatacacgacaacaatggaagatggcagccttgtggtctgtgagagatccttgactggttctggaggcggtccaaatgcagcttctgcacagcaatttgttagggctgagatgcttccaagtgggtatttagtgcgcccatgcgaaggtggaggttcgattgtgcatatagtggaccatctagatcttgaggcatggagtgttcctgaagtgcttcgaccactatatgagtcttctagagtagttgctcagaaaatgactactgtggcactgcgccaccttagacaaattgctcaagaaacaagtggagaagtagtgtatgccttgggaaggcaacctgcagttctacggacctttagtcaaagactaagcagggggtttaatgatgccattagtggtttcaacgatgatggttggtctgtaatggggggagatggcattgaagacgttgttgttgcttgcaactcaaccaagaaaattaggaataatagcaatgctgggattacatttggagcgcctggaggcattatttgtgcgaaggcatccatgttactgcagagcgtcccaccggcagtactggtccgatttctgagggagcatagatctgaatgggccgattacaatattgatgtgtatttggcttcatcactgaagaccagtgcgtgctcacttcctgggttgcgacccatgagattttctggggggcagatgatcatgccacttgctcacacagtggagaacgaggagattcttgaagttgtccgccttgaaggacaacctcttactcatgatgaagcccttctttcaagggacatccaccttctccagctttgcactggaatagatgagaaatctgtgggttcctccttccagcttgtgtttgcaccaattgatgagcattttccggatgatgctccattgatttcctctggctttcgtgtcataccacttgatatgaaaacagatggtgtatcctctggtaggacgctagatttggcatctagtcttgatgtgggttctgctgcaccccaagcctcaggggatgcacctccagatgactgtaatttgagatctgtgctgacaatcgcctttcaattcccttatgagatgcaccttcaggacagtgttgctactatggcccgtcaatatgtgcgtagtgttgtttctgctgtgcaaagggtgtcgatggctatatctccctcccaatctggtctaaatgctgggcagaggatgctttccggcttccctgaagctgccacacttgctagatgggtttgccagagttatcactaccatctaggtgtggaattacttaaccaatcagatgaagctggtgaagcattgttgaaaatgctctggcatcatccagatgctattctgtgctgctcttttaaggagaaacctatgtttacgtttgcaaacaaggcagggctcgacatgttagaaacatctcttattgcgctgcaagacctgacgctagacaagatcttcgacgagtcaggaaggaaagcaatattctcagatatctcaaaactaatggaacagggctacgcgtacctgccgtcgggcgtgtgcatgtcaggaatgggtcggcatgtctcattcgaccaagctgtagcgtggaaggtgctcggcgaggacagcagcgtccactgcctggcgttctgcttcgtcaactggtccttcgtttgacacgccatcccatggcctgtgtgatgagcaggccaatttttttgtatggtgatcccaatatggggaaaccatcagctgtgacagaaggctttatgttgcatgcactagttgtacgtcttgaatcgagtgtatttatgaagaaattggatactgcgcaaaaaaaaaaaaaaaagggcggccgc

SEQ ID NO: 654 - DNA, 1816 bp, Zea mays
  Predicted polypeptide sequence is orthologous to G390, G391, G438
ccggccgggtggttgcccagaagatgacaaccacagcgctacggcaccttagacaaattgctcaagaaacaagtggagaggttgtatatgcgctaggaaggcaaccagctgttctacggacatttagtcagaggctgagtagaggctttaatgatgctataagtggtttcaatgatgatggttggtccgttatgtgtggagatggcatggaagatgttatcattgcttgcaactcgaagaagatcaggagcagtagcaatcctgctactggttttggagcccctggacctggaggtatcatatgcgctaaagcatcaatgttgctgcagagtgttccaccagcagtccttgttaggttcctgagggaacatcgatctgagtgggcagattataactttgatgcgtattcagcttcagcattgaaaacaagcccttgttcccttcctgggttgcggcctatgaggttttctgggagtcagatcatcatgccccttgctcacacggtggagaatgaggagatcttagaagttgttcgtcttgaaggacagactcttacacatgacgagggccttttgtctagagatatacatctgcttcagctttgcactggaatggacgagaaatcaatgggatcctgcttccagcttgtctttgcaccaatcgatgagcttttccctgatgatgctccattggtatcttcaggctttcgcgtgatcccgttggacataaaaacagacggaccaccctctggaagaacgttggatttggcctctagccttgaagttggcgcaaccacgcaacaagtggcaggggatggatctcaggacgtttgcaacctgcgatctgtgctgacaattgcctttcagtttccctatgaaacacatctccaggacaccgttgcagctatggcccggcaatatgttcgaagcatcgtttctgcggttcaaagagtatcaatggccatttctccctcccattctggcttgaatactgctgggcagaagctaatttctggctcccctgaagctgctacacttgttcgctggatttgccaaagctaccggtatcacttgggggtggatttggtcagccactcggatcaagctggggaatcacttttgacaatgttctgggaccatcaagacgctgtcttgtgctgctctttcaaggaaaagcctgtgtttactttcggcaaccagatgggagttgacatgttagaaacgactttagtcgctctgcaagatctcacccttgacaagatctttgacgagcctggtagaaaggcactacatgcggaggttccgaaactgatggaacagggctatgcgtacctgccggctggggtgtgcctgtctgggatgggccgccatgtctcctacgagcaagctgttgcttggaaagttctcggtgaggacggcaacgtgcactgcctcgccttctgtttcgtcaactggtccttcgtctgatgtgatccaatgcaccgcggaaactttacgatcagcgtccatttttgcattctctgtagacgagaatggtgcggtgttgctgctactgttagctaggcaacggcatgttcaggtaaggtagtcttggggaaagccagtattgtgaagatgtaaatttgcgcccgtttccgctaatttaacccgctgaacttgctgttgtttgttaaggccaggggcactcgtacgtgagattaaatgttgtgaaattgtatgtgctgaaacataggtttacattgaaattggcataaaaaacggaatcatgtgggctaaacggcccctaaaaagttttgatattaattaaggggggtttg

SEQ ID NO: 655 - DNA, 784 bp, Zea mays
  Predicted polypeptide sequence is orthologous to G390, G391
gggccccctctcgagttttttttttttttttttttttttttttagcaaatagtaatactgcaacctgcaacagtgatcaatatcgccggcgacaggccggggagacgagaccactaccaggcacggatacagctgttgtagttgtttgtcacgcacacacacacacacaaacaaacagagtcagttctcgatcatccacacagtacacaaattcttaacacaagcggcacaacggaaaagcaactaatgatacgtagtagggcaaaaggcggcatccggtctggcgctgccgagcgatgttgcgagcctcagatgaaggtccagttggcgagcatgagcgccaggcactgcggggcgccgtcgtcgcccaccaccttccacgccactgcctgctcgtacgacgcctgccgccccatgctcgacctgcacacgccgccggggaggtacgccaggccctgctgcatgatcgcggggagctgcgcggacagggccttctggccctcgtcgtcgaggaccgcctccagcggcaggtcctggatgttcaccatcgtcgtctccaggatgtcgaagccggcgctgttggcgaacttgagcgtgaaagccggcgacttcagagagcagcagagtatcgcgtcgctgtgcttccagaacagcatcagcggagagtccgcgccttcggtgtccgaccagcggatctccgttccggtgtgcgccctgtagctcctgccaatccacgtagctagtgcaagtgcctcgggagagcccggcggatgatatcagttcg

SEQ ID NO: 656 - DNA, 2346 bp, Zea mays
  Predicted polypeptide sequence is orthologous to G390, G391, G438
gatcacaaagattcaatgataacagcagtagtaatagggttaagtctcacacataaacagacagcaggggcattgttctccaactcccgatccaccacagtagacttaggccataaacagacagcaggggggcattgtctcgagcagttgtagtacacaggtgcaacggaaagcaactagtaatacgtagtcggataggataggataaaggcggcaaccgatctgacgctgccgagtgaggcatcgaggctgtgaacgtcaagagcggaggagcatcagatgaaggtccagttgacgaacatgagcgccaggcactgcggcgcgccgtcgtcgcccaccaccttccacgccaccgcctgctcgtacgacgcttgccgccccatgctcgacctgcacacgccgccggggaggtacgccaggccctgcagcatgatcttggggagctgtgcgaccagggccttctgtcccccgtcatcaaggaccgcctccagcggcaggtcctggacattcgccaccgtcgtctccagtatgtcgaagccggcgcggttggcgaacttgagcgtgaaagccggctttagagagcagcagattatggcgtcgctgtgcttccagaacagcgtcaggggagagcccgccgcgtcttcagtgtccgaccagcggatctccgatccagtgtgcgccctgtagctcctgccaatccacgaagctagtgcgagtgcctcgggagagcctggcggatgcttcagttcgacatgcgggccaaggcgagagggagaaatcgccatggccaccctctgcacgatcgccatcactgccctgacatactgcctggccatcgctgccacgctctcgcggaggtggttctcgaacgagaactggaaggcgatggtcaggaccgacctcgtgctgcgcgtgcctgacccgctatcgcttaaagcacacagacctccgcctgatccgacctcgagcgcagaagcaaggtcaagggtacgtgtggcagatggcacatccgtcttagcatcaagcggtatcacacggaagccagagggtagcaacggtgcatcgtcagcaaaagattcatcgataggagcgaagacaagctgtgcacaagcacccggcgcatcctcatcgatgccgctgcacaactgcagaagaaacatatccggggacataagaacctcgtcatggctaaagccatgtccttgaagtcgaataacctccaagcactcttcatgctccacggtgcgtgcaaggggtagtataacctggttgcccataaacccaccagcccttaaacccggaacattatatgggttggccctcagagaggcagcggaataagcatcaacaccagggtcagcccattcagagcgatgctccctcaaaaatcgcacaagtagagcaggtggcacattctgcagtagcattgacgcttttgcgcacatgatgccgccccccatggcagaaaagaatggggaagggctgacatcagacccaataagtttgtttggagatgagttgattgtaattgaaatatcctcagcaccatcactgctcaacaaagaagaccagccatcgtctggaaagccactcacagcatcattgaagcctctgctgagcctttgactgaaagttctgagaacagctggctgtcgcccagcaccatagggcgtttcaccacttgattcgtgtgcaatttgcctaatgtgacgcaacgccgcagcagtcatcttttgtgccagtatcttaggagattcatagagcggtcgaagaacctcagggacactacaagcattcagatcaacatgatccacaatgtaaatcatggaacctcccccatcacaaggtcgaatcagataaccactaggaagcacctcagctcttataaaatctggagttttaggtccagaaggacctccagtggagtgggtcaatgacctttcgcagatcacaagactgccatcgtcaagaccactagtgtatcgtagtgtccaaaagtcgcgcggttccgccagagttgtcagtgcataagtctgcatatagatcagctcaatcgttccaccgttacccgtagggataacatggaggatatcaacacgccgacaatcgcgataccacgatgcgcgatccttaaggatctcggcaacctttgtgggctcgaggctcacaaggccgcaagctcgtgctgctacgccgctgcagttgtgcgaaacagcgatgattccaacggaatccggaccaggcttcatcccaaccatctgcacccagttgacagcagttccggtcgccttggacatgaactccgccaatgtctcctcagcaatagcgagtagaccggacgcgtgg

SEQ ID NO: 657 - DNA, 1669 bp, Zea mays
  Predicted polypeptide sequence is orthologous to G390, G391, G438
cactcccccagttttttttttttttttttttcgagcaagcagaactagcaaatagtaatactgcaacctgcaacagtgatcaatgtcgccggcgacaagccggggagacgagaccacgaccaggcacgcatacagctgttgtagttgtttgtcacgcgcacacacacaaacaaacagagtcagttctcgatcatccacacagtacacaaattcttaacataggcggcacaacggaaaagcaactaatgatacgtagtagggcaaaaggcggcatccggtctggcgctgccgagcgatgttgcgagcctcagatgaaggtccagttggcgagcatgagcgccaggcactgcggggcgccgtcgtcacccaccaccttccacgccactgcctgctcgtacgacgcctgccgccccatgctcgacctgcacacgccaccggggaggtacgccaggccctgctgcatgatcgcggggagctgcgcggacagggccttctggccctcctcgtcgaggaccgcctccagcggcaggtcctgggatgttcaccatcgtcgtctccaggatgtcgaagccggcgctgttggcgaacttgagcgtgaaagccggcggcttcagagagcagcagagtatcgcgtcgctgtgcttccagaacagcatcagtggagagtccgcgccttcggtgtccgaccagcggatctccgttccagtgtgcgccctgtagctcctgccaatccacgtagctagtgcaagtgcctcgggagagcccggcggatgcttcagttcgatacgcgaaccgaggcgagaaggagcgatcgcccatggccaccctctgcacggagggccatcacggcccctgacgtactgcttggccattgccgccacgctctcgcgaaggtggttctcgaacgagaactggaaggcgatggtcaggaccgatctcgtggcgcacgtgccggaaccatcgcatgaagcgcgcatgccgcttccacctgatccaacctcgagcgcagaggcaaggtcaagcgtgcgtgtggtggcggcagttggcacatccatcttagcatcaagcggtatcacacggaagcctgagggcagcaacggtgcatcgtcggcaaaagattcatcaataggagcaaagacaagctgtgcacacgcaccaggtgcatcctcgtcgacgccactgcacagctgtagaagaaacatatcccgggacataaagaacctcgtcatggctgaaaccatgtctttgaagtcgaataacctccaagcactcttcatgctccacggtgcgtgcaaggggtagtataacctggttgcccataaacccaccagcccttaaacccggaacagcatatgggttggccctcagagaggcagcggaataagcatcaacaccagggtcagcccattcagagcgatgctccttcaaaaatcgcacaagtagagcaggtggcacattctgcagtagcattgacgcttttgcgcacatgatgccgccccccatggcagaaaagaatggggaagggctgacatcagacccaataagtttgtttggagatgagttgattgtaattgaaatatcctcagcaccatcggtgttcaacaaacaagaccagccatcatctggaaagccactcacagcatcattgaagcctctgccggacgcgtgg

SEQ ID NO: 658 - DNA, 3186 bp, Zea mays
  Predicted polypeptide sequence is orthologous to G390, G391, G438
ggtccaatcaatttttcaggagcaaaccaggatccatcataagatagcaagcaagcgaagacgaacaactagtacaaagctgtttgttccacgggggtgatgaacaactacaaaggtgtgtttcataggttgcctggacacaggcaaaagcgacggtacatggggtacagagttcaaacaacagagccgcaaacgctaggcaacttggctctactgactactaggggaccgggttctcacacgaaggaccagttcacgaacatgaaggcaaggcagtgcggggtgtcgtcgtcgctcaggaccttccacgccaccgcctgctcgtacgacaccggccgccccatgctcgacacacacacgccaccggggaggtacgcgaagccctgttgcataatcttagggtactcggtgcagagcgcccttcctgccatcgtcatcaaggatcttctcaagggagatgtcctggagcgcaatcagcgtcgtctccagcatgtccaggccggcttggttggcaaaggtgaacacgggagcagccttcagggaacagcacatgatcgagtccgagtgttgccacagcgctttcaaggaagcatccgtgcatttgggtgtcccgtgcggaggagttcggctcccagtgtggaacctgtagctcctgccgatccaccttgccagcgtgtgtgcctcaggagatcctggagtttgcttcatttcaagctgtccaccaatgcgcgaaggagcctattgccatggctaccctctgcaccgatgccaccacggtcctgacgtattgcctggccatggctgcgacgctctctcgtaggtgattttcatatgagaactggaaagcaatggtcagcactgatcttgtgttgcaggtgctggaggcgtcactcgaaagcacgcgttgttccccaccagatccaactcgagggggtagatgcaaggtcaagtgtgcgtgtgcctgatggtggatccgtctttgcatcccagtggaatgacacggaagcctgagggtagcagtggcgcctcctccgcaaaagattcatcgatgggtgcaaacacaagctgtgcacatgccccagctgcattttcatccaccccactgcacaactgcagaagacacatatctcgtgacagaacaacttcgtcatggcagaggctgtgtccctcaagcctaataacctctaagaactcctcgtgctctaaaggtatgtgcaaccggcagaataacctggctgcccgtaaacccactagcacgcaaaccaggaactgcatatgacccagccctcaaagcagcagcggaataagcatcaacaccaggatcagcccatttgggagcgatgctccctcagaacccgtactagtagggcaggtggcacattctgaagcagcattgatgccttagcacacaggatgcctcctccaattgcggtaaacagctgggaggagttgacatgaggaccaataagtttgtttggagaagagttgatagcaatagtaacatcctcagcaccgtcactgctcatcagtgaccaaccatcatctggaaacccattgacagcatcattgaaacccctgctaagcctctggctaaatgttcttaaaactgctggctgtcggccccctaagggaggcatttcccccactcgattcatgcgcaatttgcctaatgtgacgcagtgcagcaatagttgttttctgtgcaagaatctttggggattcataaagtggtctaaggacctcaggcacactccaagcatctaaatcaacatgatccacaatgtgaatcatggagccacctccctcaccagggtcgaattagatagccactaggaagcacttcggctcttacaaaatttggagtgttgggtcctgatggacctccagtcgattgtgttagtgatctctcacagatcacaagactgccatcctcaagaccactagtgtatcggagagtccaaaagtcgcgcggtgccgccaaagttgtcggtgcgtaagtctgcatgtagataagctcgatagttccaccattacccgtagggataacatggagaatatccacacaccgacaatcgcggtaccaagaagggcgatccttgaggatctccgcgacctttgtgggctcaaggctcactaggccgcaagctcgggctgctacgccactacaattgtgcgaaacagcgatgattccaatggaatccggaccaggcttcatcccaaccatttgcacccaatcgacagcagttcctgttgctttcgacaggaactctgccaaggtctcctcagcaatagctagtagaccagctgggttattcgcgtcccgctgaggacgcgggagctgctgggttttgctgttggtggtgctgaccacttgtgaccacagactcgcagctcgtgtctgtagtcgcagcagaaggattatggagctgctgtcgcatgtacccattctcgtagacgagtcgggagacctgcttctgcagcctgtcattctcctccatcaacagcttgttcattgcagtcagcttccggttcacagtctgcaggcgcgaggcctccttccgctgcttctcgcggcatctgcggttctggaaccagacccttgatctgcttgggctcgatgttgctgagtatggggcactccctgatgagctgctgcctgcgcagcgagctgggtttggggcactcgctgtagacgcgctcgagcgcctcgacctgctcgggggtgtagcgcacgtacttgcccgtgtccacctgcggcgccgccgccgccgccgggcgacggccggtccttgccgcccccgaccaccgccagcgccgtcgacatctggctagcaccgccgcccagggaggagtcggagtcggaggaggaggggttgtcgtcgtcgcggggagacggagaatacggagagccacggccacgggcggcgccgagtcatagcctcggggcgagagcgcagccgcccgacgccatggtggtggtgcgagagagagagagagagagagagagagacgagagagagagaggagtggcggcggtgctggggggttgtgcagctgttgcttgcttggctgcctgccgagccgcgcggcgcgcggggagggtgaggaggaggacggaggggaggagcagcggggggaaagggaaagctagcggcgagacggggatgggagagcccggccggcctc

SEQ ID NO: 659 - DNA, 721 bp, Zea mays
  Predicted polypeptide sequence is orthologous to G390, G391, G438
  misc_feature (512)..(512): n is a, c, g, or t
gtcagccacggtgctcctgctgctggtccggaggcagccacgcttgcaagatggatctgccagagttacaggttccatttcggggctgagcttatcaaatccgcagacggtagcggctgtggtgaagcagtgctgaaaactctctggcaccatgccggcgctatactctgctgctctctcaaggccttgccagtgttcacgttcgcgaaccagtccgggctcgacatgctggagacgacgctggtggcgctgcaggacatcgcgctggagagagtgttcgacgaccaagggaggaagaacctgtgcgcggagctccccggcgtcatggagcaggggttcgcgtgcgtccccggcgggatgtgcgtgtcgggcctaggccggccggtgtcgtacgagaaggcgctggcgtggaaggtgctcgacgacggcagcggcggcgtgcactgcgtctgcttcatgttcgtcaactggtcgtttgtgtgacgcgtctgctaccaggtccgtcgcgctcnaggggaaaatcagttgatcggtgacgtgcttgagggtacgtacgtctcaaatcgccctttggttattgggatgtaaaatggtttcggttttttttttgttttttttttgaagaaaaatgtgaaatggtagaaggaaggacctgaatagcagtattgtacacggatggatcgtgtgatgtcaaacaagaatgactttttgtttgatggtg

SEQ ID NO: 660 - DNA, 674 bp, Zea mays
  Predicted polypeptide sequence is orthologous to G390, G391, G438
tccaatggcggccttgcgctatctcaggcaggttgctcacgaagataccgcccattctgtgataaccgggtggggacggcagcctgctgctctacgggctctgagccagaagctcaccagagggttcaatgaagctctgaatgggctcgctgacgacgggtggtctgtgatcggaagtgacggggtggacgatgtctgcgtctctgtcagttcatccccgagtagagtggtcagctgcaatgcaactttcagtaccggacctgtagtcggcactggcagcagcagtgtgctctgcgcaaaggcatcgatgctgagctaggacgtttctccgccagagctcctgcgcttcatgcgggagcagcggtcgcagtgggccgacagcaatctagacgcgttcttcgcttctgcgatgaaaccggatttctgcagcttgcctattcctcctcgccttggagggtttggtggccaggtcatacttcctctagcccacacgtttgaccctgaagaattcctcgaggttataaaagtaggaaatgccggtaactaccaagacgcgctcctgcaccgtgatctgtttctgttgcagatgtacaacggggtagacgagaacatggcaggcacttgttcagagctcatgctttgcccctatagacgcatcgttcagcgacgactcg

SEQ ID NO: 661 - DNA, 467 bp, Zea mays
  Predicted polypeptide sequence is orthologous to G390, G391, G438
ggttccagaaccgcaggtgccgggagaagcagcggaaggagtcgtcccggctgcaggcggtaaaccggaagctgacggccatgaacaagctgctcatggaggagaacgaccgcctgcagaagcaggtctcgcagctcgtctacgagaacggctactaccgccagcagacgcagagcgcggggctggcgaccacggacacgagctgcgagtcggtcgtcaccagcggcccccagaacgtggccgcggtgctgccacaagcccagccgcgcgacgcgggccctgccgggctcatgtccatagcggaggagacactgacggagtttctgtccaaggccaccggcaccgccgtcgagtgggtccagatgcccgggatgaagcctggtccggattctattggaatcattgccatctcgcatggctgccccggtgtcgccgcgcgagcttgcggcctcgtgggcatggagcct

SEQ ID NO: 662 - DNA, 558 bp, Zea mays
  Predicted polypeptide sequence is orthologous to G390, G391, G438
  misc_feature (278)..(278): n is a, c, g, or t
  misc_feature (522)..(522): n is a, c, g, or t
gaccatctagatctcgaagcatggagtgttcctgaagtgcttcgaccactgtatgagtcttctagagttgttgctcagaaaatgactactgtggcactgcgccaccttagacaaattgctcaagaaacaagtggagaagtagtgtacgccttgtgaaggcaacctgcagtcctacggacctttagtcaaagactaagcagggggtttaatgatgccattagcggtttcaatgatgatggctggtctgtaatggggggagatggcattgaagacgttgntattgcttgcaactcaaccaagaaaattaggaataccagcaatgctgggattacatttggagccccaggaggcattatttgtgcgaaggcatccatgttactgcagagcgtcccaccggcagtactggtacgatttctgagggagcatagatctgaatgggctgattacaatattgatgcgtatttggcttcatcattgaagaccagtgcgtgctcacttcctgggttgcgacccatgagattntctgaggggcagatgatcatgccacttgctcacaca

SEQ ID NO: 663 - DNA, 500 bp, Lycopersicon esculentum
  Predicted polypeptide sequence is orthologous to G390, G391, G438
atccttgttctgttgtaacctttaaaatgcactctttactaaactaggtgattgtggaggtggtacatatgtttacatgttgctggaggtcattaagttggaaggagtttgccattccccagaagacgttataatgccaagagatatgtttctattgcaattgtgcagtggaatggatgaaaatgctgttggtacctgtgctgaactcgtttttgctccaatagatgcctcatttgccgatgatacaccactccttccttctgggtttcgcattattcctttagactctgctaaggaagcctccagtccaaatcgcacccttgatcttacttctgctcttgaaactgggccagtaggaagtaaggtggctaatgatctcaagtcaactggtggcacatcaaaatctattatgacaattgctttccagtttgcatttgaaagccacatgcaagagaatgttgcatcaatggctagaaaatatgtacgaagcttcatttcat

SEQ ID NO: 664 - DNA, 370 bp, Oryza sativa
  Predicted polypeptide sequence is orthologous to G391, G438
aattgctgcgtgagtgccccatacttgctaacattgagcccaagcagatcaaggtctggttccagaacagaaggtgccgggataagcagcggaaggagtcttcacggcttcaggctgtcaacaggaaattgacggcaatgaacaagctacttatggaagagaatgagcgactccagaagcaggtctcccaattggttcatgagaatgctcacatgcgacagcagctgcagaatactccgctggcaaatgatacaagctgtgaatcaaatgtgactacccctcaaaaccctttaagggatgcaagtaacccctctggggctcctttcaattgcagaggagaccttgacagagttcctctcaaaggctactg

SEQ ID NO: 665 - protein, 148 aa, Oryza sativa
  Orthologous to G390, G391, G438
MAASDRPPAQDCRGEGGNFGGGGGRSGGWRQRWRCPMRSGSGSDGSGYDKAGMDSGKYVHYTPGQVEALERVYAECPKPRFSRRQQLLCELSILANIEPKQKIKVWFPKQKWKELIGVPLLKWLLCILIVSHVCFISVFKGLALLKVV

SEQ ID NO: 666 - protein, 886 aa, Oryza sativa
  Orthologous to G390, G391, G438
MDASKYVRYTPEQVEALERLYYECPKPSSLRRQQLVRECPALANVDPKQIKVWFQNRRCREKQRKESSRLQALNRKLTAMNKLLMEENDRLQKQVSQLVYDHGRHGVAAAGMMRRVPAFPPQAAAAAGHQLATATDTSCESVVTSGHHHQQQQHNVVQPPPRDASPAGLMSIAEETLTEFLSKATGTAVEWLQMPGMKPGPDSIGIIAISHGCAGVAARACGLVGMEPAKVAEILKDRPLWLRDCRSMDVVNVLPAGANGTIELLYMQARTHKPENSEPEPEILKLKFVFDLQLYAPTTLAPARDFWLLRYTSILDDGSLVVCERSLSSKQGGPSMPLVQPFIRGEMLPSGFLIRPSDVGGSVIHIVDHMDLEPWSVPEVVRPLYESSAMVAQKISMAALRYLRQVAHEDTRSVITGWGRQPAALRALSQKLTRGFNEALNGLADDGWSVIESDGVDDVCISVNSSKVIGCNATFSSGLPIVSTGVLCAKASMLLQDVSPPSLLQFLREHRSQWADSNLDAFFASTMKPNFCNLPMSRLGGFSGQVILPLAHTFEPEEFLEVIKLGNASNYQDTLVHRDLFLLQMYNGVEESSAGTCSELIFAPIDASFSDDSPLLPSGFRIIPIDSPLDTSSPNCTLDLASTLEAATPRSRISGVNGGGGGCAAAAASSSSKAVMTIAFQFAFDGHLQDSVAAMARQYMRNIISSVQRIAVALSSSRLVPPGAGAAAAQLSPVTPEAATLPRWICQSYRFHFGDELIKSVDANSSNESILKAVWHHPSAILCCSLKAMPVFTFANQSGLDMLETTLVALQDMTLEKVFDDQGRKNLCTELPNIMEQGMACMEGGVCVSSVGRAASYEKAVAWKVVDGDGGGAHCICFMFINWTFL

SEQ ID NO: 667 - protein, 855 aa, Oryza sativa
  Orthologous to G390, G391, G438
MAAAVAMRSGSGSDGGGGGYDKAGMDSGKYVRYTPEQVEALERVYAECPKPSSSRRQQLLRDCPILANIEPKQIKVWFQNRRCRDKQRKEASRLQAVNRKLTAMNKLLMEENERLQKQVSQLVHENAYMKQQLQNPSLGNDTSCESNVTTPQNPLRDASNPSGLLTIAEETLTEFLSKATGTAVDWVPMPGMKVDCQLLRFTLPASNDPGPDSFGIVAVSHGCRGVAARACGLVNLEPTKIVEILKDRPSWFRDCRSLEVFTMFPAGNGGTIELVYMQMYAPTTLVPARDFWTLRYTTTMEDGSLVVCERSLSGSGGGPSTASAQQFVRAEMLPSGYLVRPCEGGGSIVHIVDHLDLEAWSVPEVLRPLYESSRVVAQKMTTAALRHIRQIAQETSGEVVYALGRQPAVLRTFSQRLSRGFNDAISGFNDDGWSVMGGDGIEDVIIACNAKKVRNTSTSANAFVTPGGVICAKASMLLQSVPPAVLVRFLREHRSEWADYNFDAYSASSLKTSSCSLPGLRPMRFSGSQIIMPLAHTVENEEILEVVRLEGQALTHDDGLMSRDIHLLQLCTGIDEKSMGSCFQLVSAPIDELFPDDAPLISSGFRVIPLDMKTDGTPAGRTLDLASSLEVGSTAQPTGDASMDDCNLRSVLTIAFQFPYEMHLQDSVATMARQYVRSIVSSVQRVSMAISPSRSGLNAGQKIISGFPEAPTLARWICQSYQFHLGVELLRQADDAGEALLKMLWDYEDAILCCSFKEKPVFTFANEMGLNMLETSLVALQDLSLDKIFDEAGRKALYNEIPKLMEQGYVYLPGGVCLSGMGRHVSFEQAVAWKVLGEDNNVHCLAFCFVNWSFV

SEQ ID NO: 668 - protein, 806 aa, Oryza sativa
  Orthologous to G390, G391, G438
MAAAVAMRGSSSDGGGYDKVSGMDSGKYVRYTPEQVEALERVYTDWPKPTSSRRQQLLRECPITANIDPNRSRCRDKQRKESSRLQAVNRKLTAMNKLLMEENERLQKQVSQLVHENAHMRQQLQNLYQLGPYASVPLELIYELILRMLLSIAEETLTEFLSKATGTAIDWVQMPGMKPGPDSVGIVAISHGCRGVAARACGLVNLEPTKLYAPPPLVPARDFWTLRYTTPMEDGSLVVCERSLSGSGGGPSAASAQQYVRAEMLPSGYLVRPCEGGGSIVHIVDHLDLEAWSVPEVLRPLYESSRVVAQKMTTAALRHIRQIAQETSGEVVYALGRQPAVLRTFSQRLSRGFNDAISGFNDDGWSIMGGDGVEDVVIACNSTKKIRSNSNAGIAFGAPGGIICAKASMLLQSVPPAVLVRFLREHRSEWADYNIDAYLASTLKTSACSLTGLRPMRFSGSQIIIPLAHTVENEEILEVVRLEGQPLTHDEALLSRDIHLLQLCTGIDEKSVGSSFQLVFAPIDDFPDETPLISSGFRVIPLDMKTLELIEAFGFKYSLGKIKQDGASSGRTLDLASSLEVGSATAQASGDASADDCNLRSVLTIAFQFPYELHLQDSVAAMARQYVRSIVSAVQRVSMAISPSQTGLNAGQRIISGFPEAATLARWVCQSYHYHLGVELLSQSDGDAEQLLKMLWHYQDAILCCSFKEKPVFTFANKAGLDMLETSLVALQDLTLDRIFDEPGKEALFSNIPKLMEQGHVYLPSGVCMSGMGRHVSFDQAVAWKVLAEDSNVHCLAFCFVNWSFV

SEQ ID NO: 669 - protein, 880 aa, Physcomitrella patens
  Orthologous to G391
MTETWKDQTMDASGKYVRYTQEQVEALERVYHECPKPSSIRRHQLIKESPILANIEPKQIKVWFQNRRCREKQRKEATRLVSVNAKLTALNKLLMEENERLAKHTSQLTLENHALRQQIPNLPFPDGRHRLPSQILQSPLKKEGAVNGGDESSTQGGICVKVHGQAGIASTDTSCDSAVTGGLPHRLTPQHSPRDSSPAGLLATAEETLTEFLAKATGTAVDWIQLPGMKPGPDAIGIIAISHGCVGIAARACGLVALDISKVTEVLKDRPRWLQDCRRMEILGALPTGNGGTIELLYTQMYAPTTLAPARDYCTLRYTTILEDGNVVICERSLSGVQGGPTMPPVQSFVRGEMYPSGYLIRPCDGGGCIIHVVDHYNNEPRSVPEVLRPLYESPAVLSQKSTLAALRHLRRLAAEESGEGVPRNGQHPAVLRTLCQRLTKGFNNAVNGFPDDGWEATISDGLDDVSVMLNATPKSMEGQIASDKLLYSLGGGILCAKASMLLQNVPPSLLIRFLREHRSEWADYDIDANVASFRSNGNGYVPRCGGVSHVQLPLPLAYSGESGEILEVVKVEGHSSVQHMVLSRDTFLLQLCSGVDESAVGACAQLVFAPVDVALADDIPLLPPGFCVSPIDTNVVDGFGLDRTLDLASTLEGGNDLRSNGDAKSSNSPGQMRSVLTIAFQFAYEVHTRETVAAMARQYVRNVVASVQQVAMALAPSRGAPPPRQVPSNPDALSLVRHVLSSYRFHMGIDLIRPENGSDEALFKAFWHHTDAIVCCALKGIPEFVFANRSGLEMFETATASSLKDLDWEKTLNENDRKLSYATFTHVLQQGYCSLPAGVRMSSTGRTATYEQALAWKVLNDSEAVECIAFLFINWSLAT

SEQ ID NO: 670 - DNA, 1896 bp, Glycine max
  Predicted polypeptide sequence is orthologous to G409
gtcgacccacgcgtccgccctcgcgtccgcccacgcgtccgtacgggcgagaagacgccagaagggggaactccaaaacacaaacaaaaactcccgttttctctctctgtttttccatggccatctgatcaaacttttcttgattctctctctcagtttttgctattctgagtgatgggtatgccctgccgctgttcccacacctcccacatcactgaaatcatcatcaccagcttcttccgccacaagtcttaaattacaacaatttccctcaattattcatcaaccaaccaccttaatagccttttccaatggttccttaaagatccaacttggtcggagtaaacatggcggctagtggaagttccttttccaacatcactagcttccttcgcaaccaacaaccctcttcccaacctctcgattcttctctcttcctctctgctccttcaatttttgtttcaggttcgagatccatggtgagttttgaagcagaaggagggaaggggtgtaacggctccttcttccgcgcgtttgacatggacgacaatggggacgagtgcatggatgagtactttcataaacccgagaagaagcgtcgtctctccatgaaccaggttcagtttctggagaagagtttcgaggaggagaacaagcttgaaccggagagaaagaccaagcttgccaaagaccttggtttgcggccacggcaagttgctatttggttccagaaccgtcgagctcgctggaagaccaagacgctggagaaggattacgaggctctgcatgcaagttttgagaatcttaagtccaactatgacagcctcctcaaggagaaagacaacttaaaagctgaggtggcgagcctcaatgagaaggtgcttgcaagagggaaacaagaggggcacatgaagcagcaggctgaaagtgaagaagaaacaaaaagattattgcatttgcaggaacaggaaccaccccagaggcttttactggaatcagtttcggagggagaaggatccaaagtctcttctgttgtcgggggttgtaaacaggaagatatcagttcagccaggagtgatattttggattcagatagtccacattacaccgatggagttaactccgcactgctagagcatggtgattcttcttatgtgtttgagcatgatcaatcggatatgtcacaagatgaagaagataacctcagcaaaagtctctacccttcgtacctctttcccaaacttgaagaagatgtggattactccgacccgcctgaaagttcttgtaattttggattttctgaggaagatcacgccctttggacctgggcatactaagttttcttccatgttcatgtgtgtgtttgtgtcatatgtttttttagtaattagtatttagtatttgcactttttgtccaggcttcaaaaatggctatagctttagctttatcaggaaagaaatgtttgttttctttttgcctcattttgttagtacttgtaatcaaactgttggttccaatgtaattaaataatgtcttctcgttgagaatgtaactatggatttcatttaatttcactaagaaaatcaagtaagaaacttgatgaaatggggaaaaaaaaatggaagccaattgcttggtagagtggaaaagattgaggcctatagtatttatactatttaagatgactatgattcattgattcttcttcacttgggttctggacttctgggtccatgttgttttgattggtaagcaaccctgcatgacgaagttgacttgcttgcacctttgcaatactttcctacttgagagcatttaagttttgtgacagaaggggtgtcactttcactatgaattggacaaaaatggccactctccattggatgaggatcacc

SEQ ID NO: 671 - DNA, 1042 bp, Glycine max
  Predicted polypeptide sequence is orthologous to G409
cggtccggaattccccggtcgacccacgccgcacaaacacatacaaacatagtatccgcttctctctctctctctctctctctttttccatgtccatctgataaccctttcctgattctctttcgtggttgttgctattctgagtgatgggtatgccctgccgctgttcccacacctcccacatcactgaaatcatcatcaccagcttcttccgccacaagtcttagatcaacaatttccgtcaattattccaaaaccaccttaagagccttttccaaatggccccttaaagatcgaacttggtcggagtaaacatggcgggtagtggaagtgccttttccaacatcactagctttcttcgcacccaacaaccctcttctcaacctctcgattcttctctcttcctctctgcaccttcctctgctcctttcctcggttcgagatccatgatgagttttgaaggagaaggagggaaggggtgtaacggctccttcttccgcgcgtttgacatggacgacaatggggatgagtgcatggacgagtactttcatcaacccgagaagaagcgacgtctctctgcgagccaggttcagtttctagagaagagcttcgaggaggagaacaagcttgaacccgagagaaagaccaaactggccaaagacccttggtttgcggccacggcaagttgctatttggttccagaaccgtcgagctcgctgggagaccaagccgctggagagggattacgaggctctgcatgcaagttttgagaatcttaagtccaactatgacagcctcctcaaggagaaagacaacttaaaagctgaggtggcgagcctcaatgagaaggtgcttgcaagagggaaacaagaggggcacatgaagcagcaggctgaaagttcttgtaattttggattttctgaggaagatcacgccctttggacctgggcatactaagttttcttccatgttcatgtgtgtttttgtgtcatatgtttttttagtaattagtatttagtatttgcactttttgtccaggctt

SEQ ID NO: 672 - DNA, 1772 bp, Glycine max
  Predicted polypeptide sequence is orthologous to G409
tacggctgcgagaagacgacagaagggggaagaatctctctttatttctttcactctctcagaaccaaaattttccaaactcctcaactctcatcagatatcaaccttctctctctccaaactctcgcacctttctgctctgcccttcaatttattcatctctgacaccctcttaattctgcttccagttcctctgagtgatgggttcaaaacccgtggttgattttgagaatgtaagtgggagcaggatgacggataggcctttttttcaagcgttggagaaggaagagaactgtgatgaggattacgaggggtgtttccaccaaccggggaagaaaaggaggctcacaagcgaacaagttcagttccttgaaaggaactttgaggtagagaacaagcttgaacccgaaaggaaggtccaacttgcaaaagagcttggcttgcagccaaggcaagttgctatatggttccaaaaccgaagggcaaggttcaagaccaagcagctagaaaaagactatggcgtgttgaaagctagttatgacaggctcaaaggtgactatgaaagtcttgttcaagagaatgacaagttaaaagcagaggtgaattctctggagagcaaattgattctttgttaaaagcagaggtgaattctctggagagcaaattgattcttagagataaagagaaggaggagaattcggatgacaagtcatctcctgatgatgctgtcaattcttcaccccacaacaacaaggagcctattatggatttattaatttcaaaaaatgcaacaacatctgaaaatggaaccgaagtgtcaacactcccactccctattatggtaacatgcaagcaagaagatgccaattcagccaaaagtgatgtgcttgattcggatagcccacattgcactgattatgggaaccacccttcctcattcgtggagcctgctgattcctctcatgcctttgaaccagaagaccactcagaagacttctcacaagatgaagaggataaccttagtgaaaactttttgaccctcccttcttcttgttgcttacctaaggttgaagaaccctgctatgatgaccctccagaaaactcttgtaattttggcttccatgttgaggatcaaaccttctgtttctggccctactgaaccaaccaaccaaccaaccgcttccaatgttataaaaacttcgcagttgtaaccatgtactagaaatcaataaaaatggtattgttacttctactaaggaataaaaatcagaaggctaatgcaatgcatcatgctatcatcactggtggtgttaatagttagcagtgaaagtgtaacacaatgttactactagctaaaattcaaaaacttggttcaggtgtgcgcgtaggtatcccaaaatttcaggtggggtacagcaaccaatcgttgttttactttcggatgtggaaaatggaaaccctgttttctctttctctctgcactcctctggatcacaccgttgttttactcatgtattaggaagaccctttcatcatgattcacctgtcctcactgctcagcataaagttacagttttatatgcgtcccagtaatcattagagtcatcatagcaaccagagtttgagtagattaaataagatctcacattcaaattttcctgttgttattggacactgagaaaaacttgtgtctaagttgatgatgattatgtaagaaatatttggcatattttaatgaaattgaaaaactaaataaaaaaaaaaaaaaaagg

SEQ ID NO: 673 - DNA, 1625 bp, Glycine max
  Predicted polypeptide sequence is orthologous to G409
ttaagagggtttctctctctttatttctttcactctctcagaaccaaaattttccaaactcctcaactctcatcagatatcaaccatctctctctctccaaactcaaatacctttctgttctgctcttcaatttattcatctctgacaccctcttaattctgcttccagttcctctgagtgatgggtatgatctctcctcactcccacaattcccacattatagtaatcctcatcacctgcttctttcgtcataaattctagatcaaactccactccctgatcctcccttttacttcttatgtagcatgtatgaactcaaatcatcaaatgaatatgaccctttaatctaagaagaagaaaaaaacacacacatacacacacacactttaaagtccaaagtctaaaccaacccaccaaaagtcttgttcccatggcgagtggcaagctttatgcgggttcaaacatgtcacttctcctccaaaacgaaaggctcccttgctcctctgaagtccttgagtctctttgggctcagacctctaaccctgcttccttccaaggttcaaaacccgtggttgattttgagaatgtaagtgggagcaggatgacggataggcctttctttcaagcgttggagaaggaagagaactgtgatgaggattacgaggggtgtttccaccaaccggggaagaaaaggaggctcacaagcgaacaagttcagttccttgaaaggaactttgaggtagagaacaagcttgaacccgaaaggaaagtccaacttgcaaaagagcttggcttgcagccaaggcaagttgctatatggttccaaaaccgaagggcaaggttcaagaccaagcagctagaaaaagactatggcgtgttgaaagctagttatgacagactcaaaagtgactatgaaagtcttgttcaagagaatgacaagttaaaagcagaggtgaattctctggagagcaaattgattcttagagataaagagaaggaggagaattcggatgacaagtcatctcctgatgatgctgtcaattcttcttcaccccacaacaacaaggagcctatggatttattaattatttcaaaaaatgcaacaacaacaacaacatctgaaaatgggaccaaagtgttgtcaccactcccactccctattatggtaacatgctgcaagcaagaagatgccaactcagccaaaagtgatgtccttgattcggatagcccacattgcacttcattcgtggagcctgctgattcctctcatgcctttgaaccagaagaccactcagaagacttctcccaagatgaagaggataaccttagtgaaaaccttttgatgaccttcccttcttcttgttgcttacctaaggttgaagaacactgctatgacggccctcctgaaaactcttgtaattttggcttccaggttgaggatcaaaccttctgtttctggccctattgaaccaaaccaaccaaccaaccgctagcaatgttttaaaaaactttgcagttgtaaccatgtactagaaagcaataaaaatggtattgttacttctactaaggaataaaaaaaaaaaaaaaaaaaaaggacgaccgctaagggggacccctgtatagg

SEQ ID NO: 674 - DNA, 1240 bp, Glycine max
  Predicted polypeptide sequence is orthologous to G409
cttcaatttattcatctctgacaccctcttaattctgcttccagttcctctgagtgatgggttcaaaacccgtggttgattttgagaatgtaagtgggagcaggatgacggataggcctttctttcaagcgttggagaaggaagagaactgtgatgaggattacgaggggtgtttccaccaaccggggaagaaaaggaggctcacaagcgaacaagttcagttccttgaaaggaactttgaggtagagaacaagcttgaacccgaaaggaaagtccaacttgcaaaagagcttggcttgcagccaaggcaagttgctatatggttccaaaaccgaagggcaaggttcaagaccaagcagctagaaaaagactatggcgtgttgaaagctagttatgacagactcaaaagtgactatgaaagtcttgttcaagagaatgacaagttaaaagcagaggtaaaagaaattaagaagaaaaaagagagagacacacacaacacatacttacactcaattttgcttttgtgctttatgctactagtactacttgctttaataaagtgcaatctttattatttatcccactaatgggttaatgattggattggcacaaaatttttgttactgacaggtgaattctctggagagcaaattgattcttagagataaagagaaggaggagaattcggatgacaagtcatctcctgatgatgctgtcaattcttcttcaccccacaacaacaaggagcctatggatttattaattatttcaaaaaatgcaacaacaacaacaacatctgaaaatgggaccaaagtgttgtcaccactcccactccctattatggtaacatgctgcaagcaagaagatgccaactcagccaaaagtgatgtccttgattcggatagcccacattgcacttcattcgtggagcctgctgattcctctcatgcctttgaaccagaagaccactcagaagacttctcccaagatgaagaggataaccttagtgaaaaccttttgatgaccttcccttcttcttgttgcttacctaaggttgaagaacactgctatgacggccctcctgaaaactcttgtaattttggcttccaggttgaggatcaaaccttctgtttctggccctattgaaccaaaccaaccaaccaaccgctagcaatgtttttaaaaactttgcagttgtaaccatgtactagaaagcaataaaaatggtattgttacttct

SEQ ID NO: 675 - DNA, 1296 bp, Glycine max
  Predicted polypeptide sequence is orthologous to G409
  misc_feature (1172)..(1172): n is a, c, g, or t
  misc_feature (1179)..(1179): n is a, c, g, or t
cgtaagccccgcgtttgcgcccacgaaagcactcacaaagacacagagtgcgttcgttgacgacaaacacacacaaacacacaacaaaagctcgccggaaaatctttctccggcgacctggaattccgacgaaggtagttgcggctccttcgtcccgaaactgaggccctcaaagtataaactttggtggtggtgggtaggatctggcggtgtatgatgggatcttgcatatgcccgttggagactccggcgaggttgctttggaccacaagcttcttccgtcataagcttatgatcttctaataattaataattcacgcacacaaacaaacaaacaaacaaacaaaaaacacttcataacaacaacaacaacccttctgaaattctcaacacaagtttcaaaaaacagagtaaaagaaacagagcaaaaacacacacacaaaaacacaaacacagacaccttttaagtattaaggtgtctctttctctccccggaaagtttctccgtcggcggtggtgattgaccggagtgccatggagtctggacggattttctttggtgcctctgcttcaagcggcaacaacatgctctttctcggcaacactgaacttgcttttcgagggagatcgattatgagcatggaggaagcctcgaagaggcgacctttcttcacctcaccggatgaactgtatgatgaagagtattatgagaagcagtcgccggagaagaagcaccgcctcagttccgaacaggtccatctgttggagaagagctttgaggaagagaacaaattggagcctgagaggaagacccagttggctaagaagctgggattgcagcccaggcaggtggctgtgtggtttcagaaccgcagggctcgatggaagaccaagcaacttgaaagggattatgatgttctcaagtcttcatacgataccctactttcatcctatgattcaattatgaaggagaatgagaaactcaaatctgaggtggtatccttaaatgaaaagcttcaagttcaagctaaagaggtgcctgaggaaccattatgtgacaagaaagttgatccaattccagtagatgaagatatggctccgattttcggcacaagggtggaggaccacctgagtagtgggagtgttggaagtgcggtggtggatgaaggtantccacangtagttattaacaatatgtattcatacattctatctaacaactattataaatatataaacccgtatcgagagattcaatcggatgagaatgatagcagtaatgattatcagacgtgc

SEQ ID NO: 676 - DNA, 1033 bp, Glycine max
  Predicted polypeptide sequence is orthologous to G409
aagacccagttggctaagaagctgggattgcagcccaggcaggtggctgtgtggtttcagaaccgcagggctcgatggaagaccaagcaacttgaaagggattatgatgttctcaagtcttcatacgataccctactttcatcctatgattcaattatgaaggagaatgagaaactcaaatctgaggtggtatccttaaatgaaaagcttcaagttcaagctaaagaggtgcctgaggaaccattatgtgacaagaaagttgatccaattccagtagatgaagatatggctccgattttcggcacaagggtggaggaccacctgagtagtgggagtgttggaagtgcggtggtggatgagggtagtccacaggtggttgttgacagtgttgattcatacattctagctgacaactatggtggatgtgtgggcccggtcgagagggttcagtcggaggaggaggatgggagtgatgatgggaggagttacttggatgtgtttgtggtatctgaaactgagcaccaaaaccatgaggaaggagagacattgggttggtggactaatatgtattatgttggataaaatggtaatgcagcagtgctttcgaaattagatgcttaattaagaaaacgtaataatattgtataatgtatcatgtgggcgagggaggaaaaagtaaacgcctggattgggtggcttggacccctaggaggagttgaagtgtccttaacccgagtttaataaataaagtctagtagtaatttggtcaatggtgtcttgtgttggttaatggttgtactgccaaaattaaagtaagtatatttcttgttcaagtattaaaacatggttaattagtactatacaaaatttgggcggtttcttttttttttttgaatccaattttcgaaaaccattttgccaacttaatcaaaataaaatcgggggtaaggcccccaaaaaaggcaaagccctccccattgtcttgtaacccgtttcgaatagggcctattagcaaaaattattttccccccct

SEQ ID NO: 677 - DNA, 1740 bp, Glycine max
  Predicted polypeptide sequence is orthologous to G409
ggctcgagatcatccccgtattataaacccaggattgcctcttcttccaggaaccccctcaacaaaaggaaactctcattcaccttcttctctctccctcactccctctctttcttaatacaccaccttcccaaccctcttccattctccttctccaactccaacccctgcttcccttttttcattttctcactccccatcttctgagagtgatgggtgtttgctaccgctgttcccacacctcccacatcaccgccatcatcatcaccagcttcttccgccacaagccttagaattatactattcccaccctccctctttcttcaacaacaaccgttgacttcactacagtcacgtggtctttctctgaggatccaaccatggcggctggaactgtcttctgcgctgctgctactgctgcttctaatttgacaacaaccacttttcttcacaaccaaacacctccttccacctcctctcagcctcctctcgattctcttttcctctctgcctcttcccctttcctcggttcaagatctatagtgagttttggagatgttcaaggagggaaggggtgcaatgattcattcttccgcccctatgatgagaatggggatgaggacatggacgagtacttccaccagcctgagaagaagcgcaggctctccgtggagcaagtgaagtttcttgagaagagctttgatgaggagaacaagctcgagcccgagaggaagatttggctagccaaggaactcggcttgcagcctaggcaggtggcgatttggtttcagaaccgccgcgcgcgctggaagaccaagcagatggaaaaggactatgattccctgcaggctagttacaatgatctcaaggctaactatgacaaccttctcagggaaaaggataaactcaaagctgaggtggcaaggctcactgagaaggtgcttggaagagagaaaaatgagagtcacttggaacaggctgaaaccaacggattgcaggagccgctgcacaagtctttggttgattcagcttctgagggtgaagggtccaaagtgacctttgaggcttgtaaacaggaggacattagctcagccaagagtgacatatttgattcatcagaaagcccacaatacactgatggagttcactctgcacttctagagactggtgattcttcttatgtgttcgaacctgatcgatctgatgtgtctcaggatgaagaagataacttgagcaagacccttctgcctcattacatttttcccaagcttgaagatgttgattactccgacccacctcatggttcatgtaattttggaattccggaggaagatcaagccatttggtcttggccttactgaattttctctatagcatatagagcatgtctctaccttctactctcaagttcttctgtttaaacttgagatcatgtggtagaaaagggtgagttaataataagccaaagaaaaaatggcactctactggtttgttcccaatggtggtttcttgccagctttttttttttttttttttactttgcaatgtaacttttggttcaaatgtaaataaataatatcttcttgttgaggatgtagctctgaatatcacttcaaggatgaatttacatagcaaattagatgagaaaaatgggaagataaaaaaaggttatgttttcaaaaaaaaaaaaaaaaaaaaaaaaaaaaaaaaaaaaaaaaaaaaaaaaaaaaaaaaaaaatt

SEQ ID NO: 678 - DNA, 1858 bp, Oryza sativa
  Predicted polypeptide sequence is orthologous to G409
ttgacgcctgggcggacgcccataaaaatcccaaaaacaaaaaataataaaaaaaaagaaagagagagacatttcgcatctgctgccctgcctcctctcccatcacctgcccattttttcacattgaggcccctctgaaaatattatatttacaactaggtccctggccgggccggccggccaccggaaggagcacctcgccggagaaggctttgtctcttctttttcttctcctcctcctcctccatcggcggcggcatggggttctcgctgtaccccatgaagacgtcgacgcgcatgctgtggagcaccagcttcttccgccataaggtcgcctcctccttctaagcccacgccctctcgggcggcggcggcgagccggcggcggagcgcgcggttggtaggtgcgcgtgcgtgcgtgaacgggagagcagcttcgagatcgggttttcttgggttcttggagaagggaggagaagagggggaggagagcatggatcccggccgcgtcgtgttcgactccggcgtggcgcggcgggcgtgccccggcggcgcgcagatgcttctcttcggcggcggcggcagcgccaacagcggcggcttcttccgaggcgtgccggcggcggtgctggggatggatgaatcgcggtcgtcgtcgtcggcggcgggggcgggggcgaagcggccgttcttcacgacgcacgaggagctcctggaggaggagtactacgacgagcaggcgccggagaagaagcggcggctgacggcggagcaggtgcagatgctggagcggagcttcgaggaggagaacaagctggagccggagcggaagacggagctcgcccgccgcctcggcatggccccccggcaggtcgccgtctggttccagaaccgccgcgcccgctggaagaccaagcagctcgagcacgacttcgaccgcctcaaggccgcctacgacgccctcgccgccggccaccatgccctcctctccgacaacgaccgcctccgcgcgcaggtatctcattaaccgagaagctgcaagacaaggagacgtcgccgtcgtcggcgaccatcaccaccgcggcgcaggaggtcgaccagccggacgaacacacggaggccgcgtcaaccaccggcttcgccaccgtcgacggcgcattggcggcgccaccgcccggccaccagcagccgccgcataaagatgatcttgtgagcagcggcggcaccaacgacgacggcgatggcggcggcgcggccgtggtggtcttcgacgtcaccgagggcgccaacgaccgcctcagctgcgagtcggcgtacttcgccgacgccgcggaggcgtacgagcgcgactgcgccgggcactacgccctctcgtcggaggaggaggacggcggcgcggtcagcgacgagggctgcagcttcgacctccccgacgccgccgccgccgccgccgccatgttcggcgccgccggagttgtgcaccacgacgccgcggacgacgaggaggcgcagctcggcagctggaccgcctggttctggagctgatcgatggaagcatggagcattggagccatgctatcaatgaatgaatgaatcaaatgaccttgagaccctcctctccgtcctttcttttgccctatttttaatcgctgttatatgttaattatgtgcaattaaagtgtacgtgttttgtcgtaagttgtgtttgttcaaattgtatgttttgaaggtgtcatgtattcatacacgatatgatatatagacgggatcatgaatgatactcggaaagattggaataaaaaaaaaaaaaaaaaaaaaaaaaaaaacattttcctccggggggcctcgtgcaaaaaaa

SEQ ID NO: 679 - DNA, 1926 bp, Oryza sativa
  Predicted polypeptide sequence is orthologous to G409
gtccggccccccgcgtccgcccacgcgaaaaaaatattataggaaataaaaaataatttcctggttagaataaacacatttttaaaaaaaccaagaaaagattttcctcttctgttacattccttcttccttctccggccaccggagccgtagccgaattgtgcctcttctccggcgaggggagagggagagagggggtgtgagttttgctccttccggcgagtggtctcctccccgcgcggctgaggagatctctcgggacatcggggttggggcggcgtgcatgatggggttctcgctcacgccgatgaagatctccacgaggcttctgtggagcaccagcttcttccgccacaagatcgccgccaccatcgcgtcctcctcctccttcttataagatcatcttctccgccacagcaatctgtaaatatatacacatcgaacgcgacaagcgcgtttgattgattggatttttctcccctctcctcacgacaagtaattaaggcgcgcgatctcgatctctagcgttgagaacttgatccgcgatggagtccggccggctcatcttcagcacggcgggctccggcgccgggcagatgctcttcttggactgcggcgctggcggcggcggcgtcggcggcggggccatgttccatcgaggggcgagaccggtgctcggcatggaggaaggagggcgcggcgtcaagcggcccttcttcaccacccccggcacgaggctcctcgaagaggagtactacgacgagcagctcccggagaagaagcggcgcctcacgccggagcaggtagatactccagctagctagctaagctgtaaagatcggcggcgcgcggtgctctgttcccgagttgtgacgtgacgactggatcgatcggcgtcggcgtgtgtgtatgtatgtgcatctgctggagaggagcttcgaggaggagaaacaagctggagccggagcggaagacggagctggcgcggaagctatggctgcagccgcggcaggtcgccgtgtggttccagaaccgccgcgcgcgctggaagaccaagcagctcgagcgcgacttcgaccgcctcaaggcgtcgttcgacgccctccgcgccgaacacgaagccctcctccaggaaaaccaccgcctccactctcaggtgagctagctacgcccgccgcccgcgccaccgcccaaccgcgcgttatcctcgatccgatttggccgggctccttgattctgactgaattcgtggtgatcttgtgccgtcaggtcatgttctttgaccgagaagctgccagagaaggagacgacgaccgagggcacccccggcgccggccgttgacgtccccgggctgccctgcggccgccgacgtgaaggtccccgtcccggacgccgaggaaccggcgctggaggaggcggcggcggcgttcgaggagcagcaggagcagcaggtgaaggccgaggacaggctgagcacgggcagcggcgggagcgcggtggtggacacggacgcgcaactggtggtcgggtgcggccggcagcatctcgccgccgtggacagcagcgtggagtcgtacttcccgggcggcgacgagtaccacgactgcgtgatgggccccatggaccacgccgcggggggcatccagtcggaggaggacgacggcgccggcagcgacgagggctgcagctactacgccgacgacgccggcgtccttttcgccgaccccggcccccccccccccccccaacacgcggacgacgacgaggagggcgggccccccgatcagctgctggtggatgtggaactagatttctcgcgcgcgcgcgtcgtcgggccttcaattctcgtgttaaaaaaaatcgttctctttttcctttttcaaaaaaaaggggggcccggcacccaatccctcccctcccccccc

SEQ ID NO: 680 - DNA, 1500 bp, Oryza sativa
  Predicted polypeptide sequence is orthologous to G409
cagcaatctgtaaatatatacacatcgaacgcgacaagcgcgtttgattgattggatttttctcccctctcctcacgacaagtaattaaggcgcgcgatctcgatctctagcgttgagaacttgatccgcgatggagtccggccggctcatcttcagcacggcgggctccggcgccgggcagatgctcttcttggactgcggcgctggcggcggcggcgtcggcggcggggccatgttccatcgaggggcgagaccggtgctcggcatggaggaaggagggcgcggcgtcaagcggcccttcttcaccacccccgacgagctcctcgaagaggagtactacgacgagcagctcccggagaagaagcggcgcctcacgccggagcaggtgcatctgctggagaggagcttcgaggaggagaacaagctggagccggagcggaagacggagctggcgcggaagctagggctgcagccgcggcaggtcgccgtgtggttccagaaccgccgcgcgcgctggaagaccaagcagctcgagcgcgacttcgaccgcctcaaggcgtcgttcgacgccctccgcgccgaccacgacgccctcctccaggacaaccaccgcctccactctcaggtcatgtcgttgaccgagaagctgcaagagaaggagacgacgaccgagggcagcgccggcgcggccgttgacgtcccgggcttgcctgcggcggccgacgtgaaggtcgccgtcccggacgccgaggaaccggcgctggaggaggcggcggcggcgttcgaggagcagcaggagcagcaggtgaaggccgaggacaggctgagcacgggcagcggcgggagcgcggtggtggacacggacgcgcaactggtggtcgggtgcggccggcagcatctcgccgccgtggacagcagcgtggagtcgtacttcccgggcggcgacgagtaccacgactgcgtgatgggccccatggaccacgccgcggggggcatccagtcggaggaggacgacggcgccggcagcgacgagggctgcagctactacgccgacgacgccggcgtcctcttcgccgaccacggccaccaccaccaccaccaacacgcggacgacgacgaggaggacggccagcagatcagctgctggtggatgtggaactagatttctcgcgcgcgcgcgtcgtcgtgcattcaattctcgtgttaaaaaaatcgttctctttttcatttttccgcttctttgtctgtaatgttgagtttcgatcggctatgagaaggaaggaggtgtatgcatgtgcatggtatggtagggtaacacatcggtgaatcaaatctgtcatggtgatgtacgagaattgaagaacatgggggtagcaataagtgcatggaggcaagtactcttttcaatggcacataccaaatcatgtcgtcgaattgagatttttattagtcttgaattcttcttgaaaaaaaaaaaaaaggggcctcgtgcgggaggg

SEQ ID NO: 681 - DNA, 691 bp, Zea mays
  Predicted polypeptide sequence is orthologous to G409
  misc_feature (6)..(7): n is a, c, g, or t
  misc_feature (646)..(646): n is a, c, g, or t
  misc_feature (649)..(650): n is a, c, g, or t
  misc_feature (654)..(657): n is a, c, g, or t
  misc_feature (662)..(665): n is a, c, g, or t
  misc_feature (680)..(682): n is a, c, g, or t
ggttgnngttgttctcatacatcgcacatcaccgccatcataatcaccagcttctttcgccataagccatagatctttcgatggttgcttgataatatcgtctgaagtctaaggaggaggagaagaagaagaagaagaagggttcctgatatggcggcgggtgggaatgtttcttcaaatttatgtactttgcttaagaatcaaactgttccttgcacttctcagcctcttgattctcttttcctttcttcctcttatcattttctcggttcaagatctatagtgagttttgaagatgttcaaggagggaaggggtgtaatggctctttcttccgtcattatgatcttgatgaaaatgtggatgaagacatggacgaatacttacatcgacctgggaagaaacgtaggctctcggtggaacaagttcatttccttgagaagagctttgaggaagagaacaagcttgaacccgaaaggaaaactagactagccaaggaacttggtttgcaacctcggcaagtggcgatttggtttcaaaatcgtagagctcgatggaaggcaaaacaattggagaaggattatgattccttgctagctagctataacgatcttaaagccaattatgacaatcttttgagggagaagnatnnattnnnnagcgnnnngtcaagactcactgnnnagatgcttg

SEQ ID NO: 682 - DNA, 810 bp, Zea mays
  Predicted polypeptide sequence is orthologous to G409
  misc_feature (34)..(34): n is a, c, g, or t
ggccggccgggggagtgatttctgaccacgcctnttgagacttcaagtgggcaacgtttctcgcctctcagcgcaaaaagatagatcctctgctctaccggcctaccacgttcgtctcccgcgccggccacccaccgctgccaccgaggtctggacggctcatcttcaacgcgccgggctctggcgccgggcagatgctcttcctcgactgcggcgcaggcggcggtcccggcggcggcttgttccatcgaggcgggagaccgatgcttggccttgaagaagggcgcggcgtaaaacggcccttcttcacctcgcccgacgagctcctcgaggaagagtactacgacgagcagctgccggagaagaagcgccgcctcaccccagagcaggtgcttctgctggagaggagcttcgaggaggagaacaagctggagccggagcgcaagacggagctggcgcgcaagctgggcctgcagcctcgccaggtggccgtctggttccagaaccgccgcgcccggtggaagaccaagcagctcgagcgcgacttcgaccgcctcaaggcctccttcgacgctctccgagcggaccacgacgccctcctccaggacaacaaccgcctccgctcacaggttgtgtcgttgaccgagaagctgcaagagaaggaggatgcgacggagggcggcgccaccgctgacaccgccgcgcccggcggtggacgtcgaggcttccctggccgacgacgtcgaggagccagcaagccctgcggcgacgttcgaggtgtgccaggaagtgaagtccgaggacaggctg

SEQ ID NO: 683 - DNA, 1671 bp, Zea mays
  Predicted polypeptide sequence is orthologous to G409
catcggggcctccgggccggccgggcctttagcagcgaaattcacccaaaagaaactcctgataaatataaaaaggaggggaaaaagaaaaacacttgcagcggcatccaccaccggagctcccatcatcggtctatccctccgtgtcaaccccctcctcagaagttctaattgcagttcagcccctggccggtccgccgggccaccggaaggagccgctcgccggaggaagccccccatctccttgccctgcggcgggtttatggggttctcgctgtaccccatgaagacgtccacgcggttgctctggagcactagcttcttccgccataagctcagctcctcctcctgcttcctctgagcccgccccacccgcgtcgatcacctcggcggcggcccgctgttgctgcgcggtcctagcacccgttcgagtgtgtgtgtttgtgttctttgagtttcaagattgggttttgttgcgttattggggagacgaagggactaaggcgcagtgagcggacaagaatcagcatggatccgagcgcggtcagtttcgactctggcggcgcgcggcggggcggcggcgcgcagatgctgctcttcggcggcggaggcagcgccaacagcaacggcttcttccgaggtgttccgatggcggtcctgggcatggacgacgcgacgcgcgtgggcaagcggcccttcttcacgacacacgaggagctcctagaggaggagtactacgacgagcaggcgccggagaagaagcgccgactgacggcggagcaggtgcagctgctggagcggagcttcgaagaagagaacaagctggagccggagcgcaagaccgagctggctcgccgcctggggatggcgccccgccaggtagctgtttggttccagaaccgccgcgcgcgctggaagaccaagcaactcgagaccgactatgaccgcctcaaggctgcttacgacgcactcgccgccgaccaccagggcctcctggccgacaacgataacctccgggcacaggtgatctccctgacggagaagctgcaaggcaaggagacatccccgtcggcaaccactgctgcccaagaggtcgaccagccagacgaacacaccgctgtgtcaggcacggaagaactgctggcgcagcagctcaaggacaacctccacagcagcggcgactgcactggccatggcaccctctcttcggaagaagacgacggtggcgtggtcagtgacgagggctgcagcttcgctctcccggatgccatgttcgctgccgggttcacccaccatggcgccgaggaggtgcagctggccaactggacatccatgttctggaactgatcagcggatggatgcatccaagtgcaaagatcggatcctctcctcgtctcgacccttttctgcagcatataattaccgtgttaattatgtgccgtccgatgtttttaagtgctcatgttttaagtttgtgtttttttgaagtttttgtatgttcatatatataataatgtgcttcgaacatgacactcgaaaagttgaataattggacatgtcgacctgctgtgcactagcagctggcatgttttgtttaaaaaaaaaaaaaaaaaaaaatcgagaagggaattcatatttttcaaagggaaatgaactaattttacttaggaa

SEQ ID NO: 684 - DNA, 1697 bp, Zea mays
  Predicted polypeptide sequence is orthologous to G409
cattgggtacctcgacgccggccgggcttttgtgtatatatatttcttgttattttcaaaggattaaaaaaaaaaaaaaaaaagccattggggaccgcgaccccggccggggccggtagccacaaatttcacccaaaaccaaaaaaaatcccaaattaaagaaaacgaggagaagaaaaacaactttcatcgccgtccgccaccggagctcccttcgtcggccttccttcagtgtcaacccccttctcaaaacttgtatttgcacctcagtccctgccggtctgcccggtcgccgcctcgccggaggaagcccctcgtctccttgccctgcggcgggttcatggggttctcgctgtaccccatgaagacgtccacgcggatgctctggagcactagcttcttccgccataagctcagctcctcctcctgcttcctctgaggacgccccacccgcctcgatcgcttcggcggcgggccgctgctgctgcgctgtcctagcatccgttcaagtgtgggtttgcgttcttgggtttcaagattggcttttgttgcgttcttggcgagacgaagggactagggcgcggacaaagaatcagcatgcatccgagcgcggtcagtttcgactccggcgacgggcgggcggcgcggtggcgcgcagatgctgctcttcggcggcggaggcagcgccaacagcaacggcttcttccgaggtgttccgatggcagtcctggccatggacgacgcgacgcgcgtgggcaagcggcccttcttcacgacacacgacgagctcctggaggaggagtactacgacgagcaggcgccggagaagaagcgccgtctgacggcggagcaggtgcagctgctggagcggagcttcgaggaagagaacaagctggagcctgagcgcaagaccgagctggctcgccgcctggggatggcgccccgccaggtggccgtgtggttccagaaccgccgcgcgcgttggaagacaaagcagctcgagaccgactatgaccgcctcaaggctgcctacaacgcgctcgccgctgaccaccagggcctcctggccgacaacgatagcctccgggcacaggtgatctgcctaacagagaagctgcaaggcaaggagacatccctgtcggcaaccatggctacccaagaggtcgaccagccagacgaacacaccacaggcactgagaaattgctggcgcagcagctcaaggacgacctgcacagcagctgcggttgcactggacatggtgccctgtcttcggaggaagaggatggtggcgtggtcagcgatgagggctgcagctttgatctccccgacgccatgtttgctgttggggtcaccaaccatggtgctgaggaggcgcagctggccaactggacatcttggttctggaactgatcggttgatggatggatgcatcaagtgcaaagagcaaatcctctcctggtttcgactcttttctgcaacatataattactgtgttgattatgtgccgtcagatgttttcaagtaatgaaacagaactgatgttgtaagtttatgtttctgaagatttgtatgttcatatatataataatatgctttgaacatgagactccaaaagttgaaataagtggatgtggagacctgttgtgccctagccgccaaaaaaaaaaaaaaaaaaaaaaaaaaaaaaaaaaaaaaa

SEQ ID NO: 685 - DNA, 1950 bp, Zea mays
  Predicted polypeptide sequence is orthologous to G409
  misc_feature (12)..(13): n is a, c, g, or t
  misc_feature (16)..(18): n is a, c, g, or t
ccggccaaaaannaannnaacaaaaaaaaaaaaaaaaaaaaaaaaaaaaaaaaaaaaaaaaaaccttacctggacggggtcgacgggcgatcaccaaggctcggggcctaggccaatggcccacattgcacttggggggggcgttggtttaccatctccccaagggggagaggggacgtcataatttggggtaaagggggtacgcgttcgcgcggcccctgccttaaaaaaagaaaaaaaaaaaaaaaaaaaaaaaaaaaaaaaaattttttagccacaaatttcacccaaaaccaaaaaaaatcccaaattaaagaaaacgaggaaaaaaaaaacaattttcatcgccgtcctccaccggagctcccttcgtcggccttccttcagggtcaacccccttctcaaaacttgtatttgcacctcagtccctgccggtctgcccggtcgccgcctcgccggaggaagcccctcgtctccttgccctgcggcgggttcatggggttctcgctgtaccccatgaagacgtccacgcggatgctctggagcactagcttcttccgccataagctcagctcctcctcctgcttcctctgaggacgccccacccgcctcgatcgcttcggcggcgggccgctgctgctgcgctgtcctagcatccgttcaagtgtgggtttgcgttcttgggtttcaagattggcttttgttgcgttcttggcgagacgaagggactagggcgcggacaaagaatcagcatgcatccgagcgcggtcagtttcgactccggcgacgggcggcggcgcggtggcgcgcagatgctgctcttcggcggcggaggcagcgccaacagcaacggcttcttccgaggtgttccgatggcggtcctggccatggacgacgcgacgcgcgtgggcaagcggcccttcttcacgacacacgaggagctcctggaggaggagtactacgacgagcaggcgccggagaagaagcgccgtctgacggcggagcaggtgcagctgctggagcggagcttcgaggaagagaacaagctggagcctgagcgcaagaccgagctggctcgccgcctggggatggcgccccgccaggtggccgtgtggttccagaaccgccgcgcgcgttggaagacaaagcagctcgagaccgactatgaccgcctcaaggctgcctacaacgcgctcgccgctgaccaccagggcctcctggccgacaacgatagcctccgggcacaggtgatctgcctaacagagaagctgcaaggcaaggagacatccctgtcggcaaccatcgctgcccaagaggtcgaccagccaaacgaacacaccacaggcactgagaaattgctggcgcagcagctcaaggacgacctgcacagcagctgcggttgcactggacatggtgccctgtcttcggaggaagaggtgggtgccgtggtctagcggtgagggccgcacagactttgatgtctccccgacgccatgtttgctgttggggtcaccataccatggtgctgaggaggcgcagctggccaactggacatcttggttctggaactgatcggttgatggatggatgcatcaagtgcaaagagcaaatcctctcctggtttcgactcttttctgcaacatataattactgtgttgattatgtgccgtcagatgttttcaagtaatgaaacagaactgatgttgtaagtttatgtttctgaagatttgtatgttcatatatataataatatgctttgaacatgagactccaaaagttgaaataagtggatgtggagacctgttgtgcactagcagccagcatgcgtttttatgctgctttagacatgaaaatgtatatccaacacaggcctgtgaataagatgatgaaagtatatccaatcgctgcacttcatgggcgtcgcggccgcaaaaaaaaaaaaaaaaaaaa

SEQ ID NO: 686 - DNA, 1240 bp, Zea mays
  Predicted polypeptide sequence is orthologous to G409
  misc_feature (680)..(680): n is a, c, g, or t
cctcgaggcggcgggcggttttcaggaattctccaaagaaactcctgataaatataaaaaggaggggaaaaagaaaaacacttgcagcggcatccaccaccggagctcccatcatcggtctatccctccgtgtcaaccccctcctcagaagttctaattgcagttcagcccctggccggtccgccgggccaccggaaggagccgctcgccggaggaagccccccatctccttgccctgcggcgggtttatggggttctcgctgtaccccatgaagacgtccacgcggttgctctggagcactagcttcttccgccataagctcagctcctcctcctgcttcctctgagcccgccccacccgcgtcgatcacctcggcggcggcccgctgttgctgcgcggtcctagcacccgttcgagtgtgtgtgtttgtgttctttgagtttcaagattgggttttgttgcgttattggggagacgaagggactaaggcgcagtgagcggacaagaatcagcatggatccgagcgcggtcagtttcgactctggcggcacgcggcggggcggcggcgcgcagatgctgctcttcggcggcggaggcagcgccaacagcaacggcttcttccgaggtgttccgatggcggtcctgggcatggacgacgcgacgcgcgtgggcaagcggnccttcttcacgacacacgaggagctcctagaggaggagtactacgacgagcaggcgccggagaagaagcgccgactgacggcggagcaggtgcagctgctggagcggagcttcgaagaagagaacaagctggagccggagcgcaagaccgagctggctcgccgcctggggatggcgccccgccaggtagctgtttggttccagaaccgccgcgcgcgctggaagaccaagcaactcgagaccgactatgaccgcctcaaggctgcttacgacgcactcgccgccgaccaccagggcctcctggccgacaacgataacctccgggcacaggtcatcgtctgaagttcgatgtcatggtgcgatgaaaagactgcaagtgcaagcatatccgtaggaaactaggaactagagttaaaactggggaataatgtaaatgagttcatgatcatcgttgtttggatgttttggaatgccatgtatgtccaatttggggcctccatgttatcaacattcctgaaacgtgggctttaagatgagcaaaaaaaaaaaaaaaaaaaaaaa

SEQ ID NO: 687 - DNA, 1673 bp, Zea mays
  Predicted polypeptide sequence is orthologous to G409
ggggcgcacacggatagggggggacccaccagtcgcgggggaataattcgcggcggagaggggggagcgccccagagagggggggcccgactcgggggggggcggtggcaacaggggggggaaggggggaaacggaccccctggggctcctgaaaagatgaaaaaagggggcttaggaggagaggggcggcgcaatgcgcttccacaaacgggagggaggggacaaaggctctccgcggtgcggcaagagggcaaaaggcgcgtcccgccgccacccggtgtgcggtttgccggaaaccacaaaagggggcccccggggggtctccccaattgaaagtcgggccgagaggattagtccccacatagttgggggcaaatacgttttccggcggcggacccgggtggggaaccgtgatgggcccggggggtttagggggggcggacagggggggaggaggggaaatcgtcccccggggaaaggcgcgaaataaaaaaggtcggggtggggaggcccccagggggggggccggggaaaaagtggccgggttgccgggggccggtagtgtggtgtctgcccggggtttttttttttttttttttttttttttttttttttttttttttttttttttttttttttttttttttttttttttttttttttttcactttcactcacagctattacacatggcgaaaatgcatacagtaatttttttttggcacgagatttggcggtcggtccccgcgggaagattgctctgctagttccacatccaccaccagctgacctggccggcgtcctcgtcgtcgccgtccgcgtggtgggtgtgttcggagaggaacgcggcggcggcttcttcgtcggcgtagtagctgcatccctcgtcgctgccggcgccgtcgtcgtcgtccgactggatgcctccagcgccgtgggttactggacccatcgtcccgcagccgtggtactggtcctggacctcggcgccggggaagtacgactcgacgctgctatcgacggccgcgccgccgatcctgccgttgtacaacagcgcgtccgccgggtccaccaccgcgctcccgccgttgcccgtgctcatcagcctgtcctcggacttcacctgccgctcctcgaacgccgccgcctctgcctccggctccggctccggctccggttcctcgacgtcatcggccacggaagccctgacaacgcccaccgccggcaacgccgccgcggcgccgttggcgtcgccctccgtcgcctccttctctcgcagcttctcggtcaacgacaccacctgtgagcggaggcggtggttgtcctggagaagggcgtcgtggtccgcgcggagggcgtcgaaggaggccttgaggcggtcgaagtcgcgctccagctgcttggtcttccaccgggcgcgccggttctggaaccacacggccacctgccggggctgcaggcccagcttgcgcgccagctccgtcttgcgctccggctccagcttgttctcctcctcgaagctcctctccagcaggtgcacctgctccggcgtcaggcggcgcttcttctccggcagctgctcgtcgtagtactcctcctcgaggagctcgtcgggcgaggtgtagaagggcgttttacgccgcgccttcttcaaggccaagcatcgcccggg

SEQ ID NO: 688 - DNA, 1370 bp, Glycine max
  Predicted polypeptide sequence is orthologous to G427
tccacgcgtccgcttcaccctctcacaacaataccgctgcagtagagaagtcccttaaataaatctgaatttccctgctttgcttcaccaccccccttgcttgcgtgggtagaaatgcaagaagcagggctgggaatgggaatgggaatgatgagcggagaagtatccgccgccggggaccaccaccgtcaagtgaaggcggagatagccaaccacccactctatgaacagcttctatctgcacacgtgtcatgcctccgcgtcgccacacctatcgatcagttgccgctcatcgacggacagttatcgcagtcccaccatctcctccgctcttatgcctcacaccattcccattccctctcgccccatgaccgacaagaacttgacaacttcatggcacaatatttgattgtgttatgtacgttcaaagagcagcttcagcaacatgtgagggtgcatgccgtggaggctgtgatggcctgccgtgatattgaaagtaccttgcaagctctgacaggagtcagtttgggagaaggaacaggtgcaacaatgtcagatgatgaagatgatttgcagatggatggctctttagatcagtctagcgctgacgggcatgacatgatgggatttggtccattgcttcctacagaatctgaaaggtccctgatggaaagagttcgtcaggagcttaagattgagctcaagcagggttttaagtcaagaattgaagatgttagggaggaaatattaaggaagcggagagctgggaaattaccaggtgacacaacatcggttttaaaggcctggtggcagcaacatgctaagtggccctacccaactgaagatgacaaggcaaaacttgtggaggagacagggttgcagctgaagcaaatcaataattggttcatcaatcaaaggaaacgcaactggcacagcaactctcaatcggttaactctctgaagtccaagcgcaagagagagtatgcccactaaggattccagtctggtgcagaagataacaggtgatgcactacaacataagatggcttacaatagtgatggttgtaaattcttggaatacataacggatacaaactattcttgttgtgcacggtcgcctccatttctttcaagtgtttttttatttgtaaatttgtttgctatgatttgactggctgaagaagtatttttagcagctgaaagcctgaaagtgtttcctatacttgatatgcttgcatgtactattatgtatattttgtgttgtgcttgatatcagttaaatttacaagtactaacatctccatcctttggaggagataactgtaatttgtaaggatgcaaaaaggaatttaaggacgaattggctaatg

SEQ ID NO: 689 - DNA, 1306 bp, Glycine max
  Predicted polypeptide sequence is orthologous to G427
gaattcggctcgagctcgagccgaatcggctcgagacggctgcgagaagacgacagaaggggggtccggaatcccggccttggacgaaaagaaaggaagagatgcaagaagcaggcttgggaatgatgggtgaggtctccggcgatcagcaccgtcagctgaaggcggagatagcgactcatccgctgtacgagcagcttctggcagcacacgtggcatgcctccgtgtggcgactcccatcgatcagcttccactcattgatgctcaattatctcagtctcaccatcttctacgctcttatgtctcacacaacactctttctctctcccctcatcaccgccaagaacttgacaacttcctggcacaatatttgatagttttgtgtacatttaaagaacagcttcagcaacatgtcagagtccacgccgtcgaggctgtcatggcctgccgtgatatcgaaaataccttacaagctctcactggagtgagtttgggagaaggaactggtgcaacaatgtcagatgacgaagatgatttacagatggatttttctttagatcaatctagcgctgaagggcatgacatgatgggatttggtcttcctacagaatctgaaaggtcattgatggaaagagttcgccaggaactaaagattgagctgaaacagggtttcaagtcaagaattgaagatgtcagggaagaaatattaaggaaacgtagagctgggaaattgccaggtgacacaacttctgtgttgaagaactggtggcagcaacatgcaaagtggccttacccaactgaagatgacaaggcaaaacttgtggaggagacagggttgcagctgaagcaaattaataattggttcatcaaccaaaggaaacgtaactggcacagcaactctcaatcggttacttctttaaagtccaaacgcaagaggtagacattatattattttgtccctaactatgtggaacagctagcaagcaacacaactatatataaggacatgcttattgctgataaagtgtagtcccactaaggattcagaagatagtagatggggttactgtaatattgtaagatagctgaaacaaattcgaggctggctgtaaatttgtggaacttaacgtatgcaaacttttcttttaggtgtggttaagttgcctctctttttaactgtctttgtaaattgttttgctacttttctgaccggcggaagaattattattactactacacagatgattgaaagattcgctggtctattaaagattctcggttctttatatatatgctctttggtcc

SEQ ID NO: 690 - DNA, 1169 bp, Glycine max
  Predicted polypeptide sequence is orthologous to G427
attcggctcgagggtgttgtgtgagacataagagcgtagaagatggtgagactgagataattgagcatcaatgagtggaagctgatcgatgggagtcgccacacggaggcatgccacgtgtgctgccagaagctgctcgtacagcggatgagtcgctatctccgccttcagcttccactcattgatgctcaattatctcagtctcaccatcttctacgctcttatgtctcacacaacactctttctctctcccctcatcaccgccaagaacttgacaacttcctggcacaatatttgatagttttgtgtacatttaaagaacagcttcagcaacatgtcagagtccacgccgtcgaggctgtcatggcctgccgtgatatcgaaaataccttacaagctctcactggagtgagtttgggagaaggaactggtgcaacaatgtcagatgacgaagatgatttacagatggatttttctttagatcaatctagcgctgaagggcatgacatgatgggatttggtcttcctacagaatctgaaaggtcattgatggaaagagttcgccaggaactaaagattgagctgaaacagggtttcaagtcaagaattgaagatgtcagggaagaaatattaaggaaacgtagagctgggaaattgccaggtgacacaacttctgtgttgaagaactggtggcagcaacatgcaaagtggccttacccaactgaagatgacaaggcaaaacttgtggaggagacagggttgcagctgaagcaaattaataattggttcatcaaccaaaggaaacgtaactggcacagcaactctcaatcggttacttctttaaagtccaaacgcaagaggtagacattatattattttgtccctaactatgtggaacagctagcaagcaacacaactatatataaggacatgcttattgctgataaagtgtagtcccactaaggattcagaagatagtagatgggttactgtaatattgtaagatagctgaaacaaattcgaggctggctgtaaatttgtggaacttaacgtatgcaaacttttcttttaggtgtggttaagttgcctctctttttaactgtctttgtaaattgttttgctacttttctgaccggcggaagaattattattactactacacagatgat

SEQ ID NO: 691 - DNA, 1239 bp, Glycine max
  Predicted polypeptide sequence is orthologous to G427
  misc_feature (500)..(500): n is a, c, g, or t
aaaaaaataaaagagaaaagaaatgaagttgtcaggtgacagaagcagctttatcttctttttctgacccctttcatagtaatgattccgcagcttgttactctcttctctctcaaaacaaaacttgaatccatccatactctacataccccttgcccttgctttgcttctttctttctcacaagcaccagcagcactcaaatcaatcaatcgtttttaatgcccttgcttctccctctttccgtgtgtatgtaaaatctttgtttttatcagaggtggtgcagaaagttgtatctcagatccctatatacaccgaaaacgatacaactgtgtgctgtgtacactgtgcactgtgcttctccctctctctctctctctctctcacaaaatcataatcattttacatattacacctattaccgaatagagtggtcctcaacctcaacctaaaagcctcactttttttgttttccccgataaccctattcaacccaatcctnctttccttttcctttgccaatgtgcttcaccaccccccttgcttgcgtgagggaaggtagaaatgcaagaaccagggctgggaatgggaatgggaatgatgagcggagatagccaaccacccactctatgaacagcttctatctgcacacgtgtcatgcctccgcgtcgccacacctatcgatcagttgccgctcatcgacggacagttatcgcagtcccaccatctcctccgctcttatgcctcacaccattcccattccctctcgccccatgaccgacaagaacttgacaacttcatggcacaatatttgattgtgttatgtacgttcaaagagcagcttcagcaacatgtgagggtgcatgccgtggaggctgtgatggcctgccgtgatattgaaagtaccttgcaagctctgacaggagtcagtttgggagaaggaacaggtgcaacaatgtcagatgatgaagatgatttgcagatggatggctctttagatcagtctagcgctgacgggcatgacatgatgggatttggtccattgcttcctacagaatctgaaaggtccctgatggaaagagttcgtcaggagcttaagattgagctcaagcagggttttaagtcaagaattgaagatgttagggaggaaatattaaggaagcggagagctgggaaattaccaggtgacacaacatcggttttaaaggccctggtggcagcaacatgctaagtggccctac

SEQ ID NO: 692 - DNA, 1089 bp, Glycine max
  Predicted polypeptide sequence is orthologous to G427
ccacgcgtccggtccgggtccatgcaatggaagcagtaatggcttgttgggagttagagcaatcattgcagagtctaacaggagtttcacctggagaaggtacaggggcaacaatgtctgatgatgagaatgaccaagtagatagtgatgccaatctcttcgattgtagttttgatggggcagatagcatggggtttggtcctcttgttcctacagagagcgagaggtccctcatggagcgagtaagacaagaattaaagcatgaactgaaacagggttataaggagaaaattgttgacataagagaggaaattttgcgcaagagaagagcagggaaacttcctggtgacacaacttctgttcttaaagcttggtggcaatcacattccaagtggccttaccctaccgaagaggataaggcaaggttggtgcaagaaactgggttgcaattaaagcagattaataactggtttatcaatcaaaggaagaggaattggcacagcaatccttcaacttctactgccttgaagagcaagcgcaaaagaagcaatgcaggtgataactgatgatcgttgcatgaaattcaactctttgtcctttggtcaatcatggaaagacaatgagaaagaaccacattttgtttctgatgggccagggttaaagcagatcaaggagctaatattggtgaaccagtttacttatgcttaaaggccagcaaatagttcatatagtacttgtgatgctacataattaggaagttcaattaagaatcatataccaacagagaattatgatttttgttcatgttttattgctttgtgaaatatagtatatggtagcgaagggggttatgggtgtacagtaataagctgtgcattttttttcccttacaatcatactcttgtttttgttcttggtctttcaattggtatttggtaatgtagagagtaatttgttgtttaaatatggtataagtttttccattttatatatattatgttatcggtatggagtattcattgccttttctgataactaatatagtgtggagttgttaaaagatccaccatatagtgtggtgggttcttt

SEQ ID NO: 693 - DNA, 1331 bp, Glycine max
  Predicted polypeptide sequence is orthologous to G427
aggtcatcgatgacgtggccggcgcaggcgccgaatccggagatttgaagggagagacggcgccggtggacggcctcttgaactggcagaatgcgagattgaaggcggagattttaacgcatcctctgtacgaacagcttctgtcggcacacgtggcgtgcttgcggatcgccacgccggtcgaccagttgcccaggatcgacgctcagctcgcacagtcccagaatgtggtcgccaagtactctgccttcggacaagccatcgttggcgacgataaagaactcgatcagttcttgtcccactatgttctgttgctctgttctttcaaagaacaacttcaacagcatgtccgggtccatgcaatggaagcagtcatggcttgttgggagatcgagcaatccttacaaagtttaacaggagtttcacccggggaaggtacgggagcaacaatgtctgatgacgaagatgagcaagtagatagtgatgccaatctgtttgatggtgctttggatggtcctgatagcatgggattcggtcctcttattcccacagagaatgagaggtccctcatggaacgtgtaagacatgaattgaagcacgaattgaaacagggttataaagataaaatcgtggacataagagaggaaattttacgtaagagaccagctgggaaactttctggtgacacgacctctgtccttaaagcttggtggcaatcacattccaagtggccttatcctacggaggaggataaggcacggttggtgcaggaaacgggtttgcagttaaagcagatcaataattggtttatcaatcaaaggaagaggaactggcatagcagtccctcaacttctactgttttgaagagcaagcgcaaaaggtcatagtggtgctgatcatcacatgtaaatggaggaaaactcaagaaccaatccctgactctgtactctgttagtttgtctctgcggtcaatcatgggtgcatggcaagggattcaagtaaagtcaatgataaaaaaaaaggttcagattttgtttttgctcaaggaacaggcctaaaacacagatgtggaggattaaaagcctgcagtacggtgatgcatcaaaattagggagttcaattaggaattatataccgatatcaaaatgggtacctccatgggagcatgatttttagtgatatatatatatatatatatacattaatgtttgtgaaatatatataatagtgaggggttgtgggtgtatagtaataatcagagcatttttccttcaataatgctaaatttgtttttgtgcttgaattcttggcctcgagggccaaattcccta

SEQ ID NO: 694 - DNA, 1428 bp, Glycine max
  Predicted polypeptide sequence is orthologous to G427
gaattcggctcgagcggcgccggggagtccatggtggagcacgccgatttgaaggacggcggcggagacgccgtgagctggcagattgggcggtgtaagacggagattctgcagcacccgctgtacgagcagctgctgtcggcgcacgtggcgtgcctccggatcgccacgccggtggaccagctgccgaggatcgacgcgcagctggcgcagtcgcagaatgtggtcgcgaaatacgcagtgttcggacacaacaacatcgtcgccgatgacaaagaactcgaccagttcatgtcgcactatgttttgttgctctgttccttcaaagaacaattgcaacagcatgtccgggtccatgcaatggaagcagtaatggcttgttgggagttagagcaatcattgcagagtctaacaggagtttcacctggagaaggtacaggggcaacaatgtctgatgatgaagatgaccaagtagatagtgatgccaatctctttgatagtagtttcgatggggcagatggcatggggtttggccctcttgttcctacagagagcgagaggtccctcatggagcgagtaagacaagaattaaagcatgaactgaaacagggttataaggagaaaattgtagatataagagaggaaatcttgcgcaagagaagagctgggaaacttcctggtgacacaacttctgttcttaaagcttggtggcaatcacattccaagtggccttaccctaccgaagaggataaggcaaggttggtgcaagaaactgggttgcaattaaagcagattaataactggtttatcaatcaaaggaagaggaattggcacagcaatccttcaacttctactgccttgaagagcaagcgcaaaaggtgataactgatgatcgttgcatgaaattcaactctttgtcctttggtcaatcatggaaagacaatgagaaagaaccacattttgtttctgatgggccagggttaaagcagatcaaggagctaatattggtttacttatgcttaaaggccagcaaatagttcatatagtatttgtgatgctacataattaggaagttcaattaagaatcatataccaacagagaattatgatttttgttcatgttttattgctttgtgaaatatagtatatggtagcgaagggggttatgggtgtacagtaataagctgtgcattttttttcccttacaatcatactcttgtttttgttcttggtctttcaattggtatttggtaatgtagagagtaatttgttgtagaaatatggtataagtttttacttgttatataatttaaatgctcgttgtcatggtgctacaaatcgtaaacacttttaactgttgtctgttggaaggtataataatagtgtggtgggttcttgtgatttgacatgtagatggatgtgcagtgt

SEQ ID NO: 695 - DNA, 1628 bp, Glycine max
  Predicted polypeptide sequence is orthologous to G427
cttcttccttcctccttctctctctcaccctttctcccccactccctagtcagctagctcctgcaacaacaaccactcctcttctttttctcacccaaatccacgcttcccttacaccgcgtttggatctccgttatacaaactcattaaaatgttgcgagagaaaaacaaaacagaaaaaaaattcagttaatttattaaattttgttatggctttccacgaccatctccagcacgagatagcgttccagcgtttcacggaggagcaagagttgaacgagaacagagacatgcagcagaggctcccacctccgacatggctcaacaacgttaacgcgcgtcaacagaatttcctcgacaccgagaagagcgtggatcggaacaaccgaagcgagagcaattgcgaatccgaggatttgagggaatacaaagcggacattctaggtcaccctctctacgatcaactgttgtcggcgcacgtctcgtgcctcagaatcgccacgcccgtggaccagcttcctaggatcgacgcgcagcttcagcagtcgcagcgcgtggttgaaaagtactctgcacttgcacacaacggggtcgtcgatgagaaggagcttgatcagttcatgacccattatgttctgttgctctgtgcctttaaagaacaactgcagcagcatgtccgtgttcatgccatggaggcagtgatggcttgttgggatctggagcaatctctgcaaagcttgacaggtgtatctcctggtgaaggaacgggtgcaacaatgtcagacgatgaagatgaccaggcagagagcaatgccaacttatacgaaggaagccttgatggcggcgaaactcttggatttggtcctcttgtccccactgaaagtgaaagatctttgatggaaagagtcaggcatgagttgaagcatgaactaaaacagggttacaaggagaagattgtggacataagagaagaaattctaagaaagagacgagcggggaagcttccaggggacaccacatcccttttgaaagcttggtggcaatcacattctaaatggccttaccccactgaggaagacaaggctagattggtgcaggaaacagggttgcaattaaagcagataaataattggttcataaatcaaaggaaaaggaactggcatacaaataacccctcatcctctagcaactccaaaagcaagcgcaagagtagtgcaggagaagccagtaaccagagcttcatgtgaacggtcgcatattttgaacaaaaattattggtattgttctcccttttaatgcatgctcgtgggattcatagatcttacggtccagcgtgaacgtgatggattctggatgaaaaagggaaattcatgatatataaaaccactgtattggttgaattacagaaaattatccctggtattgttgtatatgaggctgctgcatgccgcttgatatctgatattgatgcagtcgcattctattcgatttaatgggtagcatgctgatattattctgcttatttaaaaatattatggatccatctggtgtagttcaattttttttattaacaaatttaattgttagtttgttaatttttgttagtaggtaattgaatccaatccttt

SEQ ID NO: 696 - DNA, 1742 bp, Glycine max
  Predicted polypeptide sequence is orthologous to G427
atcctcttcaccctccctccctccctcgatcttcgtgtcaacacttcaaaaagtcttcccttatagaacaaagtgtttttccaaatcccttcccttcttccaaatccctttactgtcacgtgaaatctaacaccgagcgtgtagatagtctatgaaatccaattaaatgttcttctgagaacaaagaacataagataacaaacagaaagcgcttataaatggctttccacgaccatctaccgcacgaaatcacgttccagccgtttaccgaggagcagcagttaggtcagagcagggacatgcagcggctgctcccgctctccggcggggcgccgacgtggctgaacaacagcaccgcggcgacgctccgccagcagaatttcctccacctgcagccggaatccgccgcaacgacgcagcaaaacgacgacgttcgcggcggcggcggcagcggcatggatcggaaccggaccgagagcaactctgaaccggatgatttggcagaatacaaagcggacattttaggtcaccctctctacgaccagctcctatcggcgcatgtctcatgcctgagaatcgccacccccgttgaccagcttccaaggatcgacgcgcagcttcagcagtcgcagcgcgtcgtcgacaagtactccggcatcggaaacggaaacggcgtcgtcgacgacaaagagcttgatcaattcatgacgcattatgttatactgctctgtgctttcaaagaacaattgcaacaacatgtacgtgttcatgctatggaagctgttatggcttgttgggagctggaacaatctctacaaagcttgactggtgtatctcccggcgaaggaacgggtgcaacaatgtccgacgatgaagatgatcacgcagagagtaatgccaacttgttcgaaggaggcatggatggagctgatagtctcagctttggtcctcttgttcccacagaaactgaaagatctttgatggagcgtgtgaggcaggagctgaagcatgagttaaaacagggttacaaggacaagattgtggacataagagaagaaattttacgaaagagaagagcgggaaagctaccaggcgacaccacttcccttttaaaagcttggtggcagtcacattctaaatggccatatccagcagaagaggacaaggcaaggttggtgcaggaaacagggctgcaattaaagcagataaataactggttcataaatcaaagaaaaaggaattggcatactaatccgtcgtcttctagtggctccaaaagcaaacgcaagagtagtggtgcaggtgaaacaagtaaccagagcttcatgtgaatgaacacctgatttgaactgaaaaaaaaaatagatatatctctattcttcattttatgcaacaatggtgagattcatatatgaccggagcttagagggaaaaacatgaacggaaatggtggaatatggatgatgaaggagtaatttgtgataccaacatttacttggggggattaattaattacttggttcaattacagaaaaacctagtattgttgtatatgaggctgctgagttgatacctgatactgttgcaggcactatctatttggttcaatgggtatctatgtattactattacagttcaaaggtttttgataaaaaagaaaaaaacaacatagaatccttgaatgcggtgcaaattaacgatcagttttatttgttacacacataagtgtcctacatctgata

SEQ ID NO: 697 - DNA, 772 bp, Glycine max
  Predicted polypeptide sequence is orthologous to G427
ccggtccggattccccgtcgacccacgcgtccgccctattcaacccaatcctcctttcccttttcctttgacaaaaggaaaggaagaaatgcaagaaccaagcttgggattgatgggtgaggtctccggcgatcaccaccgtcagctgaaggcggagataacgactcatccgctgtacgagcagcttctggcagcacacgtggcatgcctccgtgtggccaccccgatcgaccagcttccactcatcgatgctcagttatctcagtctcaccatcttctacgctcttatgtctcacacaacactcattctctctcccctcatcaccgccaagaacttgacaacttcctggcacaatatttgatagttctgtgtactttcaaagaacagcttcagcaacatgtaagagtccacgccgtcgaggctgtcatggcctgccgtgatatcgaaaatgccttacaagctctaactggagtgagtttgggagaaggaactggtgcaacaatgtcagatgatgaagatgatttacaaatggatatttctttagatcaatctagcgcggaagggcatgacatgatgggatttggtccattacttcctacagaatctgaaaggtcattgatggaaagagttcgccaggaactaaagattgagctgaaacagggtttcaagtcaagaattgaagatgtcagggaagaaatattaaggaaacgtagagctgggaaataccaggtgacacaacttctgtgttaaagaactggtggcagcaacatg

SEQ ID NO: 698 - DNA, 1371 bp, Oryza sativa
  Predicted polypeptide sequence is orthologous to G427
tttttttttttttttttatataagtgattaactgattaagcacacagagtgcagcagaacacaatagataagctaaataaacccacagcaatacatgcatatatacgtgtgaaaaaaatcgtctgaagcggacggttcaaccgcttgtctacgacgcatggagaacaaaaacatcaacaccagtgctatgagcagtattacccagtggtatctagaaactgaaatataaatttcgccattttatacaacccctttggaaaaatttccccttttcttcaaatcaagcgcttacagaactatatatgtttacttgcaattagttttgtctataaaatataactggttctctaatatacggctcctgatcctgatcttgcagaacatttcctgatctaagcaattgtcctcctattgctttggatgaattcctcctgccctgtaacccagcatagtgttcagccctcggcgatcatctgctacgaattgttatcacctcttgcgtttggttttgacgctggtggaggaagatgggttactgtgccagtttcttttcctttggttgatgaaccagttgttgatctgctttagctgtagccctgtttcttggactagccgtgccttgtcttcctctgttggatatggccactttgcatgagactgccaccaagcttttaacgtagaagtcgtgtctcccggtagctttcccgctcttcgcttgcgaagaatttcttctcttatgtcaatcagcttctctttgtaaccctgctttagttcatgctttagctcttgacggacacgctccattagggatcgctcgctttctgtgggaaggccgaaacccatgttatccgctccatccaagcttggatcatacatgtttgcctcgctatctgcctgatcatcttcaccatctgacatggttgctcccgtgccttcaccgggcgaggcacctgtcaaactctgaaggttttgttcaagttcccagcatgccattactgcttccatggcatgaacacggacacgctgctgtagctgctctttaaacgaacataatagcaagacgtagtgcgtcatgaactggtcgagctcgcggccgtcgtccccggcggcggcggcggcgagggcggagtacttggcgacgaccccccgccccggcgcgtcctccgcgtcgatgcgggggagctggtcgaccggggtggcgatgcggaggcacgccacgtgcgccgacagcagctgctcgtacagcgggtgcgccagtatctccgccttgcaccgcgccgcgtccgcctcgccgccgccgcccatcgcggccgctctagaggatccaagctacgtacgcgtgcatgcgacgtcatagctcttcatagtgtc

SEQ ID NO: 699 - DNA, 599 bp, Zea mays
  Predicted polypeptide sequence is orthologous to G427
  misc_feature (70)..(70): n is a, c, g, or t
acacgtacctaaacttgttttctctagcccggccggctaccctagctttgtatccggtagcggaatgggncggaggcgcccggctgggagagggagaaggatggcatcgctggcagcacccaatcatcgagcgtatagtccaggcgcacgtcagctgcctccgcatcaacaccccaggggaacagctcccgatcatcgacgcgtcacatagatgatgaggccactcacccatggaggccgccgctgcgactgcatgtggtgggcggagcacactaggcaggcaaggagctcgacctcttgatgacacattatgtgttgctactctgttcattcaaagaacaactacagcaatatgtgcgtgctgatgcaaaggaagcagtcatggcttgttgggagctataacaaactttacaaagccttacaggagcatctcctgccgagggcactggctcaactatatatgacgatgaagacaaacaggtggacagtgagagcaacatgtttgatggaaatgaggggtcatgatagaatgcaatttgccccattaatgttgactgatggtgagagatccttagttgagcgtgtccgtgactagctaa

SEQ ID NO: 700 - DNA, 330 bp, Zea mays
  Predicted polypeptide sequence is orthologous to G427
  misc_feature (61)..(61): n is a, c, g, or t
  misc_feature (64)..(66): n is a, c, g, or t
  misc_feature (69)..(69): n is a, c, g, or t
  misc_feature (79)..(79): n is a, c, g, or t
gatcatacggtatgggctttggcccccggacgtgacataggaagatcgggggttaaaaaancannnacngaaggagctnaagaacgagcttaagcagggttacaaggaaaagctgggcgatatcaaggaagagatcatgcgcaaacacaagactgggaagcttcctggaaaaaccgcatatgtactgaaagcttggtggcaagctcattccaagtggccgtacccaactgaagacaacaaggccagactggtgcaggaaacagggttccatctaaagcaaatcaacaaccggttaattaaccaacacaagcggaactggcaaagaaaccc

SEQ ID NO: 701 - DNA, 1214 bp, Zea mays
  Predicted polypeptide sequence is orthologous to G427
gtcgtaagctgatccttagagcggcgcgcggaggggtgatagcggcagctgctcaagggggagatcgcggtgcacccgctgtgcgagcagctagtggcggcgcacgtggggtgcctgcgcgtggccacgcccatcgaccacctccccctcatcgacgcccagctcgcgcagtccagcggcctcctccactcctacgccgcccaccaccgccccttcctctccccgcacggcaagcacgacctcgactcgtccctcgcgcagtacctgatgctgctgtgctcgttccgggagcagctgcagcagcacgtccgggtgcacgccgtggaggccgtcatggcgtgccgcgagatcgagcagtccctgcaggacctaaccggggcgacacttgaggaagggacgggggcgaccatgtcagaggacgaggacgaggcgccgatgctggaggtgggcctggatatgggctccgacgggcacgacatgatgggcttcggcccgctcatgcccaccgactcggagcgctcgctcatggagagggtcaggcaggagctcaagatggagctcaagcagggtttcaagtcgagaatagaggatgtgcgggaggagatcctgaggaaaaggagggccgggaagctgcctggggacaccaccagcatcctcaagcaatggtggcaggagcactccaagtggccataccccacggaagacgataaggctaagctcgtcgaagagaccggcctgcagctgaagcaaatcaacaactggttcatcaaccagaggaagaggaactggcacaacaactcccagacgtcaaccctcaaatcgaagcgtaaaaggtgatggaggagagctagctgcaccgtatataccgtgtatgtaacgcacacctgctgacacacatgtacacatgtataccataccaacacgctaatcaaacggagctctgcatggcgactgtactcacggaaataaagaggaccatatcgaccggttcaactgtatatctagccattagtctgaccactggcatatttgtttgctgcggctgatactttgagctgatgatgtgtggctcacagcatactttattcttgttcttattgtgttgacatagtttgtcccccataatcttgaggattatcatcttgaggatgaaactgggagggggggccgggacccagttgggcctatgggggaggggattacgcgcgctgact

SEQ ID NO: 702 - DNA, 676 bp, Zea mays
  Predicted polypeptide sequence is orthologous to G427
  misc_feature (17)..(17): n is a, c, g, or t
cccgggcaagatagagntgtgagggaggagattctgaggaaaggagggccgggaagctgcctggggacaccaccagcatcctcaagcaatggtggcagcagcactccaagtggccataccccacggaggacgataaggcgaggctcgttgaagagaccggcctgcagctgaaacaaatcaacaactggttcatcaaccagaggaagaggaactggcacaacaactcccagacgtcaaccctcaaatcaaagcgtaaaaggtgatggagagctgcgccaccatgtactgcacacctgacacgtataccaattaccaacacgctaatcaaacgacgtacggccatgcatggcgactcacaagaaataaagaggatcgatcgattcaactgtatatttctagtcattagtcactagtcagagaggtgacaggttcatgacacacacaaacacacgtacactagtctgaccactggcatatttgcttgctgctgtgattaatatattttgagccgatcatgtgctcggaccatactttattcttgttattattgtatagccatagtttgtccaccccaccccctgtgcacatatatacagtgacctgatctgaccatctcatctgctggcaggaagagatcgaagaacagagaggttaattgcattcatctttgtaccat

SEQ ID NO: 703 - DNA, 1076 bp, Zea mays
  Predicted polypeptide sequence is orthologous to G427
gacacattatccgcgcctccgcccccgcgtccgcccacgcgtccggcagcatgtacgtgttcatgcaatggaagcagtgatgggttgctgggagcttgaacaatctttacaaagcctaacaggggcatctcctggtgaaggcactggagcgaccatgtctgatgatgaagacaaccaggtggatagcgaagccaacatgtttgatggaaatgatggatcagatggtatgggctttggccccttaatgctgacagagggtgaacgatccttagttgagcgtgtacggcaggagctaaagaacgagcttaagcagggttacaaagaaaagcttgttgatatcagggaagagattatgcgcaagcgcagagctgggaaacttcctggagatactgcatctgtgctgaaagcttggtggcaagctcattccaagtggccatacccaactgaagacgacaaggcacgactggtgcaggaaacgggattgcagctaaagcagattaacaactggttcatcaaccaacgcaaacggaactggcacagcaacccaacatcctcgggtgaaaagactaagaagaaaaggtgatattgatccagagcaatcttgacgatgctaaacgtccactgtgtactttatggcgaagtacattaccctccctccgtagccaggagcggagatgtgcatcttgggtggcccagtggtcacttaatgccccaagtttgaccacgttgtgggactggtgctagtagtgacctctgcagtatagtaatattcactaatgttgtgggaatcatgtggtgtataaccggcgaacgggagggagtaatttatgttttattgtaattgtctatctttaccttgtaatgatattttagggagaatcccaagatctcagaatggccgttcactgtattgtcggtggtaaaagtggtgggcaatcatcgtgttcagattacctccagaagggtatgcaatggctcgaatgttccatgtcgtgtttagctggttgtcgtttgtcttacttcctgctgagttggatacttgattccttcgaagatgtaaagcacccatcgatgcc

SEQ ID NO: 704 - DNA, 1463 bp, Zea mays
  Predicted polypeptide sequence is orthologous to G427
attcggctcgaggctcccgctcccgctgctttttatcttctcgcgccgcggcccccagcctttgcccgccgctacctctctctaattgggcggcggcctgccggtccgatggcgttcaactaccacgaccacgcgctggcgatggaccccgcgaaccctagctttgtctccggaggtggcatggccggggggcccggctgggagagggagaaggcggccatcgcggcgcacccgctgtacgagcgtcttctcgaggcgcacgtcgcctgcctccgcgtcgccacccccgtcgaccagctcccgcgcatcgacgcgcagatagcggcgaggcccccgcccatggaggccgcggctgcggctgctgcggcgggcggagcacactcgggaggcgaggagctcgacctcttcatgacacattatgtgttgctcctctgttcattcaaggaacaactccagcagcatgtgcgtgttcatgcaatggaagcagtcatggcttgttgggagctcgaacaaactttacaaagccttacaggtgcatctcctggtgagggcactggggcaactatgtctgacgatgaagacaatcaggtggacagtgagagcaacatgtttgatggaaatgaggggtcagatggaatgggatttggcccattaatgttgactgagggtgagagatccttagttgagcgcgtccggcaggagctaaagcatgagcttaagcaggggtacagagacaaacttgtggatattcgggaagagatattgcggaagcgaagagctgggaaactccctggcgacactgcttctaccttaaaagcatggtggcaggctcattctaagtggccgtacccaaccgaggaagacaaggctcgactggtgcaggaaacagggctacaactgaagcagatcaataactggtttatcaaccagcgtaagcggaactggcacaacaattcggcgtcatcctcgtcggacaaaagcaagagaaaaaggaacactgcaggtgatgggaacgcagaaccagcctggtagggcatggtcggggaacgaagtttatgtaaataatgcttctactgtgaagagttccatcatatttgttgctccagaaaagaccctcagaccggtgtttcctgaacccatattcatacaaagacatcaggcgatgaataatgttgcgagtagtcaaataaaataaataacttgtatagtgaataactagaaactagcattcatcgttttggtattgtatagcgctagagtgtaattgtttggtcggactgtcttgtataatggtgtaaggttcaaatgcattttgacctagcattcgatattgtattttgtgatgttaaaaaccattggattcgttttgtgttttatccgtggaatagggacactgttagtgttgccctcaaaaaaaaaaaaaaaaaaaaaaagggcggcagcgcgcccctcgcgcctggaac

SEQ ID NO: 705 - DNA, 780 bp, Zea mays
  Predicted polypeptide sequence is orthologous to G427
  misc_feature (763)..(763): n is a, c, g, or t
agcagtggtaacaacgcagagtacgcggggatggaaatgatggatcagacggtatgggctttggccccctaatactgacagagggtgaacggtccttagttgagcgtgtacggaaggagctgaagaacgagcttaagcagggttacaaggaaaagcttgtcgatatcagggaagagatcatgcgcaagcgcagggctgggaaaccgcccgcggcgaccgcatctgtactgaaagcttggtggcaagctcattcgaagtggccgtacccaactgaagacgacaaggccaggctggtgcaggaaacggggttgcagctaaagcagatcaacaactggttcattaaccaacgcaagcggaactggcacagcaacccaacatcctcggctgaaaagaccaagaagaaaaggtgatgatggcccagagcaatcttggcaaaagctagagatgtccactatactttattatggcgaagtacattctccctcacttcgtaggcaagagggaaaggtatcttgggtgacttgagtggccacctaatgcgcaagtttgaccacgtgtggggctggggttggtagtgacctcagcagtatagcattcgctaacgtgatgtgggtgaatcacgtgttgcagtagaaccggcgagcgggaggggggtaatttatgttgtattgtaattgtgttttttattaccttgtaatgatattttagggagaatcccaagattcatattcgcaaaaaaaaaaaaaaaaaaaaacaacccctntcgctgttaccactgct

SEQ ID NO: 706 - DNA, 1341 bp, Zea mays
  Predicted polypeptide sequence is orthologous to G427
  misc_feature (607)..(607): n is a, c, g, or t
gccgccgcccccgcgtcgcgccgaaccctagcggcttctcccccggcgtcggcggggagagggagaaggcggccattgcggcgcacccgctgtacgagcgccttttggaggcgcacgtcgcctgcctccgcgtcgccacccccgtcgaccagctccctcgcatcgacgcgcagatcgccgcgcgccccccgccactagccgccgccgccggggccgcggcagcgggagggccgtccggcggcgaggagctcgacctcttcatgacgcactatgtattgctcctttgctcattcaaggaacaactccagcagcatgtacgtgttcatgcaatggaagcagtgatgggttgctgggagcttgaacaatctttacaaagcctaacaggggcatctcctggtgaaggcactggagcgaccatgtctgatgatgaagacaaccaggtggatagcgaagccaacatgtttgatggaaatgatggatcagatggtatgggctttggccccttaatgctgacagagggtgaacgatccttagttgagcgtgtacggcaggagctaaagaacgagcttaagcagggttacaaagaaaagcttgtcgatatcagggnaagagatcatgcgcaagcgcagggctgggaaacttcctggagataccgcatctgtactgaaagcttggtggcaagctcattccaagtggccgtacccaactgaagacgacaaggccagactggtgcaggaaacggggttgcagctaaagcagatcaacaactggttcattaaccaacgcaaacggaactggcacagcaacccaacatcctcggctgaaaagaccaagaagaaaaggtgatgatggcccagagcaatcttgggaaaagctagagatgtccactatactttattatggcgaagtacattctccctcacttcgtaggcaagagggaaaagtatcttgggtgacttgagtggccacctaaggctttgtttgggtactctagcattgaccccaatccacatgtgttgaggtggattggggtgtaaattagtttaagttacacctcaatccacctcaatacaagtggattgaggtcaataccagagtacccaaactaagcctaatgtgcaagtttgacaacgtggttgggctggagttggtagtgacctcagcagtatagcattcgctaacgtgatgtgggtgaatcacgtgttgcagtagaaccggcgagcgggaggggggtaatttatgttgtattgtaattgtgttttttattaccttgtaatgatattttagggtgaatcccaagattcatattcgccaaaaaaaaaaaaaaagcgggcgcttggg

SEQ ID NO: 707 - DNA, 496 bp, Zea mays
  Predicted polypeptide sequence is orthologous to G427
gggagggccgtccggcggggaggagctcgacctcttcatgacgcactatgtattgctcctttgctcattcaaggagcagttgcagcagcatgtacgtgttcatgcaatggaagcagtgatgggttgctgggagcttgaacaatctttacaaagcctaacaggggcatctccgggtgaaggcactggaggaaccatgtctgacgatgaagataaccaggtggatagtgaagccaacatgttcgatggaaatgatggatcagacggtatgggctttggccccctgatactaacagagggtgaacggtccttagttgagcgtgtacggaaggagctgaagaacgagcttaagcagggttacaaggaaaagcttgtcgatatcagggaagagatcatgcgcaaacgcagggctgggaaacttcctggagataccgcatctgtactgaaagcttggtggcaagctcattccaagtggccgtacccaactgaagacgacaag

SEQ ID NO: 708 - protein, 202 aa, Oryza sativa
  Orthologous to G427
MDKYYEEDWTHYVLLLCSFKEQLQQHVRVHAMEAVMACWELEQNLQSLTGASPGEGTGATMSDGEDDQADSEANMYDPSLDGADNMGFGLPTESERSLMERVRQELKHELKQGYKEKLIDIREEILRKRRAGKLPGDTTSTLKAWWQSHAKWPYPTKVSHYETEGLFAFTGGRQGTASPRNRATAKADQQLVHQPKEKKLAQ

SEQ ID NO: 709 - protein, 143 aa, Oryza sativa
  Orthologous to G427
MSEDEDETAPMLEGPMDMGSDGHDLMGFGPLMPTDSERSLMERVRQELKIELKQGFKSRIEDVREEILRKRRAGKLPGDTTTILKQWWQQHSKWPYPTEDDKAKLVEETGLQLKQINNWFINQRKRNWHNNSQTSTLKSKRKR

SEQ ID NO: 710 - protein, 331 aa, Oryza sativa
  Orthologous to G427
MAFHYQDHALAMDAAAAAAETGGHHHPGFVGAGGVVGGGGGGGWEREKAAIAAHPLYERLLEAHVACLRVATPVDQLPRIDAQIAARPPPLAAATAAAAAAAAGGAPSGGEELDLFMTHYVLLLCSFKEQLQQHVRVHAMEAVMACWELEQTLQSLTVVTLTAGASPREGSGATMSDDEDNQVDSESNMFDGNDGSDGMGFGPLMLTEGERSLVERVRQELKHELKQGYREKLVDIREEILRKRRAGKLPGDTASTLKAWWQAHSKWPYPTEEDKARLVQETGLQLKQINNWFINQRKRNWHSNPASSSSDKSKRKRKRSNAGDGKAEQSW

SEQ ID NO: 711 - protein, 427 aa, Malus x domestica
  Orthologous to G427
MAYHNHLSQDLPLHHFTDQTHHQHQQYQSDQPDPNSKPPEPHHSFQPAPNWLNSALLRNFTNTDTNPTNSNNANNNGGGVSNFLNLHVTASDSAASQASNQWLSQSHRPILHRNHSDVNDDVTVAGDSMIAAALSHDSADLKPDSILNKNEGGGGDGGVMNWQNARHKAEILAHPLYEPLLSAHVACLRIATPVDQLPRIDAQLAQSQNVVAKYSALGNGMVGDDKELDQFMRNYVLLLCSFKEQLQQHVRVHAMEAVMACWEIEQSLQSLTGVSPGEGTSATMSDDEDDQVDSDANLFDEGMEGHDSMGFGPLIPTESERSLMERVRQELKHELKQGYKEKIVDIREEILRKRRAGKLPGDTTSVLKAWWQSHSKWPYPTEEDKARLVQETGLQLKQINNWFINQRKRNWHSNPSTSTVLKSKRKR

SEQ ID NO: 712 - protein, 422 aa, nicotiana tabacum
  Orthologous to G427
MAYNPNHMSQEMDMHHFSDENSAVLRSILPEQLAQSSPDVKPLDHQQPPTWLNSAILRQESHYTGTGGRGVGENFLNLHSNSESSAAASQASNQWLSRSILRRNVSDVQTSNNSSAVIAAADLKNDDGNNNNDNGNNNAGGQLTDSEVVGGGGTDGILNWQNAGYKAEILAHPLFEQLLSAHVACLRIATPVDQLPRIDAQLAQSQQVVAKYSTLGQNIGDDKELDQFLTHYVLLLCPFKEQLQQHVRVHAMEAVMACWEIEQSLQSLTGVSPGEGTGATMSDDEDDQVDSEANLFDGSLDGHDGMAFGLPTESERSLMERVRQELKHDLKQGYKEKLVDIREEILRKRRAGKLPGDTTSVLKAWWQSHAKWPYPTEEDKAKLVQETGLQLKQINNWFINQRKRDWHSNASSSTTSKSKRKR

SEQ ID NO: 713 - protein, 426 aa, Lycopersicon esculentum
  Orthologous to G427
MEFQDHFSQEMVLHQQQQQQQQQQNAVLRSMLPESPHHDARKSPPTWLNTSLLRQQHSQFGNASSPSSAAAAAAVAGGNNFLHLQTSNSDSSNSNQWLSPTAAAGGGSNGGGSGHNDELSESMNFAKKMSQQHSGGGEENNNNNNNNNNNNNEEENSWEREKCKADILNHPLYDQLLSAHVSCLRIATPVDQLPRIDAQLAQSQNVVAKYSVLGQGQPPLDDKDLDQFMTHYVLLLSSFKEQLQQHVRVHAMEAVMACWELEQSLQSLTGVAPGEGTGATMSDDDDDQADSDTNFLDGGFDGPDSMGFGPLVPTESERSLMERVRQELKHELKQGYKEKIVDIREEILRKRRAGKLPGDTTSVLKAWWQSHSKWPYPTEEDKARLVQETGLQLKQINNWFINQRKRNWHSNPSTSSSQKSQTQECR

SEQ ID NO: 714 - DNA, 1045 bp, Glycine max
  Predicted polypeptide sequence is orthologous to G438
  misc_feature (103)..(103): n is a, c, g, or t
ctacctaagctcttttttcggctcgagctttgctgagggtgggcggctgtttaccttctggatttcgcatcattcctcttgaatctggaaaggaagcttccanccccaatcgcacccttgaccttgcatcttcccttgacgttggtcccagtggaaaccgagcttcatatgaatgtgctggaaattccagctgggggggatctgtgatgacaatagcatttgaatttgcatttgaaagccatatgcaagatcatgtagcagctatggcacgtcaatatgttcggagcattatatcatcggttcaaagggtaggattagcactttctccttctcatttgagttcacatgcagggcttaagtcaccattgggtactcctgaagcacaaacccttgctcattggatctgcaacagttataggtgctacttgggtgtggagctacttaaatctaataacgaggggaatgaatctttgctcaagtccttgtggcatcactcagatgcaatattgtgctgcactctaaaggcattgccagtgttcactttctcgaaccaggctgggcttgacatgctggagaccaccctagttgcattacaagatatacctttggagaaaatatttgatgatcatggacgaaaaattctcttttcagagtttccccagattatccaacagggttttgcatgtcttcaaggtggcatttgtctttcaagcatggggcgacctgtctcatatgaaagagttgttgcttggaaggtgctgaatgaagaagagaatgctcattgtatttgctttatgtttgtgaactggtcttttgtttgacatcttgttctgagtacacttgggcttattgtatccaagtgttagataaagttttactctaagactaaaaaaaaaaatgttggttggtgttttactgtatttgcactaaatacttggattgcactttaaatgactatttgtgttattattagcttatgtaacttgtttccttattcaacctccagctaatatttaatgcaatcttaagaagtgttgcccctttt

SEQ ID NO: 715 - DNA, 1129 bp, Oryza sativa
  Predicted polypeptide sequence is orthologous to G438
gtaaaagatggctgcagtgcatgcagcagtgtaaaaaaaaaaaaaaaaaaaaaaaaaaaaaaaaaaaaaaaaaaaaaaaaaaaaaaaaaagggggggggggcatgtccagtcctgctttgttggcaaatgtaaacaccggtttttccttgaatgagcagcacaaaatagcatcttggtaatgccatagcatcttcaacaattgttctgcatctccatctgattgactaagtaactctacccctagatggtaatggtagctctggcaaacccatcgagcaagggttgctgcttcagggaaaccagagattatcctctgtccggcatttagaccagtttgagagggagagatagccattgacactctttgcacagcagaaacaatgctacggacatattggcgagccatagctgcaacactgtcttggagatgcaactcgtaagggaattgaaaagcgatcgtcagaacagatcgcaagttacaatcatctgcagatgcatctccggaggcttgagctgttgctgaacctacttcaagactagatgccaaatctaatgtcctaccagaggatgcaccatctgttttcatatcaagtggtataacacggaagccagaagaaatcaatggagtttcatctgggaaatcatcaatcggtgcaaagacaagctgaaaggaggatcccacagacttctcgtctattccagtgcagagctgaagcaggtggatatcccttgaaagaagagcttcatcatgagtaagaggttgaccctcaaggcgaacaacttcaagaatctcctcattctcaactgtgtgagcaagtggaatgatgatttggctcccagaaaatctcatgggtcgcaacccaggaagtgaacatgcacttgttttcagagttgaagccaaatatgcatcaatattgtaatcggcccattcagatctatgctccctcagaaatcgaaccagtactgctggaggaacactctgcagtaacattgatgccttagcacatataatacctccgggggctccaaaggcgatgccagcattgctgttactcctaattttcttagttgagttgcaagcaatcactacatcttcaacaccgtctccgcccattatagaccacccat

SEQ ID NO: 716 - DNA, 1154 bp, Oryza sativa
  Predicted polypeptide sequence is orthologous to G438
gtggatcccccgggctgaggaatcggcacgaggctaaatttggtctgcatttcgaagaatctcgccaatgccaatgcagttttcgacgccctacaggatccgattttacattgctggaaggaacccaagtacccaaccgtcaggattgctccgatccccctacaactaaaaccacttggccactgccttgtacttgggtacttgatggaatgggagcgagattacatttacataagcgagaaatttcgcaaatactactagattctcaggtctagatctagtgcaaaacagtcttgaacaagcaaaaatgaatcttcacttcgcagtggatgtgggatggtcacacaaaggaccagttgacgaaacagaaggccaggcagtgaacattgctatcctcggcaagcactttccaagccacggcctgatcgaaagaaacatgccgacccattcctgacatgcacacgcctgatggcaggtagacatggccctgctccatcaatttgggaatgtttgagaacaatgcttcttttccaggctcatcaaagatcctgtccaatgtgaggtcctgtaaggcgacaagggaagtttctagcatgtccagtcctgctttgttggcaaatgtaaacaccggtttttccttgaatgagcagcacaaaatagcatcttggtaatgccatagcatcttcaacaattgttctgcatctccatctgattgactaagtaactctacccctagatggtaatggtagctctggcaaacccatcgagcaagggttgctgcttcagggaaaccagagattatcctctcccccgccccggggcccctctgagagggagagatagccattgacactctttgcacagcagaaacaatgctacggacatattggcgagccatagctgcaacactgtcttggagatgcaactcgtaagggaattgaaaagcgatcgtcagaacagatcgcaagttacaatcatctgcagatgcatctccggaggcttgagctgttgctgaacctacttcaagactagatgccaaatctaatgtcctaccagaggatgcaccatctgttttcatatcaagtggtataacacggaagccagaagaaatcaatggagtttcatctgggaaatcatcaatcagtgcagagctg

SEQ ID NO: 717 - DNA, 666 bp, Oryza sativa
  Predicted polypeptide sequence is orthologous to G438
gcacgagggttggtattgtggccatttcacatggttgccgtggtgttgctgcccgtgcctgtggttgggtgaacctagaaccaacaaaagtggtagagatattgaaagatcgtccatcttggttccgtgattgtcgaaacctggaagtctttacaatgattccagcaggaaatggaggaacggttgaacttgtctacacacagttgtatgctccggcaactttagttcctgcacgagatttttggacgttacggtacacaaccacaatggaagatggcagtcttgtggtctgtgagagatctttaagtggttcagggggcggtccaagtgctgcctctgctcagcaatatgtgagagcggaaatgcttccaagtggatacctggttcgcccatgtgaacgtgggggatcaattgtgcacatagtggaccatctggatcttgaggcatggagtgttcctgaggtgcttcggccactctatgaatcttccagggtagtcgctcagaaaatgactactgcggcactccggcacatcagacaaattgctcaagaaacaagtggggaagtggtgtatgccttggggaggcaaccagcagtgctacggacttttagtcaaaggctgagcagaggctttaacgatgccattagtggtttcaatgatgatgggt

SEQ ID NO: 718 - DNA, 712 bp, Oryza sativa
  Predicted polypeptide sequence is orthologous to G438
tgcaggaatcggcacgaggctagtgcgcccatgcgagggtggtggctccatcgtgcatattgtggaccatctggatcttgaggcttggagtgttccagaagtgcttcggccactctacgagtcatctagggtagttgctcagaaaatgactactgcagcactacggcacatcagacaaattgctcaagagacaagcggggaggttgtatacgctttggggaggcaacctgctgttttgcggacatttagtcagaggttgagtagaggcttcaatgatgctataagtggtttcaatgatgatggttggtctgtcatgggtggggatggcattgaagatgtgatcattgcttgcaatgcaaagaaggttaggaatactagcacttcggccaatgcttttgtaactccaggaggtgttatatgtgctaaggcatccatgctactgcagagttgtcccacctgcagctttggttcgatttttgagggaacatcgttctgaatgggcggattataacttcgatgcatattcagcttcatctctgaagacaagctcatgttcacttcctgggttgcggcctatgagattttctgggagccagatcattatgccacttgctcacacggtggagaatgaggagattttagaagttgtccctcttgaaagacaaagtggtcacacatgattgatgtacttaagtgttaagatattgaccct

SEQ ID NO: 719 - DNA, 348 bp, Zea mays
  Predicted polypeptide sequence is orthologous to G438
ggttttcttgaaagatcgtccatcttggtttcgtgattgtcggagtcttgaagtctatacagtgttaccagctggaaatggcggaaccattgaacttgtttacatgcagatgtatgctcctactactttagttcctgcacgtgacttttggacactgagatacacatccactatggaggacggctgtcttgtggtctgtgagagatccttaagtggttcaggagatggacaaagtgctgccacaacacaacaatttgtaagagctgagatgctttctagaggctatttaattcgccaatgtgagggtgggggctcgattgtgcgaatagtggaccatctggatcttga

SEQ ID NO: 720 - protein, 880 aa, Physcomitrella patens; identical to SEQ ID NO: 669
  Orthologous to G438

SEQ ID NO: 721 - protein, 840 aa, Oryza sativa
  Orthologous to G438
MAAAVAMRSGSGSDGGGGGYDKAGMDSGKYVRYTPEQVEALERVYAECPKPSSSRRQQLLRDCPILANIEPKQIKVWFQNRRCRDKQRKEASRLQAVNRKLTAMNKLLMEENERLQKQVSQLVHENAYMKQQLQNPSLGNDTSCESNVTTPQNPLRDASNPSGLLTIAEETLTEFLSKATGTAVDWVPMPGMKPGPDSFGIVAVSHGCRGVAARACGLVNLEPTKIVEILKDRPSWFRDCRSLEVFTMFPAGNGGTIELVYMQMYAPTTLVPARDFWTLRYTTTMEDGSLVVCERSLSGSGGGPSTASAQQFVRAEMLPSGYLVRPCEGGGSIVHIVDHLDLEAWSVPEVLRPLYESSRVVAQKMTTAALRHIRQIAQETSGEVVYALGRQPAVLRTFSQRLSRGFNDAISGFNDDGWSVMGGDGIEDVIIACNAKKVRNTSTSANAFVTPGGVICAKASMLLQSVPPAVLVRFLREHRSEWADYNFDAYSASSLKTSSCSLPGLRPMRFSGSQIIMPLAHTVENEEILEVVRLEGQALTHDDGLMSRDIHLLQLCTGIDEKSMGSCFQLVSAPIDELFPDDAPLISSGFRVIPLDMKTDGTPAGRTLDLASSLEVGSTAQPTGDASMDDCNLRSVLTIAFQFPYEMHLQDSVATMARQYVRSIVSSVQRVSMAISPSRSGLNAGQKIISGFPEAPTLARWICQSYQFHLGVELLRQADDAGEALLKMLWDYEDAILCCSFKEKPVFTFANEMGLNMLETSLVALQDLSLDKIFDEAGRKALYNEIPKLMEQGYVYLPGGVCLSGMGRHVSFEQAVAWKVLGEDNNVHCLAFCFVNWSFV

SEQ ID NO: 722 - DNA, 1195 bp, Glycine max
  Predicted polypeptide sequence is orthologous to G450
gagattccccattattattattatgacagaatctctaacacgtgggatcatatccaccgccggatgtcccttcaacccaccacactcccaacatatatcaccaaaaccttattcccaattctaaaagaacacacctgagtgagtcccgacatcaacttataataattcctaatcagtgacaagtgttatggaggcagagccagacaagtacaagatgatcaactttgaagaaaccgagttgcgactcggcctgccactcagtggaaacgagacgacgctcaaaaacacttgcagtactgggaagagggttttttcggatactagcgtggatttgaagcttaacctttcctcaacctcaaataacgcccctcctcctggcaaagccacccgcaaaggcacaagtggtggggtggccaccagtgaggtcattcagaaagaacattgtaaacaacgttcaaaggagtaacaacaacgatggcgaaaaagccgccacaagtagtagcaacaatgtgaacatgggagcagctttcgtgaaggtgagcatggatggtgctccctatttacgcaaggtggatttgaagatgtacaagagccaccaagagctgttggatgcactggctaaaatgtgcagttcattcaccatcgacaagtgtagttcccaaggcatgacagacttcatgaacgagggcaaattgattgatcttctcaacggctctgattacgtaccaacctgtgaagacaaagatggtgattggatgctcgtgggtgacgtaccttgggaaatactcgtggaatcatgcaagcgcctgcgtataatgaaaggatctgcggcaatcgggctagcaccaagagcagtgcaaaagtgcaagaacagaagctagaggcaaatttgtaagttccagtttcgaccacaatctcctcgatctgttgctcttgggcgtccatgggaagcattaatgctaatataggagccaagttatataatatgtcggtaccattttttggaaataattttcttgtatatggattgtgtattatatatatatatgagaaaatagttggaaattagggacaagaaataatggagtatgtttatatgaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaa

SEQ ID NO: 723 - DNA, 1220 bp, Glycine max
  Predicted polypeptide sequence is orthologous to G450
tacggctgcgagaagacgacagaaggggacacctctttctccttctccccagttctcaaaccttacctagtattttcgtttctgaacccaattaattaagcacacaaggaccataacatacctatacctcaatatcacaagtcttatggaggcagagcgagacaagtacaagatgatcaactttgaagaaaccgagttacgactcggcctcccactcagtggaaacgagacgctcaaaaccacttgcagcactgggaagagggtttttttcggatactgccgtggatttgaagcttaacctttcctcaacctcaaacagtgcttcttctgacctgactaaagagaagaacatcactgctgctgcacctcctgctaacgacccagcaaagccacctgcaaaggcacaagtggtggggtggccaccagtgaggtctttcagaaagaacattgttcaaaggagtaacaacaatgagggcgaaaaagccgccacaagtagtagcaacaatgtgaacacgggagcagctttcgtgaaggtgagcatggatggtgctccttatttacgcaaggtggatttgaagttgtacaagagctaccaagagttgttggatgcgctggctaaaatgttcagttcattcaccattgacaagtgtggatcccaaggcatgaaagacttcatgaacgagagcaaattgattgatcttctcaacggctctgattacgtaccaacctatgaagacaaagatgctgactggatgctcgttggtgacgtaccgtgggaaatgttcgtggaatcatgcaagcgcctgcgtataatgaaaggatctgaggcaatcgggctagcaccaagagcagtggaaaagtgcaagaacagaagctagagtcaaatttgtaaattccactttcgacaacaatctgctctatctgttgctcttgggcgtccacggaaagcattaatgctaatttctcgagcaaggggtagtctaatataggagccaagttgttacataatgtgtcggtaccatttcttagaaataattttcttgtatatgtattgtgtattttatatatgtgagaaaatatataatttggaaattagggacaagaaataatgaagtatgttttatatatgtgagcccgtttttgtttctaagtacaaaacgttacgttgtctatcgttggtgtgcttgtctaataagaataatgtctacgtttatagctgt

SEQ ID NO: 724 - DNA, 1192 bp, Glycine max
  Predicted polypeptide sequence is orthologous to G450
tttctcgcgtccgcggacgcgggccaaacaaaccaagcagtattataatagaaagaggacacaaagtgaaagagaagggagctatagccataaggagaaaaactttcaaagaggtgaaagcaaaagagttcttcttttccttttttatatatacttgggtgctaagctgtgtgagttcattgacaagcctgaaatggcaactatgctgacaaaggagcatggtctgaacctcaaggagaccgagctttgcctcggtttgcctggtgggggaggcggcggcggcggcggtggtgaggtggaaactccaagggccactgggaagagagggttctctgagactgttgatctgaaacttaatcttcattccaaggaagatctgaatgagaatctgaagaatgtctcaaaggagaagaccctccttaaggatcctgccaagccaccggctaaggctcaagtggttggttggccaccagtgaggtcatacaggaagaacatgatggcagtacaaaaggttagcactgaggatgtggcagagaagacaacaagcagcactgctaattctggggcatttgtcaaggtttccatggatggagcaccttacctgcgcaaggtggacctcacaatgtacaaaagctacaaagagttatctgatgccttggccaaaatgttcagctccttcaccatgggtaactatggggcccaaggaatgatagacttcatgaatgagagcaagttgatggatcttcttaacagctctgagtatgtgccaagctatgaagataaggatggtgactggatgctcgtgggtgatgtcccatgggagatgtttgttgagtcatgcaagcgtctgcgaataatgaagggatcagaagcgattgggcttgcgccaagagcaatggaaaaatgcaaaagcagaagctgaagcgggcctaatacaatgttcaatgaaatcccgtaccaaagtggacctatatatatatatatatatatgaagcacttcagcgagactatggagcggagtgttgttagcttgaatgtgtctggtgttttttgttttgttcgtatatagattcaacttttaattttaaggagccgatcgatgggccgcgtgtaggggccaagagccgcgcgccttaacctatatagtctggcttgtttaaaaaaaaaaaaaaaaaaaaaaaagggcggccgc

SEQ ID NO: 725 - DNA, 1127 bp, Glycine max
  Predicted polypeptide sequence is orthologous to G450
ccacgcgtccagccaaacaaaccaagcaacattataatagaaagaggacacaagagaaagaagggggagctatagccataaggagaaaaactttcaaagaagtgaaagcaaaaaagagttgttcttttcctttctgctgataagctgtgtgagtgagttcattgacaagcctgaaatgacaactatgctgacaaatgagcatggtctgagtttgaacctcaaggagactgagctttgcctcggtttgcctggcgggggctctgaagtggaaactccaagggccactgggaagagagggttctctgagaccgttgatctgaagcttaatcttcagaccaaggaagatctgaatgagaatctgaagaatgtctcaaaggagaagactctccttaaagatcctgctaagccgccggctaaggctcaagtggttggttggccaccagtgagatcatacaggaagaacatgatggcagtacagaaggttagcaatgaggaagtagctgagaagacaacaagcagcactattgctaattctggggcgtttgtcaaggtttccatggatggagcaccttaccttcgcaaggtggacctcacaatgtacaaaagctacaaagacttatctgatgccttggccaaaatgttcagctccttcaccatgggtaactatggggcccaaggaatgatagacttcatgaatgagagcaagttgatggatcttcttaacagctctgagtatgtgccaacctatgaagataaggatggtgactggatgctcgtgggtgatgtcccatgggagatgtttgttgggtcatgcaagcgcctgcgaataatgaagggatcagaagcgattggccttgcgccaagagcaatggaaaaatgcaaaagcagaagctgaagctggcctaatacaatgttctatgagagatcccgtaccaaagtggacctataaaagaaattatatgaagcacttcagcgagactatggagcggagtgttgttggtttgaatgtgtctggtgtttggcgttttgttcgtatatagattgtgcagcgtttaactacggtgccttaacctatacggtctggcgtgtttaggatgtgatcgtccaggctgtccggatggtatttg

SEQ ID NO: 726 - DNA, 1801 bp, Glycine max
  Predicted polypeptide sequence is orthologous to G450
gaaaggttgaagaattatttagaatgataaaagccatgaaaacagtgagttacttaccctcttgtgtgtgaaatgacgaaaccctaggagaaggagagtaataaagaaagaaatatgtggtgtaagcaagcaacatggagtgtccacttccgcttcttccactgaacaatcataggaagatagcatcaccttgtcgtcagcaagggcagcatgcacagaaaagtccagctcacacattcctccacgtgtcacaaacccatttccctctaaaaagacaggacgcaccatgcgtccttgtattatacgtccccttgtcctgcccctgcccctataccatagaacattagtacccccacacacaccccgcctcgagctttcacttcggctcgagcacaaatcaattaactgaatgcttagagagagaaagaggagaaggagtagtgataaggtgatcatagagcatattataagagagtgaaaactaatggaggttggcctcaagaaggagaacatggggtttgaggaaactgagttaaggcttggactgcctggaaacggaggcactgaagaagtgctcatcaggaagaggggtttctctgagactgaaactggtcatgaagatgagtctgccaccactgtggatttgatgcttaatctttcttctaaggaggccgcaaccactgctgctgctgctgcagatccaactgataagcacaagactttgcctaaggagaagacccttctgccagcagatcctgctaagcctccagccaagacgcaggtggtgggttggccacctgtgcggtccttccggaagaacatgttagctgtgcaaaagagcgtcggagaagagaacgagaagaacagcagcagccctaatgcaagctttgtcaaagttagcatggatggagcaccttaccttcgcaaagtggacttgaagatgtacaagagttaccgagagctctctgattctttaggcaaaatgttcagctccttcaccattggcaattgtgaatcccaaggaatgaaggatttcatgaatgagagcaagctgaatgatcttttgaacagctctgattatgtcccaacctatgaggacaaggatggtgactggatgcttgtcggtgatgtcccatgggagatgtttgttgaatcatgcaagcgtttacgcatcatgaaaggaaaggaggccattggtcttggtcttgcaccaagagccatggcaaaatccaagaacaggagctagactagtcgcacaattcatgacctgccccatcctttgtaattgcggtgcccagttggcttagttactaaagtaaggataattaagctgcagcagacacggatggacattgctaaggggttgaattatagttaatttgtgtcattatggtttgttataatatttcatcaaacaaaacaatgagatgcatgtctaattaagtactaatcatgaacaggaacataatgactctcaatcatgttgttagacttggctttcttatatatcgatctttgcttgttttgtgtgagtgcttcttaatacgagtataattttaagatgtgtttgtctgttgtagttgtagcgacatgttatcatgctttacatttaaaattgtcttgtaaaggttttccttatcattatgagattccttggtattaatcatttttcatataataacaaaattgtatttattacatttacgttagtttttgttgtgatcatcaagagccgaatatatagtactggaaatgttccctgaacatggtggatgggaaacaagaacatgtgcgtgttcat

SEQ ID NO: 727 - DNA, 1302 bp, Glycine max
  Predicted polypeptide sequence is orthologous to G450
gagaagacgacagaaggggtccccacaacgctcgaacgtgcctgcccctatacctcaccccacttactattattattgtacaacacaaccaggtccctgaatgctttttagagagagaaagagtaataataataaagtggaagaaaaagaattaggagagtgaaacaagaagaagaagaagaagaagaagaagaagaagaattgagaagatggtgtttgaggaaactgagctgaggctgggactgggactatgtctccctggaaatggaaccacggcaacaactgaagctgctgctgcggaattaggagtgaggaagagagggttctctgagactgaaactgatgaaacagccaccgttgatttgatgcttaacctctcacccaaggaagctgctgctgctgatggtgcagatccacgtgagaagccaaagacttcgccgaaggagaagacccttctgcttcccgatcccgccaagcctcctgccaaggcgcaagtggtgggatggccacccgtgaggtctttccggaagaacatgttcgcagcccaaaagagcagcggcggagaggaaagcgaaaagagcagccctaatgcaagctttgtcaaagttagcatggatggagcaccttacctccgcaaagttgacttgaagatgtacaagagttacccagagctctctgatgccttgggcaaaatgtttagctccttcaccattggaaattgtgaatcccaaggcttcaaggatttcatgaatgagagcaagttgatggatcttttgaacagctccgactatgtcccgacctatgaagacagggatggcgactggatgcttgtcggtgatgtgccatgggagatgtttgttgaatcatgcaagcgtttacgtatcatgaaaggaaaggaagctattggactggcaccaagagccgtggagaaatgcaagaacaggagctagactagtagttaccagtccaaaatctgctccatcatcattagcggtgcctagttgacttagtaactgaagcaaggttaagctgcagcagacacagagggagagagcagggtgttaaaaaatatagttaagtaaatctgtgtatcattatggtttgttatataatatatatttcaaacaaagttgtgagatgtcgtaagtataaattatgaacacaaacgataatgactctaaattatgttgcaagactttcttatttctttacttgtgtgcttgcataataataagtttattaatatgcttgtcaaaaaaaaaaaaaaaaaagcggccggttttttttttttttttaaaaaca

SEQ ID NO: 728 - DNA, 1224 bp, Glycine max
  Predicted polypeptide sequence is orthologous to G450
attgcggcgacgtgagcggttcgctgcccgcgacgttgtgagaagtccactgaaccttatcatttagaagaaggagaacatggggtttgaggaaactgagttaaggcttggactgcctggaaacggaggcactgaagaagtgctcatcaggaagaggggtttctctgagactgaaactggtcatgaagatgagtctgccaccactgtggatttgatgcttaatctttcttctaaggaggccgcaaccactgctgctgctgctgcagatccaactgataagcacaagactttgcctaaggagaagacccttctgccagcagatcctgctaagcctccagccaagacgcaggtggtgggttggccacctgtgcggtccttccggaagaacatgttggctgtgcaaaagagcgttggagaagagagcgagaagaacagcagccctaatgcaagctttgtcaaagttagcatggatggagcaccttaccttcgcaaagtggacttgaagatgtacaagagttaccgagagctctctgattctttaggcaaaatgttcagctccttcacctttggcaattgtgaatcccaaggaatgaaggatttcatgaatgagagcaagctgaatgatctcttgaacagctctgattatgtcccaacctatgaggacaaggatggtgactggatgcttgtcggtgatgtcccatgggagatgtttgttgaatcatgcaagcgtttacgcatcatgaaaggaaaggaggctattggtcttggtcttgcaccaagagccatggcaaaatgcaagaacaggagctagactagtcgcacaattcatgacctgccccatcctttgtaattgtggtgcccagttggcttagtaactaaagtaaggataagctgcagcagacacggatggacattgcagggtgttgaattatagttaatttgtgtatcattatggtttgttataatatttcaaacaaaacaatgagatgcatgtctaattaagtactaattatgaacaggaacataatgactctcaatcatgttgttagacttggctttcttataaaaccttgcctggtccgggggggggcctgctttattattattataagatgtgtttgtctgttgtctacagagccaagttcgacgacgagaacttttgaagaatcacacttgtccaaggggcgtgtgaatcggaaaaaaaaaaaaaaaagggggggccgc

SEQ ID NO: 729 - DNA, 1237 bp, Glycine max
  Predicted polypeptide sequence is orthologous to G450
tccaccacctcctcctccaaagaagaaaccatactactatcactccccaccacctcctcaccctatacctcacccccacccactattattattgtactacaacacaatcaagtccctgaatgctttttagagagagaaagagtcataataaagtgaaagaaaaagaaaaaggagagtagtgaaacaagaagaaaggagaagaagatggtgtttgaggaaactgagctgaggcttggactgagactaggactccctggaaatggagccgcgccaacaactgaagctgctgcggaattaggagtgaggaagagagggttctctgaaactgaaaccgatgaaacaacctccgttgatttgatgcttaacctctctcccaaggaagcttctgctgctgctactactgatggagcagatccacgtgagaatccaaagacttcgccgaaggagaagaatcttcctcttctcgatcccgcaaagcctcctgccaaggcgcaagtggtgggatggccacctgtaaggtctttccggaagaacatgtttgcagcccaaaagagcagcggcggagaggaaagcgagaagaacagccctaatgcaagctttgtcaaagttagcatggatggagcaccttacctccgcaaagttgacttgaagatgtacaagagttaccctgagctctctgatgccttgggcaaaatgttcagctccttccccattggcaattgtgaatcccaaggcttcaaggatttcatgaatgagagcaagctgatggatcttctgaacagctccgactatgtcccgacctatgaggacagggatggcgactggatgcttgtcggtgatgtcccatgggagatgtttgttgaatcatgcaagcgtttacgcatcatgaaaggaaaggaggcctttggtctgggttttgccccaagagccggggcaaaatccaagaacaggagctagactagtcgcccaattcatgacctgccccatcctttgtaattgcggtgcccagttggcttagtttctaaagtaaggataattaagctgcagcagacccggatggacattgctaagtggttgaattaaagttaatttgggtcattaaggtttgttataatatttcatcaaacaaaacaatgagatgcatgtttaattaagtactaatcatgaacaggaacataatgactttcaaaaaaaaaaaaaaaaaaaaaaaaaagaaaagagaagagaagaggaaagg

SEQ ID NO: 730 - DNA, 1019 bp, Glycine max
  Predicted polypeptide sequence is orthologous to G450
  misc_feature (773)..(773): n is a, c, g, or t
  misc_feature (775)..(775): n is a, c, g, or t
  misc_feature (806)..(807): n is a, c, g, or t
  misc_feature (811)..(813): n is a, c, g, or t
  misc_feature (815)..(821): n is a, c, g, or t
  misc_feature (823)..(829): n is a, c, g, or t
  misc_feature (831)..(832): n is a, c, g, or t
  misc_feature (834)..(836): n is a, c, g, or t
  misc_feature (862)..(862): n is a, c, g, or t
ggcgtttgaggcatctgttctttcgctcgcactgcctgaaaacctaggacgcactgtctctgacaacacgctgactaggaacagaggtgcccatactactgaaactgatactgaagaggatgagactgctaccgctgtggatttgatgcttaagctttcttctaatagaactgatgttgatcgaaatgcaactgataatcacaatactttgcctaaagagaagacactcatgcctgcatatcctgctaagcctccaaccaaggcacaagacgtatgatggccacctgtgcagtccttccagaagaacatgttaactgtacaaaagagcgtgagtgcatagaacgagaagaacagcgtcatccctaatgcaagctttatcaaaactagcatggatggatcaccttacctccgctaagtggtcttgaagatgtacaagagttaccgagagctctctgattctttaggcaaaatgttcagctccttcaccataggcaattgtgaatcccaaggaatcaaggatttcatgaatgagagcaagctgatggatcttttgaacagctccgactatgtcccgacctatgaggacagggatggcgactggatgcttgtcggtgatgtcccatgggagatgtttggtgaatcatgcaagcgtttacgtatcatgaaaggaaaggaagctattggactggcaccaagagccgtggagaaatgcaagaacaggagctagactagtagttaccagtccaaaatctgctccatcatcatgagagganantatttaaattattatttttttaatttttaanntttnnnannnnnnnannnnnnnannannntgttaaaaaatatagttaagtaaatntgtgtatcattatggtttgttatataatatatatttcaaacaaagttgtgagatgtcgtaagtataaattatgaacacaaacgataatgactctaaattatgttgcaagactttcttatttctttacttgtgtgcttgcataataataagtttattt

SEQ ID NO: 731 - DNA, 1346 bp, Oryza sativa
  Predicted polypeptide sequence is orthologous to G450
actagtggatcccccgggctgcgggctagtctctttttttttttttttttttttggtggacaatacatttgcaagcttcattgaacatttatgtagcgaacaaacagttcattgacaacattttgcaaagtaggtaggggtgctcaatcatagcagtagcacatggtgtccaaaccatttacacgaatagcattaacacacgtacaaagacttgggcacaatcaaatagagtttatgtccctaggagatttggcgaagctaacataacaagacacctttttttttaactttcacaatagcaaaccatgtagtacagaccataaggcagactccatcttaaaactgttagacttcttggttttcagaaaattccctacagtcatttgatctccatcttgcttttgactgtggggcagaaaccattctagttgcggtttttggacttatcaactgcccttggagcaagtccaattgcatctgaacctttcatgatcctgagtctgcgacaagagttggcaaacatctcccatggaacatcgccaacaagcatccagtctccatccttgtcttcataagtcagcacatattcaccatccttgcggctctcagataagccatccttgccagttgtgaagccaatgaacatcttctcaagcgcagttgacaggtccttgtagttcttgtaggtcttgaggtccaccttcctgaggtagggggcaccatccatgctgaccttgacgtacaggaacccctggccctgcttcgcttcagcatcctccttgctgctcttcagctggttagtagccatcgtgttcttgcggtagctgcgaattggtggccatccaaccacctgagccttggcagcaggcgcctgcggcgcggcggcgaccttcttgtcctcctcctccgcatcctcatcctcctcgccggccgccgccttcttgcccttcccggcggcggcggcggcggcggcggacgccggcagcggacgcgcctcgtcggagaacccgcgcttggcgcccttggcagcggggagaaggtcgagcgtggcggcgggcggggagcggtccggcgagtgggagccgggcaggccgaggcggagctcggtgcccttcaggtcgttgtcggcggcggcatcggcggcggcgggcaccggcggcgagaggcctatgtagtcgagctcgagtgggggcgacatggggagcagcaggacatgaaccggagagagagtgggggagtgggtgtgggtgtgtgttgtgtccagcgagccacagcgagacaagagaagagagtgtgtgtgtgtgtgtggacccgccgctgaggtggtgaagctgcttcttcttctt

SEQ ID NO: 732 - DNA, 1327 bp, Oryza sativa
  Predicted polypeptide sequence is orthologous to G450
ctctcctctcctcttctcttccctctctctatatatatactcagctccaagctgttcttggctcctccctcttcttccaacacctcctaatcaccacaaaggcttaaaaatctccagtctccatagagagaaagagagagaagagaaggcagcttgatttggggcgaggagacgcgatagccgcgataggctaagcagctggcagcggcggctgctgcgatggccggcgccgacgtggacgtcgggacggagctccggctggggctgcccggaggtggcggcggcgccgccgagggcggcggccaaggccgcgaagaggggcttcgaggagaccattgacctgaagctgaagctgcccaccgccggcatggaggaggccgccgccggcaaggcggaggcgccggccgccgagaaggccaagaggccggcggaggccgccgccgccgacgccgagaagccacctgctcccaaggcgcaggcagtgggttggccaccagttcggtcgttccgcaggaacatcatgaccgtccagtcagtgaagagcaagaaggaagaggaagctgacaagcagcagcagcagcccgctgccaatgccagcggcagcaacagctctgccttcgtgaaggtcagcatggacggggcaccctacctgcgcaaggtggacctgaagatgtacaacagctacaaggacctctcccttgctctgcagaagatgttcggcaccttcaccgcaactgggaacaatatgaatgaggtgaatggctctgatgctgttacaacttatgaagacaaggatggtgactggatgcttgttggagatgtcccgtggcagatgtttgtcgagtcatgcaaacgcttgaggatcatgaagggttccgaagccattggtcttgcaccaagagcaaaggacaagtacaagaacaagagctgaaaatgttgcagtattaagatgctgagcatggtgccataagaatggtgttcttgcagtgtgttatggtttccttagaaatataaggttttacttgtttagctggattaaaagaaggaagagttgtcatgtttaatttgtttatggaccagaagcaataatctatttgtgtgtagctggattggtgttatgtgatgtcccctaccgtgtgtcccaagatctacttgatgattttattccaatgttgttaatttaagtttgtgtgattgtgaagtaaagggtatcaatgagactattattattatggtaaaaaataaattaacatgtttgttaaaaaaaagcaaaaaaaattttgtaaaaaaaaaaaaaaaaaaaactcgagactagttctctctctcc

SEQ ID NO: 733 - DNA, 1318 bp, Zea mays
  Predicted polypeptide sequence is orthologous to G450
attgggtacctcgaggccttgggtacctcgaggccggccgggcggcctctctgccttttccttttccttcccccgctttctccttccttcctcctcctcccggctcccctcacccagccaccggccatgtcggtggagacggagcggagctccaccgagtcctccggggcttccgggctcgacttcgaggacaccgcgctcacgctcaccctccgcctcccgggctccgcgccttccgccgccgccgccgccgcggcttccctgtccctctcctcctcgtcgtcctccgccttccccgaccccgaccgcaagcgcgcctcctccgacgctgaccccggccgctcctccccgctcgccgcgtcctccgacgctgcaccggcacccaaggctcgtgtggtgggctggccgccggtgaggtcgtaccgcaagaacgcgctcgccgacgccgcgggctccagcaaggccgccaagttcgtcaaggtggccgtcgacggcgcgccctacctgcggaaggtggacctccaggcgtacgccggctacgaccagctgctccgcgcgctccaggacaagttcttctcccacttcaccatcaggaagttcgccgacgacgagaggaagctggtggacgcggtgaacgggacggagtacgtgcccacgtacgaggacaaggatggcgactggatgctcgtcggcgacgtcccctggaagatgttcgtggaaacctgccagcgccttcgtctgatgaaaggttcagaggccgtgaacttggcaccaagagccgcccgatgaggcacactccgttgggcgttggcacgcacgcacgcactggcgtcttgaaggaaagcgggaactctgctggtcttgatgaggatcttcacgtgagataggaacgtgtgtacagttgtcgccttatggtattgagttgaggaaacttggaagttccattacttgtctgtagtctctactttatatagatgcgaagaagcttgagatacacattgcctacaatgtcttttgatgaataagaccagacagcaccgaaccgaactcgtcctccacacggttgctttgccatctcggtggttttgtggtggtggtggtggtcgtgcttcctataggtgtgaggctgatggcgtggctgccatttatacaatctttaatcgtgttttgttgagctttattatatggttttgtttgagagttcatggctctgcatcctgttcctacgggatgctggtcagcttttccctaaaaaaaaaaaaaaaaaaaaaaaaaaaaaaaaaaaaaaaaaaaaaaaaaaaaaaaaaaaaaaaaaaag

SEQ ID NO: 734 - DNA, 1080 bp, Zea mays
  Predicted polypeptide sequence is orthologous to G450
gatttattgccccctcttcccttcccaacccaacccattgcatttgcaagcccttttacattgcagagcgccagagcctcgctcgctctcggaacagagctaggcagctaacagacgaagaagaagcaagccaagcagaattgagagagaggcgaggacgtggcgacgacggcagccgcgatggcgacgacgacggacctggggttcgaggcgacggagctccgcctgggcctgcccggcgggggaggtggaggggagccggcgctgggcggcgaggggaggagctcttcctccgcctccggcaagaggggcttcgccgagaccatcgacctgaagctgaagctggagccagcggccgtcgtggaggcggaggaggaggaggaggaccacggcgttgctgttgcccttgagaaggaggaggaggccgggaagatgaagcggtccccgagccagagcagcgtcgccgccgccgccgccgccgtgctggctgaccccgccgagaagccgcgcgccgccaaggctcaggtggtgggatggccaccggtcccggtcgttccggaagaacatcatgtccgtgcagtccgacaagggcgccggcaaagacgccgccgccgccaacggcgacaagtcctcggcggcggcaggcgggcggtgccgcgttcgtgaaggtgagcttggacggcgcgccctacctgcgcaaagtggacctcaagatgtacaggagctaccagcagctgtccaaggcgctcgagaacatgttcagctccttcaccatcggaagctgtgggtctcaagggatgaacggcatgaacgagagcaagctggtggatctgctcaacggctccgagtacgtgccgacctacgaggacaaggacggggactggatgctcgtcggcgatgtgccgtgggagtgagcactgcatgcatgcgcttcttcctgcactatactccttattatattattgcctaatcggaaaataataataatttccatttcattttcaggatgttcgtcgaatcatgcaagcgccttcggatcatgaaaggatcagaagccattggcctggcgccaagggccat

SEQ ID NO: 735 - DNA, 1598 bp, Zea mays
  Predicted polypeptide sequence is orthologous to G450
caacccttgtgacgttattgccccctcttcccttcccaacccaacccattgcatttgcaagcccttttacattgcagagcgccagagcctcgctcgctctcggaacagagctaggcagctaacagacgaagaagaagcaagccaagcagcaagcgaagcgagagagaggcgaggacgtggcgacgacggcagccgcgatggcgacaacgacggacctggggttcgaggcgacggagctccgcctgggcctgcccggcgggggaggtggaggggagccggcgctgggcggcgaggggaggagctcttcctccgcctccggcaagaggggcttcgccgagaccatcgacctgaagctgaagctggagccagcggccgtcgtggaggcggaggaggaggaggaggaggaccacggcgttgctgttgcccttgagaaggaggaggaggccgggaagatgaagcggtccccgagccagagcagcgtcgccgccgccgccgccgccgtgcgtggctgaccccgccgagaagccgcgcgccgccaaggctcaggtggtggggatggccaccggtcccggtcgttccggaagaacatcatgtccgtgcagtccgacaaggggcgccggcaaagacgccgccgccgccaacggcgacaagtcctcggcggcggcaggcgggcggtgcccgcgttcgtgaaggtgagcttggacggcgcgccctacctgcgcaaagtggacctcaagatgtacaggagctaccagcagctgtccaaggcgctcgagaacatgttcagctccttcaccatcggaagctgtgggtctcaagggatgaacggcatgaacgagagcaagctggtggatctgctcaacggctccgagtacgtgccgacctacgaggacaaggacggggactggatgctcgtcggcgatgtgccgtgggagatgttcgtcgaatcatgcaagcgccttcggatcatgaaaggatcagaagccattggcctggcgccaaggggcccatggagaaatgcaagaacagaagctgaggagaagacggacggacggaaggcttgcatctcagcaccacccaggggtggatggatgcaagaagaacaaatctccatggcttttgcagctctgctcgtctctgtatcatactcgtcgtccctgcccttcaggcctctgtatctccctgatcaatgaagtcgttttggtgtgtcaactgttctctccgtgcccagccttgtcagtgaaagagtcagtcagtgtccatcaagtctcatcttgtcctatacagaagcacagaagccatgcatgaacatgtacctgtcctataacaatgtctttttttgctacctgttttttttttctctctctctctttttttggcacaagatgcaaaggcaccctgctcctgatcaaagggccttttgcatcataagctgtttgattataattaccatggtgtgtcagtggaacaaataactgttgcaaggtgttaaaaaaaaagttgtattgtaatatgatcacctctcttccttgttgttttcattgtctttggtattagctgttccatggaacaggattatatatataagctcagtgatg

SEQ ID NO: 736 - protein, 193 aa, Oryza sativa
  Orthologous to G450
MSTSSGADSSPPVSGLDYDDTALTLALPGSSSSSSSTADPERKRAAHADHADAKPPSPKARAVGWPPVRAYRRNALREDSARAKLVKVAVDGAPYLRKVDLAAHAGYAPLLRALHGMFASCLAVRGGGGGDGEGTKLVDLVTGAEYVPTYEDKDGDWMLVGDVPWKMFVESCKRIRLMKSSEAVNLSPRRSSR

SEQ ID NO: 737 - protein, 219 aa, Oryza sativa
  Orthologous to G450
MAGLGFDETELRLGLPGAGELAARSSGKRGFAETIDLKLKLQPAAPAAVSGEEGAQEDKEDADAAAAAADEKMSMKRSASQSSVVTAEPDPDKPRAPKAQVVGWPPVRSFRKNVLAEKCKAAALVKVSMDGAPYLRKIDVAMYKSYPELSMAFQNMFTSFTIGKCGSHQQLKESNKLRDDLEYVPTYEDKDGDWMLVGDVPWDTKGSGEMQELKLIKEN

SEQ ID NO: 738 - protein, 207 aa, Oryza sativa
  Orthologous to G450
MSVETERSSTESSAASGLDFEDTALTLRLPGSLAAAAAPDPDRKRSSPSSSDAADAADNSSPLAAAADAPPAPKARVVGWPPVRSFRKNALAAKFVKVAVDGAPYLRKVDLEAYSGYDQLLRALQDKFFSHFTIPIDGRKVAGKFADDERKLVDAVNGTEYVPTYEDKDGDWMLVGDVPWKMFVETCQRLRLMKSSEAVNLAPRAAQ

SEQ ID NO: 739 - protein, 236 aa, Oryza sativa
  Orthologous to G450
MAGADVDVGTELRLGLPGGGGGAAEAAAKAAKRGFEETIDLKLKLPTAGMEEAAAGKAEAPAAEKAKRPAEAAAADAEKPPAPKAQAVGWPPVRSFRRNIMTVQSVKSKKEEEADKQQQQPAANASGSNSSAFVKVSMDGAPYLRKVDLKMYNSYKDLSLALQKMFGTFTATGNNMNEVNGSDAVTTYEDKDGDWMLVGDVPWQMFVESCKRLRIMKGSEAIGLAPRAKDKYKNKS

SEQ ID NO: 740 - DNA, 1320 bp, Oryza sativa
  Predicted polypeptide sequence is orthologous to G464
ctccttgcccccctctcgaggcccaggtgttcgtccgtgtcctcttctccactccacacacgcacacgcacaagccaagcagcaagcagcggcgccgatgagaggaggagtagctgggcccaccgccggcgagccgccggggacggaggcggaggcggaggaggtggaggagagctcagctggggacgacgaggagctggagctcgggctcagccttggctccaagaaacagcagcagcagcagcatgcgccgtgccgaatcctgacggccagggacctgcagccggcggcggcgctgtcaccggactcctccgtgtcgtcgtcatcccccgcggcggcggcggcggcgggggggaagagggctgagggccccaccgccaccacctcgcctgggacggttgcttccggccatccacacagctttggagtggtgggatggccaccgatccgacagttcaggatgaacagcctgttcaatcaggctaaagaaaacacatctgaaaccgacaccaagaagaccgccaccaatgaatctgatgtgcagaaggacaaggaggagggcgaaaagaaaggacgggttgctggatgggtgaaggtgaacatggatggagaggtcattggaaggaaggtggatctcaatgcgcaccgctcatacaagacccttgcattagcccttgaactcatgttcacgaagccgtccattggcctttgcgcttctcataatacaaagtcgctgaaactactagacaactctgccgaataccagctcacctacgaggacagggatggtgactggatgctcgttggagatgttccttgggaaatgtttgtcagctctgtgaagaggttgaggatcatgaggacatcagatgcgaatggtcttggtcagcgataccagggaattcacagaaccattgcttcaacaagaggcagatcctgagagcgtgtgacaaggaaaagagctataccgctggtgaagcttggagcgtgcttgatggttaattacttgtccagttaaaatagcagaaggctagtaagaaagagccacagggctcacccggttctgttatatttttgcctttgtggtgcctgtttttgtttgcactgtcgatctgcaagagcatatggtcgccttgctctgcttgcatgtacaagtatgtctttctagtagtttttatggtgtttgatgatgatccttgtgcctacctgattactactgactcttgcacagcctcacaaatctctatgaattagccctggagtttcattgattaatccacctccaaaattcctaatatgtgtgatggactagttctctcc

SEQ ID NO: 741 - DNA, 1475 bp, Zea mays
  Predicted polypeptide sequence is orthologous to G464
ccttttttttttccttttttttttttttgaaacagcagagcagatacttctgccatatcaaacacaaggataaaaaccaacactttgggcgaccattcctcacaggtaaacagcgtggacagaagagctgggggcgatgatgctcgtatagcccataagaaaagctcaacgagggcaccacagggaagaagcaaaaaaaaaaacttctactatttccactagacacaatgaagttgcctaagtttagtcgttcgaattgaagaactaaacttagacataaaagttagccatgttgtggcgccttagacagtaaaccaaacagccccgtaatctcacaactatgccagcgatatgggctgctgttactgttacgtgatatcaaatacagttcaagcttcaccagcggtgttagcaccaaacgcacatcggtggtttcacgtcctgcctctcgtgcaagctgctgtgggtctgtgagacccttggaatcgtggaccgagacctttggcgtctgaggttctcatgatcttgagcctcttcactgaacctacaaacatctcccagggaacatctccaacaagcatccagtccccgtccctgtcctcataggtgagctgatactccgatgagctgtctaatagctttagagtctttgaactgctagaagtgcaaagaccaatggacggcttcatgaacatgagctcaagtgctgaggcaagggtcttgtaagagcgatgggcattgagatcgaccttccttccaatgatatctccttccatgttcaccttcacccaaccgacggtccggcctttcttgctctcctccttgtcttcctgcatgtcaggttcgacgatgggcttcttggcgccagcctccgatgcattctctttggcctggttaaataggctgttcatcctgaaagttcttatgggtggccatcccaccactccaaagctctgtgggtggccagacgcgaccgtccctggcgagttgggcgccgcatccgccttggccctcttgcttggcgccgcggtacctgcacctgccgcgggggaggaagaggacacggaggaatccggtgacagggacctcggctgcaggtcccgggccgtgaggatccggcacggcggcggatgctgctgctgctgttgcttggagccgaggcagagccccagctccagctcgtcgtcgtcctgctccaccaccgtctcctcgtcctcctcctcggcgccggagttctcctccacctcttccgcgtcggctggaggcggctcgtcggacatgaacgccgcagtgggccccgctcctcctcctctcatcgcggcgctgctctctgccttcctgttctgcgactgtgctgtgcgttctgggagagacacctcgagggagaggaaaggaggtgtcgctattatctgagcacagcagacagagagagagggaggagctctccggcccggccggcctcgaggtacccaatg

SEQ ID NO: 742 - protein, 281 aa, Oryza sativa
  Orthologous to G464
MRGGVAGPTAGEPPGTEAEAEEVEESSAGDDEELELGLSLGSKKQQQQQHAPCRILTARDLQPAAALSPDSSVSSSSPAAAAAAGGKRAEGPTATTSPGTVASGHPHSSFGVVGWPPIRQFRMNSLFNQAKENTSETDTKKTATNESDVQKDKEEGEKKGRVAGWVKVNMDGEVIGRKVDLNAHRSYKTLALALELMFTKPSIGLCASHNTNSLKLLDNSAEYQLTYEDRDGDWMLVGDVPWESAIPGNSQNHCFNKRQILRACDKEKSYTAGEAWSVLDG

SEQ ID NO: 743 - DNA, 1434 bp, Glycine max
  Predicted polypeptide sequence is orthologous to G470
  misc_feature (718)..(718): n is a, c, g, or t
ccctctcccccacacaacacaccacaaccttcttcttcttcttcttcaacttctggttcaaaacctcaacagtttgttgaattgcgcgttgaaatacgactcaatattctttcgcgagctctgttctcacttcaaaggttaggttcttcgacagtttctttgtttccactccgtcgcttgctgagaaggcgtgagcgagagttgtagaattacgcaacgagtgtcgcggatgagagatctgtggtgaggtctctggaaatgacatcattggaggtgacgatgaagggaaattgcttgaaccacaacgacggcggagccacggagcctcattccccgtccacggccaaagacgcagaagctgcacttttcagggagctatggcatgcttgtgcaggtcctctagtcacggctccgcgagaaagagagcgcgtgttttatgttccctcagggacatactgagcaggtggaggcgtcggcgaaccagggggcgggcccagcacttgccgggtttacgatctcccacccaagatcctttgtcgggtcatcaacgtgcagctgaaggccgagcccgacacggatgaggtgtttgctcaggtgactttgcttccggagccaaacgtgagtttcctctcctcgttagtgtgtgttttttagagagagacagagtaattgggtgaaaaagtggtgatgcttatgatttttttttaatgtgggtggnggatgatgatatagcaagatgagaatgccgtggagaaagagccaccaccacctccgccaccacggtttcatgttcattctttctgtaagactctgacggcgtccgatacgagtacccatggtgggttttctgtgctgagacgacatgctgatgaatgtcttcctcctctggatatgtcgaagcagccacccacactggaattggtggctaaggatcttcatgcaaatgaatggcgatttaaacatatcttccgaggtcaaccccgtagacacttgcttcagagtggttggagtgttttggccagctccaaaaggcttgtcgctggggatgcatttatatttcttagaggtgagaatggggaacttcgtgttggtgtccgacgagcaatgagacagcagggtaatgttccatcctcagttatctccagccacagcatgcatctcggtgtccttgcaactgcttggcatgccatctcgaccgggaccatcttcactgtttattacaagcccaggaccagtcctgctgaatttattgttccgtatgatcaatatatggagtctctcaaaaataattatagcatcgggatgcgggtcaaaatgaggtttgaaggtgaagaggctccagagcagaggtatgggcaaatgatcctgcagtgctttattattattaaatgttcgattctagtgggaaatatcccttgattggcttgtaaaata

SEQ ID NO: 744 - DNA, 887 bp, Oryza sativa
  Predicted polypeptide sequence is orthologous to G470
gggggatgtgaagatctggtggggtgatggcgacggcggaggtcggcggcggcggcggtgagggggatgctgctgccgcggcggtggcgcgagcaggcggcggcggcggcggaggaggaggaggaggggaggacgcgctgttcacggagctgtggagcgcgtgcgcggggccgctggtgacggtgccgagggttggggagaaggtgttctacttcccgcaggggcacatcgagcaggtggaggcctcgaccaaccaggtaggcgagcagcggatgcagttgtacaatctcccatggaagatcctgtgtgaggttatgaacgttgagctgaaggccgagccagacaccgacgaggtttatgctcagctcactctgcttcctgaattgaagcaacaagaagataacggctctactgaggaggaggtgccttctgctccagcagctgggcatgttaggccacgggtgcactcattctgcaagacattgaccgcctcggacacgagcacacatggcggcttctcggtgctgcgacgccacgcggacgaatgcctcccaccactggatatgagccgtcagcctccaacacaagagctggtggccaaggatctgcacggtgtggaatggcgctttcgtcacatattcagaggtcaaccacgaagacaccttttgcagagtggctggagtgtgtttgttagtgccaaacggcttgttgctggggatgcctttatctttctcagaggtgagaacggggaactgcgtgttggagtcaggcgtgcaatgaggcagcaaactaatgttccatcttcagtgatatcaagccacagcatgcatcttggggttcttgccacagcatggcatgctgttaacacaggaaccatgttcactgtc

SEQ ID NO: 745 - DNA, 560 bp, Oryza sativa
  Predicted polypeptide sequence is orthologous to G470
  misc_feature (78)..(78): n is a, c, g, or t
tagtggatccccgggctgcaggaatcggcagagggttggtctgttgtgtagcaacaagaagataacggctctactganggaggaggtgccttctgctccagcagctgggcatgttaggccacgggtgcactcattctgcaagacattgaccgcctcggacacgagcacacatggcggcttctcggtgctgcgacgccacgcggacgaatgcctcccaccactggatatgagccgtcagcctccaacacaagagctggtggccaaggatctgcacggtgtggaatggcgctttcgtcacatattcagaggtcaaccacgaagacaccttttgcagagtggctggagtgtgtttgttagtgccaaacggcttgttgctggggatgcctttatctttctcagaggtgagaacggggaactgcgtgttggagtcaggcgtgcaatgaggcagcaaactaatgttccatcttcagtgatatcaagccacagcatgcatcttggggttcttgccacagcatggcatgctgttaacacagggaccatgttcactgtctactacaagc

SEQ ID NO: 746 - DNA, 1131 bp, Glycine max
  Predicted polypeptide sequence is orthologous to G481, G482
attcggctcgagataatccagagagaggagagagaagtaaaaaggtggaggaagaagcgaaaagcgagtgagggcagtgttgcttaataaaagaaaacgaacggtggtgataggcttcagtctagatctcaatcgtctccaccttgctttcttctccagcgtccgattctctcaccgatctcgcgccaaatacaaattcgtgtcaacccaacccagggttccggcgagcatggccgacggtccggctagcccaggcggcggcagccacgagagcggcgaccacagccctcgctctaacgtgcgcgagcaggacaggtacctccctatcgctaacataagccgcatcatgaagaaggcacttcctgccaacggtaaaatcgcaaaggacgccaaagagaccgttcaggaatgcgtctccgagttcatcagcttcatcaccagcgaggcctctgataagtgtcagagagaaaagagaaagactattaacggcgatgatttgctctgggcgatggccactctcggtttcgaggattatatggatcctcttaaaatttacctcactagataccgagagatggagggtgatacgaagggctctgccaagggtggagactcatctgctaagagagatgttcagccaagtcctaatgctcagcttgctcatcaaggttctttctcacaaaatgttacttacccgaattctcagggtcgacatatgatggttccaatgcaaggcccggagtaggtatcaagtttattattgaccctcttgttgtaacgtatgttttctacgccagttaccaagtgctcacggcatattgaatgtctttttatgttatgtgaatactgacaggagatgttggttcttgtgtccgtttttttttttaaattaaggtttgtatattatctttggattcgaattattatttgaaagttattattatattgtaaatcctagagccctgttgtctgaatccatcaggcggcttggtaaagaccgagattttaggactgattgtaagcataaatccgaatattcttttcctaatttctttgcgcaataatgtatgaaaaaggctcgagcttctttttaaaaaaaaaaaaaaaggaacaaaaaaaaaaaaggggggg

SEQ ID NO: 747 - DNA, 993 bp, Glycine max
  Predicted polypeptide sequence is orthologous to G481, G482
attcggctcgggaggaacgtgaaagtaaaacggacggtggcgatagaagcgtctctcatctccatcgtctcctcactcctctcttctccagcgttcattttttctcgcgcccaaatacaaaatcacatcacaacagggttccggcgaccatgtccgatgctccggcgagtccatgcggcggcggcggcggaggcagccacgagagcggcgagcacagtccccgctccaatttccgcgagcaggaccgcttcctccccatcgccaacatcagccgcatcatgaagaaagcgcttcctcccaacgggaaaatcgccaaggacgccaaggaaaccgtgcaggaatgcgtctccgagttcatcagcttcgtcaccagcgaagcgagcgataagtgtcagagagagaagaggaagaccatcaacggcgacgatttgctttgggctatgaccactttaggtttcgaggagtatattgatccgctcaaggtttacctcgccgcttacagagagattgagggtgattcaaagggttcggccaagggtggagatgcatctgctaagagagatgtttatcagagtcctaatggccaggttgctcatcaaggttctttctcacaaggtgttaattatacgaattcttagccccaggctcaacatatgatagttccgatgcaaggccaagagtagatattgatcctctccttcagtgtttgacatgtgtgatctaaatgccagtggaacttttatgtcaatatgtgcccttggtatattgaatgcattttatgttatgtaaacactacatgcggggatgttggttcttgtgaccagatattatttattaagacttacatttatctttggaaaagaatcattattcataagttatattgtaaattctggaacaatgcttgtctgattccatcaatcgtcctggtaacgattttatgtacctgattggaagcataaattggtatattctttcccttcgttgtctgtt

SEQ ID NO: 748 - DNA, 1000 bp, Glycine max
  Predicted polypeptide sequence is orthologous to G481, G482
taataaggttgtatatggtttggtgggatggctcgagagtctttagaaaagatatccatggctgagtccgacaacgagtcaggaggtcacacggggaacgcgagcgggagcaacgagttgtccggttgcagggagcaagacaggttcctcccaatagcaaacgtgagcaggatcatgaagaaggcgttgccggcgaacgcgaagatatcgaaggaggcgaaggagacggtgcaggagtgcgtgtcggagttcatcagcttcataacaggagaggcttccgataagtgccagaaggagaagaggaagacgatcaacggcgacgatcttctctgggccatgactaccctgggcttcgaggactacgtggatcctctcaagatttacctgcacaagtatagggagatggagggggagaaaaccgctatgatgggaaggccacatgagagggatgagggttatggccatggccatggtcatgcaactcctatgatgacgatgatgatggggcatcagccccagcaccagcaccagcaccagcaccagcaccagcaccagggacacgtgtatggatctggatcagcatcttctgcaagaactagataacatgtgtcatctgtttaagcttaattgattttattatgaggatgatatgatataagatttatattcgtatatgtttggttttagaaatacaccagctccagcttgtaattgcttgaaacttccttgttgagagaatatagacattattgtggatggtgatgtggcatatgtggcatacacagaatttttgtattcttctttctctctatggatttttgtgtaagggcaggactatggctttgtttgctgatcgtatagctagtatggtgctatctaggttcggatttttttctttttcatgtataatgaaaaattaacggaggaaattactcttacgttactttgaaattaattaactaaatcccgcttctgcctttttttttttctcctttctgag

SEQ ID NO: 749 - DNA, 620 bp, Glycine max
  G3476 Predicted polypeptide sequence is orthologous to G481, G482
  misc_feature (560)..(560): n is a, c, g, or t
tgaagaagattcctggattgattgtgaagatggctgagtcggacaacgactcgggaggggcgcagaacgcgggaaacagtggaaacttgagcgagttgtcgcctcgggaacaggaccggtttctccccatagcgaacgtgagcaggatcatgaagaaggccttgccggcgaacgcgaagatctcgaaggacgcgaaggagacggtgcaggaatgcgtgtcggagttcatcagcttcataacgggtgaggcgtcggacaagtgccagagggagaagcgcaagaccatcaacggcgacgatcttctctgggccatgacaaccctgggattcgaagagtacgtggagcctctgaagatttacctccagcgcttccgcgagatggagggagagaagaccgtggccgcccgcgactcttctaaggactcggcctccgcctcctcctatcatcagggacacgtgtacggctcccctgcctaccatcatcaagtgcctgggcccacttatcctgcccctggtagacccagatgacgtgctcctctattcgccactccctagactttntatattatattatttaattaaactctcttctccactcaacctttgcaagatcactgggtt

SEQ ID NO: 750 - DNA, 1872 bp, Glycine max
  Predicted polypeptide sequence is orthologous to G481, G482
aacataaataataaaatatttctttgaacatttcttaaaaagtatgaacataaatttaaattattattttatatttaatgtatttacattaatttatttgtcttacatacacttgtaatgttctccttatatttattaaactataatatagtatatataaagaaaagattttgagaatttgaataaaataagagtgtccaagtcagaggcgagcacgtgccagataccaaagcaacggtccagatcatggagcactcaccaaatccaagggctcctatttgtccgtgcaaactcacacttatcgcccaacaacggtccacaaagcgccacgtgttctcaagataaagcgttattaacccttctgatccaacggatcctgctcattacctcccaaacaagcccttccgttccgtttcacctttcctcttcccgccggagccgccgtcacccgccgccggcaatcgtatcagaccctcccaatacaccgtctccgacttccacgcagaattgcacgattcattgatttcaattttcaagtcttgaggatttcgtttcaacagcgcttcaatttgacgcagaaaaactgagtcaaaccaattctcccagagttcgtgacttggattctcaatttatcgttcattccgaatagaatttgaaactccgaagaaaactgcaccgaacactgaatctcagttaccgaggagcttcttctacgaaccgtgcttaattccacacagaaacaccgagtcaaactggttcgtgctgtgttcgtggttcagattctcaatcgaaatttgaaattcagaagaaaaccgcaccgaacacagaatttcagaatctgaacaagtttcttccgttaacagcacttcaacttcacgtggaacaagaatcaaaccgtttcgtggttcggattctcaattcctcgtccattcgcaatcgattttcaaattccgaagaaaaccgctccgaacactgaatttcagactctgaacagcgaacagtacttcaagttcacgtggaacgagtcaaagcgattccaatcaatttcgcgaactcctccacggtgaactccgatattttcctgcactgacttagtgattcgtttcatatttctcagcttcgattatccgtttgtcgatggcggactcggacaacgactccggcggcgcgcacaacgccgggaaggggagcgagatgtcgccgcgggagcaggaccggttcctgccgatcgcgaacgtgagccgcatcatgaagaaggcgctgccggcgaacgcgaagatctcgaaggacgcgaaggagacggtgcaggagtgcgtgtcggagttcatcagcttcatcaccggcgaggcctccgacaagtgccagcgggagaagcgcaagacgatcaacggcgacgacctgctctgggcgatgaccactctcggcttcgaggactacgtcgagcctctcaagggctacctccagcgcttccgagaaatggaaggagagaagaccgtggcggcgcgtgacaaggacgcgcctcctcctaccaatgctaccaacagtgcctacgagagtcctagttatgctgctgctcctggtggaatcatgatgcatcagggacacgtgtacggttctgccggcttccatcaagtggctggtggtgctataaagggtgggcctgtttatcccgggcctggatccaatgccggtaggcccaggtagatgggcctatgttattattattattattattcttattcgtaagttaaaagaaatgtgagattcaaagtggtgattaagtgaattagtaacaaaaaagtgcgactcagttgattaaaaatatatataaattattataagtcttttaatatgtttttgattctcacacat

SEQ ID NO: 751 - DNA, 521 bp, Glycine max
  Predicted polypeptide sequence is orthologous to G481, G482
agactttagctttacacaacatattattgtaaggctagctagctagccatggctgagtcggacaacgagtccggaggtcacacggggaacgcaagcggaagcaacgaattctccggttgcagggagcaagacaggttccttccgatagcgaacgtgagcaggatcatgaagaaggcgttgccggcgaacgcgaagatctcgaaggaggcgaaggagacggtgcaggagtgcgtgtcggagttcatcagcttcataacaggagaagcgtccgataagtgccagaaggagaagaggaagacgatcaacggcgatgatctgctgtgggccatgaccacgctggggttcgaggagtacgtggagcctctcaaggtttatctgcataagtatagggagctggaaggggagaaaactgctatgatgggaaggccacatgagagggatgagggttatggtcatgcaactcctatgatgatcatgatggggcatcagcagcagcagcatcagggacacgtgtatggatc

SEQ ID NO: 752 - DNA, 1156 bp, Glycine max
  Predicted polypeptide sequence is orthologous to G481, G482
gaagttaggtaaaaatagtggaaatgagtatcttctttgttccatgtcttgcattgtctgcttagatttgtttttgtaaatcgattccaccaatcatcgctgtccttgtcgcgccaaatacaaaaaccaccacttctacctctctccttctgactctctcactctcaccgggtttgtgagatgtcggatgcgccaccgagcccgactcatgagagtgggggcgagcagagcccgcgcggttcgtcgtccggcgcgagggagcaggaccggtacctcccgattgccaacatcagccgcattatgaagaaggctctgcctcccaacggcaagattgcaaaggatgccaaagacaccatgcaggaatgcgtttctgagttcatcagcttcattaccagcgaggcgagtgagaaatgccagaaggagaagagaaagacaatcaatggagacgatttgctatgggccatggccactttaggatttgaagactacatagagccgcttaaggtgtacctggctaggtacagagaggcggagggtgacactaaaggatctgctagaagtggtgatggatctgctacaccagatcaagttggccttgcaggtcaaaattctcagcttgttcatcagggttcgctgaactatattggtttgcaggtgcaaccacaacatctggttatgccttcaatgcaaagccatgaatagtttagatgcttctacgcatcttatttatttccctttaatgcttgtacgcatggcatgggtggaaacaattgtctggtgatttaatatttaggttctcgtgtagaagggtgtcagaattttgttacggtactaatgtagatttttattaatacatgtcttatttagctttgtaatacctactcaagggagagatgtgtttagggttatgctagtgattcgccatgtagcttgtcagggtgagaagcacttgcttttagagttttctttagattattatataatatataatatttgcagacactgcatttgttagtttatttagtttaggccatacagtttgcttctctcttaatgatgtaaaaaatattcacttgtcattcatctagaaaattcgtaatagtgtaatagaatctttaaagacttgctaaaaaaaaaaaaaaaaagggcggccgcc

SEQ ID NO: 753 - DNA, 939 bp, Glycine max
  Predicted polypeptide sequence is orthologous to G481, G482
  misc_feature (596)..(596): n is a, c, g, or t
  misc_feature (762)..(762): n is a, c, g, or t
  misc_feature (767)..(767): n is a, c, g, or t
  misc_feature (769)..(769): n is a, c, g, or t
  misc_feature (775)..(775): n is a, c, g, or t
  misc_feature (786)..(786): n is a, c, g, or t
taatatagtgcggctcgagctctgctttctgtgttattgtctggcttttggagccgatccaaccaatcatcgctggcgccaaatacaaaatctcatcccttcccctttctcttactgactctctttgtcaccgggtttgtgagatgtcggatgcaccggcgagtccgagtcacgagagtggtggcgagcagagccctcgcggctcgttgtccggcgcggctagagagcaggaccggtaccttcccattgccaacatcagccgcatcatgaagaaggctctgcctcccaatggcaagattgcgaaggatgcaaaagacacaatgcaagaatgcgtttctgaattcatcagcttcattaccagcgaggcgagtgagaaatgccagaaggagaagagaaagacaatcaatggagacgatttactatgggccatggcaactttagggtttgaagactacattgagccgcttaaggtgtacctggctaggtacagagaggcggagggtgacactaaaggatctgctagaagtggtgatggatctgctagaccagatcaagttggccttgcaggtcaaaatgctcaggtgcaaccacaacantctggttatgccttcaatgcaaggccatgaatagtttagatgcttctacgcatcttatttatttcccttgaatgcttgtacgcatggcatgggtggaaccaattgtctggtaaaaaaatgggggggctctcgtccccccgggtgggggggttttgtttcggtactngtgtngntttttnttaaaacacgncttgtagcgggtgtttctcttctcaagggagagatgtgtttagggttatgctagtgattcgaaatgtagcttgtcagggtgagaagcacttgcttttagagttttctttagattattatataagagagaatatttgcagacaaaaagacttac

SEQ ID NO: 754 - DNA, 715 bp, Glycine max
  Predicted polypeptide sequence is orthologous to G481
ttccggctcgaccccgcgtccgaatttttctcctcttctgtaaacttggtccatccatgtcaatgttttttggatctcagtcaccaccgttccctttccatcgccaattaatccccccctcaatttttacttccctctcatctgccatacatacacgtctctataagcatctccccgcgaggggggccttgcctcgattgttttctttatcgaatatatatatatatatatatatatatatatatatatatatatttgcattgtaatttgtagggtttgtgagatgtcggatgcgccaccgagcccgactcatgagagtgggggcgagcagagcccgcgcggttcgtcgtccggcgcgaggcagcaggaccgggacctcccgattgccaacatcagccgcattatgaagaaggctctgcctcccaacggcgggattgcggaggatgccagagacaccgtgcaggaatgcgtttctgagttcatcagcttcattaccagcgaggcgagtgagaaatgccagaaggagaagagatagacaatcaatggagacgatttgctatgggccatggccactttatgatttgaatactacatagagccgcttaaagtgtacctggctaggtacagagaggcggagggtgacactaaacgatctgttagaagcggtgatggatctgctacatctgatcatgtgcgtgttgcaggtgcaaacgct

SEQ ID NO: 755 - DNA, 738 bp, Glycine max
  Predicted polypeptide sequence is orthologous to G481
  misc_feature (298)..(299): n is a, c, g, or t
  misc_feature (302)..(302): n is a, c, g, or t
  misc_feature (316)..(316): n is a, c, g, or t
  misc_feature (340)..(340): n is a, c, g, or t
ttcggctcgtgggacgtgaagtaaaaggtcggtggctatagaagcgttttttcatcttcttcgtttcctcactcctctctttttcagcgttcattttttctcgcgcccatattcaaaatcacatcacaacatggttccttgttactctatgttctattgctctctgttagtccattgctgtggcggtgtgttgtgcagctcattatagcggttagcacagtccccgctccaattttcttctagcatgatccttttcctttcccattgtcaacatctgccgcatcaggaagaaagcgcnnccncccaacgggaaaancgccaaggacgccaaggaaaccgngcaggaatgcgtctccgagttcatcagcttcgtcaccagcgaagcgagcgataagtgtcagagagagaagaggaagaccatcaacggcgacgatttgctttgggctatgaccactttaggtttcgaggagtatattgatccgctcaaggtttacctcgccgcttacagagagattgagggtgattcaaagggttcggccaaaggtggagatgcatctgctaagagagatgtttatcagagtcctaatggccaggttgctcatcaaggttctttctcacaaggtgttaattatacgaattcttagccccaggctcaacatatgatagttccgatgcaaggccaagagtagatattgatcctctccttcagggtttgacatgtgtgatctaaatgccagg

SEQ ID NO: 756 - DNA, 1231 bp, Oryza sativa
  Predicted polypeptide sequence is orthologous to G481
ttttttttttttttttttttttttttttgggaatcagagtaaaattgctaccattacagagagcatctatttctcaatagtacaacacgctagttcaggacgaaatacaacatgaatatttatgcctcccaatacagattatatggaaccgaatgacagccaaagaccaattgttaaattatcctgaatatacatacaacaacagagctagaccacgaaccgaaactatcctcacggggagtaatttacatctgagaagcagccttggctcgacgcttccaagcagcatcagttcctggttgacaaacatgggacctagaggtggtagcaagttacttccttcactgctcaccatgaggtgtaggtatatatattagctaacgactgcagcaccaaataaaatccacctagcaacagttgcatgaaaaggtcctatcttcagtttgagacatccccattatggtactgaggttgcatataacccattccttgattgtatgctgcttgttggcccatcccttgggcacttgaactgcttcctccatgagaaccaagtacatcctttttcacagagccatcaccagcctttgcagttaatttactatcaccctccatctctctgtacttctgcaggtagaccttgaggggctcgatgtagtcctcgaagcccagcgtggccatcgcccacagcaagtcgtcgccgttgatggtcttgcgcttctccctctggcatttatcgctcgcctcgctggtgatgaaggagatgaactcggagacgcactcctgcacggtctccttggcgtccttggcgatcttcccgttggccgggatggccttcttcatgatgcggctgatgttggcgatggggaggaacctgtcctgccggacgagtgggccccccccacccccacctccccctcctccccctccccccctcgggctcccgctctcgtggctcccccctcctccccccgggctccccggcccatccgccatcccacctcccccctccttatatagaagcgcgggcgcgcgcggagagggcgcgacgtggagaggagagagaggggggttgggcgcgaggtggtgaagcgaggaggagagagagagagagagagagagagagagggggggggagaggagagagagaggaagcgggggtgggaagcggagcggaggtgaggcggagaggcgagagggggagatcggacgctggagaagagaagcggcc

SEQ ID NO: 757 - DNA, 693 bp, Oryza sativa
  Predicted polypeptide sequence is orthologous to G481, G482
taattttttttttttgaatttgaaacccaactttgcataaacttgtgtcagcatcacacctgcttgcgtaatagagtttagaaaagtttctcttagatctctttacccctctgaatttagcatatgcaggacagccggaaacggccaaatatggttagacacaaccacacaacacacgactgaactagaacctacaacaaatttggacatcctggctaacacaagaacatttcaaaaagaacgacgactaacattcgtggtaacaaggtattggaactttggaagcatcctgcttacaacataacaggatgctggagcgttctttccctaaaaacgatggttctccttcctagatgccattagcgtgccaatcagtatcacactcctcgtcctacatgccttcaaacgatgatccaggatctccattaagtacaacatctttctttactggcagttcagaagctcttgaaccctttgtgtcaccctccgtctcccggtagagcctgaggtagagcttgagaggctcgacatagtcctcgaatccgagcgtgcccattgaccagatcaggtcgtccccattgatggtcttgcgcttctccttgaggcacttgtcgcttgcttcgctggtgatgaagctgatgaactcggagacgcactcctggacggactccttggagtccttggcgatcttgc

SEQ ID NO: 758 - DNA, 420 bp, Zea mays
  Predicted polypeptide sequence is orthologous to G481
ctcccgcccccttctctcccctcctcgcctccccgcgcgcgcgtttttataagggttgcggcggaggcgcccggtcgctggcgatggccgacgacggcgggagccacgagggcagcggcggcggcggaggcgtccgggagcaggaccggttcctgcccatcgccaacatcagccggatcatgaagaaggccgtcccggccaacggcaagatcgccaaggacgctaaggagaccctgcaggagtgcgtctccgagttcatatcattcgtgaccagcgaaaggagaaacgaaagacaatcaacggggacgatttgctctgggcgatggccactttaggattcgaggagtacgtcgagcctctcaagatttacctacaaaagtacaaagagatggagggtgatagcaagctgtctacaaaggc

SEQ ID NO: 759 - DNA, 523 bp, Zea mays
  Predicted polypeptide sequence is orthologous to G481, G482
cccagcgtccgaggaaggctacgggcaccagggccacctgttgagccccgtgggcagcccgctgtcggacaacgagtccggcgccgcggcagcggccggcggcggcgggtgcgggagcagcgtggggtactgcggcggcggcggcggtgagtcgccggccaaggagcaagaccggttcctgccgatcgccaacgtgtcgcgcatcatgaagcgctccctgccggcgaacgccaagatctccaaggaggccaaggagacggtgcaggagtgcgtgtccgagttcatcagcttcgtcacgggggaggcctccgacaagtgccagcgcgagaagcgcaagaccatcaacggcgacgacctgctctgggccatgaccacgctcggcttcgaggcctacgtcgccccactcaagtcctacctcaaccgctaccgcgaggccgagggcgagaaggccgccgtgctaggcggcggcgcgcgccacggcgacggcggcggcgcggcggacgacgccggcccactcgccggg

SEQ ID NO: 760 - DNA, 1199 bp, Zea mays
  Predicted polypeptide sequence is orthologous to G481, G482
cccacccggagcgcctcctcttctccagcgtccgatccccattccccacctctcctccctccgccgccagctcccgcccccttctctcccctcctcgcctccccgcgcgcgcgtttttataagggtttcggcggaggcgcccggtcgctggcgatggccgacgacggcgggagccacgagggcagcggcggcggcggaggcgtccgggagcaggaccggttcctgcccatcgccaacatcagccggatcatgaagaaggccgtcccggccaacggcaagatcgccaaggacgctaaggagaccctgcaggagtgcgtctccgagttcatatcattcgtgaccagcgaggccagcgacaaatgccagaaggagaaacgaaagacaatcaacggggacgatttgctctgggcgatggccactttaggattcgaggagtacgtcgagcctctcaagatttacctacaaaagtacaaagagatggagggtgatagcaagctgtctacaaaggctggcgagggctctgtaaagaaggatgcaattagtccccatggtggcaccagtagctcaagtaatcagttggttcagcatggagtctacaaccaagggatgggctatatgcagccacaggtaatctatcgtactgtcatttgttagtaaaacaatactgcagctattttccgtctcactaaacatggcagaaaatttcgatcattacattatgccactaataattttctctctgtacgcactcagtaccacaatggggaaacctaataaagggctaatacagcagcaatttatggtaatattattgctccctgaattttgttaactaaagattctgtatcatgctatatgtatgtttccttttttcttcttctttgttttgacaattgcttctttctctacggtgtttatccatcagctagggaagtctctgcattgcttaccatgtgtattggcagaaaacaggaggcacttacaaagggtgttaatctctgcgatggctgcctctcaggtgtaaattggcttcggtttagcgctgcttttgtccgtatatttaggatgatttgactgttgctacttttggcaaccttttacatttacagatatgtattattcagcataaatataatatagtagtcctaggcctaaataatggtgattaacataccaaaaaaaaaaaaaaaaaaaaaaag

SEQ ID NO: 761 - DNA, 564 bp, Zea mays
  Predicted polypeptide sequence is orthologous to G481, G482
gccttctcttctccagcgtccgatctctcccactcgccttcctcaccgcagctctcccggctcggtcgcttcgccacctccgtcctccccccgcgctcggtcgctcgccacctgctctcccctccctccacgttgctcgcgcccgcgcttatataagtgcacgaggaggagctcatggcggacgctccggcgagccctgggggcggaggcgggagccccacgcagagcgggagcccccagggccggcggaggtggaggcggtggcagccgtcagggagcaggacaggttcctgcccatcgccaacatcagtcgcatcatgaagaaggccatcccggctaacgggaagatcgccaaggacgctaaggagaccgtgcaggagtgcgtctcggagttcatctccttcatcactagcgaggcgagtgacaagtgccagagggagaagcggaagaccatcaatggcgacgacctgctgtgggccatggccacgctggggtttgaggactatattgaacccctcaaggtgtacctgcagaagtacagagagatggagggtgatagtaagt

SEQ ID NO: 762 - DNA, 1053 bp, Zea mays
  Predicted polypeptide sequence is orthologous to G481, G482
cattgggtacctcgaggccggccggcatcgcacccacccggagcgcctcctcttctccagcgtccgatccccattccccacctctcctccctccgccgccagctcccgcccccttctctcccctcctcgcctccccgcgcgcgcgtttttataagggtttcggcggaggcgcccggtcgctggcgatggccgacgacggcgggagccacgagggcagcggcggcggcggaggcgtccgggagcaggaccggttcctgcccatcgccaacatcagccggatcatgaagaaggccgtcccggccaacggcaagatcgccaaggacgctaaggagaccctgcaggagtgcgtctccgagttcatatcattcgtgaccagcgaggccagcgacaaatgccagaaggagaaacgaaagacaatcaacggggacgatttgctctgggcgatggccactttaggattcgaggagtacgtcgagcctctcaagatttacctacaaaagtacaaagagatggagggtgatagcaagctgtctacaaaggctggcgagggctctgtaaagaaggatgcaattagtccccatggtggcaccagtagctcaagtaatcagttggttcagcatggagtctacaaccaagggatgggctatatgcagccacagtaccacaatggggaaacctaataaagggctaatacagcagcaatttatgctagggaagtctctgcattgcttaccatgtgtattggcagaaaacaggaggcacttacaaagggtgttaatctctgcgatggctgcctctcaggtgtaaattggcttcggtttagcgctgcttttgtccgtatatttaggatgatttgactgttgctacttttggcaaccttttacatttacagatatgtattattcagcataaatataatatagtagtcctaggcctaaataatggtgattaacataccaagtcttttatcaggctactcgttttctggaacaggattcatgcttagctttccctcctgtctgaatgtgatggttgcctgaatcctaatttgcc

SEQ ID NO: 763 - DNA, 1178 bp, Zea mays
  Predicted polypeptide sequence is orthologous to G481, G482
gtcgacccacgcgtccgcgcaccctcccgggccgccttctcttctccagcgtccgatctcccactcccctccctcaccgcagctctcccacctccgccctccccccgcacgcgctcgccacctcgccctcccctccacgttgctcgcacccgcgcttatataagtgcaggaggagctcatggcggaagctccggcgagccctggcggcggcggcgggagccacgagagcgggagccccaggggaggcggaggcggtggcagcgtcagggagcaggacaggttcctgcccatcgccaacatcagtcgcatcatgaagaaggccatcccggctaacgggaagaccatcccggctaacgggaagatcgccaaggacgctaaggagaccgtgcaggagtgcgtctccgagttcatctccttcatcactagcgaggcgagtgacaagtgccagagggagaagcggaagaccatcaatggcgacgacctgctgtgggccatggccacgctggggtttgaggactatattgaacccctcaaggtgtacctgcagaagtacagagagatggagggtgatagtaagttaacttcaaaatccagcgatggctccattaaaaaggatgcccttggtcatgtgggagcaagtagctcagctgtacaagggatgggtcaacaaggaacatacaaccaaggaatgggttatatgcaaccccagtaccataacggagatatctcgaactaatgaagacatggaccttttctgcgacagctgctcttccctgaggcgattttttggtctcagttatttactaagtaagacaccttgcggtgaccattaaagagtaaccaatcaccctcggtaggtccgtttttatctgcaagaactgatgaggccgcttggtaggagtaaatcgcttttcctgggaacgattgttggttagcgccgctactgtatgtatattgagataccttaacgattggtcttttggctgccatttggttacatgtatttgtatcgggaggcataaatattgtgtaatttgtgttaaagactggtgtaattgaactatgggaagagctgctttggttgtaaccatattttgatgcccgtatattaggcaaaaatagaaggctgtgggcgtgcacaacaaaaaaaaaaaggaggaaaaaaaaagggcggccgc

SEQ ID NO: 764 - DNA, 2109 bp, Zea mays
  Predicted polypeptide sequence is orthologous to G481, G482
ccacgcgtccgcccacgcgtccgggcttgctgagctggagctgatggatctagggtttgggttgcggtgatggtcctgcagcgcaggaggagctcatggcggaagctccggcgagccctggcggcggcggcgggagccacgagagcgggagccccaggggaggcggaggcggtggcagcgtcagggagcaggacaggttcctgcccatcgccaacatcagtcgcatcatgaagaaggccatcccggctaacgggaagatcgccaaggacgctaaggagaccgtgcaggagtgcgtctccgagttcatctccttcatcactagcgaagcgagtgacaagtgccagagggagaagcggaagaccatcaatggcgacgatctgctgtgggccatggccacgctggggtttgaagactacattgaacccctcaaggtgtacctacagaagtacagagaggtgcgtacggtgtttgggaatttgggggtcaggtcgtgcaatcgccaatctgtcacctggccgatcgtacctctgattgaacttaaataatcctgttgggcatcagcacgctaataagtgataagtgagctatccacttcccttccaatgcttcggccacatatttatacttctttagttgaggacataaagagaccccctgttcctgtgtactactccagtaaatacagctagtaaacacattatttttataaggtgaaccaattcgaaagcacttttatccatttaatactgaacagtgatcgaaacctctatttgatgttcttacatgggattgagttagcactcgtgcttggtaagatattataactactcacagccctatgtggctgtgtctgttctatgatgaaaagtagatgtaatgcaaatggataagagcggaaagagctcctacagtagtgtaattagagcatgttgtagtgcaagcttttggttgtttacacaaaagatacatgaaaccattccactgtaggtcatatacaatcttgcttagggtcctgaacatatctggtgcacatggttcacatattaaattatcaccatccattctagatctaacgtctttagttgtccattctagatctaacatctttagttgctctgtataattgtatattttgcaaagaaccccttccaccactactctctaccacttctaccctgctccgagggtgttctctgcaaaaatatatagaacacccatagatgttagatataggatgaatgatggtgatctaatatgtacaccatgtgcaccaaactcagtgcaccagatatattctcgagtttatttagctgtatttttctatacgctcttcgtattggttgaataatctgtctaatgaggtttctcttttggtcttatgtctggtggatgacatcacggattgcagatggagggtgatagcaagttaactgctaaatctagcgatggctcgattaaaaaggatgctcttggtcatgtgggagcaagtagctcagctgcagaagggatgggccaacagggagcatacaaccaaggaatgggttatatgcaacctcagtaccataacggggatatctcaaactaatgaaggtatggaccttttctgcgacagctgctcttacctgaggcgattttttttgtcttagttatttactaagacaccttgcggtgaccattaaagagtaaccaatcgccctcaataggtccgtttttatctgccagaactgatgaggtcgctcactaggagtaagtcgcttccctgggaacggttgtcggctagcaccgctcttgtatgtatattaagagtaacttaatgattggtcttttggctgcgatttgattatatgtatttgtatcgggaggcataaatattgtgtaatttgtgttaaagactagtgtaattgaactatgggaagagctgctttggttgtaaccatattttgatgcccgtatattaggcaaaaacagaaggctgtgggcgtgcacaacatatttactgttcaccgaaatacttgtattgatgtatttccgcatcaattatagtcatcgtcagcttgtaactacggcaatgaataaataaaaattcactgagtaaaaaaaaaaaaaaag

SEQ ID NO: 765 - DNA, 1255 bp, Zea mays
  Predicted polypeptide sequence is orthologous to G481, G482
aattcggcacgaggcaccctcccgggccgcccgcgcttctccagcgtccgatctcccactcccctccctcaccgcagctctcccacctccgccctccccccgcacgcgctcgccacctcgccctcccctccacgttgctcgcacccgcgcttatataagtgcaggaggagctcatggcggaagctccggcgagccctggcggcggcggcgggagccacgagagcgggagccccaggggaggcggaggcggtggcagcgtcagggagcaggacaggttcctgcccatcgccaacatcagtcgcatcatgaagaaggccatcccggctaacgggaagatcgccaaggacgctaaggagaccgtgcaggagtgcgtctccgagttcatctccttcatcactagcgaagcgagtgacaagtgccagagggagaagcggaagaccatcaatggcgacgatctgctgtgggccatggccacgctggggtttgaagactacattgaacccctcaaggtgtacctgcagaagtacagagagatggagggtgatagcaagttaactgcaaaatctagcgatggctcaattaaaaaggatgcccttggtcatgtgggagcaagtagctcagctgcacaagggatgggccaacagggagcatacaaccaaggaatgggttatatgcaaccccagtaccataacggggatatctcaaactaatgaaggcatggaccttttctgcgacagctgctcttccccgaggcgggtttttgtgtcgcagttatttactaagtaagacaccttgcggtgaccattaaagagtaaccaatcaccctgggtaggtcaatttttatctgcaagaactgatgaggccgcttggtaggagtaaatcgcttttcctgggaacgattgttggttagcgccgctactgtatgtatattgagataccttaacgattggtcttttggctgccatttggttacatgtatttgtatttggaggcataagtatcgtgtaatttgtgttatgactagtgtattgactattgaattatcagaagagctgctttagttgtaagatcacacaaaacagcctggaaagtataacaagattaaaactgaaccaaaaatgggcaataaataaattatcacatttacagtgaataaaaaaatccctgaacatggggcgttcattctaaagaatccaaatttacttgcactgcctggcaacttttttactcttttatgctgaaccctaagtttaat

SEQ ID NO: 766 - DNA, 1173 bp, Zea mays
  Predicted polypeptide sequence is orthologous to G481, G482
cattgggtacctcgaggccggccgggattccccatctcccttcattgctcgctcgctcgctcgttgctcttctccagcagcagctccttcaaatgcaaatctctttgctgccgacgcagagactcgccaaatttccctccctcctcctagccttctcgtcgctcctgttcttctcgcatccccagcccaggtggtgtcccctgtcgcgttgatgcatgctccctcggcggtggccttgagctgaggcggcggagcgatgccggactccgacaacgactccggcgggccgagcaacgccgggggcgagctgtcgtcgccgcgggagcaggaccggttcctgcccatcgccaacgtgagccggatcatgaagaaggcgctcccggccaacgccaagatcagcaaggacgccaaggagacggtgcaggagtgcgtgtccgagttcatctccttcatcaccggcgaggcctccgacaagtgccagcgcgagaagcgcaagaccatcaacggcgacgacctgctgtgggccatgaccacgctcggcttcgaggactacgtcgagccgctcaagcactacctgcacaagttccgcgagatcgagggcgagagggccgccgcgtccgccggcgcctcgggctcgcagcagcagcagcagcagggcgagctgcccagaggcgccgccaatgccgccgggtacgccgggtacggcgcgcctggctccggcggcatgatgatgatgatgatggggcagcccatgtacggcggctcgcagccgcagcaacagccgccgcagcctcagccgccacagcagcagcagcagcaacatcaacagcatcacatggcaatgggaggcagaggaggattcggccaacaaggcggcggcggtggctcctcgtcgtcgtcagggcttggccggcaagacagggcgtgagttgcgacgatacgttcagaatcagaatcgctgatactcctacgtagaattatacctacctaattgatgacaccgcaccgcacctcgttgtgctgcctgtccttgtacgtttactaattattgctgcctgtatgtaaatcaaaatctgaggctcccatttcgaaaaaaaaaaaaaaaaaagcggccggtgaactactcttcccgtttcgtttcatacgagaatcgaactcgttttcaattaaaaa

SEQ ID NO: 767 - DNA, 1064 bp, Zea mays
  Predicted polypeptide sequence is orthologous to G481, G482
ctcagtctcaaactccccgctctcccccgcccgtccagctcgtgctccgcctccgctgctctgtcctcttccctcctctgcgtttctcctcagagctgtttgacttgaccggacagtgctgttcggtggctcggccgcgatgccggactccgacaacgagtccggcgggccgagcaacgcggagttctcgtcgccgcgggagcaggaccggttcctgccgatcgcgaacgtgagccggatcatgaagaaggcgctcccggccaacgccaagatctccaaggacgccaaggagacggtgcaggagtgcgtgtccgagttcatctccttcatcaccggcgaggcctccgacaagtgccagcgcgagaagcgcaagaccatcaacggcgacgacctgctctgggccatgaccacgctcggcttcgaggactacgtcgagccgctcaagctctacctgcacaagttccgcgagctcgagggcgagaaggcggccacgacgagcgcctcctccggcccgcagccgccgctgcacagggagacgacgccgtcgtcgtcaacgcacaatggcgcgggcgggcccgtcgggggatacggcatgtacggcggcgcgggcgggggaagcggtatgatcatgatgatggggcagcccatgtacggcggctccccgccggccgcgtcgtccgggtcgtacccgcaccaccagatggccatgggcggaaaaggtggcgcctatggctacggcggaggctcgtcgtcgtcgccgtcagggctcggcaggtaggacaggttgtgaccgtcgccgtccatgcttgcatggccatggccatggctcggctcccgccgccggcttcttgcttggtgtcggtaattagcgctggtggcctgcgctggttaagttaaccttcggtttttcccccttttcttttcgtggtaagtaatgttgtgctgaatggagacagtgatatggttaagatagctccataacctctcggtaattaatcctgtgatttgtactcccaagctgctgctaaactgagctatgacacaatacaaatgctgccattaac

SEQ ID NO: 768 - DNA, 686 bp, Gossypium arboreum
  Predicted polypeptide sequence is orthologous to G481, G482
cttcaacgacaaagagaaaagggtctctctcaaattttcattttttttctatcattcctttcttctccatcgtcagatctctctttcattccttgcaccaaataaaacaaataatttaaccaatcaaatcctctcgcgccaaataagagagaaatcccattttttttcttctctatttcctttcccttcagttgtgatttaggttttctggggacatggcggatggtatgggaggagggccaacgagtccggcaggagggagccatgagagtggaggagagcacagcagtcctcagtcaactgtgagggaacaagatcgttacctcccaattgctaatataagtagaatcatgaagaaagcattgccttctaatgggaaaattgctaaggatgctaaagatactgttcaagaatgtgtttccgagttcatcagcttcatcactagcgaggctagtgataaatgtcaaaaagagaaaaggaagacaattaatggagatgacttgttgtgggcaatggcaacattaggattcgaagactatatcgagccacttaaaatataccttgccagatacagggagttggagggtgacaccaagggatcagcccgtggtggtgatggatcttttaaaagagacgcagccggagctcttcctgcccaaaatccacaggtttcagtccaggggtca

SEQ ID NO: 769 - DNA, 542 bp, Glycine max
  Predicted polypeptide sequence is orthologous to G481, G482
aatagtggagtatcttctctgctttctgtgttattgtctggcttttggagccgatccaaccaatcatcgctggcgccaaatacaaaatctcatcccttcccctttctcttactgactctctttgtcaccgggtttgtgagatgtcggatgcaccggcgagtccgagtcacgagagtggtggcgagcagagccctcgcggctcgttgtccggcgcggctagagagcaggaccggtaccttcccattgccaacatcagccgcatcatgaagaaggctctgcctcccaatggcaagattgcgaaggatgcaaaagacacaatgcaagaatgcgtttctgaattcatcagcttcattaccagcgaggcgagtgagaaatgccagaaggagaagagaaagacaatcaatggagacgatttactatgggccatggcaactttagggtttgaagactacattgagccgcttaaggtgtacctggctaggtacagagaggcggagggtgacactaaaggatctgctagaagtggtgatggatctgctaga

SEQ ID NO: 770 - DNA, 616 bp, Gossypium hirsutum
  Predicted polypeptide sequence is orthologous to G481, G482
gaaaaaatctctctcaaattttcatttttttttctatcattcctttcttctccatcgtcagatctctctttcattccttgcaccaaataaaacaaataatttaaccaatcaaatcccctcgcgccaaataagagagaaatcccttttttcttcttctctatttcctttcccttcagttgtgatttaggttttctggggacatggcggatggtatgggaggagggccaacgagtccggcaggagggagccatgagagtggaggagagcacagcagtcctcagtcaactgtgagggaacaagatcgttacctcccaattgctaatataagtagaatcatgaagaaagcattgccttctaatgggaaaattgctaaggatgctaaagataccgttcaagaatgtgtttccgagttcatcagcttcctcactagcgaggctagtgataaatgtcaaaaagagaaaaggaagacgattaatggagatgacttgttgtgggcaatggcaacattaggattcgaagaatatatcgagccacttaaaatataccttgccaaatacaggtagttggagggtgacaccaatggatcagcccgtggtggtgatggatctttttaaat

SEQ ID NO: 771 - DNA, 520 bp, Lycopersicon esculentum
  Predicted polypeptide sequence is orthologous to G481, G482
ttttctccattttcttgttcttaaagcttgtgtactatcataggcaaatacaagactgcgtatacatcaatgtcttcggactttactcgtagaattacatttacgacagaataaagttgtgcatatcgtaccacttgtgagattactccgggtaatttctcttttgtattgatcggaacagaatttaggcgatttcgatggcggattcggataatgaatcaggaggacatagagataacagtaacattgagagttccctaagagaacaagacaggttccttcccatagcaaatgtaagcagaatcatgaagaaagctttaccagctaacgcgaaaatctcaaaagatgctaaggaggtagttcaagaatgtgtttctgaattcataagtttcatcacaggggaagcatcagataagtgtcaaagagaaaagagaaagacaatcaatggtgatgatctgttgtgggcaatgacaactcttggttttgaagaatacattgagccactcaagatttatttgca

SEQ ID NO: 772 - DNA, 501 bp, Lycopersicon esculentum
  Predicted polypeptide sequence is orthologous to G481, G482
cttaaagcttgtgtactatcataggcgaatacaagactgcgtatacatcaatgtcttcggactttactcgtataattacatttacgacagaataaagttgtgcatatcgtaccacttgtgagattactccgggtaatttctcttttgtattgatcggaacagaatttaggcgatttcgatggcggattcggataatgaatcaggaggacatagagataacagtaacattgagagttccctaagagaacaagacaggttgcttcccatagcaaatgtaagcagaatcatgaagaaagctttaccagctaacgcgaaaatctcaaaagatgctgaggaggtagatcaagaatgtgtttctgaattcataagtttcatcacaggggaagcatcagataagtgtcaaagagaaaagagaaagacaatcaatggtgatgatctgttgtgggcaatgacaactcttggttttgaagaatacattgagccactcaagatttatttgca

SEQ ID NO: 773 - DNA, 512 bp, Medicago truncatula
  Predicted polypeptide sequence is orthologous to G481, G482
gtggtgataggtctcattctgtaatctcaatcgtcctcctccttcctttcttctccagcgtccgattctctctccattcttaccgatctacgctcgcgccaaatacaaacataatattcagggttccgacgatatgtccgaaactccggcgagtcctggcggcggcagccacgaaagcggcgaacacagtcctcgttccaacatccgtgaacaagaccgtttccttcctatcgccaacatcagccgcatcatgaaaaaagctcttcctgctaatggtaaaatcgctaaagatgctaaggaaaccgttcaggaatgcgtctccgagttcatcagcttcatcaccagcgaggcctctgataagtgtcagagagagaagaggaagacgattaacggtgatgatttgctttgggcgatggctactttagggtttgaggattatattgatcctcttaagatttaccttacaagatacagagagatggagggtgatactaaaggctctgccaaaggtg

SEQ ID NO: 774 - DNA, 611 bp, Lycopersicon esculentum
  Predicted polypeptide sequence is orthologous to G481, G482
ccctccatccccagtatggcggatggtcaaggttcgtctaggtcaccggcgagtccaaacggaggtggtagtcatgagagtggtggggaccagagtccgaggtctaatgtacgtgaacaggacaggtttttaccaatagctaatattagtagaatcatgaagaaggcacttcctgctaatggaaaaattgcgaaggatgctaaggagactgttcaggaatgtgtttctgagttcatcagcttcattactagcgaggcaagtgacaagtgccagagagagaaaaggaagactattaatggtgacgatttgctatgggcaatggcaactcttgggtttgaagattatattgaaccactcaaggtgtatcttgctcgatacagagagatggagggaacgtcaaaggctgctgatggctctactaaaagagatgggatgcaacctggtcctaattcacagcttgcacatcagggttcatactcacaaggaatgaattatgggaattctcagggtcagcatatgatggtcccgatgcaaggaactgagtaaaaatccgatcttcgtcctgtttgagaagacgggtggagttgaaaacatattatatatatagatgg

SEQ ID NO: 775 - DNA, 768 bp, Solanum tuberosum
  Predicted polypeptide sequence is orthologous to G481, G482
gggcagtcgctgccgttggatctatgtgtatagcgcagaaaagctcagcatccattttccgccaaattcctttctcaaacaaaaactaacaaaatattctcttggatcaacctctacctacgatcatccataaagttagggttccggtacactgagaatggcggagccggcaagtccaggaggcggcggcggaagccatgagagtggcggtgacccgagtcctcagtccaacttgcgagaacaggataggtacctaccgatcgctaatattggacgcataatgaaaaaggcattgcctgctaatggaaagatcgcaaaggattctaaggacactgttcaggaatgtgtatctgagttcatcagttttattactagcgaagctagtgacaagtgtcagaaagagaagagaaagacgatcaacggagatgatttactatcagccctggctaccttgggatttgaggactacattgaaccactgaaggtctatttgactcgatacagagagatggagggagatgccaagggatctgcaagggttggtgatgcatctgttagaaaagatgtagttggaagtcagcttgggtccaatacgcagttcatgtatgaaggttcttttgcacaaggcttagactatggaaactcccaattatgaattttaagatgaacaaagaactttggatgcataccaaaaaaaagctgaatacatagaacagtgggttagtctttttgctggtacaagatgccagccagggtttctcttcttgc

SEQ ID NO: 776 - DNA, 720 bp, Triticum aestivum
  Predicted polypeptide sequence is orthologous to G481, G482
  misc_feature (2)..(2): n is a, c, g, or t
  misc_feature (10)..(10): n is a, c, g, or t
  misc_feature (13)..(14): n is a, c, g, or t
  misc_feature (690)..(690): n is a, c, g, or t
cnccccccanaannagtttgattacccctgctcgaaattaaccctcactaaagggaacaaaagctggagctccaccgcggtggcggccgctctagaactagtggatcccccgggctgcaggaattcggcaccagccaccaccttccctccctccacgcgcccgtctatataaggaggagggccggatgtcggacgcgccggcgagccccccgggcggcggcggcggcggaggaggcggcggcagcgacgacggcggcggcggcggcggcttcggcggcgtcagggagcaggacaggttcctgcccatcgccaacatcagccgcatcatgaagaaggccatcccggccaacggcaagatcgccaaggacgccaaggagaccgtgcaggagtgcgtctccgagttcatctccttcatcaccagcgaggcgagcgacaagtgccagagggagaagcgcaagaccatcaacggcgacgacctgctctgggcgatggcgacgctgggcttcgaggagtacatcgagcccctcaaggtttatctgcagaagtacagagagacggagggtgatagtaagctagctggaaagtctggtgaagtctctgttaaaaaggatgcacttggtcctcatggaggagcaagtggcacaagtgcgcaagggatgggccaacaagtacatacaatccaagaatggnttatatgcaacctcagtaccataatggggg

SEQ ID NO: 777 - DNA, 837 bp, Hordeum vulgare
  Predicted polypeptide sequence is orthologous to G481, G482
cgcgcgcgcgcgcgttttttataagggtttcgcggcgccggatggccgacgacgacagcggcagcccccggggcggcggcggcggcggggtccgggagcaggaccgcttcctccccatcgccaacatcagccgcatcatgaagaaggccgtgccggccaacggcaagatcgccaaggacgccaaggagaccctccaggagtgcgtctccgagttcatctccttcgtcaccagcgaggccagcgacaagtgccagaaggagaagcgcaagaccatcaacggggacgatctgctctgggccatggccacgctcgggttcgaggagtacgtagaccccctcaagatctacctgcaaaagtacagagatatggagggtgatagtaaattgacctcaaaatctggtgatggatccgtgaagaaagatataattggtgctcatggtggtgcgactagctcaaacgcccaagtgatggttcagcatggtgcttacgcccaaggcatgggttatatgcaaccccagtaccataatggggatacctgaaactgaagactgcggcaattttcggaaatgggtattgctccatgagtggttatctatctgttaaagaagccgccccaacattaggttcatgatgatcattggctggaaactaaagcacctggaagggtgcttaacagttggttgtgatggctgcctccaagatgtaaattgcttccgagagaatagattcacctattatggtttagtgccttggttttatctggtacattcggaataaattcaacccgtggtaggttggcaaatactttggttttcaggatttttgtatttagggacg

SEQ ID NO: 778 - DNA, 638 bp, Triticum monococcum
  Predicted polypeptide sequence is orthologous to G481, G482
gcacccgcctgcgccgccttctcttctccgcgtcggatccccccccactcgccgccctcaccgcacctccattcccctccaccaccttccctccctccacgcgctcctctatataaggaggagggccggatgtcggacgcggcggcgagccccccgggcggcggcggcggcggaggaggcggcggcagcgacgacggcggcggcggcggcggcttcggcggcgtcagggagcaggacaggttcctgcccatcgccaacatcagccgcatcatgaagaaggccatcccggccaacggcaagatcgccaaggacgccaaggagaccgtgcaggagtgcgtctccgagttcatctccttcatcaccagcgaggcgagcgacaagtgccagagggagaagcgcaagaccatcaacggcgacgacctgctctgggcgatggccacgctgggcttcgaggagtacatcgagcccctcaaggtttatctgcagaagtacagagagacggagggtgatagtaagctagctgggaagtctggcgatgtttctgttaaaaaggatgcactgggtcctcatggaggagcaagtggcacaagtgcgcaagggatgggccaacaagtagcatacaatccaggaatggttta

SEQ ID NO: 779 - DNA, 1818 bp, Glycine max
  G3473  Predicted polypeptide sequence is orthologous to G481, G482
tttttaaataataaaatgtttctttggaaatttcttaaaaagtatgaacataaatttaaattattattttatattaaatgcacttatgttaatttatttgtcttgcatacacatttaatgttatccttctttatatctatattaaactatatatataaagaaaagattttgaaatttgaataagataagagtgtccaggtcagaggcgagcacgtgccagataccaaagcaacggtccagatcatggagcactcaccaaatccaagggctccaattcgtccgtggacactcacacttatcgactaacaacggtccacaaatcgccacgtgtcctcaagataaagcgttattaacccttctgatccaacggatcctgctcattatctcccaaacaaacccctccgttccgtttcacctttccccttcccgccggagccgccgtcaccggtcgctggccaccgtatccgaccctcccaatacaccctttccgagtcccacacaaaattgcacgattctgtgatttcaattttcaggtctcgaggatttcgtttcagaagcgcttccatttgacgcagaaccaccgactcaaaccgattcgcgccgagttcgtgactcgaattttcaacttctcattcatattccaaatcgaatttgaaactccgaagaaaaattcaccgaacactgaatctcagtttccaaggagcttcttctacgaagagcgcttcaattccacgcagaaccaccaagtcaagccggttcgtgactcggattctcaattcctcgttcattcccgaacgaattttaaattccgaagaaaaccgcaccgaacactgaatttcagattctgaacaagtttcttccgcgaaacagcacagcacttcaatttcacgtggaacagagacaaagggattcgtggttcgaattctcaatcgattttcaaattccgaacagcgaacagtacttcaatttcacgtcgaactagtcaaagcgattcaaatcgatttcgcgaactcgtccgatattttccctgcactgacttagtgattcgtttcatctttctcagcgcgtcttcgatttttccgttagtcgatggcggactccgacaacgactccggcggcgcgcacaacggcggcaaggggagcgagatgtcgccgcgggagcaggaccggtttctcccgatcgcgaacgtgagccgcatcatgaagaaggcgctgccggcgaacgcgaagatctcgaaggacgcgaaggagacggtgcaggagtgcgtgtcggagttcatcagcttccattcaccggggggcctcgccggtgagtgccagaaggagaagaggaagacgatcaacggcgatgatctgctgtgggccatgaccacgctgggattcgaggagtacgtggagcctctcaaggtttatctgcataagtatagggagctggaaggggagaaaactgctatgatgggaaggccacatgagagggatgagggttatggtcatgcaactcctatgatgatcatgatggggcatcagcagcagcagcatcagggacacgtgtatggatctggaactactactggatcagcatcttctgcaagaactagataacaggtttatgcatgtgttatctcatctgtttaagcttattaagggtggtctttttggatggtgattttgtttgattttagaaacaccccagctccagcttgtaattgttgcttgaaacttcgttgttgagagaatatagccattattgtggatggtgatgtgacatgcacagaatttttgtattcttctttcttccaatggatttatctcgggccc

SEQ ID NO: 780 - protein, 229 aa, Oryza sativa
  Orthologous to G481, G482
MPDSDNESGGPSNAGEYASAREQDRFLPIANVSRIMKRALPANAKISKDAKETVQECVSEFISFITGEASDKCQREKRKTINGDDLLWAMTTLGFEDYIDPLKLYLHKFRELEGEKAIGAAGSGGGGAASSGGSGSGSGSHHHQDASRNNGGYGMYGGGGGMIMMMGQPMYGSPPASSAGYAQPQPPHHHHHQMVMGGKGKVEEVQSKGKIRDFLQLQASMLELIQGEN

SEQ ID NO: 781 - protein, 241 aa, Oryza sativa
  Orthologous to G481, G482
MSEGFDGTENGGGGGGGGVGKEQDRFLPIANIGRIMRRAVPENGKIAKDSKESVQECVSEFISFITSEASDKCLKEKRKTINGDDLIWSMGTLGFEDYVEPLKLYLRLYREGDTKGSRASELPVKKDVVLNGDPGSSLVNYGAQRADANANHLDLFFLLRKNPESTTANCMREDEAKPVTVKIIETVYVEADTADDFKSVVQRLTGKDAVAGDAPELNSAQRFGSGREASRHGDHKVRIYE

SEQ ID NO: 782 - protein, 297 aa, Oryza sativa
  Orthologous to G481, G482
MKSRKSYGHLLSPVGSPPLDNESGEAAAAAAAGGGGCGSSAGYVVYGGGGGGDSPAKEQDRFLPIANVSRIMKRSLPANAKISKESKETVQECVSEFISFVTGEASDKCQREKRKTINGDDLLWAMTTLGFEAYVGPLKSYLNRYREAEGEKADVLGGAGGAAAARHGEGGCCGGGGGGADGVVIDGHYPLAGGLSHSHHGHQQQDGGGDVGLMMGGGDAGVGYNAGAGSTTTAFYAPAATAASGNKAYCGGDGSRVMEFEGIGGEEESGGGGGGGERGFAGHLHGVQWFRLKRNTN

SEQ ID NO: 783 - protein, 137 aa, Oryza sativa
  Orthologous to G481, G482
MKKAIPANGKIAKDAKETVQECVSEFISFITSEASDKCQREKRKTINGDDLLWAMATLGFEDYIEPLKVYLQKYREMEGDSKLTAKAGDGSVKKDVLGSHGGSSSSAQGMGQQAAYNQGMGYMQPQDIFTGHVVRLV

SEQ ID NO: 784 - protein, 285 aa, Oryza sativa
  Orthologous to G481, G482
MADAGHDESGSPPRSGGVREQDRFLPIANISRIMKKAVPANGKIAKDAKETLQECVSEFISFVTSEASDKCQKEKRKTINGEDLLFAMGTLGFEEYVDPLKIYLHKYREMEGDSKLSSKAGDGSVKKDTIGPHSGASSSSAQGMVGAYTQGMGYMQPQSNFHILVVLQSFAFPYMYQVAQIYCNKYEVSREQIWDTPQIMELSPWIPYTINRIWKETHGSQDIRIQGRPREAANSALDWQWPSKHSSLASNFYGTRVVGGHHEYQRSTKKDTTHVNFASGLGDLG

SEQ ID NO: 785 - protein, 178 aa, Zea mays
  Orthologous to G481, G482
MAEAPASPGGGGGSHESGSPRGGGGGGSVREQDRFLPIANISRIMKKAIPANGKIAKDAKETVQECVSEFISFITSEASDKCQREKRKTINGDDLLWAMATLGFEDYIEPLKVYLQKYREMEGDSKLTAKSSDGSIKKDALGHVGASSSAAEGMGQQGAYNQGMGYMQPQYHNGDISN

SEQ ID NO: 786 - protein, 179 aa, Zea mays
  Orthologous to G481, G482
MAEAPASPGGGGGSHESGSPRGGGGGGSVREQDRFLPIANISRIMKKAIPANGKIAKDAKETVQECVSEFISFITSEASDKCQREKRKTINGDDLLWAMATLGFEDYIEPLKVYLQKYREMEGDSKLTAKSSDGSIKKDALGHVGASSSAAEGMGQQGAYNQGMGYMQPQYHNGDISNV

SEQ ID NO: 787 - protein, 189 aa, Oryza sativa
  Orthologous to G481, G482
MADAGHDESGSPPRSGGVREQDRFLPIANISRIMKKAVPANGKIAKDAKETLQECVSEFISFVTSEASDKCQKEKRKTINGEDLLFAMGTLGFEEYVDPLKIYLHKYREMEGDSKLSSKAGDGSVKKDTIGPHSGASSSSAQGMVGAYTQGMGYMQPQSNFHILVVLQSFAFPYMYQVAQIYCKYPSIE

SEQ ID NO: 788 - protein, 185 aa, Oryza sativa
  Orthologous to G481, G482
MQGLPRASSSSTSASRDRDGGDGDGGGGGVTMTNGQDNLLPIANVGRIMKDGLPPQAKISKRAKETIQECATEFISFVTGEASERCRRERRKTVNGDDVCHAMRSLGLDHYADAMHRYLQRYREGEELAASLNSSSSAAAAAAAAGSRGGGAIQIDVRAELSIFRSGNNQGKKGVNSLFVEVKLN

SEQ ID NO: 789 - protein, 177 aa, Oryza sativa
  Orthologous to G481, G482
MADHHGGHHADGHRRQQQLQGEAADQAAAEIIKEQDRLLPIANVGRIMKQILPPNAKISKEAKETMQECVSEFISFVTGEASDKCHKEKRKTVNGDDVCWAFGALGFDDYVDPMRRYLNKYRELEGDRAAAAATSRSGAGAAAGPDHPSSSSSAAAATAGHFMFNAMDRSTDSSRQF

SEQ ID NO: 790 - protein, 164 aa, Oryza sativa
  G3395  Orthologous to G481, G482
MADAGHDESGSPPRSGGVREQDRFLPIANISRIMKKAVPANGKIAKDAKETLQECVSEFISFVTSEASDKCQKEKRKTINGEDLLFAMGTLGFEEYVDPLKIYLHKYREMEGDSKLSSKAGDGSVKKDTIGPHSGASSSSAQGMVGAYTQGMGYMQPQYHNGDT

SEQ ID NO: 791 - protein, 215 aa, Oryza sativa
  Orthologous to G481, G482
MADGPGSPGGGGGSHESGSPRGGGGGGGGGGGGGGVREQDRFLPIANISRIMKKAIPANGKIAKDAKETVQECVSEFISFITSEASDKCQREKRKTINGDDLLWAMATLGFEDYIEPLKVYLQKYREVRGDSKLTAKAGDGSVKKDVLGSHGGSSSSAQGQAAYNQGMGYMQPQVIYLQLFGITGSMHIHMVDRCQSILLNIPSCLGSIQDNIVV

SEQ ID NO: 792 - protein, 185 aa, Oryza sativa
  Orthologous to G481, G482
  misc_feature (136)..(136): Xaa can be any naturally occurring amino acid
  misc_feature (154)..(154): Xaa can be any naturally occurring amino acid
MADGPGSPGGGGGSHESGSPRGGGGGGGGGGGGGPLVRQDRFLPIANISRIMKKAIPANGKIAKDAKETVQECVSEFISFITSEASDKCQREKRKTINGDDLLWAMATLGFEDYIEPLKVYLQKYREMEGDSKLTXKAGDGSVKKDVLGSHGGXSSSAQGMGQQAAYNQGMGYMQPQYHNGDVSN

SEQ ID NO: 793 - protein, 124 aa, Oryza sativa
  Orthologous to G481, G482
MSEGFDGTENGGGGGGGGVGKEQDRFLPIANIGRIMRRAVPENGKIAKDSKESVQECVSEFISFITSESASDKCLKEKRKTINGDDLIWSMGTLGFEDYVEPLKLYLRLYREVLFLSSLFQSVS

SEQ ID NO: 794 - protein, 219 aa, Oryza sativa
  G3397  Orthologous to G481, G482
MPDSDNDSGGPSNYAGGELSSPREQDRFLPIANVSRIMKKALPANAKISKDAKETVQECVSEFISFITGEASDKCQREKRKTINGDDLLWAMTTLGFEDYVDPLKHYLHKFREIEGERAAASTTGAGTSAASTTPPQQQHTANAAGGYAGYAAPGAGPGGMMMMMGQPMYGSPPPPPQQQQQQHHHMAMGGRGGFGHHPGGGGGGSSSSSGHGRQNRGA

SEQ ID NO: 795 - protein, 254 aa, Oryza sativa
  Orthologous to G481, G482
MEAGYPGTAANGAAADGNGGAQQAAAAPAIREQDRLMPIANVIRIMRRVLPAHAKISDDAKETIQECVSEYISFITGEANERCQREQRKTITAEDVLWAMSRLGFDDYVEPLGVYLHRYREFEGESRGVGVGVGAARGDHHHGHVGGMLKSRVQGSMVTHHDMQMHAAMYGGGAVPPPPHPPPHHHAFHQLMPPHHGQYAPPYDMYGGEHGMAAYYGGMYAPGSGGDGSGSSGSGGAGTPQTVNFEHQHPFGYK

SEQ ID NO: 796 - protein, 224 aa, Oryza sativa
  G3398  Orthologous to G481, G482
MPDSDNESGGPSNAGEYASAREQDRFLPIANVSRIMKRALPANAKISKDAKETVQECVSEFISFITGEASDKCQREKRKTINGDDLLWAMTTLGFEDYIDPLKLYLHKFRELEGEKAIGAAGSGGGGAASSGGSGSGSGSHHHQDASRNNGGYGMYGGGGGMIMMMGQPMYGSPPASSAGYAQPPPPHHHHHQMVMGGKGAYGHGGGGGGGPSPSSGYGRQDRL

SEQ ID NO: 797 - protein, 191 aa, Glycine max
  Orthologous to G481, G482
MARESLEKISMAESDNESGGHTGNASGSNELSGCREQDRFLPIANVSRIMKKALPANAKISKEAKETVQECVSEFISFITGEASDKCQKEKRKTINGDDLLWAMTTLGFEDYVDPLKIYLHKYREMEGEKTAMMGRPHERDEGYGHGHGHATPMMTMMMGHQPQHQHQHQHQHQHQGHVYGSGSASSARTR

SEQ ID NO: 798 - protein, 165 aa, Glycine max
  G3476  Orthologous to G481, G482
MAESDNDSGGAQNAGNSGNLSELSPREQDRFLPIANVSRIMKKALPANAKISKDAKETVQECVSEFISFITGEASDKCQREKRKTINGDDLLWAMTTLGFEEYVEPLKIYLQRFREMEGEKTVAARDSSKDSASASSYHQGHVYGSPAYHHQVPGPTYPAPGRPR

SEQ ID NO: 799 - protein, 170 aa, Glycine max
  G3473  Orthologous to G481, G482
MADSDNDSGGAHNGGKGSEMSPREQDRFLPIANVSRIMKKALPANAKISKDAKETVQECVSEFISFHSPGGLAGECQKEKRKTINGDDLLWAMTTLGFEEYVEPLKVYLHKYRELEGEKTAMMGRPHERDEGYGHATPMMIMMGHQQQQHQGHVYGSGTTTGSASSARTR

SEQ ID NO: 800 - protein, 188 aa, Glycine max
  G3475  Orthologous to G481, G482
MADSDNDSGGAHNAGKGSEMSPREQDRFLPIANVSRIMKKALPANAKISKDAKETVQECVSEFISFITGEASDKCQREKRKTINGDDLLWAMTTLGFEDYVEPLKGYLQRFREMEGEKTVAARDKDAPPPTNATNSAYESPSYAAAPGGIMMHQGHVYGSAGFHQVAGGAIKGGPVYPGPGSNAGRPR

SEQ ID NO: 801 - protein, 171 aa, Glycine max
  G3472  Orthologous to G481, G482
MAESDNESGGHTGNASGSNEFSGCREQDRFLPIANVSRIMKKALPANAKISKEAKETVQECVSEFISFITGEASDKCQKEKRKTINGDDLLWAMTTLGFEEYVEPLKVYLHKYRELEGEKTAMMGRPHERDEGYGHATPMMIMMGHQQQQHQGHVYGSGTTTGSASSARTR

SEQ ID NO: 802 - protein, 160 aa, Glycine max
  Orthologous to G481, G482
  misc_feature (151)..(151): Xaa can be any naturally occurring amino acid
MSDAPASPSHESGGEQSPRGSLSGAAREQDRYLPIANISRIMKKALPPNGKIAKDAKDTMQECVSEFISFITSEASEKCQKEKRKTINGDDLLWAMATLGFEDYIEPLKVYLARYREAEGDTKGSARSGDGSARPDQVGLAGQNAQVQPQXSGYAFNARP

SEQ ID NO: 803 - protein, 144 aa, Glycine max
  Orthologous to G481, G482
MSDAPPSPTHESGGEQSPRGSSSGARQQDRDLPIANISRIMKKALPPNGGIAEDARDTVQECVSEFISFITSEASEKCQKEKRKTINGDDLLWAMATLGFEYYIEPLKVYLARYREAEGDTKRSVRSGDGSATSDHVRVAGANA

SEQ ID NO: 804 - protein, 223 aa, Zea mays
  Orthologous to G481, G482
MPDSDNDSGGPSNAGGELSSPREQDRFLPIANVSRIMKKALPANAKISKDAKETVQECVSEFISFITGEASDKCQREKRKTINGDDLLWAMTTLGFEDYVEPLKHYLHKFREIEGERAAASAGASGSQQQQQQGELPRGAANAAGYAGYGAPGSGGMMMMMMGQPMYGGSQPQQQPPQPQPPQQQQQQHQQHHMAMGGRGGFGQQGGGGGSSSSSGLGRQDRA

SEQ ID NO: 805 - protein, 212 aa, Zea mays
  G3436  Orthologous to G481, G482
MPDSDNESGGPSNAEFSSPREQDRFLPIANVSRIMKKALPANAKISKDAKETVQECVSEFISFITGEASDKCQREKRKTINGDDLLWAMTTLGFEDYVEPLKLYLHKFRELEGEKAATTSASSGPQPPLHRETTPSSSTHNGAGGPVGGYGMYGGAGGGSGMIMMMGQPMYGGSPPAASSGSYPHHQMAMGGKGGAYGYGGGSSSSPSGLGR

SEQ ID NO: 806 - protein, 164 aa, Zea mays
  G3434  Orthologous to G481, G482
MADDGGSHEGSGGGGGVREQDRFLPIANISRIMKKAVPANGKIAKDAKETLQECVSEFISFVTSEASDKCQKEKRKTINGDDLLWAMATLGFEEYVEPLKIYLQKYKEMEGDSKLSTKAGEGSVKKDAISPHGGTSSSSNQLVQHGVYNQGMGYMQPQYHNGET

SEQ ID NO: 807 - protein, 174 aa, Zea mays
  Orthologous to G481, G482
PASEEGYGHQGHLLSPVGSPLSDNESGAAAAAGGGGCGSSVGYCGGGGGESPAKEQDRFLPIANVSRIMKRSLPANAKISKEAKETVQECVSEFISFVTGEASDKCQREKRKTINGDDLLWAMTTLGFEAYVAPLKSYLNRYREAEGEKAAVLGGGARHGDGGGAADDAGPLAG

SEQ ID NO: 808 - DNA, 364 bp, Glycine max
  Predicted polypeptide sequence is orthologous to G484
  misc_feature (17)..(17): n is a, c, g, or t
  misc_feature (317)..(317): n is a, c, g, or t
  misc_feature (352)..(352): n is a, c, g, or t
gaagcccatagacatcnttggaaaagccaaagaagacgcttctcttcctaaagcaacaataacgaaaattattaaagaaatattacccccaaacatacatatcaccagagatacacaggatttattaatcaagtattatatcaaatttataaaccttatctcgtcagaatccaataaagtctataacaaagaagaaaaaagaacgattacaccgaagcacatatgaagaactgttaaaattctgaaatttagcgagtacattagagaaggggatacagcatatgaacaacacaaagtgaaaacaatgcaacattctntaaaagatgcagagaagaacaacagacctgagatnactgaagaagag

SEQ ID NO: 809 - DNA, 756 bp, Glycine max
  Predicted polypeptide sequence is orthologous to G484
  misc_feature (436)..(436): n is a, c, g, or t
  misc_feature (474)..(474): n is a, c, g, or t
  misc_feature (525)..(525): n is a, c, g, or t
  misc_feature (529)..(529): n is a, c, g, or t
  misc_feature (532)..(532): n is a, c, g, or t
  misc_feature (563)..(563): n is a, c, g, or t
  misc_feature (622)..(622): n is a, c, g, or t
  misc_feature (642)..(642): n is a, c, g, or t
  misc_feature (650)..(650): n is a, c, g, or t
  misc_feature (654)..(654): n is a, c, g, or t
  misc_feature (671)..(671): n is a, c, g, or t
  misc_feature (678)..(678): n is a, c, g, or t
  misc_feature (738)..(738): n is a, c, g, or t
  misc_feature (740)..(740): n is a, c, g, or t
acaactacgatcttcgatagtgctttctcagattcttccttcgtggtaaccggtcgaatcatggagcccatggacattgttggcaagtcaaaggaagacgcttcgcttcctaaagcaacaatgacaaaaattattaaagagatgttacccccagatgtacgtgttgcaagagatgcccaagatctattgattgagtgttgtgtagagtttataaaccttgtctcgtcagaatccaatgaagtttgtaacagagaggataaacggacaattgcacctgagcatgtattgaaggctctacaggttcttggatttggtgagtatgttgaagaagtttatgcagcatatgaacagcacaagctggagaccatgcaggactctttaaggggtggtggtaaatggagcaatggagctgagatgactgaggaagaagcattancagagcagcaaaggatgtttgcagaagcgcgtgctaangatgaacggtggagccattgctttcaagccagcccagatgctgaccaaagnttanatnagctaactttaggatcttcatttgaagcatngacaaaagcaccacccttgacttcctgcctgtgcttttccaatgaagcctccgatgggnggtacaaaaaaacccatttnacctaagntttncttggggcccaatggtnggaatgnggcctcaattttgggatttctttttccgaaaaaaaatcccattattttttttaaagtccnantgttaattttagtggg

SEQ ID NO: 810 - DNA, 1063 bp, Glycine max
  Predicted polypeptide sequence is orthologous to G484
ccacgcgtccgcccacgcgtccgcccacgcgtgaaccgtcatcataaattcatatatcatcagcctcagccatgtcttcttcgctcttgcacctcctcttccttccacaactacgatcttcgatagtgctttctcagattcttccttcgtggtaaccggtcgaatcatggagcccatggacattgttggcaagtcaaaggaagacgcttcgcttcctaaagcaacaatgacaaaaattattaaagagatgttacccccagatgtacgtgttgcaagagatgcccaagatctattgattgagtgttgtgtagagtttataaaccttgtctcgtcagaatccaatgaagtttgtaacagagaggataaacggacaattgcacctgagcatgtattgaaggctctacaggttcttggatttggtgagtatgttgaagaagtttatgcagcatatgaacagcacaagctggagaccatgcaggactctttaaggggtggtggtaaatggagcaatggagctgagatgactgaggaagaagcattagcagagcagcaaaggatgtttgcagaggcgcgtgctaggatgaacggtggagccattgcttccaagcagccagatgctgaccaaagtttagatagctaactttaggatcttcattgaagcatagacaaagcaccaccctgactcctgtctgtgcttccaatgagctcgatggtgtacaaaaaccattcactagtttgctggcccatgtggatgtgctcatttgtattctttcgataaatccatatttgtaagtcaatgtaattagtgagagatcatgaaaaccctcccgtttagcatttacttgtaattatttaatttacgtttttgtatcttctacatactaacaactcctagcttgattctgacagtagctactatgttagattgtaacaaattattaaatatgtagaagcaatagtgctctgtttatttgttaaaaaaataaaaacaaaatgggcagagcatggaaggaacatatattccacaaatgactatatgtatggactagttgaaagatatagg

SEQ ID NO: 811 - DNA, 708 bp, Glycine max
  Predicted polypeptide sequence is orthologous to G484
  misc_feature (582)..(582): n is a, c, g, or t
  misc_feature (598)..(598): n is a, c, g, or t
ccacgcgtccgctgcaacaacatgttcaccaccacctccttgttcttcacatcatcctcatcatcttcttcaatcagttgactcttcgttcctccctctattctttcggatggagcccatggacatcgttgggaaggccaaggaagacgcttctcttcctaaagcgacaatgacgaaaattattaaagagatgttgcccccggacgtgcgtgtcgccagagatgcacaggatttattgatcgagtgttgtgtcgagtttataaaccttgtctcgtcagagtccaatgaagtctgtaacaaagaagaaagaaggacgattgcaccggagcacgtgttaaaggctttagggcaagattctttaaaaggtgcaaagtggagcaacagagctgagatgactgaggaagaagcattggctgaacagcaaaggatgtttgcagaggcacgtgcaagaatgaatggaggagccattcaatccaaggagccagaggctgaccaaagtttagagagctaactttataggacacttttattttcttttgaagcataggcaagcagcatctcttactcttccctatgcgttgntaatttagctcgattntgcacatacccccattcactagtttgctggcctacgtgaatgtactcgccatttgtgttcttttagtaatccatatttgtaaggttatgtaattattggagttcatctaa

SEQ ID NO: 812 - DNA, 1034 bp, Glycine max
  Predicted polypeptide sequence is orthologous to G484
  misc_feature (924)..(924): n is a, c, g, or t
cataaatatgcgtctctgcgacatgttcaccaccacctccttgttcacatcatcatcatcatcatcatcatcatcttcttcttcttcaatcagatggagcccatggacatcgttgggaaggccaaggaagacgcttctcttcctaaagcgacaatgacgaaaattattaaagagatgttgcccccggacgtgcgtgtcgccagagatgcacaggatttattgatcgagtgttgtgtcgagtttataaaccttgtctcgtcggagtccaacgaagtctgtaacaaagaagaaagaaggacgattgcaccggagcacgtgctgaaggctttaggggttcttggatttggcgagtacattgaggaagtttatgcagcatatgaacaacacaagttggagacaatggtgattatgttaatgaccaatgtgcatgatatatattacaacttaacagcataattgtttttgtcttgtataatattcatccatcaattgtttattgggtgattagttttataagaatccatgaattttttgggagcatggcctgtgtggtttgaccgagccagtctgggctcccatataatttgttgagggacccattaaaatggtattctgtaggaaaaagcactggaaaggccctaatgggctgataacctgaccatggtcccctcttctgttttcattaagtgttttaaatatatgatgtctgagagctcagcctataacttttctggctggtgaaattgaaattaccaatgatttatgaatctccacttatgtgtatggtccattctatagttgttgagtatcccatttgtaaattactgagtgctctgtaattgtgatttgtgattcataatgtaaggtttggtcatgcaaagtgatataatctatttggctatatttagttgatgaatggcctgnatattttttcgtggtaaagttctatagttttaaatatgctgtttcaaagcacaatcatggtatatgaattgtgaatcattaaattactactatcatttatagatttgact

SEQ ID NO: 813 - DNA, 639 bp, Glycine max
  Predicted polypeptide sequence is orthologous to G484
gcacgagtctctctctttcttgttcttatccatcgcattgaaaagcagcaccatcaccaccccctcgtcttccccccttctttcataaatatgcgtctctgcgacatgttcaccaccacctccttgttcacatcatcatcatcttcttcttcttcaatcagttgactcttcgttcctccctctattcatctgatggagcccatggacatcgttgggaaggccaaggaagacgcttctcttcctaaagcgacaatgacgaaaattattaaagagatgttgcccccggacgtgcgtgtcgccagagatgcacaggatttattgatcgagtgttgtgtcgagtttataaaccttgtctcgtcggagtccaacgaagtctgtaacaaagaagaaagaaggacgattgcaccggagcacgtgctgaaggctttaggggttcttggatttggcgagtacattgaggaagtttatgcagcatatgaacaacacaagttggagacaatgcaagactctttaaaaggtgccaagtggagcaacagagctgagatgactgaggaagaagcattggctgaacagcaaaggatgtttgcagaggcacgtgcaagaatgaatggaggagccattacttccaagcagccagac

SEQ ID NO: 814 - DNA, 997 bp, Glycine max
  Predicted polypeptide sequence is orthologous to G484
atcgcattgaaaagcagcaccatcaccaccccctcgtcttccttccttctttcataaatatgcgtctctgcgacatgttcaccaccacctccttgttcacatcatcatcatcatcatcatcatcatcttcttcttcttcaatcagttgactcttcgttcctccctctattcatctgatggagcccatggacatcgttgggaaggccaaggaagacgcttctcttcctaaagcgacaatgacgaaaattattaaagagatgttgcccccggacgtgcgtgtcgccagagatgcacaggatttattgatcgagtgttgtgtcgagtttataaaccttgtctcgtcggagtccaacgaagtctgtaacaaagaagaaagaaggacgattgcaccggagcacgtgctgaaggctttaggggttcttggatttggcgagtacattgaggaagtttatgcagcatatgaacaacacaagttggagacaatgcaagactctttaaaaggtgccaagtggagcaacagagctgagatgactgaggaagaagcattggctgaacagcaaaggatgtttgcagaggcacgtgcaagaatgaatggaggagccattacttccaagcagccagacgctcaccaaagtttagagagctaactttaggacacctttattttcttttgaaggcataggcaagcacatctcttctcttactcttccctatgcgatgttaatttagctcgattttgcacaaatccccattcactagtttgctggcctatgtgaatgtgctcgccatttgtgttcttttagtaatccatatttgtaagttaatgtaattattggagttcttctaaatcctcgtctatttagaatacatgtatattatttcatttacctgttgtatcgcctacaccaactactattggcttaattttgacaatatagtggctatacaacgatcccttataatttgttatataaaaagtcctgaaggttttcccccc

SEQ ID NO: 815 - DNA, 1008 bp, Glycine max
  Predicted polypeptide sequence is orthologous to G484
attcggctcgaggcatgacggaagagctctctctctctcttgttcttatccatcgcattgaaaagcagcaccatcaccacccccacctcttaccccttctttcataaatatgcgtgctctgcaacaacatgttcaccaccacctccttgttcttcacatcatcctcatcatcttcttcaatcagttgactcttcgttcctccctctattctttcggatggagcccatggacatcgttgggaaggccaaggaagacgcttctcttcctaaagcgacaatgacgaaaattattaaagagatgttgcccccggacgtgcgtgtcgccagagatgcacaggatttattgatcgagtgttgtgtcgagtttataaaccttgtctcgtcagagtccaatgaagtctgtaacaaagaagaaagaaggacgattgcaccggagcacgtgttaaagggctttaggggttcttggatttggcgagtacatcgaggaagtttatgcagcatatgaacaacacaagttggaaacaatgcaagattctttaaaaggtgcaaagtggagcaacagagctgagatgactgaggaagaagcattggctgaacagcaaaggatgtttgcagaggcacgtgcaagaatgaatggaggagccattcaatccaaggagccagaggctgaccaaagtttagagagctaactttataggacacttttattttcttttgaagcataggcaagcagcatctcttactcttccctatgcgttgttaatttagctcgattttgcacatacccccattcactagtttgctggcctacgtgaatgtactcgccatttgtgttcttttagtaatccatatttgtaagttaatgtaattattggagttcatctaaaccctcgtctatttagaattttacatgtagattatttcatttacctgttgtatctcccacaccaacaacagctattgccttgattttgacaatagttgctatattagaatgtaacaatctatt

SEQ ID NO: 816 - DNA, 372 bp, Glycine max
  Predicted polypeptide sequence is orthologous to G484
ggctcgaggcgcacaacatgtgaccaccaccccgcgggggggacaggagcctgagcagcctcacaatcaggggactcttcgttgctccctctactctttcgggtggagcccatggacatcgttgggaaggccaaggaagacgcttctcttcctaaagcgacaatgacaaaaattattaaagagatgttgccccggggggggcgtgtcgacagagatgcacaggatttatagaacgagtgatgtgtcgaggttataaaccttgactggtcagagggcaatgaagtctgtcgcaaagaagaaagacggacaattgctccagaacacctgttaaaggcttcacgggcactggaatttggcgagtacatcagggaa

SEQ ID NO: 817 - DNA, 505 bp, Glycine max
  Predicted polypeptide sequence is orthologous to G484
  misc_feature (141)..(141): n is a, c, g, or t
  misc_feature (159)..(159): n is a, c, g, or t
tacggctgcgagaagacgacagaagggggtgaaaccgtcatcataaattcatatatcatcagcctcagccatgtcttcttcgctcttgcacctcctcttccttccacaactacgatcttcgatagtgctttctcagcctcntccttcggggtaaccggncgaatcatggagcccatggacattgttggcaagtcaaaggaagacgcttcgcttcctaaagcaacaatgacaaaaattattaaagagatgttacccccagatgtacgtgttgcaagagatgcccaagatctattgattgagtgttgtgtagagtttataaaccttgtctcgtcagaatccaatgaagtttgtaacagagaggataaacggacaattgcacctgagcatgtattgaaggctctacaggttcttggatttggtgagtatgttgaagaagtttatgcagcatatgaacagcacaagctggagaccatggtaattatgaatattaatgccccatatgtat

SEQ ID NO: 818 - DNA, 914 bp, Oryza sativa
  Predicted polypeptide sequence is orthologous to G484
ccctcctttattccccgtctcctccgcgtgagctcgccggagcaccgccggccgatcccccccacccccgccacgcgagcagcgccgctcgcgcggcctgctgcccccgcctcaccctcgccggtgaacggcgcatgcccccccgacgttaggtgtcgcgcctggagacgcggagatggatccgatggatatcgtggggaagtccaaggaggacgtctccctccccaaatcaacaatgtttaagattataacgggggggtccccccccggcgggcgagtggcaagagatgcacaagatcttcttgtggaatgctgtgtagagttcatcaacctcctatcttctgaatccaatgaagtttgcagccgagaggacaagaaaactattgctcctgagcatgttcttagagctctgcaggatcttggctttagggagtacattgaagaggttcaagcggcctacgaacaccataagcatgataccctggattctccaaaagcaagcaaattcactggtgtggagatgacagaggaacaagctgtagctgagcaacagaggatgtttgctgaggcccgagcaaggatgaacaatggtgccgccaaaccgaaggagccagaacctgaagcgcagcaacaaacacaacagccaccacagcctcagctgcaccctcaaccacagcaacccctgcagcctcaacttcagctccatcctcaaccacaacaacagccctcacagctacatcctcaacagctgctgcatcctcaattcgcagcaaactccgcagcctcaacctcaggtccaccctcaaccacagcagcctgcacagctgcaaccgcaacctcagcttctccagcaaccgcagcttgcccaacagctgcagccgcaatctcagctcccccacaaccgaagcagcccc

SEQ ID NO: 819 - DNA, 504 bp, Zea mays
  Predicted polypeptide sequence is orthologous to G484
tggctccagccccagccccttctccgcaggccgtgccctccctccctagccgcgcctcggatccatcgatcccggcggtacgcgacgtcggcgccccagactcaagatccatcgcgcgctcgacggcgagggatggatccgatggacatcgtgggcaagtccaaggaggacgtctccctccccaaatcaacaatgaccaagattattaaggagatgctaccgcctgatgttcgagtagcaagagatacacaagatcttcttgttgaatgctgtgtagagttcatcaatcttctttcttcggaatccaatgacgtgtgcagccgggacgacaagaagactattgttttttgaacatgctattagggctctgccggatcttggcttcaaggagtaccgttgaagaagtttatgcagcctacgaacagcacaagtttgaaactctgggctctcccaaagcaacccaagtcactggtatagagatgactgaagaaaaatctgttgcgg

SEQ ID NO: 820 - DNA, 919 bp, Zea mays
  Predicted polypeptide sequence is orthologous to G484
ccggccgggatagctctactcctatatcttagtggtgacaatttccccgtgcggcagccagaaaactgcactcgaatccgagcagccacaattgtttttatgacaaagaaaaggacctcaataccactctgcccgagcaagccgaattgtcgcccgaattcgctcgcggggagcacttgctacctcgcgcccgccttctgtcgcgcggattcgttgccgcgcctggagatggacccgatggacatcgtcggcaagtccaaggaggacgtctccctccccaaatcaacaatgtttaagataattaaggagatgcttcctcctgatgtacgagtggcaagagatgcacaggatcttcttgttgaatgctgtgtagagttcatcaatctcctttcgtctgaatcgaatgaagtgtgcagcagagaagagaaaaaaacgattgctcctgagcatgttatcaaggctctaagtgatcttggcttcagagagtacattgaggaggtttatgctgcatatgaacagcacaaacttgatactttggattctccaaaagctggcaaattcactgggattgagatgacagaggaagaagctgttgctgagcaacaaaggatgtttgctgaggctcgagcaaggatgaataatggagcccccaaaccaaaggagacagaacaagagccgccacagcaaccacaagcacaaccccaacttcagctgcatactgaaccacagcaacccgtggaatctcaagtgcagttgcattcgccaacacagcattccctccaacctcaagtgcagctgcacccccagccacaacagcttccacaagtgcaggtgcactctcagacgcagctgcaccctcagccacagcagccccaagtgcaggttcatccgcagctgcagcaactcccacattacaggc

SEQ ID NO: 821 - DNA, 1445 bp, Zea mays
  Predicted polypeptide sequence is orthologous to G484
attcggctcgagatttcactctgcccgagcaagccgaattgtcgtccgaattcgctcgcggggagcacttgctacctcgcgcccgccttctgtcgcgcggattcgttgctgcgcctggagatggacccgatggacatcgtcggcaagtccaaggaggacgtctccctccccaaatcaacaatgtttaagataattaaggagatgcttcctcctgatgtacgagtggcaagagatgcacaggatcttcttgttgaatgctgtgtagagttcatcaatctcctttcgtctgaatcgaatgaagtgtgcagcagagaagagaaaaaaacgattgctcctgagcatgttatcaaggctctaagtgatcttggcttcagagagtacattgaggaggtttatgctgcatatgaacagcacagactcgagactctggttggtaccacttgttagtcacagggctgcgcatatcattcccttatctaatctgtgtactgtgcttgacaccaatatgtcttgagtaggattctccaaaagctggcaagttcactaggattgcgatgacagaggatgatgctgccgctgagcatcaaaggatgtttgctgtggctcgagcaaggatgaataacggagcccccaagccaaaggagccagaacaagaaccgccacagctaccacaagcacaaccccaacttcagctgcatactgaaccacagcaacccatgcaatctcaagttcagttgcattcgcaaacacaacactacctccaacctcaactgcagctccactctcagccgcagctgcaacccctcagccgcagttgcccccacaattgcaggtccatcagcagctgcagcaacccccacaagtgcaggtccaccagcagcccgaagtgcagccccaagaagcgcagttgcaatcatcagcccagcaaacctcccaaccgcaacctcaggcacaactacaatcacaggggcactcacaagcgcagctgcaagccggactgctgggtcagttgcagacacaggcgcaaaccggacctgacatggatagttagagactattgtgtagcctgagtataagcaaaaaagggaaaaaaaaccaggcacttttgctgcatctactagaaacctgtatgcctgcttgtgactcattagatcctgatttaggtttccgtgcttcctgtagaatgtaaatgcagtgtgattgcagttgccttgttgctaataatgcgaagccgttagttactgatgatgtcattattgtgtggaatactgaattcgtgacaagtgtcatggcatggttttatgtgacgtgctgaaagatattccgttgccattgtaatagccgaacttcgacatttgtccatggtgatagcgactgatttgaatgagttcttgctgcaaaaaaaaaaaaaaaaaaaaaaaaaaaaaaaaaaaaaaaaaaaaagg

SEQ ID NO: 822 - DNA, 1391 bp, Zea mays
  Predicted polypeptide sequence is orthologous to G484
gtacccgccttaccgcgcgccctaaccctaggccctcaattccactctgcccgagcaagccgaattgtcgcccgaattcgctcgcggggagcacttgctacctcgcgcccgccttctgtcgcgcggattcgttgccgcgcctggagatggacccgatggacatcgtcggcaagtccaaggaggacgtctccctccccaaatagttgtttaaaatcttctactgctgattgaactttctgctttgcactttagcaacaatgtttaagataattaaggagatgcttcctcctgatgtacgagtggcaagagatgcacaggatcttcttgttgaatgctgtgtagagttcatcaatctcctttcgtctgaatcgaatgaagtgtgcagcagagaagagaaaaaaacgattgctcctgagcatgttatcaaggctctaagtgatcttggcttcagagagtacattgaggaggtttatgctgcatatgaacagcacaaacttgatactttggattctccaaaagctggcaaattcactgggattgagatgacagaggaagaagctgttgctgagcaacaaaggatgtttgctgaggctcgagcaaggatgaataatggagcccccaaaccaaaggagacagaacaagagccgccacagcaaccacaagcacaaccccaacttcagctgcatactgaaccacagcaacccgtgcaatctcaagtgcagttgcattcgccaacacagcattccctccaacctcaagtgcagctgcacccccagccacaacagctcccacaagtgcaggtgcactctcagacgcagctgcaccctcagccacagcagccccaagtgcaggtccatccgcagctgcagcaactcccacaattacagggcccactcgcagccaccgcaaccccaagtgcaaatccacccacagccgcagcagcccccacaagtgcagttgcagtcatcagtccagcagacctcccaaccccaacctcaggtacatctctacaatcacagggggggctcacaagcgcagctgcagccccaactgccaggtcagctgcagacacaggggcaaaccggacctggcattgacagttagagactactgctggcatatactaggaacctgtatgcttgcttgtgactcgttagatcctgatttaggtttctgtgcttcctgtacaatgtaaatccagtgtgattgcagttgccttgttgctaataatgtgaaaccgttagttactgatgatgtccttactgtgtcgaatactgaatgtcatggcgtggcttatgtgccatgctgaatgatgttctgtggtcattgttatagcctaacttgacatctgtccatgatgatagtgattgatttgaatgagctcttggtgc

SEQ ID NO: 823 - DNA, 1424 bp, Zea mays
  Predicted polypeptide sequence is orthologous to G484
ccggccgggccgggccgtatatcaacccctcccctcgtattaggccccacctccccgcgcgccctaaccctagcttctcgattcaactctgcgcgagacgaattctctcccgaattcgctcgccgaaagcacctgctacctcgcgcccgccttccgtcgcgcggattcggtgccgtgcgtggagatggacccgatggacatcgtggggaagtctaaggaggacgtttccctccccaaatcaacaatggttaagataattaaggagatgcttcctcctgatgtacgagtggcaagagatgcacaggatcttcttgttgaatgctgcgtagagttcatcaatctcctttcgtctgaatccaatgaagtgtgcagcagagaagagaagaaaacaattgctcctgagcatgttatcaaggctctaagtgatcttggcttcagagagtacattgaggaggtttatgctgcgtatgaacagcacaaactcgagactctggattctccaaaagctggcaagttcactaggattgagatgacagaggaagaagctgttgctgagcaacaaaggatgtttgctgaggctcgagcaaggatgaataacggagcccccaagccaaaggagccagaacaagaaccgccacagctaccacaagcacaaccccaacttcagctgcatactgaaccacagcaacccatgcaatctcaagttcagttgcattcgcaaacacaacactccctccaacctcaactgcagctccaccatcagccacaacagctcccacaagtgcagctgcactctcagccgcagctgcaaccccaagtgcatctgcaccctcagccgcagttgccccccacaattgcaggtccatcagcagctgcagcaacccccacaagtgcaggtccaccagcagcccgaagtgcagccccaagaagcgcagttgcaatcatcagcccagcaaacctcccaaccgcaacctcaggcacaactacaatcacaggggcactcacaagcgcagctgcaagccggactgctgggtcagttgcagacacaggcgcaaaccggacctgacatggatagttagagactattgtgtagcctgagtataagcaaaaaagggaaaaaaaaccaggcacttttgctgcatctactagaaacctgtatgcctgcttgtgactcattagatcctgatttaggtttccgtgcttcctgtagaatgtaaatgcagtgtgattgcagttgccttgttgctaataatgcgaagccgttagttactgatgatgtcattattgtgtggaatactgaattcgtgacaagtgtcatggcatggttttatgtgacgtgctgaaagatattccgttgccattgtaatagccgaacttcgacatttgtccatggtgatagcgactgatttgaaatgagtcttgct

SEQ ID NO: 824 - protein, 296 aa, Oryza sativa
  Orthologous to G484
MDPMDIVGKSKEDVSLPKSTMFKIIKEMLPPDVRVARDAQDLLVECCVEFINLLSSESNEVCSREDKKTIAPEHVLRALQDLGFREYIEEVQAAYEHHKHDTLDSPKASKFTGVEMTEEQAVAEQQRMFAEARARMNNGAAKPKEPEPEAQQQTQQPPQPQLHPQPQQPLQPQLQLHPQPQQQPSQLHPQQLLHPQSQQTPQPQPQVHPQPQQPPQLQPQPQLLQQPQLPQQLQPQSQLPPQPQQPPQLQLQSQLHPQPQQPPQLQPQPQLHQQPQPQAELQSQSQPQTEHGLDSS

SEQ ID NO: 825 - DNA, 826 bp, Glycine max
  Predicted polypeptide sequence is orthologous to G489
  misc_feature (793)..(793): n is a, c, g, or t
caaaccaaacctctctttctcagtttctctctcttagggttttctcctcccccattgacccaccgtccatcgcaaaggaagtcgcgcccaatttccatggactcagcagcaacatcagcatgggatgggcgttgccacaggtgctagccaaatggcctattcttctcactacccgactgctcccatggtggcttctggcacgcctgctgtagctgttccttccccaactcaggctccagctgccttctctagttctgctcaccagcttgcataccagcaagcacagcatttccaccaccaacagcagcaacaccaacaacagcagcttcaaatgttctggtcaaaccaaatgcaagaaattgagcaaacaattgactttaaaaaccacagtcttcctcttgctcggataaaaaagataatgaaagctgatgaagatgtccggatgatttctgcagaagctccagtcatatttgcaaaagcatgtgaaatgttcatattagagttgacgttgagatcttggatccacacagaagagaacaagaggagaactctacaaaagaatgatatagcagctgctatttcgagaaacgatgtttttgatttcttgggttgatattatcccaagagatgagttgaaagaaggaaggacttggaataaccaaggctactattccattggtgaaatcttcagctgatatgccatattactatgtcccttcacagcatctgtggaggactctgggatgacatgggcaacccgtggtgtgacaacaacgttgatctcacagagctnactccatgggtatgcatggcctcaaaccagaca

SEQ ID NO: 826 - DNA, 1669 bp, Glycine max
  Predicted polypeptide sequence is orthologous to G489
ttacggctgcgagaagacgacagaaggggcctccctttttaattgaaaccaaaccaaaccaaaccaaaccaaacctctctttctcagtttctctctcttagggttttctcctcccccattgacccaccgtccatcgcaaaggaagtcgcgcccaatttccatggtttgtagattaaatcttaaagcagtaagtcatcatggataaatcagagcagactcagcagcaacatcagcatgggatgggcgttgccacaggtgctagccaaatggcctattcttctcactacccgactgctcccatggtggcttctggcacgcctgctgtagctgttccttccccaactcaggctccagctgccttctctagttctgctcaccagcttgcataccagcaagcacagcatttccaccaccaacagcagcaacaccaacaacagcagcttcaaatgttctggtcaaaccaaatgcaagaaattgagcaaacaattgactttaaaaaccacagtcttcctcttgctcggataaaaaagataatgaaagctgatgaagatgtccggatgatttctgcagaagctccagtcatatttgcaaaagcatgtgaaatgttcatattagagttgacgttgagatcttggatccacacagaagagaacaagaggagaactctacaaaagaatgatatagcagctgctatttcgagaaacgatgtttttgatttcttggttgatattatcccaagagatgagttgaaagaggaaggacttggaataaccaaggctactattccattggtgaattctccagctgatatgccatattactatgtccctccacagcatcctgttgtaggacctcctgggatgatcatgggcaagcccgttggtgctgagcaagcaacgctgtattctacacagcagcctcgacctcccatggcgttcatgccatggccccatacacaaccccagcaacagcagccaccccaacatcaacaaacagactcatgatgaccatgcaattcaattaggtcggaaagtagcatgcaccttatgattattacaaatttacttaatgcctttaagtcagctgtagtttagtgttttgcattgaaaaatgccaaagattgtttgaggtttcttgcactcatttatgattgtatgagctcttatgctgagttacttttggttgtgtttatttgaggtactggtgtggtagttaaattagtttgtagctgtccataagtaaacagcgtagctgcttaattaggaggtctgaaatgatgaaatagtttgtattgttattgcagaaggtaggttttattcagtatttcattctactgcaatggctgaatttattgctcatccgcttagtactagttgatgttttttcctgtccctcgttacgtgttagagtgcgaagaagaattagtgtgccattcttcacctgtttttgcacactacagccccggaagaacaaattgttccgatcattttcaattttttttcccggtaacatgaaaagtggttgatgttaaatgctgtccctgtaaaaaaaaaaaaaaaagaattgacagcaggaaaaaaaaaataacgagctgttctttttcttgattcaaaaccacataaatatatccagattagttttatagttaataattgattttattcggaag

SEQ ID NO: 827 - DNA, 956 bp, Glycine max
  Predicted polypeptide sequence is orthologous to G489
tcagaaatgcactctctctctttctctctccagaacacaactcaacacactcttcaatttcaaacgcacactcttcaacttcactgtccctccctttttaattgaaacccgagcaaacctcgctttctcagtttctctttcttagggttttctccaccgtccattgcaaagtcttgcgcccaatttccatggaactgtaaagagaggatagttagaagattaaatcttaaagcagtaagtcatcatggataaatcagagcagactcaacagcagcagcagcaacaacagcatgtgatgggagttgccgcaggggctagccaaatggcctattcttctcactacccgactgcttccatggtggcttctggcacgcccgctgtaactgctccttccccaactcaggctccagctgccttctctagttctgctcaccagcttgcataccagcaagcacagcatttccaccaccaacagcagcaacaccaacaacagcagcttcaaatgttctggtcaaaccaaatgcaagaaattgagcaaacaattgactttaaaaaccatagccttcctcttgctcggataaaaaagataatgaaagctgatgaagatgtccggatgatttcagcagaagctccggtcatatttgcaaaagcttgtgaaatgttcatattagagttgacgttgcgatcttggatccacacagaagagaacaagaggagaactctacaaaagaatgatatagcagctgctatttcgagaaacgatgtttttgatttcttggttgatattattccaagagatgagttgaaagaggaaggacttggaataaccaaggctactattccgttagtgggttctccagctgatatgccatattactatgtcccttcacagcatcctgttgtaggaccacctggggatgatcatgggcaagcccattggcgctgagcaagcacac

SEQ ID NO: 828 - DNA, 1262 bp, Glycine max
  Predicted polypeptide sequence is orthologous to G489
cacgcgtccgcctctctttctagtttctctctcttagggttttctcctcccccattgacccaccgtccatcgcaaaggaagtcgcgcccaatttccatggactcagcagcaacatcagcatgggatgggcgttgccacaggtgctagccaaatggcctattcttctcactacccgactgctcccatggtggcttctggcacgcctgctgtagctgttccttccccaactcaggctccagctgccttctctagttctgctcaccagcttgcataccagcaagcacagcatttccaccaccaacagcagcaacaccaacaacagcagcttcaaatgttctggtcaaaccaaatgcaagaaattgagcaaacaattgactttaaaaaccacagtcttcctcttgctcggataaaaaagataatgaaagctgatgaagatgtccggatgatttctgcagaagctccagtcatatttgcaaaagcatgtgaaatgttcatattagagttgacgttgagatcttggatccacacagaagagaacaagaggagaactctacaaaagaatgatatagcagctgctatttcgagaaacgatgtttttgatttcttggttgatattatcccaagagatgagttgaaagaggaaggacttggaataaccaaggctactattccattggtgaattctccagctgatatgccatattactatgtccctccacagcatcctgttgtaggacctcctgggatgatcatgggcaagcccgttggtgctgagcaagcaacgctgtattctacacagcagcctcgacctcccatggcgttcatgccatggccccatacacaaccccagcaacagcagccaccccaacatcaacaaacagactcatgatgacaatgcaattcaattaggtcggaaagtagcatgcaccttatgattattacaaatttacttaatgcctttaagtcagctgtagtttagtgttttgcattgaaaaatgccaaagattgtttgaggtttcttgcactcatttatgattgtatgagctcttatgctgagttacttttggttgtgtttatttgaggtactggtgtggtagttaaattagtttgtagctgtccataagtaaacagcgtagctgcttaattaggaggtctgaaatgatgaaatagtttgtattgttattcccaaaaaaaaaaaaaaaaaaaaaaaaaaaaaaaaaaaaaaaaaaaaaaaaaaaaaaaaaaaaaaaaaaaaaaaaaaa

SEQ ID NO: 829 - DNA, 675 bp, Glycine max
  Predicted polypeptide sequence is orthologous to G489
ctctcttagggtttcctccccccccccggaccctccgtccatcgcaaaggaagtcgcgcccaatttccatggtaagtcatcatggataaatcagagcagactcagcagcaacatcagcatgggatgggcgttgccacaggtgctagccaaatggcctattcttctcactacccgactgctcccttggtggcttctggcacgcctgctgtagctggtccttccccaactcaggctccagctgccttctctagttctgctgaccagcttgcataccagcaagcacagcatttccaccaccaacagcagcaacaccaacaacagcagcttcaaatgttctggtcaaaccaaatgcaagaaattgagcaaacaattgactttaaaaaccacagtcttcctcttgctcggataaaaaagataatgaaagctgatgaagatgtccggatgatttctgcagaagctccagtcatatttgcaaaagcatgtgaaatgttcatattagagttgacgttgagatcttggatccacacagaagagaacaagaggagaactctacaaaagaatgatatagcagctgctatttcgagaaacgatgtttttgatttcttggttgatattatcccaagagatgagttgaaagaggaaggacttgggataaccaaggctactattgcattg

SEQ ID NO: 830 - DNA, 1527 bp, Glycine max
  Predicted polypeptide sequence is orthologous to G489
ccacgcgtccgcttttgttctagcacttcgctgtctgaggttcgttccaaagaaaaacatcgtcaatcctcacgacagctctgctctgctctgcttcttttgttttcttatttttcttctgaaaccctaaattttgtctgctctaaactttgggatctttcacacttgaaaaaaactgcttcttgtgcccgacccagcacaattctcatactatagttcggcggcgcgaagacgactgctggggacattcggtccacagcttttgttctagcacttcgctgtctgaggttctggattctcagtgtttgcggacgcagcatcatcttttagggaagaatggatcatcaagggcatagccagaacccatctatgggggttgttggtagtggagctcaattagcatatggttctaacccatatcagccaggccaaataactgggccaccggggtctgttgtgacatcagttgggaccattcaatccaccggtcaacctgctggagctcagcttggacagcatcaacttgcttatcagcatattcatcagcaacaacagcaccagcttcagcaacagctccaacaattttggtcaagccagtaccaagaaattgagaaggttactgattttaagaaccacagtcttcccctggcaaggatcaagaagattatgaaggctgacgaggatgttaggatgatatcagctgaagcaccagtcatttttgcaagggcatgtgaaatgttcatattagagttaaccctgcgctcttggaatcacactgaagagaacaaaaggcgaacacttcagaaaaatgatattgctgctgctatcacaaggactgacatctttgatttcttggttgacattgtgcctcgtgaggacttgaaagatgaagtgcttgcatcaatcccaagaggaacaatgcctgttgcagggcctgctgatgcccttccatactgctacatgccgcctcagcatccgtcccaagttggagctgctggtgtcataatgggtaagcctgtgatggacccaaacatgtatgctcagcagtctcacccttacatggcaccacaaatgtggccacagccaccagaccaacgacagtcgtctccagaacattagctgatgtgtcgtggaaattaagataaccaggcactggaatcagttgtgaatgtcaaactgaatggttgggaaggtcgatactacatagcgagcagaagctgtagctgatagtttacatgcaatgcagactataaacatatgtagataatgtgctagggaaaacttaaccttatctttgatttagctggaaaaaatggtatttttcattttaattcacaggtcatcagatgataatatttatttactggtgcatagcaggatttttacttgagtttaaacttgtcatgcgcccaaaatatatcccatctttttcattcatcatgcttccttgttatacctacctatctgtggttcgctttgtgggaaaattgagttatcacatgatttgcgcacaagttgtgcaagaac

SEQ ID NO: 831 - DNA, 426 bp, Glycine max
  Predicted polypeptide sequence is orthologous to G489
  misc_feature (328)..(328): n is a, c, g, or t
ggctcgaggaacgcagggttaactctaatatgaacatttcacatgcccttgcaaagatgactggtgcttcggctgatatcatcctaacatcctcgtcagccttcataatcttcttgatccttgccaggggaagactgtggttcttggaatcacactgaagagaacaaaaggcgaacacttcaaaaaaatgatattgctgctgcaatcacaaggactgacatctttgatttcttggttgacattgtgcctcgtgaggacttgaaagatgaagtgcttgcatcaatcccaagaggaacaatgcctgttgcagggcctgctgatgcccttncatattgctacatgccgcctcagcatgcgtccaaagttgagctgttggtgtattatggggtagcctgtgatggacccaacatgtatgctcagcagtct

SEQ ID NO: 832 - DNA, 564 bp, Oryza sativa
  Predicted polypeptide sequence is orthologous to G489
  misc_feature (547)..(547): n is a, c, g, or t
cccacgcgtccgctccttcctaacctagggctccgatttcgccaggtgttgcccatcgcgaccgcgccaccgccgccgccgccgccaccgccaccgccgccgccaccgccaccgccacctgccgatcctacagcagttgcataggagtacatctttagaaatggacccacattcacacaagaaggcacatgaaggtctgattggtgacaaccctgacgcgtatgccgtgacgacataccaacctgtgctgatggtagaaccatcagccgctgctgccttccctccagctccccaggttgctccagcctatccagtgaacccaatgcagcttccagagcatcagcagcacgcaatccagcaagttcagcagctccagcagcagcagaaggagcagctccaggcgttctgggccgaccagatggccgaggttgaacagatgactgagttcaagctccccaacctcccgcttgcaaggatcaagaagatcatgaaggccgatgaggacgtcaagatgatcgcgggcgaggcaccggcgctcttcgccaangcctgcgagatgttcat

SEQ ID NO: 833 - DNA, 1296 bp, Oryza sativa
  Predicted polypeptide sequence is orthologous to G489
tttttttttttttctctttcttggtgtctcctcatgccagcacttttgagtattggattagaaactgatgaaaggtaaggtacagttactacattagttgcaaatcacctaccaaatcacaatcttttttttttctactgctgccatagcagagcagaactaacattaggaaagcctaagacctaatcagattacccgtttcagccaacaatcatgggaatagttttgacaagagcactgagttttagaggccctaagttcacaggacaatgtatatcaatgtcacaacttcactgtatcatctttagctactttctggcagagagtgctgctcttcaggggcctcttcctgttgctcttgaggctgctgccacacatacgtcaccgggtgaccttgctgtccaccgtacatcattcctgatccaggcccctgctgcgctggcacgtagtaatatggatatgtgtctgctgcgccccccacattaggcggtaggccaaccctcggaagcccaagcccttcttctttcatttcatccctgggaactatgtccaccaagaagtcatagatatcagtcctggtgatggcagctgcaatgtcattcttctgcaaggtccggcgcttgttctcctccgtgtgcatccacgacctcaatgttaactctaatatgaatacctcgcatgcctttgcgaagacaacgggggcttctgccgagatcatccggacatcctcatcagccttcattatcttctttatccttgcgagtggcaagctgtggttcttgaagtcggttgtttgctcaatctcttccatttggttagcccagaactcacggagttgctgctgttgctgttgctgcagctgctgatgaaattgctgggcttgttggtagactagctggtgctgagcactgagttgagctggattagtggggaatggtgctgatggctgtgagccaggaggaacaacagcaggagctccaggaaccatggcttgaggtggatatgcagcagcaggaggaggatatgcttgtgacccaccagtggcaacacccatcacaggctgaggctgtgaggatggttccatgtcagctcttgtccgtccaaagccaaaggcccgagagacgacgcccggatctcccgcgccggcgggagcgggagcggcggcggcggagagcgctccctccggcgaagggccgcgccgcccacctccctctcgtggagccctcggcgtcggcggcggagagagagagagagagggagacgcggtcgccctcgggccgattcctgcagcccggg

SEQ ID NO: 834 - DNA, 1671 bp, Zea mays
  Predicted polypeptide sequence is orthologous to G489
ttaagaacctagtaggcagacccggccggcgtagagagggggggaggtcgacgagacagagagagaaggccaagaggcttcctctccccattcctcccttccgtgccctagccgagccagccgcgaggaaggaggcatcccgccgtctcgcctggcgcccgcccgtcggccgaccttctgccgcagcttccaattctaaaaagatcatagatttttgtgcaagagcgagtggatatggaaccatcccctcagcctatgggtgtcgctgccggtgggtcacaagtgtatcctgcctctgcctatccgcctgcagcaacagtagctcctgcttctgttgtatctgctggtttacagtcagggcagccattcccagccaaccctggtcatatgagtgctcagcaccagattgtctaccaacaagctcaacaattccaccaacagctccagcagcagcaacagcagcagcttcagcagttctgggtcgaacgcatgactgaaattgaggcgacgactgatttcaagaaccacaacttgccacttgcgaggataaagaagatcatgaaggccgatgaagatgttcgcatgatctcagccgaagctcctgtggtcttcgcaaaagcttgtgagatattcatactggagctgacacttaggtcgtggatgcacactgaggagaacaagcgccgcaccttgcaaaagaatgacattgcagcagcgatcactaggactgacatttatgacttcttggtcgacattgttcccagggatgagatgaaggaggacggaattgggcttcctagggctggtctgccacccatgggagccccagctgatgcatatccatactactacatgccacagcagcaggtgcctggttctggaatggtttatggtgcccagcaagggcacccagtgacttatttgtggcaggagcctcagcaacagcaggagcaagctcctgaagagcagcaatctgcatgaaagtggctgagaatattgctcagaagctatcacctgattcagagttctcattttaggttgtccaaactgcaggttttcttagtaatatcgttggttatcaaactgaaacaggcgattctaagtagggtgtagcatcatggtagtttcatttctgcttgtgatgttagttgaaaggataatgattagtggctagtggattaaagttaccataccatttccttctattccgaaagtttgcctccatgaggcctctgatatgacgaaaaaataaaaaatgcttcaaaaaaaaaaaaaaaaggaaaaaaaaaaaaaaaaaaaaaaaaaaaaggggggaaaaaacccctaaaggaccccccccacccggaataaaaaaaaaaaaaaaaaacaaaaggaaaacaaaaattcctttaaagaaaaaataaaaaaaaaaaagaaaacatggaaaaaaaatttaaaaaaaaaaaaaaattaaaaaaaacaaaatacccaaaaaaaaaaaaaaaaaaaaaaaaaaaaaaaaaaaaaaaaaaaccaaaaaaaagaacaaaaccaaaaaaataaaaaaaaaccaaaaaaaaaaattatccaaagggaaaaaaaaagagagaaaaaaaaaaaaaaaaaaaacaaaaaaacccccccgaaaaaaaaaaaataaaaattaaagaaacaaaaagagaaaattaaatt

SEQ ID NO: 835 - protein, 259 aa, Oryza sativa
  Orthologous to G489
MEPSSQPQPVMGVATGGSQAYPPPAAAYPPQAMVPGAPAVVPPGSQPSAPFPTNPAQLSAQHQLVYQQAQQFHQQLQQQQQQQLREFWANQMEEIEQTTDFKNHSLPLARIKKIMKADEDVRMISAEAPVVFAKACEVFILELTLRSWMHTEENKRRTLQKNDIAAAITRTDIYDFLVDIVPRDEMKEEGLGLPRVGLPPNVGGAADTYPYYYVPAQQGPGSGMMYGGQQGHPVTYVWQQPQEQQEEAPEEQHSLPESS

SEQ ID NO: 836 - protein, 530 aa, Oryza sativa
  Orthologous to G489
MLSSMFLFLLPLSLLSFSLLGNLWAGAATSAGEGWSSVGLRLMLLGGATPFFYINIETVIITNMNYYPEGSNPVYFAVLVKYEDLDGDVVQVDLMESKSAYGGAIGVWTPMRESWGSASAVTSARPFVTNNVIPAIWSRIAPSLPPSPLPRRPRSALAHCRASPASVSPSARASPTPPSPRSPPHRPSRSRHLLLSGIPAAALVVACPNLNDLDFSNDHYGSTSGMRRRRRWPSCVGFWGGFGDGDGDRYSITFSAYIVVLRTQEAYVQILQQLHRSTSLEMDPHSHKKAHEGLIGDNPDAYAVTTYQPVLMVEPSAAAAFPPAPQVAPAYPVNPMQLPEHQQHAIQQVQQLQQQQKEQLQAFWADQMAEVEQMTEFKLPNLPLARIKKIMKADEDVKMIAGEAPALFAKACEMFILDMTLRSWQHTEEGRRRTLQRSDVEAVIKKTDIFDFLVDIITDDKMKDDGMGSQAASMVSPYTSGGMGFSFDLYPNQHHLAYMWPPQEQQEQWPPQEQQEQKQKQDSDGGGQDE

SEQ ID NO: 837 - protein, 250 aa, Oryza sativa
  Orthologous to G489
MEPSSQPQPAIGVVAGGSQVYPAYRPAATVPTAPAVIPAGSQPAPSFPANPDQLSAQHQLVYQQAQQFHQQLQQQQQRQLQQFWAERLVDIEQTTDFKNHSLPLARIKKIMKADEDVRMISAEAPVIFAKACEIFILELTLRSWMHTEENKRRTLQKNDIAAAITRTDMYDFLVDIVPRDDLKEEGVGLPRAGLPPLGVPADSYPYGYYVPQQQVPGAGIAYGGQQGHPGYLWQDPQEQQEEPPAEQQSD

SEQ ID NO: 838 - DNA, 1886 bp, Glycine max
  Predicted polypeptide sequence is orthologous to G504
cccacgcgtccgcccacgcgtccgacggctgcgagaagacgacagaaggggggggaaacaaaaacaaaacatttcgtccgaaactaatataacgtgttcctccttggaagaagccatagccataacatagccaccagaaaacaaaacccaccttagttattaaaagaaaagaaaactacataaaattaagctttgttcggtggtgaccatggggagcaccgactcatcaagcggttcacaacaaccgaacctgccacctgggtttcggttccaccccaccgatgaagagcttgtggttcactacctcaagaaaaaaacagcttctgctcctcttccggtagccataatcgccgaggttgatctctacaagttcgatccatgggagctacccgctaaggccgcgtttggggagcaggagtggtatttctttacaccgagggacaggaagtatccgaacggcgcgaggccaaacagggcggccacatctgggtattggaaggctactgggactgataagcctgtgttgacctctggtgggacccaaaaggttggggtgaagaaggctttggttttctatggagggaagcccccaagagggatcaaaaccaattggatcatgcatgaatataggctaactgataacaagcctaacaataggcctcctcctggttgtgacttgggcaacaagaaaaacactctaaggcttgatgattgggtgctgtgccgaatctacaagaagagcaacacgcataggtcacccatggagcatgacagggaagattcaatggatgacatgattggagggattcctccatccatcaacgtgggccacatgagtgcgaggtttcatcatctttcaaagatgacgacagcctacaacaacggtgcattgttggaaaatgatcaccacaacttgttggaagggatgatgataggtaacagcaacggagggatgaacacaactactactactacacctggtcccatgtcatctcacttagggggatccaaggaagagctttcttttgttccaaccatgactcactcttcaaacacttctaagagaacactttcatcactgtattggaacgatgaggatgtggcgggtacctcatcttcgaacaaaaggttcaatttggaaagtggggacaataataatcatggaagtgttgtgagggatgatcaagagaatggcactgcttcctctattgccactctgcttaatcaactccctcaaaccccttcattgcaccaacaatcaatattggggtcaataggtgatggacttcttagaacaacataccaaataccaggaatgaattggtatgcttagaacaatttcaggtttgttttaattattgatgaacagggagatattgaattactataaagaaggatatatgatatgatcctcgatcagctggtggaaaccctacactattagattgtaatgattttaatgggatattgagattttggttgttaggaatttggaagcagttgttagagtttgatcatttagatgggcctcattatcatccaatgaagttcttcaaccattggagttagctgcaagcaataacaacaccaaaggtcaggccatgggatacttttagttaaactttaatatagctttatacgtatatatagatatttgctttttttattggtatgtaaataaaaaaatggtggtgtgctcttaattaatgtattcaaatattcaaatgagaaaagagatttcaactcagctgttatatgcataccttgatcaattaggatacaaatgagctttgtgtggatcatatactgtagaagaacgatctattgatattttaattaaagccaaattggtgactatggtttgtcacgggattgtgtaaataaaa

SEQ ID NO: 839 - DNA, 602 bp, Glycine max
  Predicted polypeptide sequence is orthologous to G504
aagttggctcgagcgtttctcaacatttcgtccgaactaatataacatgttcttccgtggaagaagccatagccataacataactaccacttgaaaacaaaacccaccaccaccttagttaaaaaaaaaaaaaggttagataaaaattaagctttgttcggtggtgaccatggaaagcaccgactcatcaagcggttcacaacaaccgaacctgccacctgggtttcggttccaccccactgatgaagagcttgtagttcactacctcaagaaaaaagcagcttctgctcctcttccggtagccatcatcgccgaggttgatctctacaagttcgatccatgggagctacccgctaaggccgcgtttggggagcaggagtggtatttctttactccgagggacaggaagtatccgaacggcgcgaggccaaacagggcggcgacatctgggtattggaaggctactgggactgataagcctgtgttgacctctggtgggacccataaggttggggtgtagaaggctttggttttctatggagggaagcccccaagagggatcaaaaccaattggatcatgcatgaatataggctaactgata

SEQ ID NO: 840 - DNA, 1637 bp, Glycine max
  Predicted polypeptide sequence is orthologous to G504
ccacgcgtcctcatatccctcaaggtttggcttgtgcctttgtgtgctcatttttcactaaacaccaacccaaaccttatacacaaacattcttaattttgatatttttgtttatatattctaggtttttgttaattaattatattaagcatcatgggaaccccacaatccaataacttgccaccagggtttaggttccaccctacagatgaagagctcattcttcactacctaaggaagaaggttgcctccattcctttgccagttgccatcattgctgaggttgatatctacaagtttgatccatgggagctaccagctaaggccgcgtttggggagaaagagtggtacttcttcagtcctagagaccggaagtacccaaatggagcgaggccaaacagggcagcagcttcagggtattggaaggccacaggcactgataagaacatagtggcatcactggcaggaggagtgagggagcactttggtgtgaagaaggctttggtgttctacaaaggaaaacccccaaagggtgtcaaaaccaattggatcatgcatgaatatcgccttgttgacaccaatagacccattaggatcaaagacacctccatgaggttggatgactgggttctatgccggatatacaagaagttcaagcatgctgtatctccaaccacagaggcagcatcaacactgcaagtgatcaatgagcaattagatcaagcagtggtagaagaagaggagcaaatcaaagacacccttttaccaattttgaagaataacaacacttttgtccctcctccacaagccacaatactcatgtctcagaaatccttatccttctcaaatctcttggatgccacagactactccatgcttagcaccatcttatctgagaaccactccaataattaccctactccaagtgaaaccagcttattcaataattgtgagaatctggatcaggaaattaccccccaaaactactacatcaacgatactaatagtattaataataatagctacttgtttcagaagaacccttccaacatggaaaacattgctaggccaaaacgccaccttccaaacatggatcatgaggacaacatgttattataccctttaaagaaatatcatagttcctcttgcaatttccccaacaccaacctccaaaaccagaatccacaatggaacttcatgttcaagcagccactcatgagtcctcaatatcttcaatttcagtgataaatagcaaacaattatacgagtcacataaagaaaagaagaaaaaaaggttagggagaaaataaaaatgaaaaaaaaaggtgaaatatctacaagatgaatgtgctacatggtatccacatcaacctgttcactacgtaaggattagcacacagaaagatagcattttttttctttttcttttatgttgaaaaatgatgaaaagagacttcattggatcatgaactattacggaatcacagaaaaatcgtgtacaaataaaaatgttaatttgtacgtgttgggttgggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggcggccgc

SEQ ID NO: 841 - DNA, 1465 bp, Glycine max
  Predicted polypeptide sequence is orthologous to G504
gaattcggctcggggccaaattggtattatcgcacttattgattcccttggtctctccttttgtcaagaacaaagtattttctttgatggagggagatcaacatggctctaattactcttttccacctggctttagattccacccttccgatgaagaactcatagttcattacttggaaaacaaagtcagttcacgtccacttccagcttgcattattgctgaaattgatctctataagtataacccgtgggagctaccgaataagtccttgtttggagaggaagaatggtatttctttagcccgagagacaggaagtacccgaatggattgaggccaaacagggctgcagcctcaggatactggaaggcaactggaactgacaagccaattctttcttcttgcggatcgaggcgcataggtgtgaagaaagctctggtgttttattcaggtcgacctcctaagggtgctaagacagattggatcatgaatgagtataggttggttgacacaaccatcaaatcctcaaggctaaaaggctccatgagattggatgactgggtactatgccgggttcgatataaaggctactctcagaagaattcatgtgaaaatcaagagagtcctagtgaactaaacttgtcagcaaaactactgaggagtgaagaaaacccaacaaaaatgaactgtcgggctgacatgatccctgattatcaatataaagactatcaaatcatagcctctattcttgttggtggacctattcctcccattgaaagcatgccaaatctgagctttaagggttgcaaaggcaacaatgtagtttcagattatgaagatggtttcactaaagggaattctcaaacgacaattccttcattggaaagttacttcaacccactgacaagaaaatccaatgaagatgaacagtatggaaatctcatttctttcaacaggaagttcaacactgataacagaatggacggatctactagcaaagtgttgaacagtagagaattgaattgctacaaccaaaaccattctcaagatgacattttcaatgggaacccaccagatcctaccatcaattttcaagagctaaacgaattagacttttcaggaaggtaccatcagtgatgaaggtatttattataagacagtcaacgtccctttacttcacaggtagattttcatggattatacaacttaagacgtaggagaaacctgaaggataatgggccctattccggcgaattattgctgtatttctttatgcatagtcaacatggggcaatagctacatatagaagtttccatgcattcatgaaattccttgtaaacaatgccccggccaactagcttcttgagcgtgccctgtgtcagttcaactagaactttatcctacctagtaattataacgtgtaaatacaatttgtattcgggcggccgccaacttacaggagtta

SEQ ID NO: 842 - DNA, 1503 bp, Glycine max
  Predicted polypeptide sequence is orthologous to G504
gagcggccgcttttttttttttttttttttttttttttttctagttggttttatatggctcataaaactcggggtaaattaacttataatataaacctacaatagccgctacattattatccaacccagtatataccctaagccaaattaaccaccctaagtattccaattcatgcttggaagttgaaactgttgcctcaatactccattaccaatagggccaagaagcgcatttgggtgaaacgatgttgtgttctgtgaaaggtggctaagcagagaaacgaaggaattgtcttcctcaacagtgctgcttccagcataattaagatcacagtggaatctcctgcttgaagaggatgaccctgtgtcattccaaaagtactgtgacgaaagttctcttttcatagggaagtttccctttgaagacacttgttgggaatcagaaacatcatgctacatgctctgatgatcaactcctaagattccatcaaataagttatcatcattttctactccaaggggcccataacttgtgctaatagaagacgtgggtttggaatcctgagaggtgttattattagccattgacaaagtggacctcattggtagcatagaaagctccttattctgctccaccaaaggtaaccttggcaggttggtactgttgcttttcttgtatattcggcacaaaacccaatcatcaagcctcaaggaatttttcttgcaactctgtgcatgatctgaagccatagaaggtggttttgagctagaatttgagttgctatctgcaagcctgtactcgtgcatgatccaattggttttaaccccttttggaggctttccaccatagaaaacaagtgatttcttgactccaactttgtggtggtggccatgagatgcaagtatgggcttgtcagttccggttgctttccaatacccagaagaagcagctctgttaggccttgacccatttgggtatttcctatcccttgggctgaaaaagtaccactcttgatcaccaaaagttgctttacttgggagttcccatgggtcgaacttgtagagatcaacctcggcgatgatggaaccaggaagaggaacagagtctgcttttctcttgaggtagtgaaccactagttcctcatctgtggggtagaatcgaaaacccggtgggagttgtgggtgctgagataactgagatcctgaagatgatgaatccatgctgtacacgatcgatgatgataaagagtcttcaaccccctccttcaattctcatgcatacaatattatgtacaactttttgtgcctggcttttttctgtagattctcttgtttctttgctctatctttctttttattatgggtggatgaagattaggcactatgattgaatcatttcaatcgaaataaagttgagaggaggaaaggatgatcgcatgacaaggatttgaattctgtccccttctgtcgtcttctcgcagccgtacggacgcgtgggtcgac

SEQ ID NO: 843 - DNA, 1457 bp, Glycine max
  Predicted polypeptide sequence is orthologous to G504
ccgcggatacagaacagcagtattatatcgtattcagtttaatataagcttcaaaaaaaaaaactcacaaaaatacaagcgtacggtcatgatctctctctctctctagtatgttatgtatatatggctaataaaacccaagttaaattaacttataatataaacctacaatggcagctacattatccaacccttacccggtatatataccctaagccaaattaaccaccctaagtattccaattcatgcttggaagttgaaactgttgcctcaatacaccattaccaacagggccaagaagcgcatttgggtgaaacgttgttgtgttctgtgggaggtggctaagcagagaaacgaaggaattgtcttcctcaacagtagtgctgtttccagcataattaagatcgtaatggacccgtctgtcgtcttctcgcagccctgtgccattccaaaactgtgacgaaagttcccttttcatagggaagtttccctttgaagacacttgttgggaatgatcagaaacatcttgctgcatgctctgatgatcaactccaaagattccatcaaagaaattatcatcattttctactccaaggggtccataacttgtgcttctagaagacgcagttttggaatcctgaggagtgttgttatcattagccattgacaaagttgacatcattggtagcatagaaatctccctagaaatctccttattctgctccatcaaaggtaaccttggcaggtgggtactgttgcttttcttgtatattcggcacaaaacccaatcatcaagcctcaaggagtttttcttgccactgtgtgcatgatctgaagccgaagaaggaggttttgagctagagtttgaggagctatcagcaagcctgtactcgtgcatgatccaattggttttaacaccttttggaggctttccaccatagaaaacaagtgatttcttgactccaactttgttgtggtgaccatgagatgcaagtatgggcttgtcagttccggttgctttccaatacccagaagtagcagctctgttaggccttgtcccatttgggtatttcctatcccttgggctgaaaaagtaccattcttgatcaccaaaagttgctttacttgggagttcccatgggtcaaacttgtagagatcaacctcggcgatgatggaaacaggaagaggaacagagtctgcttttttcttgaggtactgaaccactagctcttcatctgtggggtggaatcgaaaccctggagggagttgtgggtgctgagaaaactgagatccagaagatgatgaatccatgctatacatgacgatgatatgatgatgatgataatgagtcttcacctctctccttcaattctcatgcatacaataacacaactttttgagcctggctttttctttctttagattctcttatctcgagccgattcggctcgagta

SEQ ID NO: 844 - DNA, 1876 bp, Glycine max
  Predicted polypeptide sequence is orthologous to G504
gaaacattggaggtgtttgtaggagatcatttaattaatttccatctctctcagacagtcacatttccgctccagggccttcaccttgactttggatgggtaagctacatatcatacatagcgaagatgtgtgttgttctcttcttcttgtgtgaagccaaagccacaacaacaaccattggaacaacccaacaacatagtgaacaacaaccttggtaataataaccatggagagcaccgaagactcatccacgagttcacagcaacaaccgaacctgccacccgggtttcggttccaccccacagacgaggagctcgtggttcattacctcaagaagaaagtagattctgttcctctccctgtttcaatcatcgctgatgttgatctctacaagtttgatccatgggaattaccagccatggcatcgtttggggcggaagagtggtactttttcagcccgagagaaaggaagtacccgaatggcgcaaggccaaacagggctgcaacttcagggtattggaaggccacaggtacagataagcctatatgtagtggaactcaaaaggttggggtgaagaaatctttggttttctatggagggaagccaccaaaaggggtcaaaactgattggatcatgcatgagtaccgtgttgctgaaaacaagcctaacaataggcctcctgggtgtgacttgggccacaagaaaaactccctaaggctggatgattgggtgttgtgccggatctacaagaagggtaacacacaaaggtcacatgagagggatgattccatggacgacatgattggagaagtacctccttccatcaacgtgggccacatgagtgcgaggtttcacctttcaaagatgtccacgagctacagtggtgcattgttggaaaatgacagaaacacgttagaaggggtggttataggcaatggtagtgtcaatgggatcagcaatactaataatattacaagtgtcatatcatcatctcaccggtttggcacctccagactccaaggcagagcttcttccttttgtccctccaaacaacacttctatttcggcctccaaaagaacactctcatcactctattggaatgttgatgatcacaaacacttcaatttggacagtaatgggaatgtgagtgttttgaggacagatcaagagaataataataataatagtggtgcttctggctcctttgctactctgcttaaccagcttccacaaacaccttcattgccccaaatagatgggttacttcggacaccgtatcaaatacaagggaccaattggtatggttaattccattttgaggggtatgcttgatatgataatttcataattataatgcacaaggagatcaaattgaactaaggtgtggcaagggatcctcaacttgtgctagattgcaaggattttaaaagggtcattgagattgtggtttaattgttaggagaatggaagaatgttagagcacactaatcaatgttttctttcaaccatttgcaggtagctaagggcaattaataccacatgaggtgagggtgtaagaccttggaacttttagtttaattattatatagatcggtatagtaacatagataaagatagatatatagaagcatatttgcttgttttattagtgtgtaaagaaacaaaatgagggtaaaaactttcgagagaggataaaagaaagagttagccacagttctatatatatatactttgctttatgatacagaatgaagagtatgggcggccgccgtcagaacgatataaattgatgcaagattttaaaatatgtatattgattgtatttatggtttgtctatctataacttgttcatgaagagcttgatattaatct

SEQ ID NO: 845 - DNA, 1807 bp, Oryza sativa
  Predicted polypeptide sequence is orthologous to G504
tttgttttttttgtgtggctgccattaaagaatcacttattgattgatttacatgaatatgagctataaatccggctttatgatcttgacatcattctccttgatctcatgttccagacttctagtgggtctatctcaaagtcttatcaacccctatctagcttaattaatctttagtactgagctagcttgagtacacagtagtatagtaccatgagaaaaaatgtatacacaccacaaactatatagctatgcatgatcggacgacctagctagtccacacaagtacaaattaagtacaatttctttcccaatatatttactatttaaatctatcgttttggacctatttgctttcgaaatagacctcactgttcaaatcatcaattcgccatgtgcaattatgttcagtgtttaatcaggctgtggtattatgtacgaagaacgagctatcagttcatccccatgttagagtggagcagcatctggtggctcagtcccagtgacgatccctgcaaggcgctgcctatttggaaagttgcaccaacgcatgaaccgttcggcttcttgcccgccgcggcagcaggaggcagcgcctggatcgtcggctcgcctccgtccgatgatctcttgcgcttcccggtgacggccggcggctcgacgacggcgcctgccgacgtcgaggcggccgcagaggaggacgggtccaggtgcgcgagctgaaccatgctgttgttcgcgatgaaatggttcatgacggggtggccaaagagggcgtgttgttgttgttggtggtggtggtggtcgggctgcctcgccatctcctgcaggggggcggcggcggcggcgccgccgtcgtcgaagagctgcgacagcgagtactcgttgagcaggtcggaaatggaagggatcttctgcatcgccgtcctctgcgtagcggcggcggcggcggcgtgcagcgacgggaaggcgccggcggcagcgccctgcaagatcatggatgcggcgctcgacgacgacggcgcgtacagcggcgcgttctcctccagggcgcacggctcgtcctgctcgtggtcggagagcggcggcacggccagcggcgacgcgtggctgctcttcttgtagatccggcacagcacccagtcatccagcctcacgcgggccgtgccctgcttcatggggcggtaggtgttggcggcgtgggcgtctgcggcggcgaggcggtactcgtgcatgatccagttggtcttggtgcccttgggcgggcggcccttgtagaagacgagcgccttcttgacgccgacgctctcgttggtcgccgcgccgccgctgctgtggatgggcttgtcggtgccggtggccttccagtagccggagcccgcggcgcggttcggccggatcccgttcgggtacttgcggtccctcgggctgaagaagtaccactccctggtccccgtaattcgccttggctgggaggtcccacggatcgaacttgtagatgtcgacgtcggcgatgatggagacggggcacggcgaggaggcggcccggttgcggaggtagtgcacgatcagctcctcgtccgtcgggtggaaccggaaccccggcggcagcatcgccgggttcgacagaaccatcgtctccggcagtcacccacacacaacacacacctccctgcacaagcaaaacctatctagctatagctgctcacttccaagatcaagccactcgatcccctctcagctatgatctatgagatctatcagggtcgagcttgtatcaagaggaggcgagagatggacctcgtgc

SEQ ID NO: 846 - DNA, 629 bp, Oryza sativa
  Predicted polypeptide sequence is orthologous to G504
cacgcgtccgccttagcttattagcttccttccttcactagtgccagttttcctcctacgtaatctaagctagccaggtcgtcatcttcttccttcagctcacgctgaccaaacaccatctgttattctgtttgtttgttttttttaaaaaaagaaaaaaaatctagctaggcgagccgattgaaggagctgagcatgccgagcagcggcggcgccatgcctgcccttccaccaggcttccgcttccaccccaccgacgaggagctcatcgttcactacctcatgaaccaggccgcctccatcaagtgccccgtgccaatcatcgccgaggtcaacatctacaagtgcaacccatgggaccttcctggtaaggcgctgttcggcgagaacgaatggtacttcttcagcccgagggaccgcaagtaccccaacggcgctcgccccaaccgcgccgccggctcggggtactggaaggccaccggcaccgacaaggccatcctctccactccgaccagcgacaacatcggcgtcaagaaggccctagtcttctacaagggcaagccccccaagggcgtcaagaccgactggatcatgcacgagtatcgcctcacaggcacatcagctaacaa

SEQ ID NO: 847 - DNA, 1195 bp, Zea mays
  Predicted polypeptide sequence is orthologous to G504
ccggcgtcgtagtactacgcggtgatgaggtccatggtgagcacggactcgtcgtccggtgagctaccgccgcagaagcagccgagctcggcgccggatctcccgccgggcttccggttccatcccacggacgaggagctggtcgtccactacctcaagaagaaggccgcgtccgtgccactccccgtcgccatcatcgcggaggtcgacctctacaagttcgatccgtgggagctacctgataaggcgacattcggcgagcaggagtggtacttcttcagcccgagggaccgcaagtaccccaacggagcgcggccgaacagggcggacgacgtccggctactggaaggcgactggcacagacaagcccatcatggcgtccggcggcaaccgcgagaaggtcggcgtcaagaaggctctcgtgttctaccgcgggaagccgccaaagggcctcaagaccaactggatcatgcacgagtaccgcctcgcggatgcggcgagctcaaccaccagccggccgccgccgccttgcaacgccggaggcaaggccacgtctctcaggctcgacgactgggtgttatgccgcatctacaagaagatcgacaaacttggagtcggcgatccgccgcggatcatggagtgcggcgaggactccgtggagaatgcggtggcagcctacccgacgcatgccgcggctgctgccatgggccgtcgcagtcgcaggcggaaggaggggcttaccataccggcaattacacttcgctgatccaccaccatcacgaggacagcttcctggtggatgggctgctcacagcagaggacgcgggcggcagctccctgagccagctagccgcggcagccagggcagctgctccaacagacaccaccaagcagctcctcgtcccgtcctccaccaccccgttcaactggctcgacgcgtcggcactcacgattcttccgccggcaaagaggttccatgggtacaacagagacaccactgacggcggcggcacgtccctcccgtcgccgtccgagaggaataacctgcaggcggctgtcggcgccgtcgatagtggcgccagcggtggcactagtgccgtcattccatcattcctcaatccgctcggcgtgcaaggtgcgacaacctatcaccaccacgccattttcggcacaccggtgacgccggaagccgcca

SEQ ID NO: 848 - DNA, 1447 bp, Zea mays
  Predicted polypeptide sequence is orthologous to G504
gtcgacccacgcgtcccgtttctcctggctactacctctcgctccctccggctccgatccagggtgcgagctgagcttgggctagtttagtctccccaagctcgtggcgcagcagcagactcgttggtggaggtggattagtagccaaggctttgcagctaggtagggttttgtagctagttcctcgcaggctcagctctctcatactagctagcgtcggtcagtcgggcgagcaggccaatggtcatggcgaacccggacatgctgccgccggggttccgtttccacccgacggacgaggagctgatcctccactacctccgcaaccgcgccgccaacgcgccgtgcccggtcgccatcatccccgacgtcgacatctacaagttcgatccatgggacctgccatccagggctgcgtacggggacaaggagtggtacttcttcagcccccgcgaccgcaagtacccgaacgggatccggccgaaccgcgccgcggggtccggctactggaaggccaccgggaccgacaagcccatccacagcagcaccaccgccggcgagagcgtcggcgtcaagaaggcgctcgtcttctacgagggccgcccgcccaagggcaccaagaccaactggatcatgcacgagtaccgcctcgccgccgacgcgcaggcagcgcacgcctaccgccccatgaagttccgcaacgcctccatgaggctggacgactgggtgctgtgccggatctacaagaaggccagctgccaggtgccggcgatggcggcggtgccgcagctctccgaccacgaccaggacgagcactgcggcttcgacgacaacccgtacgccgccatgctcctgcagggcgcgtcgtactcgtacccggcgccgccgcatgccgcggccggcgcgcagaggatgccccggatcccgtccctcacggagctgttcaacgacccctcgctggcgcacttcttcgaggagggcggcggcatgcaggacatggcgcggctcagcaacccgcagcagcagcagcagcagcagcacgctcctctcctcgcccgccccgtcacgagccaacagctgctgctcaacaacggccacagcatgcccggcggggggcaggcgcagatggatcctcatccgcctgctgctgccgcctcgacgtcgtcggccgccgctggtaacaacaagcgcaagagatcgagccctactactgatgccggtgcgctgtcgtcgagccaggcgtctgaggccaagaaaccgaacgggtcctgtttcggcgcaacgttccaaataggcaacggactgcaggggccctccctgggccaccaccacatgccgcttcactctaacatgggcacgatgaactgacagattattgctgttgttctccgctgaaagctatacttgagagcaaaaaaaaaaaaaaaaaaaaaaaaagggcggccgc

SEQ ID NO: 849 - DNA, 1885 bp, Zea mays
  Predicted polypeptide sequence is orthologous to G504
ccggccgggaaaaaaaaagaattcccgggtccagttcagcagccagtcagtcagtcctcgatctgatatcctctcctccctgcagcgactccagctccgatcgattccattccatccatcgagctgcagcagggccatgacgatggcagctacgacgacgatgatgtcagcagcagcgcaggcggcgacgtcgcagctgccgccggggttccggttccacccgacggacgaggagctcatcctgcactacctccgcaaccgcgccgcgtcggcgccgtgccccgtgcccatcatcgccgacgtcgacatctacaagttcgacccatgggacctgccggccaaggcgctgtacggcgacggcgagtactacttcttcagcccgcgggaccgcaagtaccccaacggcatccgccccaaccgcgccgccggctccggctactggaaggccaccggcaccgacaagcccatccacgacgccgccaccggcgagggcgtcggcgtcaagaaggcgctcgtcttctacaagggccgcccgcccaggggctccaagaccaactggatcatgcacgagtaccgcctcgccgccgtcgccggctgcaccagccccctcgccgcctaccgcccgccctccaagttcaggaacgtctccatgaggctggacgactgggtgctgtgccggatctacaagaagtccggccacgcgtcgccgatggtgccgccgctcgccgactacgagcacctcgaccgcgacggaccttctcccggcggcttcttcgacgactacttctgcggcagcaccagcttgtacgccgccgccgcgccggccatcggcggcggtgctgctgctgctggtactacaaacactactacgacgccggccgtcgtcatgcagcagcaccagcagccggcggcgctgccgaggctccccaagatcccctccatctccgagctgctgtgggacgagtacgcgctcgcgcagatcttggaccccccggccgacgtggccgccgaccacgcctcgttcgccgtgcacccgtccctcaaccagctcctggccgtcggcgacgacggctccgatctcatgatgttctcgccgcccccggccgccgcagcaggcgggaagcgcaaggcgatggtggcgatgaacatgagcccagctgacgagtgcgccgccactgcccaccagcaccagtctccggcggccaagcggctcaacggtggctcctgcttcgacgacgcgccgcagccggccagcggcttgccggcgacgatgtcgtccgtgcttggcggcggcctcaaccaccacatgctcccacagttctagatagacgacttctggtagctgactttgttgggggcacatcttccgtgcatgtactgcgtcatcaactgatcaatatggtggatcgtctacgcggaatagctagcaacctgcggcgacatggaaagcaaggatcgagctcgtggattggaggccattaataaagatgggtcgtgcggtgaagaacaattgtagcagtacgtagcactatttgtactggagccagtgttgatcaacgttaggcgtaaccatggtatgtatcccatttttttccctccgttgtagagtacaggtactctatattcatttcaggcgcagtgcgaaggtagctggagcttgatgggtccatgtactactacactagtactcttatttattattcaatatgaagtatatattatattgtcttgctagataaaaaaaaaaaaaaaacagcggccttttaattccagatatatagacagattattaagtaaaaaaaaaaaaaaaaaaaaaaaaaaaaaaaaaaaaaaaaaaaaaaaaaaaaaaaaaaaaaaaaaaaaaaaaaaaaaaaagggcggccgc

SEQ ID NO: 850 - DNA, 749 bp, Zea mays
  Predicted polypeptide sequence is orthologous to G504
ttgggtaccctgggccgccggaaaatttaatggcctctctagatcttttaagctagctatccttgcttcctcccttcactttcttattgagagctctctggcgtgctgtaccggacgacaggggttggtaggtcgtaggtgtagctagctcggcgagcgagcaatccggccaacagcacacgcgtcgatcgccatgccgagcggcggcggcaatggcggtggcagtagtcgtagtagagtgatgcccaacctcccggccgggttccgcttccaccccacggacgaggagctcatggtgcactacctcatgaggcaggccgcctccatgccgtgccccgtccccatcatcgccgaggtcaacatctaccagtgcaacccctgggatctccctgccaaggcattgttcggcgacaaggagtggtttttcttcagcccccgggaccgcaagtaccccaacggcgcccgccccaaccgcgccgccgggtccgggtactggaaggccaccggcaccgacaaggccatcctgtcgtcgtcgtccacgcccacgatccaaaacgtcgtcgtcggcgtcaagaaggcgctcgtcttctacggcggcaggccgcccaagggcaccaagacggactggatcatgcacgagtaccgcctctcgggcgcggcggacgacgactgcaagggcagcagcaccaggcgcagagtgtcctcctcttcctcgtcctccatgaggctggacgactgggtgctgtgca

SEQ ID NO: 851 - protein, 346 aa, Oryza sativa
  Orthologous to G504
MEMTMSSAATSLPPGFRFHPTDEELILHYLRSRATAGQCPVPIIADVDIYKFDPWDLPSKAVYGESEWYFFSPRDRKYPNGIRPNRAAGSGYWKATGTDKPIHDSATGESVGVKKALVFYRGRPPKGTKTSWIMHEYRLAADPLAAAANTYKPSSSSRFRNVSMRLDDWVLCRIYKKSGQASPMMPPLAADYDHDEPSGVLDDAYSFYAPPMISTTLIPKLPKIPSISELFDEHALAQIFDAAADPPADHHQHALAVHPSLNQLLGVGDNFLAECYPSTASTATVAGGKRKASPAGDYAGGGHTPAKRLNGSCFDVAPQSVVGGLQATPSSVLAGLNHQMLPPQLF

SEQ ID NO: 852 - protein, 310 aa, Oryza sativa
  Orthologous to G504
MAMQLSLPVLPTGFRFHPTDEELVINYLQRRATGLSCPIPIIADVEIYNFNPWELPSMALFGEHEWYFFTLRDHRYPNSVRPSRSAASGFWKATGTDKPVQVANMQSTPVAMKKALVFYVGRPPMETKTTWIMHEYRLTNTGGSTASHPSLSSSTAHPSVKLDEWVLCKIFNKSPEPDNTAPPSNVVSRLQCSPPLPPPAAPPGNYPPLPVGATNDGGVFAGAGDMLFTIQEHQEGTPSMLPPIPNLEPPAATIGNSSLNGTAAAAAAADGHGRLEEEDTSAYTFTDQEMEQMLMDLMDQDFFGNDQPQE

SEQ ID NO: 853 - protein, 316 aa, Oryza sativa
  Orthologous to G504
MAAAVGGSGRRDAEAELNLPPGFRFHPTDEELVVHYLCRKVARQPLPVPIIAEVDLYKLDPWDLPEKALFGRKEWYFFTPRDRKYPNGSRPNRAAGRGYWKATGADKPVAPKGSARTVGIKKALVFYSGKAPRGVKTDWIMHEYRLADADRAPGGKKGSQKLDEWVLCRLYNKKNNWEKVKLEQQDVASVAAAAPRNHHHQNGEVMDAAAADTMSDSFQTHDSDIDNASAGLRHGGCGGGGFGDVAPPRNGFVTVKEDNDWFTGLNFDELQPPYMMNLQHMQMQMVNPAAPGHDGGYLQSISSPQMKMWQTILPPF

SEQ ID NO: 854 - protein, 425 aa, Oryza sativa
  Orthologous to G504
MESPDSSSGSAPPRVLRRQQQQPGSAPELPPGFRFHPTDEELVVHYLKKKAASVPLPVTIIAEVDLYKFDPWDLPEKANFGEQEWYFFSPRDRKYPNGARPNRAATSGYWKATGTDKPIMSSGSTREKVGVKKALVFYRGKPPKGVKTNWIMHEYRLTDTSSSAAAVATTRRPPPPITGGSKGAVSLRLDDWVLCRIYKKTNKAGAGQRSMECEDSVEDAVAAYAPSSQQHATAAAGMAGSDGAGGVAAAHGGDYSSLLHHDSHEDTFLVNGLLTAEDAAGLSTGASSLSQLAAAARAAATPCDATKQLLAPSPTPFNWFEAFLPRAKEFPSGLSRSSRDIGDMSLSSTVDRSLSEAGAVAIDTGDAANGANTMPAFINPLGVQGATYQQHQAIMGASLPSESAAAAAACNFQHPFQLSRVNWDS

SEQ ID NO: 855 - DNA, 648 bp, Lycopersicon esculentum
  Predicted polypeptide sequence is orthologous to G509
taccgattcatcaaccggctctcatcatcaaccacaattgccacctggatttcgatttcatccaactgatgaagagcttgtggttcattatcttaagaaaagagttgcctctgttcctcttcctgtttctattattgctgaagttgatctttacaaatttgatccttgggaactacctgctaaggcgacatttggagaacaagaatggtatttcttcagtccaagagatagaaaatatcctaacggggcgcgcccaaatagggcggcaacttccggttattggaaggctaccggaaccgacaagccggtgctcaccgccggcgggacccaaaaagtaggtgtcaaaaaggcattggtgttttatggtggcaaaccacccaaaggggtgaagacaaattggattatgcatgaatataggcttgctgataataaaacaaataataagccccctggttgtgaccttgccaataaaaaatcactaaggctagatgattgggttttatgtaggatttacaagaagaataatactcaaaggccaattgatcatgaaagagatgatttgaatattgatatgatgatgggatcatcatcaattcatccatcatgtataccaaattcaatgtcaatgccaaatatatttggtcaacc

SEQ ID NO: 856 - DNA, 1149 bp, Glycine max
  Predicted polypeptide sequence is orthologous to G509
cataacaagaccacactattattattatcaagctcgaagaatctcattccatccaagtttgatgccacgccatcattgaagctattttcttcgaggtccatgtcccataagaacccatatccattattatcatcacatttgggactaatttgagtaacggtgctagagttgttggtgtttgtttccctagagaactgaaggagacccatcaaggagttgttgttgttgttttggctttggtttggaatatgatgattgtgattgtgatgatgggttgccattgaggaagagaatggggcaagaaattggttatacccaattgatggtgtggtgttttggttggttggagatgacgaagccaaagttagggatggaactgtgctctcgtacatgatgagtttggcactgttgtctgctttgcccttgtgaaacactctacacaaaacccagtcctccttaggtggcaaatgtggcgtctccaagcgaaactcatgcatgatccaacccgttttgatgccatttggagccctgttcctgtagaacaccaatgtcttcctcatccctacaacctcacgcgtggcagggtcaaacaccgtacgatccttccccgttgctttccagtagccagatgtcgtcgcgcgattggttcgaaagccggttgcatatttacggtcacggaagctgaagaagtaccattcgtttgcattgagcttagccacctctgggagttgccatggctcgcacgtgtgcaagtcaatttccatcaaggtacccttcagaacttcctcattagtgatctttttgtaaaggtaatgaaggaccaactcctcatcactcgggtaaaaccgaaaccctgggggcagtgaagcaccaatgtctctaagacccatgaatttgctgattttgaaagcagagggaaaggtttgcaatatagttagagagagaaagagagagggaaatctaattaattgagatctttttgaaattttagatatggatagagaggtttaattagagggagatatatatggtagaggtggatttagaaatgtgaaaaaatcaatataattgaagctaggattgagaggttactctctgctggggatatttgaaatattaaggtatccccttctgtcgtcttctcgcagc

SEQ ID NO: 857 - DNA, 1109 bp, Glycine max
  Predicted polypeptide sequence is orthologous to G509
gaattcccgggtcgacccacgcgtccgtgcatgcgcaataatattaatgcacgcagaggtggctaagctcaatgcgaatgagtggtacttcttcagtttccgggaccgcaaatatgctactgggtttcggaccaaccgggcaactacatcagggtattggaaagctacggggaaggatcgtaaggtggaggatccagccacgcaagaggttgtagggatgaggaaaacactggtgttctacaggaacagagctccaaatggcatcaaaacgggatggatcatgcatgagttccgcttggagaccccacatatgcctccaaaggaggactgggtgttgtgtagagtcttccacaaaagcaaagaagatgacaacagttccaaactcctacagtatgagacgacaccatcatccctaactttgttggcttcgtcatctcccaccaaccaagccatgcctcatggtgttgggtataataaccgacttgccacctctttctctaattcattcatgccaacccaccaatatcatcatcacttcaaccctacccaaaacgctaattctttgatggatctccttcacttctctcgcgaaaccaacaccaacaatactggctttcttactcaaattggtgccaaaggtgatgacgaatatggtttcttatgggacatggatctagaagaaaatagcctagatgatggcgtggcttcaaacttggacgcaataagattcgaggttgataataataatactaatacccccaatatggtattgctataattaaatgtgtaagatgtgttatgtgtgtacatatatacacatatatgttattcatagctcgtaaattgtcgtaagattcgtttatttgtggtgtatttatggtgcttcgctatgaggggcatgtcacatgatagattgggtttagttgttacaagtttgtgtggtatattgttcaagtagtagggtaatactattgtggtccattaggcttttcgtaatcaattactattatttacccattattattgggaactattcctttgtatacagtttgtgtatgtaattagtattggctaaaaaaaaaaaaaaaaaaaaaaaaaagggcggccgc

SEQ ID NO: 858 - DNA, 611 bp, Glycine max
  Predicted polypeptide sequence is orthologous to G509
  misc_feature (122)..(122): n is a, c, g, or t
  misc_feature (124)..(125): n is a, c, g, or t
  misc_feature (177)..(177): n is a, c, g, or t
  misc_feature (183)..(183): n is a, c, g, or t
  misc_feature (189)..(189): n is a, c, g, or t
  misc_feature (201)..(201): n is a, c, g, or t
  misc_feature (208)..(208): n is a, c, g, or t
  misc_feature (210)..(210): n is a, c, g, or t
  misc_feature (213)..(214): n is a, c, g, or t
  misc_feature (219)..(220): n is a, c, g, or t
  misc_feature (224)..(224): n is a, c, g, or t
  misc_feature (228)..(228): n is a, c, g, or t
cccacgcgtccgctgaagggtaccttgatggaaattgacttgcacacgtgcgagccatggcaactcccagaggtggctaagctcaatgcaaacgaatggtacttcttcagcttccgtgaccntnnatatgcaaccggctttcgaaccaatcgcgcgacgacatctggctactggaanagcacnacgggngtaaaagggganaattttncnggnntttanncggngggnttttggttttttgaccctgccacgcgtgaggttgtagggatgaggaagacattggtgttctacaggaacagggctccaaatggcatcaaaacgggttggatcatgcatgagtttcgcttggagacgccacatttgccacctaaggaggactgggttttgcgtagagtgtttcacaagggcaaagcagacaacagtgccaaactcatcatgtacgagagcacagttccatccctaactttggcttcgtcatctccaaccaaccaaaacaccacaccatcaattgggtataaccaatttcttgccccattctctttctcaatggcaacccatcatcacaatcacaatcatcatattccaaaccaaagccaaaacaacaacaacaa

SEQ ID NO: 859 - DNA, 1002 bp, Oryza sativa
  Predicted polypeptide sequence is orthologous to G509
cgcgcacgcgtcctctcccgcgtcctccgcctcctcccgcgcgctgcgtacgtgagagcgccatctcctgcttgcagcagctagcaagcagcaggcgcaacagtattactgcagatagagctctcgaccgattgatcgattgctcactgccatatacatgatacttacataccgacgtactacacacagagatagagatcggagggatagctattgctattgctagccatagtatagtagttccctttgctcctgctgctgctttgttgcttgcttccctacacttctctctctcagctgctagctgcgcatataattattccctcgccaagctatatatatttgcctcctgccttcttcccgagctcacacaatcgccaacctatacagatatatgtgctagctacttccaagttcctacctatcaatttctctcctcctcttcttctctgcatcaatctgcagcttaattcttagctatgtacatatagctagctaccacttccaaaatactccacaggcaccaggcacatatagatatagctagattgctatagacagagagatcatcaaagaaatttagcaggtgatagccacatggggttgagggacatcgagctgacgctgcctccggggttccggttctacccgagcgacgaggagcttgtctgccactaccttcataacaaggtggtgaaccagcatcgcttcgccggagttggaggaggagccgccgccgccgccgccgccgccggcggcggcaccatggtcgaggtggacctccacacccacgagccgtgggagctaccagatgtggcgaagctgagcacgaacgagtggtacttcttcagcttccgcgaccgcaagtacgcgacggggctccgcacgaaccgcgccaccaagtccggctactggaaggccaccggcaaggaccgcgtcatccacaaccccaagctgcacgccgccgcccaccgccgcgcctccatcgtcggcatgcgcaag

SEQ ID NO: 860 - DNA, 486 bp, Oryza sativa
  Predicted polypeptide sequence is orthologous to G509
cttattcatccaaatagtattggtagcttgttgatcgaagaattaatccatggatggattgatcagtgatgatagtatgatgatgggtggtgaggtgagggcgatcgagtcgaggctgcctccgggtttcaggttccatcccagcgacgaggagctagtcggctactaccttcggaacaagcagcagcagcagcagcagcagacggcggccacctccatgctcgtcgaggttgacctccatgcctgcgagccatgggacctaccagaggtggcgaaggttggttcggatgagtggtatttcttcagctggagggagaggaagtacgcgacggggtggcgcatgaacagagcgagcaagcaagggtactggaaggccaccgggaaagacaagcccatccttcatccgacggtggccggcgccaggaagacgttggttttctactccggtcgcgcccccaacggccgcaagaccgcctgggtcatgca

SEQ ID NO: 861 - DNA, 603 bp, Zea mays
  Predicted polypeptide sequence is orthologous to G509
aaaccatccggctacagcaagcaaccgtagcagtcgtagatgtgcagcgcgcgcagccaattccttcttactcccccgggccttccctctgtctctctcctcttctcttcagatcgacgtgctggttgcagagtgcaaactgcgtatataatatacagttcgttgttcttccagctccgcacataaagatagatagatatacagggaaaaagtgtagtagctggagcagaagctagctagcatggggctgcgggacatcgagctcacgctgccgccggggttccggttctaccccagcgacgaggagctggtgtgccactacctgcacggcaaggtggccaacgagcagctcgcaggcgccggcgcagccatgggtggaggtggatctgcacgcccacgagccgtgggagctccctgacgtggcgaagctgagcaccaacgactggtacttcttcagcttccgcgaccgcaagtacgcgacggggcagcgcgccaaccgcgccaccaggtcgggctactggaaggccaccggcaaggaccgcgccatccacgaccccaggtccgccatcgtcgtcggcatgcgcaagaccctcgtcttctacc

SEQ ID NO: 862 - DNA, 1439 bp, Zea mays
  Predicted polypeptide sequence is orthologous to G509
ccacgcgtccgcggacgcgtgggcggacgcgtgggcggacgcgtgggtttaagagtgtgtcccttggcttgggtccagcagccttcagaggcaaaccgtcggccgccttccagctgcggcaggctggctgcaagagagttcatcgatctagctagctagctagcgtgtgtttagggtacctagctagctagcttcaacatatatatcttagttgcacacacagctcaaaagaaaggaaccatcgatcgatcggcagggagggatggggctgagggagatcgagtccacattgccgccggggttcaggttctatcccagcgacgaggagctggtgtgccactacctctacaagaaggtggccaacgagcgcgccgcgcaggggacgctggtggaggtcgacctgcacgcgcgagagccatgggagcttccagacgcggccaagctgacggcgagcgagtggtacttcttcagcttccgggaccgcaagtacgccacggggtcgcgcaccaaccgcgccaccaagacggggtactggaaggccaccggcaaggaccgcgaggtgcgcagcccggccacccgcgccgtcgtcgccatgaggaagacgctcgtcttctaccagggacgcgcacccaacggcgtcaagtcctgctgggtcatgcacgagttccgcctcgactcgccgcatacgccaccaaaggaggactgggtgctctgcagggtgttccagaagcggaaagacagcgagcaagacaacggcggcggctcctcctcgccgacgacctttgccggcgcgtcgtcgcagggggtcgttctagatctgccggacgaccagcgcccagcatgacgatgcccggcgcgtacgtagcagtggaccaccaccagccaggctcttccgccgtcgggttcgcactgccgccgcatgcgcaggacaacggcctcggcgatggcggcctggacgcgttgctgatgaacggagcgaccatgtggcagtacagctcatcggccctcgccgaccacttcccgccggaggaagtgaccgccgcgcccatgatggggctaggctccaggggaggaggtgacgggtgcagcttcttctacgacagcggcttcgacggcatggggttcccgcagggatggatgggctgaggaggcaaggcaccaactacaacgccatgggatgatggattgtgaaggaaacgattgaattgattccattagtggtagtattgtacagtaggtacgtagtgtgaggttaggtaattggaaattattagagtgcacctccccaatccaaaaaaaaaaacacaacggaatgaaaagtagatcgagcgcatgacgacaattgtatgtatctattcactcttactactatgcttgtacattaattaattagtataaacgaatccaagtacgtaccccccccaaaaaaaaaaaaaaag

SEQ ID NO: 863 - DNA, 1350 bp, Zea mays
  Predicted polypeptide sequence is orthologous to G509
aaaaaaaaaaaaaaaaaaaaaaaaaaaaaaaaaaaaaaataaaaaaaaaaaccacacccccactttgtcccggcctcgcgtccggagagaatcatcgagtcggatagagtcctgggctccaggcgctgcgtactgaacgaagaggcgtgtctcttcgatcgacctccaggcttccagctagctagctagcgagcgatggcattgagggagatcgagtcgacgctgccaccggggttcaggttctacccgagcgacgaggagctggtgtgccactacctccacaagaaggtggccaacgagcgcatcgcgcaggggacgctcgtcgaggtggacctgcacgcccgcgagccgtgggagctcccagaggtggcgaagctgacggccaccgagtggtacttcttcagcttccgggaccgcaagtacgccacggggtcgcgcaccaaccgcgccaccaggacgggctactggaaggccacgggcaaggaccgcgaggtgcgcagcagcagcagcgccaccgccgccgtcgtcggcatgcgcaagacgctcgtcttctaccggggcagggcccccaacggcgtcaagtccggctgggtcatgcacgagttccgcctcgacaccccgcattcgccgccaagggaggactgggtgctgtgcagggtgttccagaagacgaaagccgccgacggcgacggcgatggcggcgcccaagacggcgactcctcgtccccgccggccgccttcaccggcccgtcacggccacgcgccgtgtcagagccgccggaccattccgcgccgccggcgggaggaggctactactacggcctcgcgttcgggccgcggcaggtggaggtggcgcagcagcagtgttacggcggcggcggcgccacggtcgccgaccaccaccacggcttcacgcgagacagcgggggcgctgcagggtttggcgcgacgtggggacgaggagtcgccggcggtgagtgcggggctggctacctcgacatggacggcgcctttgacgtcatgatggccggctgctttggcggtggagacatggatgagttccctcaagtgtggaggtgatcgattgggcaacgtcacggggttattaccatcctcttgaaagaggagaatacatattgttcttactggagacactgggtcagttaaatttattggttgtttaatacacatggggtttggctggtagattagaatgggtttgaaatgctgtgagctcgacaaggttcattgtgaacgtgaactatcaaatgtaaattaattgggaaatcctttcttttctatattatttagtgtatagagttaattgataaaaaaaaaaaaaaaaagggc

SEQ ID NO: 864 - DNA, 1371 bp, Zea mays
  Predicted polypeptide sequence is orthologous to G509
caagatacatcagagtagctcattgcatagtttcagtgtgtaattatatatttgtctcctctagtgcagtactagagtctagtctagctagtttagattgagtctgcttgttcatctagcgcgtgttttggggtagctagctagctagacacgcgcacccggacaaacgcacgcagcagacaccaagcaggaatcatcggcggcaggcggagggatggggctgagggagattgagtcgacattgccgccggggttcaggttctatcccagcgacgaggagctggtatgccattacctctacaggaaggtggccaacgagcgctccgtgcagggaacgctggtggaggtcgacctgcacgagcgcgaaccatgggagcttccagcttcagggaccgcaagtacgcgaccgggccgcgcacgaaccgcgccaccaagacgggctactggaaggccaccggcaaggaccgcgaggtgcgcgacccggccgcccgccccgtcgtcgtcggcatgcggaagacgctcgtcttctaccagggccgtgcccccagcggcgtcaagtcatgctgggtcatgcacgagttccgcctcgactcgccgcgtacgacgacgacgccaccgaaggaggactgggtgctgtgcagggtgttccagaagcggaaagtcgacggcagcgagcaagacaacggcgtctccccctcgccgccggtctttgccggcgcatcgcagtcgcagggggtcgtcctgccgccgggccagcccagcgtggtggacgcgtacgtcgtagtagaccagccgggctcttcttccgtcggactcgcgccgccgcaggagaacctcggtagcggcctggacgcgttgctgacgaacggagcgatgtggcagtacacctcgtcggtcttcggtcacttgttgccgcaggaggcgaccagctccccgccggtgatggacctaggctccaggggaggaggaggaggagactacgggtgcagcttcttctacgacagcagcttcgaggacatggccaacatcgggttccgacaagggtggatgggctgatccaggaccaggaagcacacgtacgtgcgtgcagacttgcagtcatgcgatatggaatgtgcatttgtgaaggaagtgattgaattgattccattagtagtagcaccctctagtgttgtacagtaggtacgtatagtgtgagattggattattgggaattgttagagtgcacgggcctctcaaatccaaagaagtaacagcggaaagaaaagctagtagctagagcacacatgtatatttgcacaaggtagatggtttgatcaaccgcatgacacggcaattgtattatctctccacccctactaccatgtttgt

SEQ ID NO: 865 - protein, 278 aa, Oryza sativa
  Orthologous to G509
MGLREIESTLPPGFRFYPSDEELVCHYLYKKVSNERASQGTLVEVDLHAREPWELPDVAKLTASEWYFFSFRDRKYATGSRTNRATKTGYWKATGKDREVRSPATRAVVGMRKTLVFYQGRAPNGVKSGWVMHEFRLDSPHSPPKEDWVLCRVFQKSKGDGEQDNPTSAASPAATFAGSSQAAVPGQAAYSSDDHTGSSMGFAPRQNEILDSSSHQLLNLAMLQCNSVLDHFPQEVNSSPMMGLAGSIGIGDEYGFFYDTGFEETASLGGMRFPQGWS

SEQ ID NO: 866 - protein, 331 aa, Oryza sativa
  Orthologous to G509
MGLRDIELTLPPGFRFYPSDEELVCHYLHNKVVNQHRFAGVGGAAAAGGGTMVEVDLHTHEPWELPDVAKLSTNEWYFFSFRDRKYATGLRTNRATKSGYWKATGKDRVIHNPKLHAAAHRRASIVGMRKTLVFYRGRAPNGVKTNWVMHEFRMENPHTPPKEDWVLCRVFYKKKAETETESSYSMENEQEAVIAMARSAAAIKAGGCYSNSSSSHDPAAAGHHSPPPFPASLAACSSSHHYSSHPPPPPDHHHHHHMPVTGGGGGSLNEFIPTTSMALYSSIFDFSQHLDGGAVAASASAAGSRVDGGEQCGLMELGLEEHYNYNGLMPM

SEQ ID NO: 867 - protein, 324 aa, Oryza sativa
  Orthologous to G509
MAGLREMESTLPPGFRFCPSDEELICFYLRNKVANHRVASGTLVDVDLHAREPWELPEVAKLTAEEWYFFSFRDRKYATGSRTNRATKTGYWKATGKDRIVHEGTTRAVVGMRKTLVFYLGRAPNGQKTTWVMHEFRLETPNSQPKEDWVLCRVFDKKKPSTIEAEGGGSSGSDLFIPGATDGSTDPSSPTTMAPLLGSSPDPTVVDRFDHRSAAVPPLMVLMQGGGDQMISGSGVHCSNNDNSGSSSALLNLTMLQYSFLEHRPTGDDMAVGAHFGTCQGGNNDATMALGMGFEEHGMGEIIEMEPAWRQGGSNCVYRDELYF

SEQ ID NO: 868 - DNA, 1478 bp, Glycine max
  Predicted polypeptide sequence is orthologous to G519
gcggcacgtgtggcggtatcggctataaataaaggggtctctcttatgttctaagtttgaagcggcgccaccatagttggtgtagctagcgagggagggatatagggggaagcgtttattcattcattaagatggcatcggagcttcaattgcccccaggcttcagattccatccaacggaccaggagctggtgttgcactatctctgccgtaaatgcgcatcgcagcctatcgccgttcccatcatcgccgaaatcgacctctacaaatacgacccctgggacctacccggattggcttcctacggagagaaagagtggtacttcttttcaccacgggaccggaaatacccgaacggttccaggccgaaccgggcggcgggaaccgggttactggaaggcaaccggggcggataagcccattggccaccccaaaccggttgggataaaaaaagctttggtgttttacgcagggaaagctccgaaaggggacaagagcaattggatcatgcacgagtatcgtctcgccgatgtagatcgctccgttcgcaaaaagaacagcctaaggttagatgattgggtgctttgccgtatttacaacaagaagggcacgatcgagaagttccaaccaagcagcgatgttgttgttagccgaaaaatggaatcatcggagatcgaagacaggaagccggagattctgaaaagcggaggaggttgtcttctgccgccggttccgccgccgcaagcgaaggcggcggtgaagacggattacatgtacttcgacccgtcggattcaatcccgaagctgcacacggactcgagctgttcggagcacgtggtatcgccggaattcgcgagcgaggtgcagagcgagccaaagtggaaggagtgggagaaaagcctcgagtttccgtttaattacgtggatgccactctgaacaacagcaacagcttcacgacgcaattccagggcaataatcagatgatgtcgccgctgcaggacatgttcatgtactggcccaacaagcccttctgaacaaaccgatccacgccgcccattcgcatttgcacggtagcacgagactcaaggtctatgagtgtgcctgtgcgaccacacacagacgattatttatcaagttagcttagctagggcaaagaaagataaaaacattgaagctggaaacgcatgtgtttgttgggtccaccgtctgcaccggttctttttggtgttttgctatgtgacgacgacgacgacgatgacgatccaacggtgcatgtttgttgacctgtccctagtagtagtagcatgtgtacagctattgtatgtagaatgtagataggtacactactacacgttgttgtcatgtgatcatagaagctctcttaccgggaaaaataaaaattgatagaaggatggaaggtgtatttggaccttccctaattaatatttgttaaaaaaaaaaaaaaaagggcggccgc

SEQ ID NO: 869 - DNA, 2117 bp, Glycine max
  Predicted polypeptide sequence is orthologous to G519
cccacgcgttcggtggctcctggcggcacgtgtggcggtatcggctataaataaaggggtctctcttatgttctaagtttgaagcggcgccaccatagttggtgtagctagcgagggagggatatagggggaagcgtttattcattcattaagatggcatcggagcttcaattgcccccaggcttcagattccatccaacggaccaggagctggtgttgcactatctctgccgtaaatgcgcgtcgcagcctatcgccgttcccatcatcgccgaaatcgacctctacaaatacgacccctgggacctacccggtaacattatcttcaacttctgatatattcttattcttaattcttaattcattcattttttgaattgttattgtacaggattggcttcctacggagagaaagagtggtacttcttttcaccacgggaccggaaatacccgaacggttccaggccgaacccgggcggcgggaaccggttactggaaggcaaccgggggcggataagccccattggccaccccaaaccggttgggataaaaaaagctttggtgttttacgcagggaaagctccgaaaggggacaagagcaattggatcatgcacgagtatcgtctcgccgatgtagatcgctccgttcgcaaaaagaacagcctaagggtacatacatacatgaatgatgatgcatgccctttctagttcaagattattaggataggataattgcatgaaattacgactttgccctcaagttgaagctgaggatgataatcatttcccatgcaaattgcaaaatctatggccgtaatatcttaaatgttatctcaccgcgcagaaccttcaccagttgaagacttagccatcgcattaaaaacaataattgatgtggaaagagaaaaaattaaaaatataaaatcttctgccaaatcgcaattatcactttctatttttagaaattattccttcttatcactctcacctgccaccgcctgcgagattaaattaatcttacgttggtttccgattatgcagttagatgattgggtgctttgccgtatttacaacaagaagggcacgatcgagaagttccaaccaagcagcgatgttgttgttagccgaaaaatggaatcatcggagatcgaagacaggaagccggagattctgaaaagcggaggaggttgtcttctgccgccggttccgccgccgcaagcgaaggcggcggtgaagaaggattacatgtacttcgacccgtcggattcaatcccgaagctgcacacggactcgagctgttcggagcacgtggtatcgccggaattcgcgagcgaggtgcagagcgagccaaagtggaaggagtgggagaaaagcctcgagtttccgtttaattacgtggatgccactctgaacaacagcaacagcttcacgacgcaattccagggcaataatcagatgatgtcgccgctgcaggacatgttcatgtactggcccaacaagcccttctgaacaaaccgatccacgccgcccattcgcatttgcacggtagcacgagactcaaggtctatgagtgtgcctgtgcgaccacacacagacgattatttatcaagttagcttagctagggcaaagaaagataaaaacattgaagctggaaacgcatgtgtttgttgggtccaccgtctgcaccggttctttttggtgttttgctatgtgacgacgacgacgacgatgacgatccaacggtgcatgtttgttgacctgtccctagtagtagtagcatgtgtacagctattgtatgtagaatgtagataggtacactactacacgttgttgtcatgtgatcatagaagctctcttaccgggaaaaataaaaattgatagaaggatggaaggtgtatttggaccttccctaattaatatttgttgaattattatcattagtatgtgttacatctaatttagtaggtgctcctttctcttgttttttaggtcctttttaatcgagtatcgtgatatcctactgtgtgtttacttttttattttctatctttagtttaatttattatgtaataatgtaattaatagtctaaaacaagtttagcttttttttttcttt

SEQ ID NO: 870 - DNA, 2799 bp, Glycine max
  Predicted polypeptide sequence is orthologous to G519
cgcatccacgttaataaatggaaattcgagacttttctcccactcgttccacttgggctcgctttgcacctcgctcgcgaattccggcgataccacttgctccgaacagctcgagtccgtgtgcagcttcgggattgaatccgacgggtcgaagtacatgtaatccgtcttcgccgtcgcttgcggcggcgcaggcaccggcacaggcggcggaagacaacctcctccgcttttcagaatctccggcttcctgtcttcgatctccgaggattcgatatttcgggctatgagcaacatcgctgcttggttgcagtttctcgatcgtgcccttcttgttgtaaatacggcaaagcacccaatcatccaactgcgacaaaaaaaaaaaaaaaatcacaaccaccgtaagattatttcttcattttcatttattattataagtattgcaatcggaggcaggtgagagagataaagaaggaatagttttctaaaaatggaaagtgataattgcgattggcagaagatttatttctttccgcatcaattattgtttttttattggatctaatgtgatggctaagtttcttgggcccaagcccagaccacatgctggcaagtcttcaactagtgaaggttccgcgcggtagttttcacatgataacatattacgaccatacattttgcatggtttccaccaaaatcctggacttatcctcagccgatgagagcgtagggacaaagtcgtaatttcgagcaataatcttgaactagaaagaagtacggagtgtatatacccttagggtgttctttttgcgaacggagcgatctacgtctgcgagacgatactcgtgcatgatccaattgcttttgtcccctttaggagctttccctgcgtaaaacaccaaagcttttttaatcccaaccggtttgggctgaccaatgggcttatccgccccggttgccttccagtaaccggtgccagccgcccggttcggcctcgaaccgtttgggtatttccggtcccgtggtgaaaagaagtaccactctttctctccataagtagccaatccgggtaagtcccaggggtcgtatttgtagaggtcgatttcggcgatgatgggaacggcgattggctgcgacgcgcatttgcggcagagatagtgcaacaccagctcctcgtccgttggatggaatctgtagctagggagggatatatatctgagtaagatggcatcagagcttgaattgcccccaggcttcagattccatccaacggacgaggagctggtgttgcactatctctgccgcaaatgcgcgtcgcagccaatcgccgttcccatcatcgccgaaatcgacctctacaaatacgacccctggggacttacccggattggctacttatggagagaaagagtggtacttcttttcaccacgggaccggaaatacccaaacggttcgaggccgaaccgggcggctggcaccggttactggaaggcaaccggggcggataagcccattggtcagcccaaaccggttgggattaaaaaagctttggtgttttacgcagggaaagctcctaaaggggacaaaagcaattggatcatgcacgagtatcgtctcgcagacgtagatcgctccgttcgcaaaaagaacaccctaaggttggatgattgggtgctttgccgtatttacaacaagaagggcacgatcgagaaactgcaaccaagcagcgatgttgctcatagccgaaatatcgaatcctcgggagatcgaagacaggaagccggagattctgaaaagcggaggaggttgtcttccgccgcctgtgccggtgcctggcgccgccgcaagcgacggcgaagacggattacatgtacttcgacccgtcggattcaatcccgaagctgcacacggactcgagctgttcggagcaggtggtatcgccggaattcgcgagcgaggtgcaaagcgagcccaagtggaacgagtgggagaaaagcctcgaatttccatttaattacgtggatgccactctcaacaacagcttcatggcccaattccagggcaataatcagatgttgtcgccgctgcaggacatgttcatgtactggcccaacaagtccttttgagcacatcatgatggttttaaattacgatccgcaattgctcttaagattttctgactcaccatgcgaccacaatcgtaatttaaaaccatgtcacataaaatccacgcgcgccgcccattcgcatgctgcacggtagcacgagactcaaggtccatgagtgtgcctgtgcgaccacacacatacgattattgatcaagttagcttagctaggccaaagtaagaaagaaagaaacattgaagctggaaacgcatgtgttggctccaccgtttgctttggtattttgctatgtgatgatgacgacgacgatccaacggtgcatgtgtgttgacctgttcctagtagtagtagtagcatgtgtacagctattgtagaatgtagataggtacactactacacgttgttgtcatgtgatcatagaaaggtctctcaccgtacaaaaaaaaaaaaaagtgatagaaggtctatttgatagaccttctaattaatatatgttgaattattattagcatgtgttacatctaatttattaggcgtgccctttgtcttttctcatttttttaggtctttttaaattgagtatcgtgatatcctactgtgtttactttttcatttcaatatcttttgttttttatgtactactataatataattaatataaaacaattttagtt

SEQ ID NO: 871 - DNA, 1238 bp, Glycine max
  Predicted polypeptide sequence is orthologous to G519
ttttttttttttttaaacataatagtagtacgaagtcatttttgtcaaaaaacagtcttcttcaaaaccttaaagacaaataagataaatattttgtttccacacaatttatttaatatcaaactattaattgcgactagatcatgtaaacagttggattcatcatgttcatatatgaatgcttctcttttttgtttttttgtttttttataataataatcatctacgcgcaccagcacggacacactcacggacattcactcagtctcgtgcttccatgcaatgcagcaggcacgtcaaaaatgcatcatgcacacacaaagcaaagaacgacgtcgtgccgtctcgtgcgtgttgatttcagaagggcctggagaggtacatgaagatatcctggagcggcgacatctgattattcccgagagtggcatccatgtaattatacgaaaactcgctgttgccctgcctcttccgctcgctctgcacctcgctcgcaaactccgccgacaccacctgctccgaacagctcgactccgtcgtgtgcagccgcggcaccgagtcggaagcctcgaagtacaggcaatccgccgccgtatactccggcttcacgtcttccatttcgtaacattcaattttgtggacaccactcggtggtggcggtgctggttgctgcttctcaattgcacctttcttgttgtaaattcgacacagcacccagtcatccagccttaagctgttctttttgcgaaccgaacgatccacgtcggcgagacgatactcgtgcatgatccagttagttttcactcccttgggcgcttttccggcgtaaaaaaccaatgctttcttgatcccaacaggtttcggtttgccaaccggtttatccgctccggttgccttccagtatccggtccccgcggaccggttcggccgcgaaccgttcgggtacttgcggtccctcggcgtgaaaaaataccactctttctctccgtacaaagccattcctggaaggtcccatgggtcgtacttgtagagatcgatttcggcgattattggaactgcgatttcttgcgaagcgcatttgcggcagagatagtgaacgacgagttcttcatcggtggggtggaatcggaatccagggggtaagtggagttgtgttgctgcggccattgttgagaaagaaaattgggggaaagtgaagtgaaaaggaaaaatgaaatgaaattgtgtggtggcgtggg

SEQ ID NO: 872 - DNA, 1517 bp, Glycine max
  Predicted polypeptide sequence is orthologous to G519
accataattaaccacatccaacattatttacgcatgctaatttatttcctactaattgtacgctagctaatccatccttgatccaagcctaaccatacatcactcaccaagtcaatagatgaacaacaatttgatgtacacctccatcacctttcaattctactactatacttccccggcattttagccagctcgtctacactaatcaaatatagtactgacgaatgatcctagcttacacaaccaaatgtacatcaaatctaagtgtattaaattaatcaattattaacgcatcattaatcaagtacttatttttaaataaccacacattaatatactcaatgatgtattaatacttcattaatttaatatactcataattcatcatgttcatataagaatctttcttcttcttcatcttggtgcttttttgtttttttttgtaataatcgtctacacgaaccagcacggacacactcacggatcttcactcagtctcgtgcttccgtgcaaatggtgcagtggagcagctactgcaaaaatgcataatgcatacacacaacacagaacgacgtcgtctcgtcgtggtggtggtgcgtgttaattgcagaaggacttggagaggtacatgaaaatatcctgcagcggcgacatctgattattcccgagagtggcatccacgtaattatatgcaaactcgttgttgttgttgctgcccctcttcggctcgctctgcacctcgctcgcaaactccgccgacaccacctgctcggagcagctcgagtccgtcgtgtgcagccggggcaccgagtcggaagcctcgaagtacaggcaatccgccaccgtcgccgccgtatacggcggatctggcggcagaatctccggcttctcgtcctccatttcggaacattcaattttgcggaccccactcggtggtggtagttgttgcttttcaattgcacctttcttgttgtaaattcggcacagcacccagtcatccagccttaagctgttctttttgcgaacggaacgatccacgtctgcaagacgatactcgtgcatgatccagttagttttctctcccttgggcgcttttccagcgtaaaaaaccaacgctttcttgatcccaaccggtttcggtttaccaactggtttatccgctccggttgccttccagtacccggttcccgcggaccggttcggccgcgaaccgttcgggtacttgcggtccctcggcgtgaaaaaataccactctttctctccgtacaaagccattcctggaaggtcccaagggtcgtacttgtacagatcaatttcggcgattatgggaaccgcgatatgttgcgaagcgcatttgcgacaaaggtagtggatgacgagttcttcatctgttggatggaatctgaatccagggggtaagtgaagttgtgttgtagtggccattgttgagaattgagaaagaaaattggagaaactaaagagtagaaatgtgtaggaattgtgtggtggttgggccc

SEQ ID NO: 873 - DNA, 680 bp, Glycine max
  Predicted polypeptide sequence is orthologous to G519
agccctctcttgatattaaatacgccgcagcaccgagtcatccagctttcagttgtcttttgccgcgaggaccgattctcgtctagaacatcgatactcgtgcatgatccagttagttctctctccccggcgcgctcctccagcgtaaaaaaccaacgctttcttgatcccaaccggtttcggtttaccaactggtttatccgctccggttgccttccagtacccggttcccgcggaccggttcggccgcgaaccgttcgggtacttgcggtccctcggcgtgaaaatataccactctttctctccgtacaaagccattcctggaaggtcccaagggtcgtacttgtacagatcaatttcggcgattatgggaaccgcgatatgttgcgaagcgcatttgcgacaaaggtagtggatgacgagttcttcatctgttggatggaatctgaatccagggggtaagtgaagttgtgttggtgtggccaaaagtgaatggtgaagtgtgatgcgagaatagtttatttgtagaactttggaagagaacataatggacatgttgctagtggctacagtttgtcatttaaagaagaaaaaaaaaaacattttcatattttcagcacaattataagggcattattccatttaaaaaaaaaaaaaaaaaaaaactcgagactagttct

SEQ ID NO: 874 - DNA, 1818 bp, Glycine max
  Predicted polypeptide sequence is orthologous to G519
  misc_feature (1371)..(1371): n is a, c, g, or t
ctttttttttttttttttttttttttttttttttttttttttttttttttttttttttttttttttttttttttttagcaatgaaacaagaattttctactaggggtccttagtccttacatgtcgacacaattcctaacatagctaatggatcttcattcttcacccagttgagatcatttttcttatttttaggtacctatgatctcattttttcctagtgatcaatggcagtcaaattcaacaatcccaagaacagataatagtcaccacacgtgcagaccaaagccggcatgagtagtagttaggtacagtagtatagtaggtacgcttgaatgtgatttttttgttgtttttttttttaacgaattttaaaaataaatgtgagacccgtatttccttcttggggtcccattgaccctaaaaaaatcaaaatgtctttggtaggtacgtgaacatttcttgccacggtgagagatggttgatttggtattgaacctgaggggcaaaagcgtcatctgaggtcaggtccatgaaattaaaatcgaagcccaaggctgggtcggggcccaactcaagatcattccacttgggctcgctctgcacctccttctcgcacgtgccatcgggcgaaaccacgtgctcggagcagctggagtccgtgtgcaacctgggccccgaatccgacgtgtccatgtacaattggtcgttcctgaaatcatcgtggccgtacatcttgatctgaggcttggtctcgtgctggaactgaacctcctcttctgataacttggccactttctgatccaccaccgcaacaccattgtacttctcaatcttccctttcttgttgtaaattcggcacaaaacccaatcatcaagctgccattccaataagcacaacagttaaaaaaattgtccaaatcacatattatttctacctaaccaaactttgaaacattattaatccctgttcttaatcttagttaaaaaattaaaaaaagaattttgtttatgtatttattaaaatacataaaattatgtattaatgactttttaacgctatctcacattaaatattctttttattcctcaactaacacctaacgatattgattagcaagaatcttataattattattaataagattgttatcgggacataccctcaagttgttggtggtggtgttttttttttgaggcggatctgtcgacgttggctaagcgatattcgtgcatgatccaattggtcttcactccctttggggctttgcccgcgtagaacacgagggccttcttgattccaagggctttcggttttccgatcggtttgtcagctccggtagccttccagtacccgcttccggcagccgnagttcggtctcgaaccgtttgggtattttcggtctcgaggagagaaaaagtaccactctttctcaccgtaaagagccatctctgtacataaaaacataaataataggactttaaggtggagagaaaaaaaatgtagtagaattaagaccctaatgaaattaaaaaaggcaaaagaatacagagactagagtgagaaaagaaaaaaaggtacctggaagctgccatggatcaaacttgtacaaatcgatttctttgatgatgggaacagcaatggtttgtgcagcacactttctacacaagtagtgattcacaagctcatcgtcagtggggtggaatctgaacccgggtggtaattggagttctcctggcattcgcgtttcttctgtcctttgtgagttctagtgttactttgcccacgcgtccgcccacgcgtccgcggacgcgtgg

SEQ ID NO: 875 - DNA, 1497 bp, Glycine max
  Predicted polypeptide sequence is orthologous to G519
tttttttttttttttttttttttttttttcacaaaaatgaaacccttacattttcatttcaattgctgcttactttgaaaattaaaaaaaaatatatatatatatatatataatataatataatataatatttcacagacatacaaaaaaatcctactacaatagcaatgaaacaagaattttctactaggggtccttagtccttacatgtcgacacaattcctaacatagctaatggatcttcattcttcacccagttgagatcatttttcttatttttaggtacctatgatctcattttttcctagtgatcaatggcagtcaaattcaacaatcccaagaacagataatagtcaccacacgtgcagaccaaagccggcatgagtagtagttaggtacagtagtatagtaggtacgcttgaatgtgatttttttgttgtttttttttttaacgaattttaaaaataaatgtgagacccgtatttccttcttggggtcccattgaccctaaaaaaatcaaaatgtctttggtaggtacgtgaacatttcttgccacggtgagagatggttgatttggtattgaacctgaggggcaaaagcgtcatctgaggtcaggtccatgaaattaaaatcgaagcccaaggctgggtcggggcccaactcaagatcattccacttgggctcgctctgcacctccttctcgcacgtgccatcgggcgaaaccacgtgctcggagcagctggagtccgtgtgcaacctgggccccgaatccgacgtgtccatgtacaattggtcgttcctgaaatcatcgtggccgtacatcttgatctgaggcttggtctcgtgctggaactgaacctcctcttctgataacttggccactttctgatccaccaccgcaacaccattgtacttctcaatcttccctttcttgttgtaaattcggcacaaaacccaatcatcaagcctcaagttgttggtggtggtgtttttttttgaggcggatctgtcgacgttggctaagcgatattcgtgcatgatccaattggtcttcactccctttggggctttgcccgcgtagaacacgagggccttcttgattccaagggctttcggttttccgatcggtttgtcagctccggtagccttccagtacccgcttccggcagcccggttcggtctcgaaccgtttgggtattttcggtctcgaggagagaaaaagtaccactctttctcaccgtaaagagccatctctggaagctgccatggatcaaacttgtacaaatcgatttctttgatgatgggaacagcaatggtttgtgcagcacactttctacataagtagtgattcacaagctcatcgtcagtggggtggaatctgaacccgggtggtaattggagttctcctggcattcgcgtatcttctgtcctttgtgagttctagtgttactttgtttgcgacttggaacccccttctgtcgtcttctcgcagcagta

SEQ ID NO: 876 - DNA, 1498 bp, Glycine max
  Predicted polypeptide sequence is orthologous to G519
ggaaagcaagatttttcattcagttgtttcctttgaatggaaaagtagaaagttgtatattacaaaatatatgaaaaaatcatatgctggaatagcaatggaacaagaattttcctaagtgagtccttacacccacacattaaccctccaataacctatcatcaatttgctcacttactttttacttactgcagcacctaatctccttctctcattttttctttacaccaagaaccaatccaaatagcccatttcagccgaattcaacattccctcatctctctagaacaaagaataagaatagttgctaagcttggcctagcccacatcacatgttaggtgcaatgcaattgcatacaaatgctgacttttccttttaaaaaaataataaaacaaagatatttgcgggtcccatgttgctcaaaacgtttcgttttcagttttcacatcttctgtaggtacatgaacatgtcctgcaagggcgagagctggcccatttgatactgaacagtgccaaaaaggtaatcatccacggaaaggttattatcgtccaagtaattaaactgaaaatcaaacgcgttttctagctttaggtccagatcatcgttccacttggggtcgctctgcacctccctctcgcacgtgacatcgggcgaaaccacggtgctccgaactgctcgagtccgtgttcaaccttggcaccgaatccgaagtctccatgtacaattgctcatttcctagcttatgaatctctggcttcgtctcgttctcgtgctcaaaactatgaaccatctcaacattcatcttcgctgcgcctgtgttgtatttctcaatcttccctttcttgttgtagattcgacacaacacccaatcatcaagcctcaaagttgttgttttttttttcttggaggcagatcggtcaacattggcgaggcgatattcgtgcataatccaattggttttcacacctttgggggcttttcgggcgtaaaaaaccagagctttcttgatccctagcgctttcggttttcccgatcggtttatcagcgccggtggctttccaatagccgcttccggcggcgcggttcggccgtgaaccgttcgggtatttccggtcccgaggagaaaagaagtaccattctttctcgccgtaaaaaccaatttctggaagctgccatggatcaaacttgtacaaatcgacctctttgatgacgggaaccgcgattggttgaccagcgcacttcctacacaagtagtgattcaccaattcttcatcagtggggtgaaatctgaacccaggtggcaactctaattctcccttcattcgcgcgcgtttcttcttctctttcttcttgtgtgttcttcttcccttttaactgaagattcttctaatttgcaagccttatgctgatgttgttgttgttgattatgttggttttcttcttcttcttcttggctctgctttgctttgctaagcgctcgagccgaattcagagct

SEQ ID NO: 877 - DNA, 1252 bp, Oryza sativa
  Predicted polypeptide sequence is orthologous to G519
ccggccgggagactacctccctctatatatccccccctccgcccgccatctccccccattcgcacgaggcctcacaacccacaacattttcaaacaacgcaaagcagtagcagcagcgagaagcaagcaagaagcgatggggatggggatgaggagggagagggacgcggaggcggagctgaacctgccgccggggttcaggttccaccccacggacgacgagctggtggagcactacctgtgcaggaaggcggcggggcagcgcctgccggtgccgatcatcgccgaggtggatctctacaagttcgacccgtgggatctgcccgagcgcgcgctgttcggcgccagggagtggtacttcttcaccccgcgggatcgcaagtatcctaatgggtcacgccccaaccgcgccgccggcaacgggtactggaaggccaccggcgccgacaagcccgtcgcgccgcgggggcgcacgcttgggatcaagaaggcgctcgtgttctacgccggcaaggcgccgcgaggggtcaagactgattggatcatgcatgagtaccggctcgccgatgctggccgcgccgccgcgggcgccaagaagggatctctcaggttggatgattgggtgctgtgtcggctgtacaacaagaagaacgagtgggagaagatgcagcaggggaaggaggtgaaggaggaggcgtccgacatggttacgtcgcagtcgcactcgcacacccactcgtggggcgagacgcgcacgccggagtcggagatcgtggacaacgaccccttcccggagctggactcgttcccggcgttccagcctgcgccgccgccggcgacggcgatgatggtgcccaagaaagaatcgatggacgacgccaccgcggccgccgtcgccgccgccaccatccccaggaacaacagcagcctggtcgtggactctgagctacgacgatttcagggcttgtacagtgtgctgtcatgcttgcgtcggcgacgattttactcttatttttttctttttatgggtgaagggtcaactcctccgcctttccttttgttattttctctctttgtgtctttacttattatttgtgctctacgttctcacgttgtatcccaatttctatctccattttttttcgacactattgcatttttttacttgtttgatattccttttttattttacttatttttctacattttttctaatcttactctctcttttataatattatttttatttaat

SEQ ID NO: 878 - DNA, 1344 bp, Oryza sativa
  Predicted polypeptide sequence is orthologous to G519
cacgaggggtcgccacgcagccgcagcatcggcagcagcagcagcagcagcagcagcagcgttggtggtggtggtgtgtcatcaccaacattttcacgagaggagaaggatggaaatggcggcggcggttgggggcagcgggaggagggacgcggaggcggagctgaacctgccgccgggcttccgtttccacccgaccgacgaggagctcgtggtgcactacctctgccgcaaggttgcccggcagccgctccccgtcccaatcatcgccgaggtcgacctctacaagctcgacccctgggatctccctgagaaggcgttgttcgggaggaaagagtggtacttcttcacgccgagggaccggaagtacccgaacgggtcgaggccgaaccgcgcagcggggagagggtactggaaggcgacgggagccgacaagccggtggcgcccaaggggagcgcgaggacggtggggatcaagaaggcgctcgtgttctactccgggaaggcgccgaggggggtcaagacggactggatcatgcacgagtaccgcctcgccgacgccgaccgcgccccgggcggcaagaagggctcacagaagctggacgagtgggtgctgtgccggctgtacaacaagaagaacaactgggagaaggtgaagctggagcagcaggacgtggcctccgtggcggcggcggcgccgcgcaaccaccaccatcagaacggccgaggtcatggacgcggcggcggctgacaccatgtccgacagcttccagacgcacgactccgacatcgacaacgcctccgccggcctgcggcacggtggctgcggcggcggcggcttcggcgacgtggcgccgccgaggaatgggttcgtgacggtgaaggaggacaacgactggttcaccggcctcaacttcgacgagctgcagccgccgtacatgatgaacctgcagcacatgcagatgcagatggtgaatccggcggcgccagggcacgacggcggctacttgcagtccatcagctcgccgcagatgaagatgtggcagacaatcctgccaccattctgagatggatggagcaagaaaaaggttgctgtagataaagggcggaaataggagtgatggctagaaaattattagatttactagaacgaaaatgattagaaatctggcaagcatgattctgcaaatgtggtggtagatgcttgcagtatgtaattcatttgttcagtatatgcatttggtaatctgcaaaacaaaaaaaaaaattctcataaaaaaagcgaaacatatatgattttatccttcattagtctgaattctgaaatatatgcttgatggtttt

SEQ ID NO: 879 - DNA, 1159 bp, Oryza sativa
  Predicted polypeptide sequence is orthologous to G519
tcgacccacgcgcccgcccaccaccctcattccctcaagtcccaagatcgaacacctcgtgtccatggcggcggcgaagcggcgagtgcgcgacgcggaggcggacctgaacctcccgccgggcttccgcttccaccccaccgacgaggagctggtggcgcactacctctgcccgcgcgccgcgggccgcgccgccccggtccccatcatcgccgagctcgacctctaccgccacgacccatgggacctcccccaccgcgccctcttcggccgccgcgagtggtacttcttcaccccgcgcgaccgcaagtaccccaacggctcccgccccaaccgcgccgccgcctcgggctactggaaggccaccggcgccgacaagcccgtgctgcacaacggcaggacggccgggatcaagaaggcgctcgtgttctaccacggcaagcccccccgcggcgtcaagacggagtggatcatgcacgagtaccgcctcgccaagaagggcggcgccgccgccgccgcgggcgcgggcgcgctcaggctggatgactgggtgctgtgccggccgcgcggcaagaagaacgagtgggagaagatgcagagcaggaaggaggaggaggaggccatggcggcggcgcagtcgtggggggagacgcggacgccggagtcggaggtcgtcgacagcgacgcgttcccggagatggactactcgctgccggcggcgtcgttcgacgacgccctgctgcccaaggaggaggcgcgcgacgacgactggctcatggggatgagcctcgacgacctccagggcctcggctcgctgctgcaggccgacgacctctccatgctcgcgccgccgccggcggcgaagacggagccgctcggcgcgccattcttctgagctctctctctctctctctctctctctctctctgtgactgcaccactgtatataaattcagagttttcagacatgttcagtattcagagttctcaggcaagttcagaattcagagatggttaaggattagtggcttatgagcagtatgatatgcaggttagtttctagtttagcagtgttactccagattggagatttgattaatgatttgattctaattaatgtagtatactgagtgttactcatcaaaaaagattcatcaga

SEQ ID NO: 880 - DNA, 745 bp, Zea mays
  Predicted polypeptide sequence is orthologous to G519
  misc_feature (688)..(688): n is a, c, g, or t
agtcctcctctcctccctcctcccacctagatcagcagcagaagagaaggaaaattcagtagcagtagaactcagagcagcggcagcagaactgcggcgagctgatccagcgagagaactacagcgaggtttgttggatcgccgacccgaccggagatgagcggcggacaggagctgaatctgccgccgggcttccggttccacccgacggacgaggagctggtgacgcactacctctgccgccgctgcgccggcgcgcccatcgccgtccccatcatcaccgagatcgacctctacaagttcgacccctggcagctcccaaagatggcgctgtacggcgagaaggagtggtacttcttctccccgcgggaccgcaagtaccccaacgggtccaggcccaacagggccgccgggtcagggtactggaaggcgacgggggccgacaagcccgtgggcacccccaagccgctggccatcaagaaggcgctcgtcttctacgccggcaaggcccccaagggcgagaagaccaactggatcatgcacgagtaccgcctcgccgacgtcgaccgatccgcccgcaagaagaacagcctcaggttggatgactgggtgctgtgccgcatctacaacaagaagggcggcttggagaagccggcgtccgtggaccgcaagccggcggccatgggcnggctacgggggtcctcctggggccatggtgagctccccgcaggagcagaagccgtca

SEQ ID NO: 881 - DNA, 2405 bp, Zea mays
  Predicted polypeptide sequence is orthologous to G519
cgattgggtccctcgaggccggccgggattccattccctctcgagacttcctcagcaatcaatcagctttccagcgatcggcagctcctcgatcgtttcgaagctccaatccgcccggccgcctccgcctgttgccactagctaggtgatcgatcgaatggactgcggtggcgcgctgcagctcccgcctgggttccgcttccaccccaccgatgacgagctggtgatgtactatctcctccgcaagtgcggcggcctgccgctcgccgcgccggtcatcgccgaggtggatctctacaagttcgacccatggcagctcccagagaaggcgttcggtggggagaaggagtggtacttcttctcgccgcgcgaccgcaagtacccgaatggctccaggcctaaccgggcggccgggacagggtactggaaggccaccggcgccgacaagccggtagggtcgccgcgccccgtggccatcaagaaggcgctcgtcttctacgccgggaagccgcccaagggcgtcaagaccaactggatcatgcacgagtaccgccctcgcggacgtcgaccgctcggccgccgcacgcaagaagaccaacaacgcgctcagggtaattcactacaccatgacctttctcaggagaacatatttatctccccgaaatactgacacttgcagttagagggaaaaaatatagagagaagtaaaaaaaaaaagattgatgtttgattttaccaatgctgcaacaagaaacagtggatcgaatcgaaatgtgttgttaggcttgcaactatatatgcagattcttagttaagaggaattgaaaaaggctctagagacatgtaaagcgcgggcggcgtggcgtcacggctcacgcacgccgcgatagagacaagcgcggcaaccatggtccatggccggcgcagagccgccgcctgatcttatcgcccgcgcacaaattaccacatgcgcggcgcgcaccggatccgacgtcacgtcgacctcatctccaagcctcttccaaacactccaatgcgtactggatgactgggtgctgtgccggatctacaacaagaagggtgttatcgagcggtacgacacagtggacgacgacgacggcgacggcgccgtggccgaagacgtcaagccggtgccggcgccggcggcgtcgaagaacccgcgtgccagtgcccgcgtaggggcagcagcggcggcgccgatgaaggtggagctccccgagtacggcggcggctactacgactacgacgacctggagacgccgtcggcggggatgctgtgcttcgaccgcccgtcggccccggcgcccgcggaccgcgactcaaacaactccgtgccgtggacgacgcaccacacgcacacggacaactccagcagcggctccgagcgcgtgctctcgccgtcgccggacctgcccgaccgcgaccacgccgagagccagcccgccgccgccgccgccgccgccgggtggtggcctgtcggaggcgactggggcagcgccgccgaggacgggttcatggtcgacgtcgacgtcgacgacgggagctcgctgttcgggccgctgtccccggggctgttcgcgcgcgtcgacgccgccgcgttcggcttcggcgacatgctcgcgtcgtacctgcacaaaccgttctgatgcaacgcgacgcgacgcgacgcgagcgcggccaccccgcgcctgcgtgctcctctaggccactgaccactgacatggacattctggtcgtcgtgtagctcggttcaggacgaatcgagagccggccggtctaggtgtagtgctgcgaaaccaacaccaccgtgcaggcacactctccgcgggcggcagatcgacggacaatcctgcgcccgtaggtatataccggtcgtcgatcaggtgttcatcagttcttcattcattcaggtcgacgtgcaactggtaattgtacaagatcttgggcagctgccgtatggagatcgatgagtgccgagttagcatggaggacgactggtggtcatggttggtacagagctagctagccgtccgatcgggtatcggattaatctgattgccagttttgtttttttttggtcgcgtcaagtagctgacatcttaagaatgaagcctactggattcagaggcctgttgatggtaatggtatggtgtatgtatatcgtctagtttagtctagcctagctgtacttagaattggttcaggttggtggcaagcagagcgctgtaatttttgttgagtgtttatgcactataattgcaacgtcatgtattagagtcgctctcagcggtcgctttctcgtgatcgaaaattttgcgatgcaaattatcctaataaagttgttgtaagatgtaaaaaaaaaaaaaaaaatcgaagcggccgca

SEQ ID NO: 882 - DNA, 842 bp, Zea mays
  Predicted polypeptide sequence is orthologous to G519
cattgggtacctcgaggccggccggcggcccattccaaagctctcgagacttcctcagcaatcaatcagctttccagcgatcggcagctcctcgatcgtttcgaagctccaatccgcccggccgcctgttgccactagctaggtgatcgatcgaatggactgcggtggcgcgctgcagctcccgcctgggttccgcttccaccccaccgatgacgagctggtgatgtactatctcctccgcaagtgcggcggcctgccgctcgccgcgccggtcatcgccgaggtggatctctacaagttcgacccatggcagctcccagagaaggcgttcggtggggagaaggagtggtacttcttctcgccgcgcgaccgcaagtacccgaatggctccaggcctaaccgggcggccgggacagggtactggaaggccaccggcgccgacaagccggtagggtcgccgcgccccgtggccatcaagaaggcgctcgtcttctacgccgggaagccgcccaagggcgtcaagaccaactggatcatgcacgagtaccgcctcgcggacgtcgaccgctcggccgccgcacgcaagaagaccaacaacgcgctcaggctggatgactgggtgctgtgccggatctacaataagaagggcgttatcgagcggtacgacacagtgaacgacgacgacggcgacggcgccgtggccgaagacgtcaagccggtgccggcgccggcggcgtcgaagaacccgcgtgccagtgcccgcgtaggggcagcagcggcggcgccgaatgaaggtggagctccccgagtaccgcggcggctactacgactacgacgacctg

SEQ ID NO: 883 - DNA, 1617 bp, Zea mays
  Predicted polypeptide sequence is orthologous to G519
cattgggtacctcggggccccccgggccccgcccgaagctctcctcccctcttcctaccattagcagtagccacagccagaacaccagcagacagcagcatcagcagggaggaacacgatgagcggcgccggtccggatctgcagctgccaccggggttccggttccacccgacggacgaggagctggtgatgcactacctctgccgccgctgcgccggcctgcccatcgccgtccccatcatcgccgagatcgacctctacaagttcgacccatggcagctcccaaggatggcgctgtacggcgagaaggagtggtacttcttctccccgcgggaccgcaagtacccgaacgggtccaggcccaaccgcgccgccggggctgggtactggaaggccaccggcgctgacaagcccgtgggcacgcccaagccgctggccatcaagaaggcgctcgtcttctacgccggcaaggcgcccaagggcgagaagaccaactggatcatgcacgagtaccgcctcgccgacgtcgaccgctcggcgcgcaagaagaacagcctcaggttggatgactgggtcctgtgccgcatctacaacaagaagggcggcgggctggagaaggcggcggcgccggcggccggcggcgaccacaagcctgtgttcgccacggcggcggtgagctccccgccggagcagaagccgttcgtggcggcggcgggcgggctgcccccggcgttcccggagctggcggcgtactacgaccggccgtcggactcgatgccgcggctgcacgcggactactccagctgctcggagcaggtgctgtccccggagcagctggcgtgcgaccgggaggtgcagagccagcccaagatcagcgagtgggagcggaccttcgcctccgaccccgtgaaccccgcgggctccatgctcgaccccgtcgtcggccacgccggcggcgacccgctgctgcaggacatcctcatgtactggggcaagccgttctagacgacaccgcccatcatgtcctgaggggaggtgggggtggcgaagcatcctcggctgcggttggttggttgattgatctgtcttgggcagcgcaatgcaatgcaaccgcacggtgtgggcttgactcaggcgagccgccattgttgacttgcaaggaggatataatatgaaactatagctggattacatggagaggcggcaatgagaccgtctggccccgccggaagggagacggagacggagacggatggcgcagtgcatcgggtgtggtggatcgtgcgcggcatgtgtgtgtgtggctgtacatatacatactgtacatgattggttcagtgcagggtttctgttccttcattgattagttattatactaataagtactagtaattttgtaagggcttgtagttgcagtctccgtactggtggtaggtagtgcaggccatattcgtcatcgccaagcttcgagtgtacttactcctacaatatatattttacagtatatattgtagctgtgttggctcttccggaaaaaaaatggaaggggaaaatagggattatgttattttgattaaaaaaaaaaaaaaaaaaaactcgagggggggcccggtacc

SEQ ID NO: 884 - DNA, 2122 bp, Zea mays
  Predicted polypeptide sequence is orthologous to G519
ccgggaagctctcctccccgcttcctaccattagcagcagcactgcagcagtagccacagccagcaccagcagacagcagggaggaacacgatgagcggcgccggtccggatctgcagctgccaccggggttccggttccacccgacggacgaggagctggtgatgcactacctctgccgccgctgcgccggcctgcccatcgccgtccccatcatcgccgagatcgacctctacaagttcgacccatggcagctccccaggatggcgctgtacggcgagaaggagtggtacttcttctccccgcgggaccgcaagtacccgaacgggtccaggcccaaccgcgccgccggggctgggtactggaaggccaccggcgctgacaagcccgtgggcacgcccaagccgctggccatcaagaaggcgctcgtcttctacgccggcaaggcgcccaagggcgagaagaccaactggatcatgcacgagtaccgcctcgccgacgtcgaccgctcggcgcgcaagaagaacagcctcagggtaagaacaagcgcgctccgccgccgtccgtccgtccgttggcgtcgtcaccgtccaaatcaaacaaaaagaacttggcgataatgtgtcgctttcgtaatgaacgcggggataagcgtggcccatggttttgggccgctgaattttttttacgtgggccatgctaggtggggtggggggctgcaccgtgcccaatgattcgaccgcgtcgcagtcctccgcgcgcaagtattcgatgcccatgggtcatggcgtacagatcattttcgcccgtcgcgcccctgcgactgcgacggcgacggagagccagtggggtctgggattagacatcgaaatgacgctttgtgattctttagctcatccatttctcgtcagctgcacggatgacaaactaagttctctattgtgttgacgggtgcagttggatgactgggtcctgtgccgcatctacaacaagaagggcggcgggctggagaaggcgccggcggccggcggcgaccacaagcctgtgttcgccacggcggcggtgagctccccgccggagcagaagccgttcgtggcggcggcgggcgggctgcccccggcgttcccggagctggcggcgtactacgaccggccgtcggactcgatgccgcggctgcacgcggactactccagctgctcggagcaggtgctgtccccggagcagctggcgtgcgaccgggaggtgcagagccagcccaagatcagcgagtgggagcggaccttcgcctccgaccccgtgaaccccgcgggctccatgctcgaccccgtcctcggccacgccggcggcgacccgctgctgcaggacatcctcatgtactggggcaagccgttctagacgaatcatgcatgcaaacacccatcctcggctgcggttggtttggttggttgatctgtcttgggcagcgcaatgcaatgcaaccgcacggtgtgggcttgagtcaggcgagccgccattgttgacttgcaaggaggatataatatgaaactacagctggattacatggagaggcggcaatgagaccgtctggccccgccgcggaagtgagacggagacggagacggatggcgcagtgcatcggatgtggtggatcgtgcgcggcatgtgtgtgtgtggctgtacatatacatactgtacatgattggttcagtgcagggtttctgttccttcattgattagttattatactaataagtactagtaattttgtaagggcttgtagttgcagtctccgtactggtggtaggtagtgcaggccatattcgtcaccgccaagcttcgagtgtacttactcctacaatatatattttacagtatatattgtagctgttggctcttcggaaaaaaaatggaagttattttgattattctgctagaaaaaaaaaaaaaaaaaaaaaaaaaaaaaaaaaaaaaaaaaaaaaaaaaaaaaaaaaaaaaaaaaaaaaagtgtctagtagtgcacaatagctgctccccgccgttgcggtcttcgtaactacgctttcaaacgacttcggtatctaaagcacgctggagtataccgaagcctacacacagcacctact

SEQ ID NO: 885 - DNA, 861 bp, Zea mays
  Predicted polypeptide sequence is orthologous to G519
  misc_feature (838)..(838): n is a, c, g, or t
cattgggtacctcgaggccggccggcatgcctttcgcgagagaaaggggtcgaatcggcggctgatttgacccggctcgctattagagctgcgaaagtgatccgagcagtcacggtttcggaagcggcgcgtcggccggaggagaaacgcaaccagctgtcgaggagctatgagcagcggtggcggaggcagagtgccggcggcggcggcggcgcagtcgcaggagctgcagctaccgccggggttccggttccacccgacggatgaggagctggtggtgcactacctctgccggcgctgcgccgggctgcccatctccgtgcccatcatcgccgaggtcgacctatacaagcacgatccctggcagctcccaaggatggcgctgtacggcgagaaggagtggtacttcttctccccgcgggaccgcaagtacccgaacgggtcgcggccgaaccgcgccgccggcgccggggtactggaaggccaccggcgcagacaagccggtgggcacgccgaagccggtggccatcaagaaggctctcgtcttctacgccggcaaggcgcccaagggcgacaagaccaactggatcatgcatgagtaccgcctcgccgacgtcgaccgcaccgcccgcaagaagaacaacagcctcaggttggatgattgggtgctgtgccgaatctacaacaagaaaggcgcgctggagaagccgaccggagccggcggcagggccgaggccagcagccagggcgcgctggggtccatgtccatgggctcgccgccggagcagaaaccgtccgtaaacacgtctgccacggcaacggccgcggccgccgactngagtgctcgtcgaaccaggaatt

SEQ ID NO: 886 - DNA, 2162 bp, Zea mays
  Predicted polypeptide sequence is orthologous to G519
  misc_feature (607)..(608): n is a, c, g, or t
tcggcacagctctcctcccctcttcctaccttagcagtagccacagccagaacaccagcagacagcagcatcagcagggaggaacacgatgagcggcgccggtccggatctgcagctgccaccggggttccggttccacccgacggacgaggagctggtgatgcactacctctgccgccgctgcgccggcctgcccatcgccgtccccatcatcgccgagatcgacctctacaagttcgacccatggcagctcccaagtacgtcccgtcgtcctcggtcttcttgcagcagcagtagcagccgtgaaccaatttcctgtgcggccgtgacgatggcgagctaatcgatcgattgctaactctctgtgtgcagggatggcgctgtacggcgagaaggagtggtacttcttctccccgcgggaccgcaagtacccgaacgggtccaggcccaaccgcgccgccggggctgggtactggaaggccaccggcgctgacaagcccgtgggcacgcccaagccgctggccatcaagaaggcgctcgtcttctacgccggcaaggcgcccaagggcgagaagaccaactggatcatgcacgagtaccgcctggnncgacgtcgaccgctcggcgcgcaagaagaacagcctcagggtaagaacaagcgctccgccgccgtccgtccgtccgtttggcgtcgtcaccgtccaaatcaaacaaaaagaacttggcgataatgtgtcgctttcgtaatgaacgcggggataagcgtggcccatggttttgggccgctgaattttttttacgtgggccatgctaggtggggtggggggctgcaccgtgcccaatgattcgaccgcgtcgcagtcctccgcgcgcaagtattcgatgcccatgggtcatagcgaacagatcattttcgcccgtcgcgccctgcgacggcgacggcgacggagagccagtggggtctcactgggattagacatcgaaatgacgctttgtgattctttagctcatccatttctcgtcagctgcacggacgacaaactaagttctctattgtgttgacgggtgcagttggatgactgggtcctgtgccgcatctacaacaagaagggcggcgggctggagaaggcggcggcgccggcggccggcggcgaccacaagcctgtgttcgccacggcggcggtgagctccccgccggagcagaagccgttcgtggcggcggcgggcgggctgcccccggcgttcccggagctggcggcgtactacgaccggccgtcggactcgatgccgcggctgcacgcggactactccagctgctcggagcaggtgctgtccccggagcagctggcgtgcgaccgggaggtgcagagccagcccaagatcagcgagtgggagcggaccttcgcctccgaccccgtgaaccccgcgggctccatgctcgaccccgtcgtcggccacgccggcggcgacccgctgctgcaggacatcctcatgtactggggcaagccgttctagacgacaccgcccatcatgtcctgaggggaggtgggggtggcgaagcatcctcggctgcggttggttggttgattgatctgtcttgggcagcgcaatgcaatgcaaccgcacggtgtgggctttgactcaggcgagccgccattgttgacttgcaagggggcgcgtgggtgaaactatagctggattacatggagaggcggcaatgagaccgtctggccccgccggaagggaggcggagaccggagacggagacggatggcgcagtgcatcgggtgtggtggatcgtgcgcggcatgtgtgtgtgtggctgtacatatacatactgtacatgattggttcagtgcagggtttctgttccttcattgattagttattatactaataagtactagtaattttgtaagggcttgtagttgcagtctccgtactggtggtaggtagtgcaggccatattcgtcaccgccaagcttcgagtgtacttactcctacaatatatattttacagtatatattgtagctgttggctcttcggaaaaaaatggaagttattttgtttaatataaaattattaaagaatattttttttctcatcatttttactttttaattttcacacttcctctttaaaacgggggggccgtttttaa

SEQ ID NO: 887 - DNA, 1507 bp, Zea mays
  Predicted polypeptide sequence is orthologous to G519
ggcgcggggaaacaggcagctctccacggacaacgcgattctatttagttatctggcggctgccagtgccagccagccgcctttcgaaaccgagcacgagggagccgacgtggtggtctctggaacctggttcgagcgagcgagcgatccatctatccagccgcccgccgggaatttctgtgacgaggaggaggaggaggagggggtatggcaatggtggcgtcgcagggaggcggccggagggacgccgaggcggagctcaacctgccgccggggttccggttccatcccaccgatgaggagctggtggtgcactacctctgcaggaaggtggcgtgtcagcagctgcccgtgcccatcatcgccgaggtcgacctttacaaattcgacccgtgggatcttccagagaaggcgctgtttggccgcaaggagtggtacttcttcacgccgcgggaccgcaagtacccaaacggctcgcgccccaaccgcgccgccgggagggggtattggaaggcaacgggcgcagacaagccgatcgcgcccaagggcggtggcggggcggcaggaatcaagaaggctctcgtcttctactcgggcaaggcgcccaggggattcaagaccgactggatcatgcatgagtaccgcctcgcgggcgcggaccgtgcgccgggcaagaagggctcacggaagtcttgcagttggatgagtgggtgctgtgccggctgtacaacaagaaaaacaactgggagaaggtgaaggccgaggagctggaggcggcggcgccgctccgtaaccagcagggcgcagcggaggattccatgtctgacagcttccagacgcacgactcggacatcgacaacaatgccttcggcatgcagaacggcttcggtaacatggtgcacgggcaggccatgaccatgaggaacggcattggcagcgtggcgaggacggtgaaggaggatagctattggttcacggacctgaatctggatgatctgcaggcgccctacaacgtgacccatgtgttgaatccgaacccggtccagacgatgaatctggcggctgggcaaggccatggctacttgcagtctatgagctcgccgtcgacgaagatgtggcagacgatcctgcctccgttctgagagttgctgtgatggaagggggaagagatgatcttgggcgtaggagtggttagactggctaggaacagcaggtttaaaatttggagggtttgaattctgcaactgttgctggtagtcttgtaagggttattcatttgttaaattatgtgcttggtaatataccaaaaggaaaatccatctccctttgcactacttgaagaaaccagtacaaaattacagttctcatatttcatatggtcggtttgagccgagattggtttaggacactttcctctttattcgggtataaattcggccagttgtttcaaaatgattaaatggtaggagtaacattcagtgaatggaatcgactcccttttttccct

SEQ ID NO: 888 - DNA, 1496 bp, Zea mays
  Predicted polypeptide sequence is orthologous to G519
gaattcccgggtcgacccacgcgtccgcccacgcgtccgcaggcctgccagccagccgcctttcgaaaccgagcaccagggagcagacgcggtctctggaacccaggttccagcgagcaaaccatctaaccaggcgctgagaattctgtgcggaggaggcggatggcaatggtggcggcggcggaggggagcgggcgcagggacgccgaggcggagctcaacctgccgccagggttccggttccacccaacggatgaggagctcgtggtgtactatctctgcaggaaggtagcgcggcagcaggtgcccgtgcccatcatcgcggaagtggatctttacaagttcgatccgtgggatctgcccgagaaggcgttgtttggtcgcaaggagtggtacttctttacgccgcgggaccgcaagtacccaaacggctcgcgccccaaccgcaccgccgggaaggggtactggaaggcgactggggccgacaagtcgatcgtgcccatgggcagcaccagggcggcagggatcaagaaggcgctggtgttctactctggcaaggcgtccaggggcgtcaagacggactggattatgcatgagtaccgcgtcgctcaagcggaccacaccctggggaagaagggctcacataagctggacgagtgggtgttgtgccggctgtataacaagagaaacaattgggacaaggtgaaggtcgaggagcaggagttggaggcggcgccgcgccgacaacatcaccgacaaagtgcggaggattccatgtctgacagtttccagacacacgacttagacatcgacaacgccttcgagctacataattgctacggtaacaacatggtgcaagggcaggccatgacccccaggaacgacattggcgtcgtgacggtgaaggaggacaacgactggttcaccgacatgaatctggatgatttgcaggcatcctacaacatggcccatacggtgaatccgaacccggcccaaaccgcgaacctggtggcagggcaaggccatggctacttgcaaggctatggctacttgcagtacatgaactcaccgtcgatgaagatgtggcagacaatcttgcctccgttctgagtgtccacgatgaagatgagtgtccacgatgaagagatgctcttgtacataaggggacataggagtgactagactggaatagaaacaacagggtatgattctgtatctataggcttgtaacgtttattcattcgttagataatacgtatgtggttggtaataccaaaaaaatgcatctccctttgcactacttgaagaaagcacaaagttgtagttctcgtatctcatatggtcggtctaaatcgattctgatcttcatgtgatgtgatatatattatatgttcgcacatttatttaaagatgatgaaatggtaggggtaacattcagtggacggatataaataaaaccatgtgattctacaaaaaaaaaaaaaaagggcggccgc

SEQ ID NO: 889 - DNA, 1399 bp, Zea mays
  Predicted polypeptide sequence is orthologous to G519
ggccggggccttgactctctatttatcccccgatcgccaagaacaactccactccgctcccccatttttttctcacctcccgtggcagcagccggccaacacccgcaccgcagtccacagcaagaaccaagccacagcgaagaaaagatccaatggtgatggcgccggcggcggcgcagcagcagcggcgccgcgacgcggaggcggagctgaacctgcccccgggcttccggttccacccgacggacgaggagctggtggcgcactacctctgcgcgcgcgccgcgggtcgccgccccccggtgtccatcatcgccgaggtcgacctctaccgcttcgacccctgggacctgcccgagcgcgccctcttcggccgccgcgagtggtacttcttcacgccgcgggaccgcaagtaccccaatggctcccgccccaaccgcgccgccgggtcggggtactggaaggccacgggagcggacaagcccgtggagcacggtggcaggacggtcggcgtcaagaaggcgctcgtgttctaccacggcaagccgccgcgcggggtcaagacggagtggatcatgcacgagtaccgcctcgccgacgccggcgcccgcgcccgcgccaggaagcccggcaccggcacgctcaggttggatgactgggtgctctgccggctgtacaacaagaagaacgagtgggagaagacgcagcagcagcaggagaagaagcagaatcagaagcaaatggagtcggaggcctcgctctcgcactcccactcagacacgcggacgccggagtcggagatcgacgacgacccgttcccggagctggcctcgctgccggcactcgacgacatgatgggcccagcagcagcagcgcctgccggcgccatcttgcccaaggaggaggtggaagacttgggcggcctcggcggcgacgactggctcgcgggcatcaacctcgacgacctgcagatcccgggcgaggccgacttttatggctccatgctcgtgtcgccgatggccgccaagatggagcaggacgccgccggcttcccgttcttctgagaccttctgcgcaacgcaaactgtgtatagttcagatttcttcaggattcggagaaaaaaacagttctgctgatatctggttgtagtggtttagtgcacaagcagcagtatgccggtcagttaagattgaagtccattgtagttcatcaccacttgagctgtgactgtgataagtgacagcattctttcatttctggtctgctaattcttcaatggtcagaatatagtttgtggccttcccagagtggtcacaccactgtggagccttgagatggagtaaattttttcttcaaggtttacggtttacctctttaaaatatcttagtactgtttct

SEQ ID NO: 890 - protein, 303 aa, Oryza sativa
  Orthologous to G519
MSGGQDLQLPPGFRFHPTDEELVMHYLCRRCAGLPIAVPIIAEIDLYKFDPWQLPRMALYGEKEWYFFSPRDRKYPNGSRPNRAAGSGYWKATGADKPVGSPKPVAIKKALVFYAGKAPKGEKTNWIMHEYRLADVDRSARKKNSLRLDDWVLCRIYNKKGGLEKPPAAAVAAAGMVSSGGGVQRKPMVGVNAAVSSPPEQKPVVAGPAFPDLAAYYDRPSDSMPRLHADSSCSEQVLSPEFACEVQSQPKISEWERTFATVGPINPAASILDPAGSGGLGGLGGGGSDPLLQDILMYWGKPF

SEQ ID NO: 891 - protein, 276 aa, Oryza sativa
  Orthologous to G519
MAAAKRRVRDAEADLNLPPGFRFHPTDEELVAHYLCPRAAGRAAPVPIIAELDLYRHDPWDLPHRALFGRREWYFFTPRDRKYPNGSRPNRAAASGYWKATGADKPVLHNGRTAGIKKALVFYHGKPPRGVKTEWIMHEYRLAKKGGAAAAAGAGALRLDDWVLCRLYNKKNEWEKMQSRKEEEEAMAAAQSWGETRTPESEVVDSDAFPEMDYSLPAASFDDALLPKEEARDDDWLMGMSLDDLQGLGSLLQADDLSMLAPPPAAKTEPLGAPFF

SEQ ID NO: 892 - DNA, 658 bp, Glycine max
  Predicted polypeptide sequence is orthologous to G545
cggaacaagccaagaaataaatttatataggaatctgtatatgatgggaattaacttatatttatctttggcataaacattactgatgaaagcaattgttagattgaatcaatgacaaagaagagtccaaaagcaatgaacaaaatttgtctgtacagagtagcagaaacaaaatcccaatcccacctatatactaaaaaaaaacataaaatgaaaattaaactaactggtttgaattcataatcatattcgcgatataccagcaacaaattcaatttcaatcaatttaaaataaaattctgcaaacaaatctacgcggtttcatcatcttcccctgtaaacaaacgcgcgcctcttggcggttaccggcaacgggctttccacctcttgttcaccgcctaccttcttcttcccgaaatcaaaccccatcggcgaccagaactccgtcagcggcgccggaaggttcaggtcaaacccacggagcgtgtgggaggaggaggcagcgccgccgtcggaggtagtggcgccgctgctgttgtttccgttggcgttgctgttactgtggttgttcccgccgtcgtagtggcagcgcttgtggccacccagggcctgaccggtagggaaactcttgtgacagatggagggcggccgcgtacta

SEQ ID NO: 893 - DNA, 1101 bp, Glycine max
  Predicted polypeptide sequence is orthologous to G545
ggccgaatcccggtcgagcgaggctccccacgcgtccgtacggctgcgagacgacagaaggggactcaaaattaaccacaagcataagcacaagcacaagcacaagcacttctctaattccctttcacactctattacagatttcacaagtgcttacacttcaaatggctttggaagctcttcaatcacccaccacagccactccatcgtttagtccctttgaagaaaccagtctcagttacttagagacaccgtggacgaaaggaaagcgttctaagcgtagccgcacggagcaacaactgcaacacccttcatgcaccgaggaagagtacctcgctctttgtctcatcatgctcgctcgcggcggcgccggcagtgtctccaccgccaaacccgctgtctccgacaacaattctgcgccgctatccgccgccaaactgagctacaaatgttcggtttgcaacaaagccttctcctcttaccaagcactcggaggacacaaggccagccaccggaagctcgccggagaaaaccacccgacctcctccgccgtgacgacgagttcggcgtcgaacggtggtggtaggacccacgagtgctccatctgccacaagacgttttcgacaggacaggccttgggaggacacaaacgttgtcactacgaaggcggtaacagcgccgtaaccgcctctgagggagtggggtccactcacacaggaagccaccgcgatttcgatctcaacctcccggcttttccggacttctcagcaaggttcttcgtcgatgacgaggttaccagtcctcatccatccaagaagtcccgtttcaatttgaccatacccaagattgaaatccctcaatactgatgatccatagatccaaaaaaattattcagtgtttttttcttctttcttttttaaagttatttgggattaatttgtccttgtacatatatagtacttgggccttattcgctagttttagcttttagattgtagtcattgtacttttgacagtggcaatgcaattcaattcaattcatttatttttatttgtaaaaaacgcgagactagttccctcgtgccgaattcggcacgaggc

SEQ ID NO: 894 - DNA, 1178 bp, Glycine max
  Predicted polypeptide sequence is orthologous to G545
agcacaccgcgcttacttgctcaccacttgtcacgcaacttccctcatttcctcacgtctttataaaccctcctctcccccctcgcgccccattccgcgtcaactcgatcaactcaacacaaaccaaaactcaagctaaaattctcactctctctctcatctcgagatcatagtatcatattcaatatcatttcataccaaacacatggctttggaagctctcaactcaccaacaacaaccgctccatcttttccctttgacgacccaactattccatgggcgaaacgaaaacgttcaaagcgttctcgcgaccatccttctgaagaagagtacctcgccctctgcctcatcatgctcgctcgcggcggcaccaccaccgtcaacaaccgccacgtcagccctccaccggccgccacagccacagccacagccgacaccagatccttccaccaagctcagttacaaatgctccgtttgcgacaagagcttcccctcttaccaagcgctcggtggacacaaggccagtcaccggaaactcgccgccgccgccgaagaccaaccccccagcaccaccacttcctccgccgccgccaccagctccgcctccggaggtaaggcccatgagtgctccatttgccacaaatccttccccaccggacaggcccttggcggacacaaacgttgtcactacgaaggtaacggtaacggaaataacaacaacagtaacagcgttgtcaccgtcgcctcggaaggcgtggggtccacccacactgtcagtcacggccaccaccgcgacttcgatctcaacatcccggcctttccggatttttcgaccaaggtcggagaagacgaggttgagagccctcaccctgtcatgaagaagcctcgcctcttcgtcattcccaagatcgaaatcccccaatttcaatgaactcgttgaatttttagtttatttttcgactatatattttggagaattttgagagttactataatttgattttgtacatagtacttggaagttttgttggaccgtaccggacccagttctctggttgaggttgtactttcacaacagtggcagatttgcaattcaattcaatttatttgtttattttaattagtaaaaaaaaaaatcaaaattgaaattaaaaaagaaaaaaaaaaaactcgagac

SEQ ID NO: 895 - DNA, 992 bp, Glycine max
  Predicted polypeptide sequence is orthologous to G545
ggactcgagccgagcccaaactcaagttcaccaaaagcaaccacaacaagcacttctcttatttcctatcacaccctattacagattcacaagcgcagacacttcaaatggctctggaagctcttcaatcacccagaactgccactccatcgtttagtccctttgaagaaaccaacctcagttacttggagacaccgtggaccaaaggaaagcgttctaagcgtagccgcatggagcagcaactgcaacactcttcatgcaccgaggaagagtacctcgctctctgtctcatcatgctcgctcacggcggcgccggcggtgtccccgccgccaagcctgctgtctccgacaacaattccgcgccgctacccgccgccaaactgagctacaaatgttcggtctgcaacaaagccttctcctcttaccaagcactcggtggacacaaggccagccaccggaagctcggcggcgagcaccactcgacctcctccgccgtgacaacgagttcggcgtcgaacggcggtgctaggacccacgagtgctccatctgccaaaagacgttcccaacaggacaggccttgggaggacacaaacgttgtcactacgaaggcggtaacagcgccgtaaccgcctctgagggagtggggtccactcacacaggaagccaccgcgatttcgatcctgaacctcccggcttttccggacttttcaacaaggttcttcgttgatgacgaggttaccagtcctcatccatccaagaaatcccgtctcaatttgaccatacccaagattgaaatccctcaatactgatgatccatagatccaaaaaatattcagtgtttttttcttctttcttttttaaagttatttgagattaatttgttcttgtacatatatagtacttggaccttattcgctagttttagcttttagattgtagtcattgtacttttgacagtggcaattcaattcaattcaattcatttatttat

SEQ ID NO: 896 - DNA, 1010 bp, Glycine max
  Predicted polypeptide sequence is orthologous to G545
cccacgcgtcccaacccaacccaaaactcaagctaaattctcactctcacaacttcaatctctttctctctctctctctctctctctctctaccaaaaaaatggctttggaaactctcaactcaccaacaacaaccgccccatctttccccttcgacgacccaactattccatgggccaaaagaaaacgttcaaagcgttgttcacgcgaccacccttcggaggaagagtacctcgctctctgcctcatcatgctcgctcgcggcggcaccacccgccgcgtcagcactccaccgccgcaaccgactccagatccttccaccaagctcagttacaaatgctccgtttgcaacaaaagcttcccctcttaccaagcgctcggtggacacaaggccagtcaccggaaactcgctgcctccggcggcgaagaccaacccaccaccacctcctccgccgccagctccgccaacaccgcctccggaggtaggacccacgagtgctccatctgccacaagtccttccccaccggacaggccctcggcggacacaaacgttgtcactacgaaggtaacagtaatggaaataacaacaacagtaacagctctgtcaccgccgcctcggaaggcgtggggtccacccacaccgtgagtcacggccaccaccgagacttcgatctcaacatcccggcttttccggatttttcgaccaaggtcggagaagacgaggttgagagccctcaccctgtcatgaagaagcctcgccccttcgtcattcccaagatcgaaatccctcaatatcaatgaactctatgaattttttatttttatttttttcgattattttggagaattttgagatttactataatttgattttgtacatagtcctacctggaagttttgttgaaccgtacgtaccggacccagttctctgatttaggttgtactttcacagtgacagatttgcaattcaattcaatttctttatttaatttataaaattatttgatct

SEQ ID NO: 897 - DNA, 390 bp, Glycine max
  Predicted polypeptide sequence is orthologous to G545
gcgtggatcacgcgaccacccttcagaggaagagtaccgtggatcttgactcatcatgcgggctcgcggtggcaccaaccgccgggtcagcactccaccggcgcatccgactccagatgcttccaccaagctcagttacaaatgctccgtttgcaacaagaagcttgccctctgtaccaagcgctcggtggacacaaggccagtcaccatagactcgctgactccggcgaccaagaccaacccaccatgacctacttcggcggcagcttcatcaacaccgactccagaggtaggacccacgaatgctacatctgccacaagtcctttctcaccagacaggccctctgcggacacagacgacgtcactacgaaggtaacagtaatggaaat

SEQ ID NO: 898 - DNA, 650 bp, Glycine max
  Predicted polypeptide sequence is orthologous to G545
ctcgatcaactcaacacaaaccaaaactcaagctaaaattctcactctctctctcatctcgagatcatagtatcatattcaatatcatttcataccaaacacatggctttggaagctctcaactcaccaacaacaaccgctccatcttttccctttgacgacccaactattccatgggcgaaacgaaaacgttcaaagcgttctcgcgaccatccttctgaagaagagtacctcgccctctgcctcatcatgctcgctcgcggcggcaccaccaccgtcaacaaccgccacgtcagccctccaccgccacagtcacggccaccaccgcgacttcgatctcaacatcccggcctttccggatttttcgaccaaggtcggagaagacgaggttgagagccctcaccctgtcatgaagaagcctcgcctcttcgtcattcccaagatcgaaatcccccaatttcaatgaactcattgaatttttagtttatttttcgactatatattttggagaattttgagagttactataatttgattttgtacatagtacttggaagttttgttggaccgtaccggacccagttctctggttgaggttgtactttcacaacagtggcagatttgcaattcaattcaatttatttgtttat

SEQ ID NO: 899 - DNA, 614 bp, Oryza sativa
  Predicted polypeptide sequence is orthologous to G545
gcacgaggctccctgcagctacgtactgtacttgttagcaatcaatcccatcaaatcatccaccggtcgctgctgctgctacgtactatacagcttgattaattaggttttacgacgacggcaacggggacagatatgacggccgccctgcaagcgctgctcgacccgacggcgctgtccttgggcctgcccacgccggcgatcaacaaggaggagtacctcgccatctgcctcgccgcgctcgcctgcacgcgggcggggaaggccctggtgggagtgggaggccagcagcaggtgcaggcctgcaataagtggctgtgcccagcgcccgcggcgcctgaggagctccgcttccggtgcaccgtctgcgggaaggccttcgcctcgtaccaggcgctcggcggacacaagtccagccaccggaagccgccttccccgggagaccactacggcgccgccgccgcggcgcagcagctggcatccgctggtgactcgaaggaggactcggcgtcgtcagcggccgggagcactggcccgcaccggtgcaccatctgcaggaggagcttcgcgacggggcaggcgctcggcggccacaagcgctgcccctactggga

SEQ ID NO: 900 - DNA, 864 bp, Zea mays
  Predicted polypeptide sequence is orthologous to G545
gcggccgccctttttttttttttttaacctcaattggtagatgcctatatggcctatggcttttatctcaagtatatatggctcgacaaaattaaatacacgtttattcaccgcgcaaacacaaaaactaaaatacggttaaaagaatgaagcaacgaaaacactctacaagcctcagatcgccaaaaggaactctaaatcgttaaactaagttcggtggaaggaccggaggacagccgccgcttcttgaccggcaaggggctctgcacctcttcctcctctcgccaccttgccgcgccggcggccggcaccaaattcagatcgaagcccctcaagctcgacgcggaccccgacgccgccgacgcggtgagcgacaccgagagcccgtcccagtaatggcacctcttgtgcccgccgagcgcctgccccgtggcgaagccccggtggcacaccgagcacctgtgcctcccctgcccggcgccgctgccgcccgccgacgaggtattcgtcgtcaccgacgacgacgacgacgccgcctgtacgagcgtcggcggcggcttccggtggctggccttgtgcccgcccagcgcctggtgcgacgcgaaggccttgccgcagacggagcaccggaagcggagctcgcactcttgcgtcgtcatcgtcgtcgtcgtcctggcactggcagccgcagcgtgccctcctcctcctcccgcggctgcgagcgccatgaggcacagggagacgtagtcgtcgtgggtgatggccatctatcggtcacggcgcgcgagcgaggcttgttgaaaagctaatgctgctagctggttaggtttccgctggtttagcaagtccgatcgatgagtcgac

SEQ ID NO: 901 - DNA, 758 bp, Zea mays
  Predicted polypeptide sequence is orthologous to G545
gaattcggctcgagatcgccatctgcctcgccgcgctcgccgggacccgcaagttcgggctcggtcgggagaaggaccagcaccagcacaccaagtggtgcccgacgacgacgacaacccacgcgccatctgcgcagcaggagcttcggttccggtgcgcggtctgcgggaaggccttcgccacctaccaggcgctcggcggccacaagtccagccaccgcaagccgacgacgccggagcggtacgccgccgcccttgccgccgcggcgacgacgacagcggcccggggcgaccactccgacgagacgacggcgtcgtctctgtcggggtcggcggctagcggcgggccacaccggtgcagcatctgccggaggggcttcgccacgggccaggcgctcggcgggcacaagcgctgccactactgggacggcatgtccgtgtcgatctccgtgtcgtccgggatggcgtcgtcgtcgggcctcagtaccgtcaggaactttgacctcaacctggcgccactgccggagaatggcgacgccgggatgatgaagaggtgggccgaggaagaggaggtgcagagtccgttgccgatcaagaagcgcaggatgtcggactgactactcaccgatgccgtcgtgtctatcgtttcatgtaaaaatggatctacgccatcgttgtgtcgttaatttaatttcttttaattaggttctgtttttctggacataaattcgttcaattcattgattcgtcaaaaaaaa

SEQ ID NO: 902 - DNA, 436 bp, Zea mays
  Predicted polypeptide sequence is orthologous to G545
tccgcgggaggaggcccgcaccgatgcacgatctgccggagggggttcgccacgggccaggcgctcggcgggcacaagcgctgccactactgggacggcgcgtcggcgtccgtctccctgtccgcgtccggtacggggtcgtcgggcgtcacactgaggaattttgacctcaacctgatgcccgtggcggagaacgcagggatgaagaggtgggtcgaggaggaggaggtgcagagtccactgccgatcaagaagcgcaggatcttggattagctctcgcgctactaccagcggttgagacctgtgtgcccacagcctcggttcgtgtaaaaaggaagattgattgtttcatcgattatttgattcgttctttacttctttcacactaataaaatatttgattgttgtatcaaaaacctacctccgcggacccatg

SEQ ID NO: 903 - protein, 181 aa, Oryza sativa
  Orthologous to G545
MALAAAARGESTALALALAPPPPELHFRCSLCGKAFASYQALGGHKASHRKPSAAAAAPPAHRDVVVAAAPASSGRVAADADAASEADGRRRRHVCSLCRRGFATGQALGGHKRFHYLHGPSVSATVSSAATAASVGAAFDLNVAPIKEIAGEQRRCGEEADDDDEAESPSPAKKPRRRPG

SEQ ID NO: 904 - protein, 226 aa, Oryza sativa
  Orthologous to G545
MGLNEKPLVPPLSPTPVDFRAHQVFPSKHHDFDTSKSRNISGSVAIGSDSEEEYLATSLLMLAHGIRDETKDIRGMGDVKGVGVDTLELVKPSQRAYECSVCGKVYWCYQALGGHMTCHRNLFAQVVAGDELSSDRTMVVKGHKCSICRLEFPSGQALGGHMRVHYVGGVEGGSVKEKNVVKTKVTGALKLVLKDFDLNVPVVATMVGDEAESSHSEAKARMMTLP

SEQ ID NO: 905 - protein, 200 aa, Oryza sativa
  Orthologous to G545
MVTNMTHDDYVSLCLMALAQAGVGGQWPAQKQQIDMAPPAPERELLRFRCSVCGKAFPSHQALGGHKASHRKPQTTALPMHVIDAPPPPSAEDTASSSTTTTTSGGGRHRCSVCHRTFATGQALGGHKRCHYWDGLSVVSVTASASGSGSSSVRNFDLNLKPVPETVAAGVTRWGEEEEVQNPLPFKKRRLSSPSLELNL

SEQ ID NO: 906 - protein, 220 aa, Oryza sativa
  Orthologous to G545
MTAALQALLDPTALSLGLPTPAINKEEYLAICLAALACTRAGKALVGVGGQQQVQACNKWLCPAPAAPEELRFRCTVCGKAFASYQALGGHKSSHRKPPSPGDHYGAAAAAQQLASAGDSKEDSASSAAGSTGPHRCTICRRSFATGQALGGHKRCHYWDGTSVSVSVSASASAASSAVRNFDLNLMPLPESTAAAGIKRWAEEEEVQSPLPVKKLRMSN

SEQ ID NO: 907 - protein, 247 aa, Datisca glomerata
  Orthologous to G545
MALEALNSPTTATPVFHYDDPSLNYLEPWTKRKRSKRTRLDSPHTEEEYLAFCLIMLARGRVASANRRDSQSSIQIQPEATTSATKVSYKCSVCDKAFSSYQALGGHKASHRKLAGGEDQSTSFATTNSATVTTTTASGGGGRSHECSICHKSFPTGQALGGHKRCHYEGSIGGNSIHHHNNTTNSGSNGGMSMTSEVGSTHTVSHSHRDFDLNIPALPEFRSNFFISGDDEVESPHPAKKPRILMK

SEQ ID NO: 908 - DNA, 566 bp, Oryza sativa
  Predicted polypeptide sequence is orthologous to G546
  misc_feature (498)..(498): n is a, c, g, or t
  misc_feature (503)..(503): n is a, c, g, or t
  misc_feature (546)..(546): n is a, c, g, or t
  misc_feature (548)..(548): n is a, c, g, or t
gcgtcgtcgtccgggccctcgacgcgcgcgacgacgggtgcgcggcagacggggcaggtgggcgcgcgcgtgagcagccaccggtcgacgcactccctgtggaacccatgcccgcacgccggcagcacgcgcacctcgtccccggcggcgtactccgccaggcacaccgcgcagtcgccgctgccgccctcctcgtcggcgccgccgccgccgccgtcgcggggcggcatctggaccacgtgcaccgggatcccgtcgagcgcgcgcttggtctcctcggacggctcggggcgcaccgacgacgacccgccgtcttctcgccgtcgccgcccgccgccgtcgcagaagcaggcgtagagcgcggtgagcgcgatgtaggagacgctggcgacgaagagcaccgtggtggtcacccccagcgcccgcaccatgtgcgcccccgcccccggtccatcgagtgggccgaagccgaacccaagcccggcagcggcggcggcnaggcngtgccggcgccgaggagacggcgcccgcatggctgcatagccncngctctcgtggtggtgcac

SEQ ID NO: 909 - DNA, 418 bp, Zea mays
  Predicted polypeptide sequence is orthologous to G561
cggacgcgtgggattttcgaattttgagaaagttttttttccttataaccttggtatgtctatctagaacctgtcatgtttaggcaataactgttttgtggttcatcgactgcaggatgagagggaattgaagcgcgaaaagaggaagcagtcaaatagggagtccgctagacgatcaaggctgagaaaacaggctgagacagaggagttggctacacaagtggagtctcttgcagcagagaacacgtcccttagatctgaaatcggccggctaacagagagctcagagaagctcagactagagaactcagctctaatggtgaagctgaaggacaccgcaaaaccgtctcccagcaaagcagccgcattcccattctatcccgtgcctcggcggagaacatcctttccatgatcgaca

SEQ ID NO: 910 - protein, 372 aa, Sinapis alba
  Orthologous to G561
MGSSHEEGKSTTQSDKPAQVQAPPPPPPPIQEQSNVHVYHHDWAAMQAYYGTRVAIPPQYYNSNGHAAPPPPYIWGSPSPMMAPYGTPYPPFCPPGGIYAHPGVQMGTQPQGPTSQATPVVTTPLNLEAPANSAGNTDQGFMKKLKEFDGLAMSISNNKAGSAEHSSEPRNSQSSENNDDSSNGSDGNTTGGEQSRKKRSREGSPTNDGKPSSQIVPLLRDENEKQAVTMGTPVMPTAMDFPQPCHGAPREVWNEKEVKREKRKQSNRESARRSRLRKQAETEELSVKVDALVAENMTLRSKLGQLNDESEKLRLENEALLAQLKATQTQATGKTENLISGVDKNNSVSGSSKNVEQQLLNVSLRTDSVAAS

SEQ ID NO: 911 - protein, 358 aa, Raphanus sativus
  Orthologous to G561
QSDKPEQVQAPPPPPEQSNVHVYHHDWAAMQAYYGPRVAIPPQYYNSNGHAPAPPPPYIWGSPSPMMAPYGTPYPPFCPPGGVYAHPGLQMGSQPQGPVSQATPVVTTTPLNLEAPANSPGNTDQGFMKKLIEFDGLAMSISNNKAGSAEHSSGPRNSQSSENDDSSNGSDGNTTGGEQSRKKRSREGSPNDDGKPSSQIVPLLRDENEKPAVTMGTPVMPTAMDFPQPCHGAPHEVWNEKEVKREKRKQSNRESARRSRLRKQAETEELSLKVDALVAENMTLRSKLAQLNDESEKLRLENEASLAQLKATQTQAAGKTENLISRVDNNNNSVSGSSKNVEQQLLNVSLRTDSVAAS

SEQ ID NO: 912 - protein, 376 aa, Brassica napus
  Orthologous to G561
MGKSEEPKVTKSDNKPSSPPADQTNVHVYPDWAAMQAYYGPRVAMPPYYNSAMAAASGHPPPPYMWNPQHMMSPYGTPYAAVYPHGGGVYAHPGFPMPQGQKGATPLTTPGTPLNIDTPSKSTGNTENGLMKKLKEFDGLAMSLGNGNNGDEGKRSRNSSETDGSSDGSDGNTTGADEPKLKRSREGTPAKDEKKHLVQSSSFRSVSQSSGDNNCVKPSVQGGGGAIVSAAGVSANSNPTFMSQSLAMVPPETWLQNERELKRERRKQSNRESARRSRLRKQAETEELARKVEALTAENMALRSELNQLNEKSNNLRGANATLLDKLKSSEPEKRVKSSGNGDDKNKKQGDNETNSTSKLHQLLDTKPRADGVAAR

SEQ ID NO: 913 - protein, 374 aa, Brassica napus
  Orthologous to G561
MGKSEEPKVTKSDNKPSSPPADQTNVHVYPDWAAMQAYYGPRVAIPPYYNSAMAAASGHPPPPYMWNPQHMMSPYGTPYAAVYPHGGGVYAHPGFPMPQSQKGAALSTPGTPLNIDTPSKSTGNTENGLMKKLKEFDGLAMSLGNGNNGDEGKRSRNSSETDGSSDGSDGNTTGADEPKLKRRREGTPTKDEEKHLVQSSSFRSVSQSSGDNVVKHSVQGGGGAIVSAAGVSANSNPTFMSQSLAMVPPETWLQNERELKRERRKQSNRESARRSRLRKQAETEELARKVEALTAENMALRSELNQLNEKSNNLRGANATLLDKLKSSEPEKRVKSSGNGDDKNKKQGDNETNSTSKLHQLLDTKPRADGVAAR

SEQ ID NO: 914 - DNA, 2158 bp, Glycine max
  Predicted polypeptide sequence is orthologous to G562
  misc_feature (2054)..(2055): n is a, c, g, or t
  misc_feature (2057)..(2057): n is a, c, g, or t
  misc_feature (2118)..(2118): n is a, c, g, or t
  misc_feature (2130)..(2133): n is a, c, g, or t
  misc_feature (2150)..(2150): n is a, c, g, or t
  misc_feature (2154)..(2154): n is a, c, g, or t
cggtcgtttgggcagacacacgggcggacgcctgcgccacgcgtccgctctttccctcgttttttaagagagagaaagtagagagagagagaaacacaactgctttgccaaaccttaatttcagggcacttccaagctaacaggaccagttgttgttccctttttgtgttgtttgattcagcgatttctggttttcgttttttttctttctttgttacaaggagagttcgatgtctttaagttgaataacttgttgggacatatttgactcggtgcttttcttttggtgcttgcctcatgggaaacagtgaggatgagaaatctgttaaaactggaagtccttcttcttcacctgcaacaactgagcagaccaaccaacctaatattcacgtctatcctgattgggctgccatgcagtattatgggccaagagtcaacattccaccatacttcaactcagctgtggcttcaggtcatgctccacacccatacatgtggggaccaccacagcctatgatgccaccttatgggccaccttatgcagcattttattcgcatggaggggtttatactcaccctgcagttgctattgggccacactcacatggtcaaggagttccatcttcacctgctgctgggactccttcaagcatagaatcaccaaccaaattatctggaaatactgatcagggtttaatgaagaaattgaaagggtttgatgggcttgcaatgtcaataggcaattgcaatgctgagagtgctgagcgtggagctgaaaacaggctgtcacagagtgtggatactgagggttccagcgacggaagtgatggcaacactgcaggggctaatcaaacaaaaaggaaaagaagccgagagggaacaccgaccactgatggagaagggaaaactgagctacaaaatggtccggcttccaaagagactgcatcttccaaaaagattgtgtcagctaccccagctagtgttgcaggaacattagttggacctgtagtttcttcaggtatggccacaacactggagctgaggaacccttcgactgttcattctaaggcaaattccacaagtgccccacaaccttgtgcaattgtgcctaatgaaacttgcttacagaatgagcgtgagctgaaacgggagaggagaaaacaatctaaccgtgaatctgctagaaggtccaggctgaggaagcaggccgagactgaagaattggcacgaaaagttgatatgttaactgctgagaatgtgtccctgaagtcagaaataactcgactgactgaaggttctgagcagatgaggatggaaaattctgcattgagggaaaaactgataaatactcaactgggaccaagggaagagataactttgagcagcattgacagcaagagggctgcacctgtaagtacagaaaacttgttatcaagagttaacaattccggatctaatgatagaactgcagagaatgagaatgatatctgcgagaacaaaccaaattctggtgcaaagctgcatcaactactggatacaaatcctagagctaatgctgtagcagctggttgaaaccagtaactgcactggctaattatgtaattttggcatattacaagcccaaaattacagcttggtgctaacagttttcagagggatggatcagctgaattttacaatctaattccatctatatagaccagaactaattctttgcttgtgagtttcttagggcataaactctgtattttactagatttcacagaattgaatgacaactttaaaagtttgtaaattgaagagtattagggatttagtttagactttaagagaggcttgtcggccgctgtataattggttgtgtattaactatattggtgtgatctttctaatggtatcttagtcaaggcattctgacttttggttagttttggttttgtatactttaaagcaattcctcatgttgtggctgtggttgccttttaccatgtgtttgttaccacttagtgtgcatttggattgaattaattttagaaatgttaatctgaatgatnnanaaaaaaaaaaaaaaaaaaaaaaaaaaaaaaaaaaaaaaaaaaaaaaaaaaaaaaaaaaaanaaaaaaaaaaannnnaaaaaaaaaaaaaaaanaaanaaaa

SEQ ID NO: 915 - DNA, 1715 bp, Glycine max
  Predicted polypeptide sequence is orthologous to G562
tcgcttcgggatgttttcttggttaccaagattatataggatcatgtgtagattttagatggcagaaatcttggtttatgaattttgtcttgtcccttgcaatattttcatgccgataataattaacaagctgacatggctcctgttaatgcagttgagacatttttcaagaagtagtaaagctccttctacaatattttttgacttggtgctttccttttggatcttacaatgggaaacagtgaggaagagaaatctgctaaaactggaagtccttcttcttcacctgcaacaactgagcagaccaaccaacctaatattcacgtctatcctgattgggctgccatgcaggggccacactcacatggtcaaggagttccatcttcacctgctgctgggactccttcaagcgtagaatcaccaaccaaattctctggaaatactaatcagggtttagtgaagaaattgaaagggtttgatgagcttgcaatgtcaataggcaattgcaatgctgagagtgctgagcgaggagctgaaaacaggctgtcacagagtgtggatactgagggttccagcgacggaagtgatggcaacactgcaggggctaatcaaacaaaaaggaaaagaagccgagaaggaacaccgatcactgatgcagaagggaaaactgagctacaaaatggtccggcttccaaagagactgcatcttccaaaaagattgtgtcagctaccccagctagtgttgcaggaacattagttggacctgtagtttcttcaggtatggccacagcactggagctgaggaacccttcgactgttcattctaaggcaaattccacaagtgccgcacaaccttgtgcagttgtgcgtaatgaaacttggttacagaatgagcgtgagctgaaacgggagaggagaaaacaatctaaccgtgaatctgctagaaggtccaggctgaggaagcaggccgagactgaagaattggcacgaaaagttgagatgttaactgctgagaatgtgtctctaaagtcagaaataactcgactgactgaaggttctgagcagatgaggatggaaaattctgcattgagggaaaaactgataaatactcaactgggaccaagggaagagataactttgagcagcattgacagcaagagggctgcacctgtaagtacagaaaacttgttatcaagagttaacaattccggagctaatgatagacctgcagagaatgagaatgatatctgcgagaccaaaccaaattctggtgcaaagctgcatcaactactggatacaaatcctagagctaatcctgtagcagctggttgaaaccagtaactgcactggctaattatgtaattttggcatattacaagcccaaaattccagcttggtgctaccagttttcagagggatggatcagctgaattttacaatctaatcccatctatatagaccagaactaattctttgcttgtgagtttcttagggcataaactctgtattttactagatttcccagaattgaatgccacctttaaaagtttgtaaattcaagagtattagggatttagtttagactttaagagaggcttgtcgccccctgtataattggttgtgtattaactatattggtgtgatcttcctaatggtatcttagtcaaggcattctgactttgggtcaaaaccaaaaaaaaaaaacaatatttaat

SEQ ID NO: 916 - DNA, 1775 bp, Glycine max
  Predicted polypeptide sequence is orthologous to G562
cccccgcgtccgcccacgcgtccgccctcgcggacacttggagctgcgagcactagttttcccttttccccttgtttgtttttttaggataataattgaccaattgggtatcttgtcagttgagacatttttcaagaagtagcaaagctccttctacaatatttgacttggtgctttccttttggatcttacaatgggaaacagtgaggaagagaaatctaccaagactgaaaaaccttcttcacctgtaacagtggatcaagccaatcagaccaaccagaccaatattcatgtctatcctgattgggcagccatgcaggcatattatgggccaagagtcaccatgccaccatactacaactcagctgtggcttctggtcacgctcctcacccatacatgtggggaccaccacagcctatgatgccaccttatgggcctccttatgcagcaatttatccacatggaggggtttatactcaccctgcagttcctattgggccacatacacatagtcaaggagttccatcttcacccgccgctgggactcctttgagcatagagacaccacccaaatcatctggaaatactgatcagggtttaatgaagaaattgaaagagtttgatggacttgcaatgtcaattggcaatggccatgctgaaagtgcagagcgtggaggtgaaaacaggctctcacagagatggagaagggaaaactgagatacaaggcagtccaatttccaaagagactgcagcttctaataagatgttgggagttgtccctgccagtgttgcaggaacaatagttggacatgtagtttcttcaggtatgaccactgcactggagctgagaaatccttccagtgttcattctaaaacaagtgccccacaaccttgtccagtattgcctgcagaagcttgggtacagaatgagcgtgagctgaaacgggagaggcggaaacagtcaaatcgagaatctgctagaaggtccagactaaggaagccaggctgaaactgaagaactggcacgaaaagttgaatccttgaatgctgagaatgcaacactgaaatcagaaattaatcgactgactgaaagttctgaaaaaatgagggtggaaaagtttttgactcagggaaaacttaaaaatgctcaactgagacaaacacaagagataactttgaacataattgacagccagagggctacacctataagtacagaaaacttactatcgagagttaataataattccggttctaatgatagaactgtggaggatgagaatggtttttgcgaaaataaaccaaactctggtgcaaagctgcatcaactactggacacaagtcctagagctgatgctgtggcagctggttgatacagaaaaccagtaattgtactggctgatcagaggtagttttggcatattacaagcccaaaattactactaacaatttcctgagggatggatcagctgaattttagtatctaaatccatcaaaatcagaactaattcattgtttacttaggacaaaactctgtattctattagatttgacaaaaatggatgaccaagtttgtaaaatgaagagaactagagatttcagattggagggggtttgttgaaacgctacataattgcgtatgtattaacgattggtgtggagactttctaatgatatctacgcagttattctgccttattatttgtttggtttgtattttgtgctagctaaaaaaaaaaaaaaaaaaaaaaaaaaaaaaaaaaaaaaagggcgc

SEQ ID NO: 917 - DNA, 1597 bp, Glycine max
  Predicted polypeptide sequence is orthologous to G562
agtagaaccattatcctcattgtcttatttcttccatgctccaaagtcaagtgattctgtagctacttcttccttgggacgacaccaagcttattttttatttaaaaatacttagtgtatttccattttcttttttgtggatgaagcaatgaactgatgaaagcttcttatattccctcttgtgaattattgtttatcctctcagaatataaatattagagtgtcattcctgtggtgcattgtattacctattctgtgttttgtgagttgttatcaatatgtacccctaatcaatgtcagactgaaattatgcactgaattgctactggatttggcaatcagttggggtaatatctaggatgagatgtgctttgtccctggattgctcaatctgtaaaaaaaacattgattcgatggtataaaactattaattttatccctttcaaattggttcacccagcaagttttcaagtgtgtttggtctctagtgtagtgaatagtgactgtattataatttaaaatgtctactatatcttcaggcatattatgggccaagagtcaccatgccaccatactacaactcagctgtggcttctggtcacgttcctcacccatacatgtggggaccaccacaggtagcccttctgtcgtcttctcgcagccgtgcagcaatttatccacatggaggggtttatactcaccctgcagttcctattgggccacttacacatagtcaaggagttccgtcttcacctgctgctgggactcctttgagcatagagacaccacccaaatcatctggaaatactgatcagggtttaatgaagaaattgaaagagtttgatggacttgcaatgtcaattggcaatggccatgctgaaagtgcagagcctggaggtgaaaacaggctctcacagagtgtggatactgagggttccagtgatggaagtgatggcaacacttcaggggctaatcaaacaagaaggaaaagaagccgtgagggaacaccaaccactgatggagaagggaaaactgagatgcaaggcagtccaatttccaaagagactgcagcttctaataagatgttggcagttgtcactgctggtgttgcaggaacaatagttggacctgtagtttcttcaggtatgaccaccacgctggagctgagaaatccttccagtgttcattctaaagcaagtgccccacaaccttgtccagtattgcctgcagaaacttggttacagaatgagcgtgagctgaaacgtgagaggcggaaacaatcaaatcgagaatctgctagaaggtccagactaaggaagcaggctgaaactgaagaactggcacggaaagttgaatccttgaatgctgagaatgcaacactgaaatcagaaataaatcgactgaccgaaagttctgaaaaaatgagggtggaaaatgctacattaaggggaaaacttaaaaatgctcaactgagacaaacacaagagataactttgaacataattgacagccagagggctacacctataagtacagaaaacttactatcgagagttaataataattcccggttctaatgatagaactgtggaggatg

SEQ ID NO: 918 - DNA, 538 bp, Glycine max
  Predicted polypeptide sequence is orthologous to G562
  misc_feature (327)..(327): n is a, c, g, or t
cttctgttcattctaaggcaaattccacaagtgccgcacaaccttgtgcagttgtgcgtaatgaaacttggttacagaatgagcgtgagctgaaacgggagaggagaaaacaatctaaccgtgaatctgctagaaggtccaggctgaggaagcaggccgagactgaagaattggcacgaaaagttgagatgttaactgctgagaatgtgtctctgaagtcagaaataactcgactgactgaaggttctgagcagatgaggatggaaaattctgcattgagggaaaaactgataaatactcaactgggaccaagggaagagataactntgagcagcattgacagcaagagggctgcacctgtaagtacagaaaacttgttatcaagagttaacaattccggatctaatgatagaactgcagagaatgagaatgatatctgcgagaacaaaccaaattctggtgcaagctgcataactactggatcaaacctagagctatgttgagcactggtgaacagtactgactgctaatatgtatt

SEQ ID NO: 919 - DNA, 2359 bp, Zea mays
  Predicted polypeptide sequence is orthologous to G562
tttcaattctgcgggcaatgcgttgatttctcccgcctctctgcgcggattcatgcagcatccagctgcatccagttatttggcttagcctcgtcgtttatattagagtagttcgtgggcgatgattattattacggtggctaaattcgagttatgcacatattcatcacggagaccccgagagttggtgcatgatgcactgaatcccagctgcacatgtttaaaacagcgacacagttatatcccagtaggaggtattattttctattgatcttttgagtgcagcatcgtcgcgtcagcagcggcgaagctctatactggtcagacccattaggtgtattccattcccacctacagtcggtgaatcactcgtctgcatctcatcgaagctggtgatgcaagctttgcatgcatccttagcttattaactggtgaagtggtttctttcgccctgtaactctttgggtgtaacttatggagagcgattagcaaattattaccgttttagatagttctgcgtcaagattttaaaccatttttttctgtaagttttttgctgtctctgtcaccctttgcgtgaagagagctaggtgggccgtagaaaaggcttcagttcagatctcatttcagatagcacaggaccaatctggtctgcagtgttcaactggaatataagatttcgctgcataggtcaaaggtttgtacgagtgaaaaaggtatttatttttaagttcatttagtattattttggctggctgaattgtatatttctatgttattttactatactattgaaaaaatgagtaaattgtatgttgtgataatctgaacttttacatgacagactagcagatactgtcatggctcaggatgaagctgtggctacccaaaagactggaaatacaacatctccttctaaggattacccaactccttctccatatcctgattggtcaaccatgcaggcatattatggccctggtgtcttgccaccaacatattttactcctgcaatagctccaggtcatccaccgccatatatgtggggtcctcagcctataatgccaccccctttcgggacaccatatgctgcagtatacccacatggtggagcttacccacacccccttgtgcccatgatgtcaactccaatgagcgtggagccagccaaatctacaaatagcaaggagaaaaattccaataagaaacttaaggaaatagatcggactgcagtgtctgctggcagtggtaacagtaaaagaacagtgtcatccattgaagattacagtgcagaaggctcaagcgatgtaaacgatcagaatgtgaacgaaacgtccaggaagcggagctcagatggtggacctggcgcagaaaccaccacaggtggaaacacggaatgtgttttagctcctaaccatacgctggggaatgctaccattttgccacaacactgcttttcagctccagtaattaagcccagtgctacaaatgtcgcgaactcgagggcgataggcacggcattatctccaccacctggtgtgatggttccagttcataatgcagtaccatctgacttatcagttaaggatgagagggaattgaagcgcgaaaagaggaagcagtcaaatagggagtctgctagacgatcaaggctgagaaaacaggctgagacagaggagttggctacacaagtggagtctcttgcagcagagaacacgtcccttagatctgaaatcggccggctaacagagagctcagagaagctcagactagagaactcagctctaatggtgaagctgaaggacaccgcagaaccgtctcccagcaaagcagccgcatccccatcctctccccgtgcctcggcggagaacttcctttccatgatcgacagcgccaacgcgccgagcgtcagcaggcacacggagcacggcggtcccaggctccggcagctcctggactccagtccggcgacagacgtcgccgccgtaagctgatgatgaagccggtccggcaaatacgccacagcacatgcatgtggcctggggattccgcaggctcatgcggctcgagtgctcgccgtaaacgtcagcgttacggactcggactctgtactccagtttaggcactgattccaccgagggtaccggtaattttatctgctctcgcgccagagtgccgggctgcctgcgaccactcctgtgtacccagagttgtaacgtagtagggtgttgtgctgcatgccgaccttttgaaacttttcgagaccgtcatttggaccatttttttcgtcgcaataacacaatacagatcggagtttgtacaggaaaaaaaaaaaaaaacaaaaaaactcgaggggggg

SEQ ID NO: 920 - DNA, 1646 bp, Zea mays
  Predicted polypeptide sequence is orthologous to G562
cctttgcgtgaagagagctaggtgggccgtagaaaaggcttcagttcagatctcatttcagatagcacaggaccaatctggtctgcagtgttcaactggaatataagatttcgctgcataggtcaaagactagcagatactgtcatggctcaggatgaagctgtggctacccaaaagactggaaatacaacatctccttctaaggattacccaactccttctccatatcctgattggtcaaccatgcaggcatattatggccctggtgtcttgccaccaacatattttactcctgcaatagctccaggtcatccaccgccatatatgtggggtcctcagcctataatgccaccccctttcgggacaccatatgctgcagtatacccacatggtggagcttacccacacccccttgtgcccatgatgtcaactccaatgagcgtggagccagccaaatctgcgaatagcaaggagaaaaattccaataagaaacttaaggaaatagatcggactgcagtgtctgctggcagtggtaacagtaaaagaacagtgtcatccattgaagattacagtgcagaaggctcaagcgatgtaaacgatcagaatgtgaacgaaacgtccaggaagcggagctcagatggtggacctggcgcagaaaccaccacaggtggaaacacggaatgtgttttagctcctaaccatacgctggggaatgctaccattttgccacaacactgcttttcagctccagtaattaagcccagtgctacaaatgtcgcgaactcgagggcgataggcacggcattatctccaccacctggtgtgatggttccagttcataatgcagtaccatctgacttatcagttaaggatgagagggaattgaagcgcgaaaagaggaagcagtcaaatagggagtccgctagacgatcaaggctgagaaaacaggctgagacagaggagttggctacacaagtggagtctcttgcagcagagaacacgtcccttagatctgaaatcggccggctaacagagagctcagagaagctcagactagagaactcagctctaatggtgaagctgaaggacaccgcagaaccgtctcccagcaaagcagccgcatccccatcctctccccgtgcctcggcggagaacttcctttccatgatcgacagcgccaacgcgccgagcgtcagcaggcacacggagcacggcggtcccaggctccggcagctcctggactccagtccggcgacagacgtcgccgccgtaagctgatgatgaagccggtccggcaaatacgccacagcacatgcatgtggcctggggattccgcaggctcatgcggctcgagtgctccccgtaaacgtcagcgttacggactcggactctgtactccagtttaggcactgattccaccgagggtaccggtaattttatctgctctcgcgccagagtgccgggctgcctgcgaccactcctgtgtacccagagttgtaacgtagtagggtgttgtgctgcatgccgaccttttgaaacttttcgagaccgtcatttggaccatttcccccgtcgcaataacccaattcagatcggagtttgttccggaaatatgtaaaaaaaaaaaaaaaaaaaaagggcggccg

SEQ ID NO: 921 - DNA, 1807 bp, Zea mays
  Predicted polypeptide sequence is orthologous to G562
cattgggtacctcgaggccggcccctcgcggcccccacgcgctcccgggctcccctgcctcgccgcctctctccctgtcgtacccacctgccccctcgcggtctctctctccttcctgattggatcaatctggcctcgcggctccgactgatccgtggcgcctcgctcccgagcggaaccaccacctgatttgacgagactagcagatactgtcatggctcaggatgaagctgtggctacccaaaagactggaaatacaacatctccttctaaggattacccaactccttctccatatcctgattggtcaaccatgcaggcatattatggccctggtgtcttgccaccaacatattttactcctgcaatagctccaggtcatccaccgccatatatgtggggtcctcagcctataatgccaccccctttcgggacaccatatgctgcagtatacccacatggtggagcttacccacacccccttgtgcccatgatgtcaactccaatgagcgtggagccagccaaatctacaaatagcaaggagaaaaattccaataagaaacttaaggaaatagatcggactgcagtgtctgctggcagtggtaacagtaaaagaacagtgtcatccattgaagattacagtgcagaaggctcaagcgatgtaaacgatcagaatgtgaacgaaacgtccaggaagcggagctcagatggtggacctggcgcagaaaccaccacaggtggaaacacggaatgtgttttagctcctaaccatacgctggggaatgctaccatttttgcacaacactgcttttcagctccagtaattaagcccagtgctacaaatgtcgcgaactcgagggcgataggcacggcattatctccaccacctggtgtgatggttccagttcataatgcagtaccatctgacttatcagttaaggatgagagggaattgaagcgcgaaaagaggaagcagtcaaatagggagtccgctagacgatcaaggctgagaaaacaggtgtgctgtgtgatacagttgtacaatgaagcagcatcctgaaacatgggagtggagtctggcttggattatttgtcctaacaacatatcttcaatcttatacttatgccctcccttggtgtaggctgagacagaggagttggctacacaagtggagtctcttgcagcagagaacacgtcccttagatctgaaatcggccggctaacagagagctcagagaagctcagactggagaattcagctctaatggtgaagctgaaggacaccgcagaaccgtctccgagcaaagcagccgcatccccgtcctctccccgtgcctccgcggagaacttcctttccatgatcgacagcgccaacgcgccgagcgtcagcaggcacacggagcacggcggtcccaggctccggcagctcctggactccagtccggcgacagacgtcgccgccgtaagctgacgatgaagctggtccggcaaatacgccacagcacatgcatgtggcctggggattccgcaggctcatgcggctcgagtgctcgccgtaaacgtcagcgttacggactcggactctgtactccagtttaggcactgattccagtgaagtaaccgagggtactcgtaattttatctgctctcgcgccagagtgccgggctgcctgcgaccactcctgtgtacccagagttgtaacgtagtagggtgttgtgctgcatgccgaccttttgaaactttggagaccgtcatttggaccatttttttcgtcgcaataacacaatacagatcggagtttgtac

SEQ ID NO: 922 - protein, 380 aa, Oryza sativa
  Orthologous to G562
MAHDEAVATQKIGKTTSPPKDQPTPCPFPDWSAVQAYYGPGVLPPTYFAPAIASGHAPPPYMWGPQPIMPPPFGTPYAAMYPHGGAYPHPLMPMMANPLSMEPAKSASSKEKGSNKKLKEVDGAAVSTGSGDSKKTMTSSGDYSAEGSSDVNDLKVGKTGRKRRLDDGAGAETSAAAKMENALPPSHILGSTAILPNHSFPAQVIRPSATNVANSRALGTPISPPPGVIVPSHTGVSTELLIKDERELKREKRKQSNRESARRSRLRKQAETEDLATQVESLTAENTSLRSEISRLSESSEKLRLENSALMGKLKDPAASTQAETSLQKTTTASSPRVVENFLSMIDNTNKTSVRHTEHAEPKLRQLLGSGPATDVVAAS

SEQ ID NO: 923 - protein, 191 aa, Oryza sativa
  Orthologous to G562
MPLDFGLPDMDVGFGLFGVDAAAFGYDGVASDAAAGLSPVVGAGDGSGGGGDVLLYCDGGGGGGGGGEDGEEERRRRLRRKISNRESARRSRARRRQRVEELERAADELRAERRALASRLNATARRALAVRGANARHHAEAGVLRRRLGEAQRNAAVLIGLSRLLRSTANGAHGGAAPAQLSNGGVASLMT

SEQ ID NO: 924 - DNA, 1019 bp, Glycine max
  Predicted polypeptide sequence is orthologous to G567
attcggctcgagacagaatcataggaaaggagacgtacgatacgatacgatacgatatggatagggtattctcagtggacgatatctccgatcatttctggccgccgcctccgatccccgtctccggcgccaacacctcctctcagatgagccgcagcgcctccgagtgggcctttcagcgcttcatccaggaagcttccgcctccgcaccctctcctccgtcttcttcctccgccgccgacgtcgtattcgtcgagatcgaagatcaacctaaacccgcccctccccctccgacaaacggcgccgttctccccaatgcccctggtcccgtcccccttgactccgacgaataccaggccttcctcaagagcaagctcaacctcgcatgcgccgccgtcgccatgactaggggatctttggctaaatctcaagacccgtcccctttttctgaaggtggatcacagccgactaatccttctctagttgaatctcagactacttctaaaggatctattccttctgaaaatgatccatctaagttacaagataaagataccaatgtaccagttgggattccttccatacctgccatgcaaaagaaacctgctgttgcaattaggccatctacaagtggatcatcaagagaacagtcagatgatgaggacattgagggagagacatctatgaatgacaacacggaccctgctgatgtaaaacgagtaaggaggatgctatccaatagggagtcagcccgacgctctagaagaagaaagcaggctcatttaactgacctagaaacacaggtttctcaattaagaggtgaaaattctaccttgttaaagcgccttactgatgttagccagaaatacagcgactctgctgttgacaacagagttctgagagccgatgttgaaacattaagagcaaaggtaaatccttgccttagtatataggccttaagtaaaacctgttacataggagacctactggactcttgctaagcagttccctaggtttgg

SEQ ID NO: 925 - DNA, 1881 bp, Oryza sativa
  Predicted polypeptide sequence is orthologous to G567
gttgttacttacgcatattttgccgttagttaattattatccggtaaagaagattagtagtaatccaaaattttcccaaccccaacctcggaacaaaaaccgcgtagtatttgtcgtaaccaggagcatccgagtcattaatttacacccaaacacaaaaaattagcagcacgcagccgccttcccaacccccttcccaatcctctcctcttctccaagcggcaattcgcgcgaggttttctccgatcaaaccctcgaatccccccctcgcgaatccatcggagggtagccccgcgatccgcgtcggcgagagcggattccgattccgcgatggagcgggtgttctccgtggaggagatctccgacccattctgggtcccgcctccgccgccgcagtcggcggcggcggcccagcagcagggcggcggcggcgtggcttcgggaggtggtggtggtgtagcggggggcggcggcggcgggaacgcgatgaaccggtgcccgtcggagtggtacttcccgaagtttctggaggaggcggtgctcgatagccccgtcccgaaccctagcccgagggccgaagcgggagggatcaggggcgcaggaggggtggtgccggtcgatgttaagcagccgcagctctcggcggcggcggcggcggcggcgacgacgagcgcggtggtggaccccgtggagtacaacgcgatgctgacgcagaagctggagaaggacctcgccgcggtcgccatgtggagggcctctggcacagttccacctgagcgtcctggagctggttcatccttgctgaatgcagatgtttcacacataggcgctcctatttccatcggaggcaatgctactccagttcaaaacatgctaagtggccctccccgggctgcgggctcacagttggtacagaatgttgatgtccttgtaaagcaggccaccagctcttcatcaagggagcagtcagatgatgatgacatggagggagaagctgagaccactggaactgcaagacctgctgatcaaagattacaacgaaggaagcaatccaatcgggagtcagccaggcgctcaagaagcagaaaggcagctcacttgaatgagctggaggcacaggtatcgcaattaagagtcgagaactcctcgctgttaaggcgtcttgctgatgttaaccagaagtacaatgatgctgctgttgacaatagagtgctaaaagcagatgttgagaccttgagagcaaaggtgaagatggcagaggactcggtgaagcgggtgacaggcatgaacgcgttgtttcccgccgcttctgatatgtcatccctcagcatgccattcaacagctccccatctgaagcaacgtcagacgctgctgttcccatccaagatgacccgaacaattacttcgctactaacaacgacatcggaggtaacaacaactacatgcccgacataccttcttcggctcaggaggacgaggacttcgtcaatggcgctctggctgccggcaagattggccggacagcctcgctgcagcgggtggcgagcctggagcatctccagaagaggatgtgcggtgggccggcttcgtctgggtcgacgtcctgagaccgaaacccagagctgcttcggttctgaaagacactgcgagcaggaaatgatgattggacaggcgtagacattgctaatgctgtgaggttgatgattgttggtcgtcgtcgtcgtcattgtgcattctttgtaagggacacctcttagtaccctcttcttctaagggacttagtaccccttgtggatctcatcgtcctctcgtgccgctcgtgccgctcgtgccgaattcggcacgagctcgtgccgaattccagctgagcgccgtcgcta

SEQ ID NO: 926 - protein, 284 aa, Oryza sativa
  Orthologous to G567
ASGTVPPERPGAGSSLLNADVSHIGAPNSIGGNATPVQNMLSGPSGGSGSQLVQNVDVLVKQPTSSSSREQSDDDDMEGEAETTGTARPADQRLQRRKQSNRESARRSRSRKAAHLNELEAQVSQLRVENSSLLRRLADVNQKYNDAAVDNRVLKADVETLRAKVKMAEDSVKRVTGMNALFPAASDMSSLSMPFNSSPSEATSDAAVPIQDDPNNYFATNNDIGGNNNYMPDIPSSAQEDEDFVNGALAAGKIGRTASLQRVASLEHLQKRMCGGPASSGSTS

SEQ ID NO: 927 - DNA, 856 bp, Glycine max
  Predicted polypeptide sequence is orthologous to G568
  misc_feature (831)..(831): n is a, c, g, or t
  misc_feature (841)..(841): n is a, c, g, or t
  misc_feature (848)..(849): n is a, c, g, or t
  misc_feature (851)..(853): n is a, c, g, or t
  misc_feature (855)..(855): n is a, c, g, or t
atggcctcgtggccacccaaacctgcagagatattttgttcgtttgagtgtgagagagaaagcgatggcctcatcaccatgtgattgctggccccattcttcttcttcttcttcttctcccattgaacatgtctggaacgacatcaaactcgcctctctctccaattcctccgttgacttagacttgaacaacaacaaccactctgtctccgtttcttctttccttaaccaacctctttccacttttctcactctcacttctacttcctcttcctcctctgtctttcacaaacatgaccactctcttctctctgtctccgaccccaacaccctgcaagatcaacgccatacgcgtgtgatcaagaatcgagaatccgcggttcggtccagagccagaaaacaggcttatagaaaaggcttggaagttgaaatttcccgtttaacggaagagaattccagactaaaaagacaattgaaagagttgcagcgctgtttgtgctcctctcacactcccagaatggccgctccgtgtagaacctcttcatctccattttgagaaggaaaggaacccgtgaatatggcatgactcttgcatgttttcacctttcaaatgtttgtgaaagaaacacaaggattataaatggattgaattttaatagggttttttttttgaggaagagttttgataaccctggttttgtagttttgactaagtttgtctagtagttgggatttgagtaattaacatggaatcttaaatttaagcttcgttaccattattgtatatattaaaaaaaaactggctgctttctgttagcaagactaataaanaaaaaaaaanaaaaaannannnana

SEQ ID NO: 928 - DNA, 520 bp, Glycine max
  Predicted polypeptide sequence is orthologous to G568
ggggtgaagcatggcctcatggccacccaaacctacagagattttttgtgtgcatgcgagggagaaagcgatggcctcatcgccatgtgattgctggccccatctctctcctccttcttccattgagcatgtctggaacgacatcaaactcgactctctctccaattcccctgttgacatagacttcaacaacaaccactctgtctctgattcttcttttcttaacctcacttccacttcctcttctgtctttcacaaacatgaccatgaccactctcttctttctgtctccaacacttccttcgaagcctccggctctaagaaaaccaccctgctagatcaacgccatgcgcgtataataaaaaatcgagaatccgcggttcggtccagagctagaaaacaggcttatagaaaaggcttggaagttgaaattgcccgtttaacggaagagaattccagactaaaaagacaattgaaagagttgcagtgctgcttgtcctcctctgataaccctcccact

SEQ ID NO: 929 - DNA, 917 bp, Oryza sativa
  Predicted polypeptide sequence is orthologous to G568
ttgaaaaaaattgaacaggatactgcatgctgatcgagttgaacaagtaagaaaaggtgttcatctttgcagagacaagatctaacacatttctaactgcagaggtagttcatagcatccatcgatcacctacacacaatatcctctctcatgcctgacccctgcacaaacgcacaccggattgcaaatacacataatttagatctttctaatgattttgtatcgtcagataatcttgcttgttttggtcgaccttcagaattgagttgatgaagttcgtcgcagtgagctctttgtaggcatcaccagtgcagcaacctcctgtttcagctctttgcactgcttcttgagattcaagttgtcatccaccagccggcgaacctctttctctagctcttcaacgtacgccctcttgcgcgccctggagcgaagcgcggactcccggttcctcatcatccggatggtcctccggtcgtcgccgctgccgccgctctgctgccgcaccctccacctccacctcctcgcccccgcgggtactggcgccgccgacgatcccggccagcgacaccggcgtggcgggcagcgcggcgccggcgaggcggacgccgccgccgtcgtcgtcgtccctcagggtggagatggagaagagggagctgcagccgctcatgatgctcagctgcgggctgtccggctccctcggccacgccaccgccgccgccgccgccatctggtagtactcctggtggtggtagttcgccatggccgcaccctgcacctgcaccttcttgcttgtagctgcaggatccttaattcgatcgccaacagctgcagttagtgctccttgcttttggttgttgttgctaagcttgtctctggctctctctctctctctctctctctctctccggacgcgtggg

SEQ ID NO: 930 - DNA, 948 bp, Oryza sativa
  Predicted polypeptide sequence is orthologous to G568
ttgttgttttttttttttttgggtttttttttttttttccgtgtctcatacaatttatattaatttgggtcttgcagcaagcaagcaaacaagggtatgcaaaagttagccggtgacacaaacaattaagcatgcatgtatgcatccatgtgtagcggatgatcgacacagtaacaaaatagagtacttacgtactaccggaatgcatggaaagccaagccggcggatcagagtgagttgttgttacttgctagagactcttgctggagctggacagccaacccaattaaataatggtccccaatccaatggctgcccgctaccttgcctatgcttaattaattaaaggcttaagctgctgcgttctgatcaagtggatgagcttcttcggtgggaactctgcttgttggtaggctgctggatcagagcagccatctccgtcttaagttgtttgcagtgcctcttgagcttgagattctcattcaccagccggcgaacttccttctccagctcctgcacatacgccctcttccttgccctggagcgcagcgccgactccctgttcttcatcatccggatggtcttgcgctcctcctcttcctcgtcgccgccgccgccaccgccaccgcctatgcccacctgcagcagcagatccagctcctcggcgccgcccacgccgagggatagatggggagcaccatcggcggcgctggtaccggcgctggagatggaaaggaaggagctgcagctgctcaggcttagctgcgggctgcccacgccgcccagctgctccgccatgcctaccctattattgtgcctctcttttctttttcttcttttagctaagctaaagctagtgtgtgagtctagtagacccgaccgtgggccctcctcctcctcctcgtcccccccctttggtactccgtcgcatcagcagcaaaagtgcgc

SEQ ID NO: 931 - DNA, 525 bp, Oryza sativa
  Predicted polypeptide sequence is orthologous to G568
tctctctgtgtgtttgtgtcacactcacgctgagcttgcgagcttgcttgctcagaggaggtaaagaaaccgaccgcgaggaggtctcgtcggccgcccccgccggtgtcccgccgccggggaccgccgcaagaggcggatgatcaagaaccgcgagtccgcggcgaggtcccgcgcgcgcaagcaggcccgcgtcaacaaccgggagaccgaggtggagcagctcaagcaggagaacaagatgctccgcgtcaagtacgagcagctgaggaagacggtggaggtgccggcgccggtgaggaggactctgcagagggtgctctccgcgccattctgattcttcctcctcatcgatctcctgctgctgctgctgctgctttgtgatgatcttggatttgtttttggagatggtggtggattagtagcttgtgttgctgtgatgatgcttaattagcagcaaagctagctaatccaggcatgtacattcaggtggacgaacttagctactatggttactactactac

SEQ ID NO: 932 - DNA, 427 bp, Zea mays
  Predicted polypeptide sequence is orthologous to G568
gaaaaaatgcacacagcacaagtccaacaaccatattccttctcgatcttaactttgtactgctactgctaccaccaaatatataaatctatatatttcatttcccttcgccccttcagaattgggtggatgaggttctccgaagtgagctcttggttgggaggaccagtgccgctacctcccgtttcagctctttgcactgcttcttgagcttcaagttgtcatccactagccggcgaacctctttctccaggttctccacgtatgccctcttcctggccctggagcggagcgcggactcccggttcctcatcatcctgatgctcctccgatcgtcgccgctggcctgctgcacctccatgtcgacctcgttgccgacgaagcccgcgagcgagacgggcgtggagggcagcgcgtggccggcgcg

SEQ ID NO: 933 - protein, 142 aa, Oryza sativa
  Orthologous to G568
MAEQLGGVGSPQLSLSSCSSFLSISSAGTSAADGAPHLSLGVGGAEELDLLLQVGIGGGGGGGGDEEEEERKTIRMMKNRESALRSRARKRAYVQELEKEVRRLVNENLKLKRHCKQLKTEMAALIQQPTNKQSSHRRSSST

SEQ ID NO: 934 - protein, 301 aa, Populus balsamifera subsp. trichocarpa x Populus deltoides
  Orthologous to G568
MWSSPGANIDNNNTSNSKVSGNSPSKCFSSTCSSPSPPSPSPPIPNQSMNGASMEEVWDDINLASLHDHSNTNTSSNTNHHSFNGMVFQDFLARPSNKDTSTRAASKEPSSGGGNSFLKNSLGPPPATMLSLNSGSDHFHYLESSNTVPVRPNPQMHSHANGGTISFDSSLDSPFDALGSSSAFLSICKKRPQENGDVSGGDRRHKRMIKNRESAARSRARKQESSSPFENLFLVKFNDYRMLMFYLLLILQAYTVELEREAAHLAQENAKLRRQQERFLAAAPAQLPKKNTLYRTSTAPF

SEQ ID NO: 935 - DNA, 2411 bp, Glycine max
  Predicted polypeptide sequence is orthologous to G584
accttccctctctcctccctccccccccgcacatagaaaaacaagcacgcacgcacacgcatacacacacacactctctcttttccactccctcttttggccgccagaacaaacaaaacccacacttcactcccatccaattccaaacccacgttgttgttggtgcatggaatgaccgagtaccggatgaacctgtggaccgacgacaactcctccgtcatggaggccttcatgagctcctccgacctctcctccctctggcttgccacgccgcagtccgccacctccaccacaactccaggcacggcaaaagcccctcctcctcctcctcctcctccgccgccgccggcgcagtcccagtccctcctcaaccaggagactctccagcaacgcctccagactctcatcgaaggcgcctgcgagagctggacctacgcaatcttctggcaatcttcctacgactattcctccggcacctcccttctcggctggggagacggttactacaagggcgaggaggacaaagacaaagtcaaaaccaaagcccccaaaacgaggtcgtccgcagagcaggaccatcgtaagaaggtcctccgcgaacttaattccttaatttccggcccttccgcttcagctgacgacattgacgaagaagtcaccgacaccgagtggttcttcctggtgtcgatgactcagtccttcgtcaacggtagcgggctgccgggccaggctttttttaactcgagcccggtctgggtcgccgggcccgaaagactttccgaatcggcctgcgaacgggcccgccaggggcagctcttcgggctccagactcttgtctgtataccgtccgcaaacggcgtcgtcgagctcgcctccgcggaggtcatttttcagaaccccgatctgatgaacaaggtgcgtgatttgttcaacttcaacaacaacaacaacaacaacaaccctgaaacgtgttcctgggcgttgaattgcgttgccaccaccgatcaaggcgagaacgacccttcctcgctctggctcaaccctgaaatcaaagactcctccaccgtctcgccgccgaattccacggttaataagacgatgcatttcgaaacccctggttccagtaccctaaccgaaacccctagcgctgctgctgctgttcacgtccccaattctaaaagccagggattcttcccgagggaattgaacttttcgaattcattgaaacctgaatccggtgaaattctgagctttggggagagcaagaagagctcttacaatggggctttctttcccggtgttgttgcggttgaggagaacaacaacaataacaagaacaagaagaagaggtccccggtggtttctcggagcagcattgacgatggaatgctttccttcacttccctgccggctgcaaatataaaatcagttaacggtgcttgtgtcggtgccggtgattcggatcactcggatctggaagcttccgtggcgaaacaggtggtggagcccgagaaacggccccggaagagagggcgaaagccggctaacggaagagaggaaccactaaatcatgtggaagccgagagacagaggagagaaaagctgaaccaaagattctatgctctacgagctgtagttccaaatgtatccaagatggacaaggcatcgctgttgggggacgccatattgtacattaacgagttgaaatcgaagctcaacgtgctggattcagagaaaacggaattggagaagcaattggattcaaccaagaaggaactcgagctcgcaactaaaaaccctcctccaccgccaccgccgccaccaccaccaggaccgcctccatctaatagcgtagaaccaaagaagacaacaagcaagctcgctgatttggagttagaggtgaagatcattggttgggatgcaatggtaagaatccaatgcagcaagaagaaccaccctgcagccaggttgatggcagcattgaaagatcttgacttggaagtgcatcacgccagcgtgtctgtggtgaatgatttgatgatccaacaagccacggtgaacatgggaaacaagttttacacgcaggaacagcttctgtcggcactatcatccaaagttggcgatgaactacgatagttccttctgtactattattggtagcagtagctgtagctttctatgtaaattagtgttcttatttttggttagtcctttttggtagcttggactaaattaattttattgaggtaatttgatttgggaagctgaatgatcaaccaggggatagtaatatctctgatgaagtccaagtggattttttttgtgttaatattattatctgtttatattgtatatatatatatatatatgtttatgaattatcataaatgtgaactgatgttggtgaattt

SEQ ID NO: 936 - DNA, 806 bp, Glycine max
  Predicted polypeptide sequence is orthologous to G584
ggtccccggtggtttctcggagcagcattgacgatggaatgctttccttcacttccctgccggctgcaaatataaaatcagttaacggtgcttgtgtcggtgccggtgattcggatcactcggatctggaagctgaaccaaagattctatgctctacgagctgtagttccaaatgtatccaagatggacaaggcatcgctgttgggggacgccatattgtacattaacgagttgaaatcgaagctcaacgtgctggattcagagaaaacggaattggagaagcaattggattcaaccaagaaggaactcgagctcgcaactaaaaaccctcctccaccgccaccgccgccaccaccaccaggaccgcctccatctaatagcgtagaaccaaagaagacaacaagcaagctcgcttgatttggagttagaggtgaagaatcattggttgggatgcaatggtaagaatccatggcagcaagaagaaccaccctgcagccaggttgatggcagcattgaaagatcttgacttggaagtgcatcacgccagcgtgtctgtggtgaatgatttgatgatccaacaagccacggtgaacatgggaaacaagttttacacgcaggaacagcttctgtcggcactatcatccaaagttggcgatgaactacgatagttccttctgtactattattggtagcagtagctgtagctttctatgtaaattagtgttcttatttttggttagtcctttttggtagcttggactaaattaattttattgaggtaatttgatttgggaagctgaatgatc

SEQ ID NO: 937 - DNA, 1203 bp, Glycine max
  Predicted polypeptide sequence is orthologous to G584
ccggttcctgtcgaaatcctcgacgaccacaccatctccttcgccgacatcggcatcgttgccggagtccaagaaaccaaaaagcggagaataaaccaaacacaaacacaaaaacctcccaggaaaaacgacaactatgtcaactccgaacactccgattcggattgtcccacgttgccaaccgccaccaccccgacaacctcggagccgaagaaaagagggagaaaaccgattctcggacgcgagactccggtaaaccacgtggaggcagagagacaacgtagggagaagctcaatcatcgattctatgcgcttcgtgctgttgttccgaatgtttcgaggatggacaaggcttcgctgttgtcggacgctgtcgcctacatcagcgagctgaaggcgaagattgagtacttagagtcgcagcagccgagagacagtagtaaaaaagtgaagacagaaatgacggatactctagataaccatagcaccacgacaatatcgacagtggtggatcaaagcgggcctgaacctagattgggcccaagcccgcttggtctcgaggtcgatgtgaaaatcgtggggcccgatgccatggttagggtacaatcagaaaatgtgaaccaccctggggcgaggctaatgggtgctttgagagacctagaatttcaggttcatcacgctagcatgtcttgtgttaacgatctcatgcttcaagatgtggttgttaagcttcccaatggaatgaggagtgaagagggtcttaaatctgcgattctgatgaggttggatcagtgacactggtgaggttattagctgtaatgtaactgtgagatgttgttgctgttcatagtagtcggtttttggtgtacgttatagataatttgtatttatcttttttgtttttttggggggtctttgtcttgcgtggtgcttgatgacggtggggttggctccaacctgcaattatgtgagggaatctaagaagcctgtcgtttatgttttgtatatataataatccttttggattttgaagttgatcaagaactagactagaagaaaaagtggtcgccatcttgttttaacattcctcaaaatacaaatattataatccaaaccctataatctagtatcactagatttagattttgtatgaataaataatataattaagcatgtgtttactataattttattatataaaaa

SEQ ID NO: 938 - DNA, 2463 bp, Glycine max
  Predicted polypeptide sequence is orthologous to G584
cccacgcgtccgcttactccccctccgcccaatctcaatcccagtgagtgctttctttctgtaactaaccccaatcatcaactcagtcagcgaatgaatctgtggacggacgagaactcctcggtgatggaggccttcatgccatcctccgatctctcctccatctggccccctcccgctcctccgcagccgcaatccacggcggtcttcaatcaggacaccctccagcaccgcctccaggccttaatcgagggcgcccgagagacctggacctacgccatcttctggcagtcctcttacgactattccggctccactctcctcggttggggcgacggttactacaaaggcgacgacgacaaagccaaggcaaaggccaagtccaaagccacctccgccgccgagcaggaccaccgcaaaaaggttctccgggaacttaactccctcatctccggctcctcctccgcttccgcctccgacgacgtcgacgaggaagtcaccgacaccgagtggttcttcctcgtctccatgacgcagtccttcgtcaacggcggaggactgcccggacaggccttcttcaactcgacccccgtttgggtcaccgggagtgaccgtctctctgcctcgccctgcgagagggcgaggcagggacatatgttcggcttgcaaaccttagtttgcataccgtccgcgaacggcgtcgttgaactgggttccaccgagttaattttccagaactcggatctgatgaacaaggtgaaggttctcttcaattttagcaacaacaacttcgacatgggttcttcttggcccgccaccagcgccgatcaaggcgaaaacgacccttcctcgctctggctcagcgatcccgaagttagggattccgttaacactgctgctgctaccccttcggtcatggttcctgcacagactcaggggatttcgatttcaaagaccatgcagttggagagttctattcaaacccctggttccagtactttaaccgaaacccctagttctattcacgcgattccgcagaaccagagcgtcttctccagagaattgaacttttctgagtatggtttcgacccaaagactgggaacaatcagaatcaccattctctgaagccggaatccggcgagattctcagcttcggcgagagcaagagaacctcctacggcggcgtcaatgggaattccaattccaattcccattttttctccggtcagtcgccgtttgttgctgctgcggatgagaacaccaacaaaaataacatcaacaacaatgggaagacaaagtcaccgaattcgcgcggtagcaacgacgacggaatgctttccttcacctccggcgtgattcttccggcctcgaatttgaagtccggtggcggcggcgattccgaccactcggatctggaggcttcggtggtgaaggacccggtggtggagccggagaagcggccgcggaagagagggcgtaagccggcgaacggaagagaggaaccattaaaccatgttgaagcagagagacagaggagggagaagctgaaccagaggttctacgcgcttcgtgctgtggttcccaacgtgtcaaagatggacaaagcgtcactcctgggcgacgccatatcttacatcacggagctgaagtccaagcttcagaccctcgaatcagataaagatggaatgcagaagcagctggaaggtgtgaagaaggagctcgagaaaacaaccgagaacgtttcttctaatcacgcgggtaatagtagtagttgtaacaacaacaacaagttgtcgaatcagaagttaattgacgtgttggagatggacgtgaagatacttgggtgggacgcgatgataaggatccattgcagcaagaagaaccaccccggggcgaggttgttgacggcattgatggagttggacttggacgtgcaccacgccaacgtaaatttggtcaacgatatgaccatgctacaagcaacggtgaagatgggaagtaggttttacacgcaggagcagcttcgtgcggctctggcggctaaggttggggatgcacgatgatgttggctctgcactttgcggcagcgtttgagattatgtgtgtgtttgtgtcgtgttattagctagctagctctttgtaagttgtgctgctctgggatattttaagccttcccggtagctgtttctgtaaaattataagctttttttctttattgggtagcttagtattgaattttgaggtaatcaaattgggaagctccatggagtagtagaactagctagggacacttttcatcaaatctgtgggtggagtggagatagcagcagctatatgtggaaataggggtaattttatctgttttagattgtgtatatattataataatatcataaatgtgaacagcatcatgcaagttctcaatattattattaaaaaaaaaaaaaaaactcgagccgaat

SEQ ID NO: 939 - DNA, 960 bp, Glycine max
  Predicted polypeptide sequence is orthologous to G584
gtaagagagggcggaagccggcgaaccggagagaggaaccattaaaccatgttgaagcagagagacagaggagggagaagctgaaccagagattctacgcgcttcgtgctgtggttcccaacgtgtcaaagatggacaaagcgtcgcttctgggcgacgcgatatcttacatcaccgagctgaagtccaagcttcagaccctcgaatctgataaagatgtattgcataagcagcttgaaggagtgaagaaggaactcgagaaaacaaccgataacgtttcttctaatcacgcgtgtaataataacaataacaacaagttgtcgtcgaatcagccggcgttaattgacttggttgagatggacgtgaagatcattgggtgggacgcgatgataacgatcacatgcagcaagaagaaccaccccgcggcgacgttgatgacggcattgatggagttggacttggacgtgcactacgccaccgtaacgttggtcaacgatttgatgatccaacaagcaacggtgaagatgggaagtagattttacacgcaggagcagcttcgagcggcgctgtcggctaaggttggggatgtacgatgatgttggcactttgcggcagcgttgagattataagtgtgtgtttgtgtcatgttattagctagctatctctttctaagttgtgtgctgctctggggtattttaagccttcccggtagctgtttctgtaaaattttaagattttatttttctttattgggcagcttagtattgaattttgaggtaatcaagctgggaagctccatggagtagtagtataactagctagggacagttttcatcaaatctgtgggtggagtggaaataggggtaattttatctgtttaggtagtgtatatatttataataaatcataaatgtgatcatgcaagttctcaatattattatgcttcagctaaagggcggc

SEQ ID NO: 940 - DNA, 870 bp, Zea mays
  Predicted polypeptide sequence is orthologous to G584
cgcactccgcggggctccgcgggcacgacggcgggccgcgctgccacgcggtggagatcgacgccaagatcctggggctggaggccatgatccgcgtgcagtgccacaagcgcaaccacccgtcggcgcggctgatgacagcgctccgcgagctcgacctggacgtgtaccacgccagcgtgtccgtcgtcaaggacctcatgatccagcaggtcgccgtcaagatggccagccgcgtgtacacgcaggaccagctcagcgccgcgctctacagccgcctcgcggagcccgggtctgccatgggcaggtaatcaaggaggagagctgctcagctcgcctgtggctgccggaataggggacgacactgatactactgctactcaccaccggactgtcctgtcgtcgtggtcaccacggttacaacacgataggcagaaagattcaggagggagacgacgacgatgccgatgctgtataaactttagaaggatggatggatggatggatgatgataccgagcttctgctcctgttcatcatcatcttctcgtgtttttgctagtagcgtgttaattagcaggattaagcaaccaacaagcgtccaaccgttgttgttaattaagtacatgttgttgtgagctgtgatgatgatggatccaccgatgttagggttcgattggatcgaaaactgtgtatagtatatggatcggccgtcgtcctatccggtggaggtggacgatgccctgatcctgatgtatgtatttttacagcaggatttcgctttgcaatggagtcagcctttttgatccaaaaccaaaaaaaaaaaaaaaaaaaaaaaaaaaaagggggccgctcgcgatctagaactagc

SEQ ID NO: 941 - DNA, 723 bp, Zea mays
  Predicted polypeptide sequence is orthologous to G584
tgcagtgccacaagcgcaaccacccgtcggcgcggctgatgacagcgctccgcgagctcgacctggacgtgtaccacgccagcgtgtccgtcgtcaaggacctcatgatccagcaggtcgccgtcaagatggccagccgcgtgtacacgcaggaccagctcagcgccgcgctctacagccgcctcgcggagcccgggtctgccatgggcaggtaatcaaggaggagagctgctcagctcgcctgtggctgccggattaggggacgacactgatactactcccgcgccccaccggactgtcctgtcgtcgtggtcaccacggttacaacacgataggcggaaagattcaggagggagggagacgacgacgatgccggtgctgtataaactttagaaggatggatggatggatgatgataccgagcttctgctgctgttcatcatcatcttcttgtgtttttgctagtagcgtgttaattagcaggattaagcaaccaacaagtgtccacccgttgttgttaattaagtacatgttgtgagcgaccaaccgatgttagcgttgggttggatccaaacctgtgtatagtatatggatcagccgtcgtcctatccggtggacgatgccctgatcctgatgtatgttttttacagcaggatctcgctttgcaatggagtcaggctttttgatcaaaaaaaaaaaaaaaaacccggggttttcggaccg

SEQ ID NO: 942 - DNA, 510 bp, Zea mays
  Predicted polypeptide sequence is orthologous to G584
gaaagcgttttttgaagcccgcgaacgggcgcgaggagcgggtgaaccacgtggaggcggagcggcagcggcgggagaagctgaaccagcgcttctacgcgctgcgcgccgtggtgcccaacgtgtcgaagatggacaaggcgtcgctgctcggcgacgccatctcctacatcaacgagctccggggcaagctgacgtcgcagcagcccgccgccggaggcgaccacgtggagacggacccgtccatgctatggctcgccgacgcgccggtcatggacatcaaggattccttgtcgcacccgtcggccgagatctccgtctccaagcctccgccgcatccgccgcagatccattttgagaacgggagcacgagcacgctcacggagaaccccagccccttcgtgcacgcgccgccacccccgtcggcgcctgctgctccacagcagcggcagcaccagcaccagcaccagaatcaggcgcaccagggcccggtccgccgggagctcaaat

SEQ ID NO: 943 - protein, 688 aa, Oryza sativa
  Orthologous to G584
MEAFMASADLPAFPWGAASTPPPPPPPPHHHHQQQQQQVLPPPAAAPAAAAFNQDTLQQRLQSIIEGSRETWTYAIFWQSSIDVSTGASLLGWGDGYYKGCDDDKRKQRSSTPAAAAEQEHRKRVLRELNSLIAGAGAAPDEAVEEEVTDTEWFFLVSMTQSFPNGLGLPGQALFAAQPTWIATGLSSAPCDRARQAYTFGLRTMVCLPLATGVLELGSTDVIFQTGDSIPRIRALFNLSAAAASSWPPHPDAASADPSVLWLADAPPMDMKDSISAADISVSKPPPPPPHQIQHFENGSTSTLTENPSPSVHAPTPSQPAAPPQRQQQQQQSSQAQQGPFRRELNFSDFASNGGAAAPPFFKPETGEILNFGNDSSSGRRNPSPAPPAATASLTTAPGSLFSQHTPTLTAAANDAKSNNQKRSMEATSRASNTNNHPAATANEGMLSFSSAPTTRPSTGTGAPAKSESDHSDLEASVREVESSRVVAPPPEAEKRPRKRGRKPANGREEPLNHVEAERQRREKLNQRFYALRAVVPNVSKMDKASLLGDAISYINELRGKLTALETDKETLQSQMESLKKERDARPPAPSGGGGDGGARCHAVEIEAKILGLEAMIRVQCHKRNHPAARLMTALRELDLDVYHASVSVVKDLMIQQVAVKMASRVYSQDQLNAALYTRIAEPGTAAR

SEQ ID NO: 944 - DNA, 2409 bp, Glycine max
  Predicted polypeptide sequence is orthologous to G585
ccacgcgtccgggatgtttgaaatcaaataacaaacaggaagtgactacttttcttttgtgaccaaaatgaaagtgatgtgagtgacagtccttcacttttgatgacatttcaaagctactagaatggccaacaacgggagtccaaagcataagaagatgcaaaagaacctttgcacacaactagctgttgcagtgagaagcactcaatggagctatggtattttctgggcaccttcaaccactgaagttcggctcgtgctcgagccgaatcggctcgagcggctcgagattaagacaagaaagacagtccaagccatggaattggaaatgaaggctgataaaataggactgcagaggagtgagcaactgaaggaactgtacaagtttcttcttgcaggtgaagctgatccacaaactaaaaggccttctgctgcattagctccagaggacctctcagatttggagtggtattacttggtttgcatgtcctttgttttcaatcacaaccaaagtttgcctggaagagcactagaaattggtgacactgtctggttatgcaatgctcaacatgctgatagtaaaattttctctcgttctttgctagcaaagagtgcgtcagttcagaccgtggtgtgttttccctatcagaaaggcgttattgagataggcacaactgaactggttactgaggatcctagtctcatacaacatgtcaaggcttgcttcttagaaatctcaaagcctacatgctctgataaatcttcctctgtccttgataagccacatgatgacaaatatccaacatgcaccaagggtgaccaaagggtgttagaagcaatggctctggagaacccatgttcccttgaagaaaatatcaaatttgatcatgaccccatcaatgaattgcaagatggcaacaacgaagattctaacatggattctcctgatggttgtcagcatcatttccctatggatggatccatgattgagggtatcaatggtgtgccatctcaagttcattttgtgaatgaagccttagtcattggtgctccagattctttgagttcttgtgattgtatgtctgaggcttctgagaaccaaggcaatgattccaagaatgtggaccaaactcaacttatggaacttcaatattgccatataccacagagaagctccatggatgttggagctgatgaggacttgtgctacataagaacactttgtgctattttggggaactcatcaacttttaaaccaaacccttatgctggtaactcaaattgcaaatctagttttgcgaaatggaagaaagggagagtttctgaaaggaagaggccaaagttgcaccaaagcatgttaaagaagactttgtttaatgtcccttttatgcatagaagttactcttctctcaagtcacaaaaagagaatggcagaatgaaatggactagtaaattggaaaatgctaatgatggtttcatggagaaaacattctctgataagaaaagagaaaataaaaactttcatgttgtcaaaccaatggttccatcttctataagtgaggtagaaaaaatttcaattcttggagacacaattaagtacttgaaaaagcttgagacaagagtggaagagctagaatcttacatggaagttacagaccctgaagcaagaatcaggagaaattgccctgatgttccagagcagatgtcagataactatggcaccagaaagatttgcatgggaatgaaacccttgggtgaacaagaggaaggcttgtggtattgatgagatagccccagagctagaaagaattgtttctgaagaatcaaaggttttggatgtgaaagtcaatgtgaaggagcaggaggttctgattgagatgaaatgtccttacagggaatacatactgtatgacatcatggataccattaacaacctacatttagatgctcaaacagttgaatcatcaacaagtgatggtgttctcacattgacacttaaatctaagtttcgaggagcagcaacagcaccaacgaggatgatcaaagaagcactctggaaagtatctggaaatacttgacatgcctatttggatttcacatgatagtattagtagtagtaatagtaaatatttatgattaaacaactttagctctagaacagtgatttgtttcctaacaaaatatgtatgccttgttgtatgaaccatgattttggctattgtgcttaagtgctgacttgttagagttaccagagctccactctgtaatttttaaaccacttcagccaatctgttagcatgcatttgcaagattttgtttgcttttactgccagcagtatagaactgtttccttgcatttagaaagtgaagtgtgaatgtaaggtttcaatgtgatcaagaaggtgcttt

SEQ ID NO: 945 - DNA, 2403 bp, Glycine max
  Predicted polypeptide sequence is orthologous to G585
gtcgacccacgcgtcagcccatctgatcatataacacaacacactgcaggcttgttgtgttgtgctgtgttcattctgaaactttgatctatgtgagacaagttgtggctaccctgcaaagccagaaaaaatggtgccagagaacttgaagaaacaacttgctttggctgtgagaagcatccattggagctatgcaatcttctggactgattcaactacccaacccggggtgttgagctggggggaagggtattacaatggagacattaagactaggaaaacaagtcaaggagtagaactcaattctgaccaaatagggttgcagaggagtgaacagctgagagaactattcaaatccctcaaaactgtagaagtcacccctcaaaccaaaaggccttcagcagcagcactgtccccagaagatctcacagatgctgagtggtattacttggtttgcatgtccttcatattcaacattggccaagggttaccaggaagaactctagcaaagggtcaacccatttggctgaacaatgcccattcttctgattgtaaaatttttagccgttctcttctggcaaagagtgcatccattgagacggttgtgtgctttccgtttagggaaggggttattgagttaggtactactgaacaggtcccagaagatttgagtgtcattgaactgatcaaaacttctttcttgaatagtctgcatgccaatgttcccaataagtcagtagctacattgaaatcaaggaaccaggaaggtctttcttatgcagcatttgatcataatgactataatgttaaatcaattccagaagttgggtatgaaatagccaacacaacctctcctgatggtagttcaaatgcattccaagccaatcaaccgctagatgaaacatttatgattgaaagtataaccaatggcacttctcaagtccaaaactggcaagttattgatgatgaattgagtaactgtgtccataactccatgaattccagcgactgtatatcacaaacttttgcctgccctgagaatattgcttctgcccccaagtctaacaacccttctgatccttgtgcccgaaattttcaaaagtgcaacaacccaaaaatgaccttagtggatcctcgaagtgatgatttgcactatcagagagttctttctacccttataaaaagttctgaccagttacttatgggaatgcatttgcaaaaatttcctcaggaatcaagctttgttagttggaggaaagaacagccaatggattgcaaatggccaagagcaggaacgtcacaaaagttattgaagaaagtattgtttgaagttcctcaaatgcacttggatgggctgcatgagtctcaagaagagaatgactataaagagggaatgagagtagaggctgatgaaaacggcatgaaccatgttatgtcagaaaggaggaggagagcaaaactaaatgaaaggtttttaacccttaggtcaatggtcccttcaatcagtaaggatgacaaagtttcaatactagatgatgctattgattaccttaaaaagctcgagagaagggtaaaagagttggaagctcacagggtggtaacagacatagagactgggactagaagatcaccacaagatacggtggagaggacttctgatcattattttaggaaaaataataatggcaagaaaccagggatgaaaaagaggaaggcttgtggtgtagatgagacagaaaaagagattaattcagatgctttaaaaggaagttatgctaatgatgttactgtgagtaccagtgacaatgaaattgtgatcgaattgaagtgcccctcgaaagcaggaaggctgctagaaattatggaagcaatcaacagtttcaatatagattttagttcagttcagtcaacagaagctgatggaaatctttatctgaccattaaatctgtgctcacaggaccaagtgttgcaacaaccaaaagaatcaaacaagcactccaaaaattggcttccaagtgctgaatttttatctataccttaaaaaccgtggggggtgttgaatctaattcataccactgccgtgtgacatagagagtccattagaatgatggagtcacaactcactagtgcagctcttggagattttttttctttgaagatttctcataaaaggaaaatgtagactttcactcatctttcggcaataccataactcttggtgacgcaagatatatggactttgaatcacttgtaaatgggtaggtaggcttagttgactagatttatgtaattaatgccacttgctcctatgggaacactaaggttgaccaatgactaaatattgacagagagacgtacattattaattatgataaaaaaaaaaaaagggcggccgcaaaaag

SEQ ID NO: 946 - DNA, 911 bp, Glycine max
  Predicted polypeptide sequence is orthologous to G585
  misc_feature (893)..(893): n is a, c, g, or t
gccaagaggcacctgtcccgatttcccggttcactctacgctttcggtttgttccattaacaaacctgaggcaattgtctgggctcatgctaagtgtgcatccattgccaccgttgtgtgcattccgtttagggaaggggttattgagctagggccttctcttcaagttccaataacttttgcgtgtcattgaactgatcaaaacctcttttttaaatagtctgtatgccaacgtaccaattagtcagttgtctacattctaatcaatgaaccaggaaggcctttcttatgcaccatttgatcataatgactattatgttaaatcaatcccaaaagttgggtatgaaatagccaacacaacctcttctgatggtaagttaaaaggcaattccaagccaatcaaccgcttgatgaaacagttatgattgatagtattacccatgggccccttctcaagtccaaaactggcaaggttattgatgatgaattgagtaactgggtccataactccttgaattccagcgactggttatcacaaactttcgcctgccctgagaattttgcctctgcccccaagtctaacaacccttctgatccttgtgcccgaaattttcaaaagtgcaacaacccaaaaatgaccttagtggatcctcgaagtgatgatttgcacagccaatggattgcaaatggccaagagcaggaacgtcacaaaagttattgaagaaagtattgtttgaagttcctcaaatgcacttggatgggctgcatgagtctcaagaagagaatgactataaagagggaatgagagtagaggctgatgaaaacggcatgaaccatgttatgtcagaaaggaggaggagagcaaaactaaatgaaaggtttttaacccttangtcaatggtcccttcaat

SEQ ID NO: 947 - DNA, 440 bp, Glycine max
  Predicted polypeptide sequence is orthologous to G585
ccataaacaaacctgtggcaattgtcttctctcatgctcagagtgcatccattgagacggttgtgtgctttccgtttagggaaggggttattgagttaggtactactgaacaggtcccagaagatttgagtgtcattgaactgatcaaaacttctttcttgaatagtctgcatgccaatgttcccaataagtcagtagctacattgaaatcaaggaaccaggaaggtctttcttatgcagcatttgatcataatgactataatgttaaatcaattccagaagttgggtatgaaatagccaacacaacctctcctgatggtagttcaaatgcattccaagccaatcaaccgctagatgaaacatttatgattgaaagtataaccaatggcacttctcaagtccaaaactgggcagttattgatgatgaattgagtaactgt

SEQ ID NO: 948 - DNA, 2517 bp, Oryza sativa
  Predicted polypeptide sequence is orthologous to G585
tgctagatctctcctccacatccggactctcgctatcaaatttacgtaagcacagtgagaaaaataattagcagggccaccagcatactgttggcgtacagctgcaaatacctgtcgagctaatcttggttaaaatgttggtttagattctgttgcttaattgctggtgaggaggagcactcactatatagctcaatccatcttcctctgcaaaacgtacgcacgacactctggttgcgatcgattatcactccctgatcgcgagttcttggtctgcgagcgtctgcaattaagggaagagttcctctttgttttgacgaggatcgaggattgtttggacgaaccagcagcagcgtacgtgccaatttcattgatagtcgctgtatctgatttacaggaaaaatacatacaacagtgtgtggtaaagtatactactattactggagtactaattaatggaagagacccctctgccatccgggaagaacttcaggagccagcttgctgctgcagcgaggagcatcaattggacgtatgccatattttggtccatttcaaccagccgcccaggagttctgacttggaaggacggcttctacaacggcgagataaagacgaggaagatcacgaactccatgaacctcacggccgacgagctggtcctgcagagaagcgagcagctgagggagctctacgactctctcctctccggcgagtgcggccaccgagcgaggaggcccgtcgctgcgctgttgccggaagatctcgcggacacggaatggtactacgtcgtctgcatgacctacgccttcggcccccgccaagggttgccaggcaaaagcttcgcaagcaatgaatttgtttggctgacaaacgctcagtctgcagatagaaaactattccatcgcgcgcttatagcaaagagtgcatctattaagacaatcgtctgcgtgccatttatcatgcatggtgtccttgagctcgggaccactgatccgatttcggaggacccggctctcgtcgaccgtatcgcggcgtcgttctgggatacgccgccccgcgcggcgttctcgtcggaggcgggagacgccgacatcgtcgtcttcgaagacctcgaccatggcaacgccgccgtcgaagcgacgacgacgacggtcccgggggagccacacgcggtagccggcggcgaggtcgccgagtgcgagcccaacgccgacaacgacctcgagcagatcaccatggacgacatcggcgagctctacagcctctgcgaggagctggacgtcgtgcgccctctcgacgacgacagtagcagctgggcggtcgcggatccctggtcgtcctttcagctagttccgacgtcttctccggcgccggatcaggcgccggcggcggaagctactgacgtcgacgacgtcgtcgtcgccgctttagacggtagctccattgatggatcttgcaggccgtcgccgtcgagttttgtggcgtggaagaggacggcggactcggacgaggtgcaggccgtgccgctcatcagcggagagccgccacagaagttgctgaagaaagctgtcgccggagccggtgcctggatgaacaatggtgacagcagcgcggcggcgatgacgactcaaggaagcagcatcaagaaccatgtcatgtcagagagaaggcgccgggagaagctcaacgagatgttcctgattctcaaatcagttgtcccgtccattcacagggtggacaaagcatccattctcgcagaaacgatagcctacctcaaagagctggagaaaagagtggaagagctggaatccagcagccaaccatcgccatgtccattggaaacaagaagcaggcgaaagtgccgtgagatcactgggaagaaggtttctgcaggagcgaagagaaaggcgccggcgccggaggtggccagcgacgacgacaccgacggggagcggcgccattgtgtgagcaacgtgaacgtcaccatcatggacaacaaggaggttctcctcgagctgcaatgccagtggaaggaattgctgatgacgagagtgttcgacgcgatcaagggagtctccctggatgtcctctcggtgcaggcatcaacatcggatggtctccttggactgaagatacaagccaagtttgcctcatctgctgccgtcgaacctgggatgattacagaagctctccggaaagctatagcaagctagctagctagaaggttgagatcagtatcgtcttggtcatttgctctcatcttgtttaggaggtaccgggaaataaatcttgtcgctctgatcagtgcctccttactagtctcgtgatctgttgtaagtaatagttagacatgcatatatatcatacaacaacgtttgatcttgcatggtagcatatatatgtacaccacatttcttatatctttactcctttaaaattcagtgaggatggtaagtgatgaatctgccaccccatcaccaactccctaaaattctgaaaaaaaaaaaaaaaaaa

SEQ ID NO: 949 - DNA, 2601 bp, Zea mays
  Predicted polypeptide sequence is orthologous to G585
cccaaggttcgtggcatatctgtaggcatctaccccgtcttcgtcgtccgctcctcactagctaccaagaggtcgccattattgccaacatagagtgtacgtggatgtctatatatatgcctacttgcacccatatggcataggcgttcgatccccttagcgcggaggagagctcctccggttcttctctacccttcgcatggaagttcttgcattgcttcgttgcttctctagtttcttccttctacgtctttccagcatacgcatgcccctcgtccgccggttcacgaggcatcgtctgatgatcagtagataataagcaatataatactgatctagaatcgagttgttgtactcttcgcagataggcgcgtgatggcgctttcagcttcccgagttcagcaggcggaagaactgctgcaacgacctgctgagaggcagctgatgaggagccagcttgctgcagccgccaggagcatcaactggagctacgccctcttctggtccatttcagacactcaaccaggggtgctgacgtggacggacgggttctacaacggcgaggtgaagacgcggaagatctccaactccgtggagctgacatccgaccacctcgtcatgcagaggagcgaccagctccgggagctctacgaggccctcctgtcgggcgagggcgaccgccgcgctgcgcctgcgcggccggccggctcgctgtcgccggaggacctcggcgacaccgagtggtactacgtggtctccatgacctacgccttccggccaggccaagggttgcccggcaggagtttcgcgagcgacgagcatgtctggctgtgcaacgcgcacctcgccggcagcaaagccttcccccgcgcgctcctggccaagagcgcgtccattcagtcaatcctctgcatcccggttatgggcggcgtgcttgagcttggtacaactgacacggtgccggaggccccggacttggtcagccgagcaaccgcggctttctgggagccgcagtgcccgagctccagcccgtcaggacgagcaaacgagaccggcgaggccgcagcagacgacggcacgtttgcgttcgaggaactcgaccacaataatggcatggacgacatagaggcgatgaccgccgccgggggacacgggcaggaggaggagctaagactaagagaagccgaggccctgtcagacgacgcaagcctggagcacatcaccaaggagatcgaggagttctacagcctctgcgacgaaatggacctgcaggcgctaccgctaccgctagaggacggctggaccgtggacgcgtccaatttcgaggtcccctgctcttccccgaacccagcgccgcccccggtggacagggctaccgctaacgtcgccgccgacgcctcaagggcacccgtctacggctctcgcgcgaccagtttcatggcttggacgaggtcctcgcggcagtcgtcgtgctccgacgaagcggcgcccgcagtagtgccggccatcgaggagccgcagagattgctgaagaaagtggtggccggcggcggcggtgcttgggagagctgtggcggcgcgacgggagcagcacaggaaatgagtgccaccaagaaccacgtcatgtcggagcgaaagcgacgagagaagctcaacgagatgttcctcgtcctcaagtcactgcttccgtccattcacagggtgaacaaagcgtcgatcctcgccgaaacgatagcctacctcaaggagcttcagagaagggtgcaagagctggagtccagtagggaacctgcgtcgcgcccatccgaaacgacgacaaggctaataacaaggccctcccgtggcaataatgagagtgtgaggaaggaggtctgcgcgggctccaagaggaagagcccagagctcggcagagacgacgtggagcgccccccggtcctcaccatggacgccggcaccagcaacgtcaccgtcaccgtctcggacaaggacgtgctcctggaggtgcagtgccggtgggaggagctcctgatgacgcgagtgttcgacgccatcaagagcctccatttggacgtcctctcggttcaggcttcagcgccagatggcttcatggggcttaagatacgagctcagtttgctggctccggtgccgtcgtgccctggatgatcagcgaggctcttcgcaaagctatagggaagcggtgaaggggcagctggaaatttggacatcgacgggcatggaaggcttcatgggatcgaagcaaagatgtatttcttgtttctttagataacagacatgaatcggacctctatatcaacaattatatgggcatgaatacttaagactccagcccttaacacgtagaaactcaaaaaagaagagaggaagctaaagactaagcgtaaggtatatttggaagtaaattgtttttgatagtttctaagcgatcccatggttttataggaatactagagtgtttatggcataaggtgtttggttgcattcataaaacctatattttcaaagtcatagcattctagataccatgatatttttgtaatattggaaactacactccaacgcaaagtttttatgacatggct

SEQ ID NO: 950 - DNA, 2563 bp, Zea mays
  Predicted polypeptide sequence is orthologous to G585
taggcgttcgatccccttagcgcggaggggagctcctccggttcttctctacccttcgcatggaagttcttattgcattgcttcgttgcttctctagtttcttccttctacgtctttccagcatacgcatgcccctcgtccgccggttcacgaggcatcgtctgatgatcagtagataataagcaatataatactgatctagaatcgagttgttgtactcttcgcagataggttcgttccttcacatagaagcgagtacagactacagaccacacagtatcagctggcacgaaacgaaaatggttacttgcaaattgcatgcacgagctagaattatattcttctaatcttcttcgttgactttctggcttcagcaggcgcgtgatggcgctttcagcttcccgagttcagcaggcggaagaactgctgcaacgacctgctgagaggcagctgatgaggagccagcttgctgcagccgccaggagcatcaactggagctacgccctcttctggtccatttcagacactcaaccaggggtgctgacgtggacggacgggttctacaacggcgaggtgaagacgcggaagatctccaactccgtggagctgacatccgaccagctcgtcatgcagaggagcgaccagctccgggagctctacgaggccctcctgtcgggcgagggcgaccgccgcgctgcgcctgcgcggccggccggctctctgtcgccggaggacctcggcgacaccgagtggtactacgtggtctccatgacctacgccttccggccaggccaagggttgcccggcaggagtttcgcgagcgacgagcatgtctggctgtgcaacgcgcacctcgccggcagcaaagccttcccccgcgcgctcctggccaagagcgcgtccattcagtcaatcctctgcatcccggttatgggcggcgtgcttgagcttggtacaactgacacggtgccggaggccccggacttggtcagccgagcaaccgcggctttctgggagccgcagtgcccgacgtactcggaagagccgagctccagcccgtcaggacgagcaaacgagaccggcgaggccgcagcagacgacggcacgtttgcgttcgaggaactcgaccacaataatggcatggacatagaggcgatgaccgccgccgggggacacgggcaggaggaggagctaagactaagagaagccgaggccctgtcagacgacgcaagcctggagcacatcaccaaggagatcgaggagttctacagcctctgcgacgaaatggacctgcaggcgctaccactaccgctagaggacggctggaccgtggacgcgtccaatttcgaggtcccctgctcttccccgcagccagcgccgcctccggtggacagggctaccgctaacgtcgccgccgacgcctcaagggcgcccgtctacggctctcgcgcgaccagtttcatggcttggacgaggtcctcgcagcagtcgtcgtgctccgacgacgcggcgccggcagtagtgccggccatcgaggagccgcagagattgctgaagaaagtggtggccggcggcggtgcttgggagagctgtggcggcgcgacgggagcagcacaggaaatgagtgccaccaagaaccacgtcatgtcggagcgaaagcgacgagagaagctcaacgagatgttcctcgtcctcaagtcactgcttccgtccattcacagggtgaacaaagcgtcgatcctcgccgaaacgatagcctacctcaaggagcttcagcgaagggtgcaagagctggagtccagtagggaacctgcgtcgcgcccatccgaaacgacgacaaggctaataacaaggccctcccgtggcaataatgagagtgtgaggaaggaagtctgcgcgggctccaagaggaagagcccagagctcggcagagacgacgtggagcgccccccggtcctcaccatggacgccggcaccagcaacgtcaccgtcaccgtctcggacaaggacgtgctcctggaggtgcagtgccggtgggaggagctcctgatgacgcgagtgttcgacgccatcaagagcctccatttggacgtcctctcggttcaggcttcagcgccagatggcttcatggggcttaagatacgagctcagtttgctggctccggtgccgtcgtgccctggatgatcagcgaggctcttcgcaaagctatagggaagcggtgaaggggcagctggaaatttggacatcgacgggcatggaaggcttcatgggatcgaagcaaagatgtatttcttgtttctttagataacagacatgaatcggacctttatatcaacaattatattggcatgaatacttaagactccagcccttaacacgtagaaactcaaaaaagaagaaaggaagctaaagactaagcgtaaggtatatttggaagtaaattatttttatagtttctaagcaatctcatggtttataggaatactagagtgtttatggcataaggtgtttggttgcattcataaaacctatattttcaaagtcatagcattctagatacca

SEQ ID NO: 951 - DNA, 2004 bp, Zea mays
  Predicted polypeptide sequence is orthologous to G585
ccacgaaatggaaatggtcacttccaaattgcacgagctggaattatatactcttctgatcttcttcaccgtctctttatagcgtgatatgcgtttctggcttcttgcttacgtgaaggattattagtaaggcgcgtgatggcgctctcagcttccccggctcaggaagaactgctgcagcctgctgggaggccgttgaggaagcagcttgctgcagccgcgaggagcatcaactggagctatgccctcttctggtccatttcaagcactcaacgacctcgggtgctgacgtggacggacgggttctacaatggcgaggtgaagacgcgtaagatctcccactccgtggagctgacagccgaccagctgctcatgcagaggagcgagcagctccgggagctctacgaggccctccggtccggcgagtgcgaccgccgcggcgcgcggccggtgggctcgctgtcgccggaggacctcggggacaccgagtggtactacgtgatctgcatgacctacgccttcctgccgggccaaggcttgcccggcaggagttccgcgagcaacgagcatgtctggctgtgcaacgcgcacctcgccggcagcaaggacttcccccgcgcgctcctggccaagagcgcgtccattcagacaatcgtctgcatcccgctcatgggtggcgtgcttgagcttggtactactgataaggtgccggaggacccggacttggtcagccgagcaaccgtagcattctgggagccgcaatgtccgacatactcgaaagagccgagctccaacccgtcagcatacgaaaccggggaagccgcatacatagtcgtgttggaggacctcgatcacaatgccatggacatggagacggtgactgccgccgccgggagacacggaaccggacaggagctaggagaagtcgagagcccgtcaaatgcaagcctggagcacatcaccaaggggatcgacgagttctacagcctctgcgaggaaatggacgtgcagccgctagaggatgcctggataatggacgggtctaatttcgaagtcccgtcgtcagcgctcccggtggatggctcaagcgcacccgctgatggttctcgcgcgacaagtttcgtggtttggacgaggtcatcgcactcctgctcgggtgaagcggcggtgccggtcatcgaagagccgcagaaattgctgaagaaagcgttggccggcggcggtgcttgggcgaacacgaactgcggtggcgggggcacgacggtaacagcccaggaaaacggcgccaagaaccacgtcatgtcagagcgaaagcgccgggagaagctcaacgagatgttcctcgttctcaagtcgttggttccctccattcacaaggtggacaaagcatccatcctcgccgaaacgatagcctatctaaaggagcttcaacgaagggtacaagaactggaatccaggaggcaaggtggcagtgggtgtgtcagcaagaaagtctgtgtgggctccaactccaagaggaagagcccagagttcgccggtggcgcgaaggagcacccctgggtcctccccatggacggcaccagcaacgtcaccgtcaccgtctcggacacgaacgtgctcctggaggtgcaatgccggtgggagaagctcctgatgacacgggtgttcgacgccatcaagagcctccatttggacgctctctcggttcaggcttcggcaccagatggcttcatgaggctcaagataggagctcagtttgcaggctccggcgccgtcgtgcccggaatgatcagccaatctcttcgtaaagctatagggaagcgatgaaagggcgctacatgtgaagcttaattaatggaagcaaacttgtatttcttgtgcaaaagcttactatatatttctgcaaaacctggtgtgccttgttttgattttcagtcgccaattgtgcccttgtttttatcaagtgatgatctacaaaatatataaggaatctttgaaaaccga

SEQ ID NO: 952 - DNA, 1568 bp, Zea mays
  Predicted polypeptide sequence is orthologous to G585
cggacgcgtgggctgcatcccggttatgggcggcgtgcttgagcttggcacaactgacacggtgccggaggccccggacttggtcagccgagcaaccgcggctttctgggagccgcagtgcccgacgtactcggaagagccgagctccagcccgtcagaagcaaacgagaccggcgaggccgcagcagacgacggcacgtttgcgttcgaggaactcgaccacaataatggcatggacatagaggcgatgaccgccgccgggggacacgggcaggaggaggagctaagagaagccgaggccctgccagacgatgcaagcctggagcacatcaccaacgagatcgaggagttctacagcctctgcgaggaattggacctgcaggcgctaccgctaccactagaggacggctggaccgtggacgcgtccaatttcgaggtcccctgctcttccccgaacccagcgccgcccccggtggacagggctaccgctaacgtcgccgccgacgcctcaagggcacccgtctacggctctcgcgcgaccagtttcatggcttggacgaggtcctcgcggcagtcgtcgtgctccgacgaagcggcgccggcagtagtgccggccatcgaggagccgcagagattgctgaagaaagtggtggccggcggcggcggtgcttgggagagctgtggcggcgcgacgggagcagcacaggaaatgagtgccaccaagaaccacgtcatgtcggagcgaaagcgacgagagaagctcaacgagatgttcctcgtcctcaagtcactgcttccgtccattcacagggtgaacaaagcgtcgatcctcgccgaaaccatagcctacctcaaggagcttcagcgaagggtgcaagagctggagtccggtagggaacctgcgtcgcggccatccgaaacgacgacaaggctaataacaaggccctcccgtggcaatgagagtgtgaggaaggaagcctgcgcgggctccaagaggaagagcccagagctcggcagagacgacgtggagcgccccccggtcctcaccatggacgccggcaccagcaacgtcaccgtcaccgtctcggacaaggacgtgctcctggaggtgcagtgccggtgggaggagctcctgatgacgcgagtgttcgacgctatcaagggcctccatctggacgtcctctcggttcaggcttcagcgccagatggcttcatggggcttaagatacgagctcagtttgctggctccggtgccgtcgtgccctggatgatcagcgaggctcttcgcaaagctatagggaagcggtgaaggggcagctggaaatttggacatcgacgggcatggaaggcttcatgggatcgaagcaaagatgtatttcttgtttctttagataacagacatgaattggacctctatatcaacaattatattggcatgaatacttagactccagcccttaacacgtagaaactcaaaaaagaagaaaggaagctaaagactaagcgtaaggtatatttggaagtaaattgtttttgatagtttctaagcgatcccatggttttatagg

SEQ ID NO: 953 - protein, 375 aa, Oryza sativa
  Orthologous to G585
MEQVLEDPQLVNRIVAYFQELQFPICLEVLMSTSPSPNETEDADIVSEGLITHNAIEEGQMVVSDECVSNANRDPITMEIDELYSIYEDLDLDMDLDLDTVRFLEDNGWPVNPSSFQLVPASSTEAVAAAAAANDVDGVANSQVSCFMAWKSAKSNEMAVPVVTGIESQKLLKKVVDCGARMSTGRGSRAALTQESGIKNHVISERRRREKLNEMFLILKSIVPSIHKVDKASILEETIAYLKVLEKRVKELESSSEPSHQRATETGQQRRCEITGKELVSEIGVSGGGDAGREHHHVNVTVTDKVVLLEVQCRWKELVMTRVFDAIKSLCLDVLSVQASAPDGLLGLKIQAKFACSGSVAPGMISEALQKAIGG

SEQ ID NO: 954 - protein, 370 aa, Oryza sativa
  Orthologous to G585
MSRVPTSWGFVYSRVNKVSEEPNVVNRITTAFWELQLPACSDEPISSGTPSSPSSPPTKETGDANTVVIDDLFLAHSDAILPAGGDQKEEHQLGDDLGQQQAATAMEIDDDVIYSLIRNWDNDSSSSWIELLDHAIVSPASCFVPWKRTELDKEAVAGGEAAQRLLKKVVGGGGAWMNRAAGSCSIKNHVMSERRRREKLNEMFLILKSLVPSIDKVDKASILSETIAYLKELERRVQELESGKKVSRPAKRKPCSETIIGGGGGGGGAGAVKEHHHWVLSESQEGTPSDVRVIVMDKDELHLEVQCRWKELMMTRVFDAIKSLRLDVVSVQASAPDGLLGLKIRAKYASSAAVVPAMISETLRTAVAGY

SEQ ID NO: 955 - protein, 506 aa, Oryza sativa
  Orthologous to G585
MADELVLQRSEQLRELYDSLLSGECGHRARRPVAALLPEDLGDTEWYYVVCMTYAFGPRQGCVWLPGKSFASNEFVWLTNAQSADRKLFHRALIAKTIVCVPFIMHGVLELGTTDPISEDPALVDRIAASFWDTPPRAAFSSEAGDADIVVFEDLDHGNAAVEATTTTVPGEPHAVAGGEVAECEPNSDNDLEQITMDDIGELYSLCEELDVVRPLDDDSSSWAVADPWSSFQLVPTSSPAPDQAPAAEATDVDDVVVAALDSSSIDGSCRPSPSSFVAWKRTADSDEVQAVPLISGEPPQKLLKKAVAGAGAWMNNGDSSAAAMTTQGSSIKNHVMSERRRREKLNEMFLILKSVVPSIHRVDKASILAETIAYLKELEKRVEELESSSQPSPCPLETRSRRKCREITGKKVSAGAKRKAPAPEVASDDDTDGERRHCVSNVNVTIMDNKEVLLELQCQWKELLMTRVFDAIKGVSLDVLSVQASTSDGLLGLKIQAKVVISAAK

SEQ ID NO: 956 - protein, 265 aa, Oryza sativa
  Orthologous to G585
MVSEDPNLVNRIVAYLKELQFPICLEVPSSTPSPDETEDADTVFDGLIEEDQMVILQGEDELGDVVVAECETNGANPETITMETDEFYSLCEELDLDLGSYQLVPTSARETVAAAAAAANDVDGVAYSHASCFVSWKRANPAEKVVAVPMTAGIESQKLLKKAVGGGTAWMSNIDDRGSVAITTTPGSNIKSHVMSERRRREKLNEMFLILKSLLPSVRKVDKASILAETITYLKVLEKRVKELESSSREPSRWRPTEIGQGKAP

SEQ ID NO: 957 - protein, 567 aa, Oryza sativa
  Orthologous to G585
MASAPPVQEEPLQPGTNHFRSLLAAAVRSISWSYAIFWSISTSCPGVLTWNDGFYNGVVKTRKISNSADLTAGQLVVQRSEQLRELYYSLLSGECDHRARRPIAALSPEDLADTEWYYVVCMTYSFQPGQGLPGKSYASNASVWLRNAQSADSKTFLRSLLAKTIICIPFTSGVLELGTTDPTFIIAYACHNMEQVLEDPKLVNRIVAYFQELQFPICLEVLMSTSPSPNETEDADIVSEGLITHNAIEEGQMVVSDECVSNANRDPITMEIDELYSIYEDLDLDMDLDLDTVRFLEDNGWPVNPSSFQLVPASSTEAVAAAAAANDVDGVANSQVSCFMAWKSAKSNEMAVPVVTGIESQKLLKKVVDCGARMSTGRGSRAALTQESGIKNHVISERRRREKLNEMFLILKSIVPSIHKVDKASILEETIAYLKVLEKRVKELESSSEPSHQRATETGQQRRCEITGKELVSEIGVSGGGDAGREHHHVNVTVTDKVVLLEVQCRWKELVMTRVFDAIKSLCLDVLSVQASAPDGLLGLKIQAKFACSGSVAPGMISEALQKAIGG

SEQ ID NO: 958 - protein, 265 aa, Oryza sativa
  Orthologous to G585
MEIDDDVIYSLIRNWDNDSSSSWIELLDHAIVSPASCFVPWKRTELDKEAVAGGEAAQRLLKKVVGGGGAWMNRAAGSCSIKNHVMSERRRREKLNEMFLILKSLVPSIDKVDKASILSETIAYLKELERRVQELESGKKVSRPAKRKPCSETIIGGGGGGGGAGAVKEHHHWVLSESQEGTPSDVRVIVMDKDELHLEVQCRWKELMMTRVFDAIKSLRLDVVSVQASAPDGLLGLKIRAKYASSAAVVPAMISETLRTAVAGY

SEQ ID NO: 959 - protein, 620 aa, Gossypium hirsutum
  Orthologous to G585
MSTGVQHQERVPMNLKKQLALAVRNIQWSYAIFWSISTRQPGVLEWGEGYYNGDIKTRKTVQSVELNTDQLSLQRSEQLRQLYESLSAGESSPQAKRPSAALSPEDLTDTEWYYLVCMSFVFNIGQGLPGRTLSSGQPVWLCNAHCADSKVFGRSLLAKSASIQTAVCFPFSGGVVELGVTDLVFEDLSLIQRVKTLLLDDPQPIVSKRSIQVDGMNNDLACPALDPLILATKLSPILGCEQLETVSPDDSPDGLEPKQSREDSLLIEGINGGASQVQSWQFMDEEFSNCVHHSLNSSDCISQTIADHRKVVPLCRGENDNGLQDVEECNQTKLTSFDRQNDDRHFHEVLSALFKSSHPLILGPQFRNSNKESSFIRWQKNGLKPQKERDETPQKLLKKILFLVPHMHDRGLIESPETNAVRDAAWRPEADEICGNHVLSERKRREKINERLMMLKSLVPANNKADKVSILDVTIEYLQTLERRVAELESCRKSEARTKIERTSDNNGKKSSLSKRKAYDVVDEADQEIGYVASKDGSTDKVTLSMNNKELLIEFKCPWREGILLEVMDALSILNLDCHSVQSSTTEGILSLTIKSKYKGSSVAKAGPIEQALQRIASKC

SEQ ID NO: 960 - protein, 644 aa, Antirrhinum majus
  Orthologous to G585
MATGIQNQKIVPENLRKQLAIAVRSIQWSYAIFWSNSVAQPGVLEWGDGFYNGDIKTRKTVQSVELNQDQLGLQRSDQLRELYESLSLGETNTQAKRPTAALSPEDLTDAEWFFLVCMSFIFNIGQGLPGRTLARNQAVWLCNAHRADTKVFSRSLLAKSASIQTVVCFPYSEGVVELGATELVPEDLNLIQHIKTSFLDSPATVPKIPNYVSNSITNNNDLICEALEHANIPENDLDQLLNCPDTNICSPDNSLDDFADNLLIDESNLAEGINGEVPQTQSWPFMDDAISNCLNSSMNSSDCISQTHENLESFAPLSDGKGPPETNNCMHSTQKCNQQIENTGVQGDEVHYQGVLSNLLKSSHQLVLGPYFRNGNRESSFVSWNKDGSSGTHVPRSGTSQRFLKKVLFEVARMHENSRLDAGKQKGNSDCLAKPTADEIDRNHVLSERKRREKINERFMILASLVPSGGKVDKVSILDHTIDYLRGLERKVDELESNKMVKGRGRESTTKTKLHDAIERTSDNYGATRTSNVKKPLTNKRKASDTDKIGAVNSRGRLKDSLTDNITVNITNKDVLIVVTCSSKEFVLLEVMEAVRRLSLDSETVQSSNRDGMISITIKAKCKGLKVASASVIKQALQKVTMKS

SEQ ID NO: 961 - DNA, 1695 bp, Glycine max
  Predicted polypeptide sequence is orthologous to G590
  misc_feature (8)..(8): n is a, c, g, or t
aaggcaanttgtttttatcgggaactgaaataaaacccccataggattttctacaggggttatataatccgcataacaatggggagttatattctctgcatacattatacatacataattttatcaactcgagaagctagaaagagaaaaaaaaaaaaatctgctctcatgtcacgtaggccagaggctttttgagaacattacaaaatgctcaagggataatattgagattcctgcttttacgaaaccaaaattcagaaggcattactggcagtaaacttcaaaaatctgacttttcggtcttcgagttgccactgaccactttctcccttctgcagtctctggtgaaaagcttttcaagacatgttgcattgcatgcacgaacctagctacatatcattcacataagcatcatatacctacctaccaacaatgttggtctcactatttcttatgatcactcctgaatgatctcttccgccaatgcatggttgcgaagagttgctgttgtctttgggttcacatgcttgcgtgtcaaaagggaatgatagtctcgtgcctgattcgaattctttgacaacttgagaaccacctaatgtattggcatctgaatggataccacttgattgctggtgctgcaaaatgtcttcccctcgtattggctcagaagatcctcctttgtgttgaagaggtttcatatccgtttggattcggggttccagaccgaaagaagtttctgggttgtcaatgtatggaggatagggcacagatggctgatttgggagattgtgtttgttaggtagattggatgcatagtgcaagggattgttgtcttggtgcagaggcagagtagctgacatgtttaaagaggtaaacctgtttctttcacttaattccatacccatctgagacaactgcagaggctgcaagccttcaggaaagcacataggatgcaaactcaacccatttctcattgacagcatctgtacttgtagctgaagctgtttaaggtattcaatagcttcatcgagcattgaagccttatctgtcttgttagaatttggaattaggttttgcaaagccttcattttctcgttgatcctaccccttctccgcttctctgacaaattatgaacttctgcagctcttgatcttttagatgaactcctagaagaagcagcctttgttggaacttcttcggccggagcctcaacaccctcctcactctcacaatcatagtcatcattctcgttctcactcactccagcagaagaagaagacacatttgcagcagaagcaccatggcccttgaaggaactgcaagcggcagaacccgaggcaaaagaagcggtggaatcaacggccaagatcttcccatcttggagctgtgacgccgtgaaagaagggtggtgtgcatttacgttttgttgagcagcgttggaggtgcaggatccagcaggcatggagtgggaaggtgaagatgaacggagcagaatctgacgcagaaaaagtgagatttcgtcttgtgaggagaggttcttgtcaaagtggtacatgtcacccattctgtgtgtgtgtgtgtgtgtttgaagaatgcagagaactgaaaggggtttcggtttggttgtggtggttttgttttgttttcggacgcgtggtgagaagaggagagaaagaaagtagtaaatggtactg

SEQ ID NO: 962 - DNA, 1373 bp, Glycine max
  Predicted polypeptide sequence is orthologous to G590
acggctgcgagaagacgacagaaggggcaccctatgtagaaaaaacgaaattcccaaaaaatagacagggacataacctaaagcagcatataaatatcacacatcaggtcagataatacacggccgatagcataacagagcacaccaacaccaacatcagcattctcattctctctctgctccctgtcggttttggctttgatctttcaagttcaatggctggtgacgtaggaagagccttgcctcctcctgattcagaagaattctcaaccttgttcagccaactcctccacaattctcccccactaggaatggaccccaatcattcacctcctgatttcaccccacacaacaccaccatcaacatcaacagcaacaacaacaacaacgctgggccttcctctccctcaaatttcaatttaaatttcaatttctctgacccccatcattacatccctgcctctgatgccaccaccttcaagcaacacaacatcaaccacaacaacaatcacacccctgatttcacttcttctcatgttgagaagagtgtggaggcatcgaaacctgtcccaccaccacgttcttcgtcaaagaggagtagagctgcagagttccataatttgtctgaaaagagaaggaggagtaggattaacgagaaaatgaaagccttacagaatttaattccaaattccaacaagacagacaaagcttcaatgctagatgaggccatagaatatttaaagcagctccagcttcaagtgcaaatgttaatgatgagaaatggtttgagcttgcatccaatgtctttgccaggaggactaagacctatgataatgcctcagactggattgaatcttgatgggagtaatggatttcagaattctacctgtgcaattgcctcatcttcaaatgatgaaagcttggtgcggcatgcctttagttttccaaagcaatgcagcatctcaaataagtctattggtgtaccctccgtgaaaaacatagcaacttcggatacctcatccacttttcatccctctattaaggatgcactctacggcaacatgccacaaccgtttatggatacaacaaagattggaaaaccctctccagacgtgtcttaaacagctcgatttcattgagggagaaaagaattttttagatggcaagtcgcctcgtaaaagggtagctttgttcaggcattataatctacatttaaatctgctgactatatgacactccattgggttgttcctggtgcagtttaatttgtagcagtttgacagagtctttgtgccattgttgacacttgcataaaaatgtacaagtattttataacttcatcaattgcaaaatgcagataatgaacattctgc

SEQ ID NO: 963 - DNA, 930 bp, Glycine max
  Predicted polypeptide sequence is orthologous to G590
ctctctctctccaagttgtttttggtttgatctttcaagttcaatggctggtgacgtaggaagagccttgcctgctcctgattcagaagaagggtgagccttgttcagccaactcctccacaattctcccccactaggaatggaccccaatcattcacctcctgatttcaccccacacaacaacaccatcgacatcaacatcaacaacaacatcatcaacaacaacaacaacaacaaccctggtcctttctcttccttcaaatttaaatttctctgacccccatcattacatccctgcctctgatgccaccacctttaaacaacacacccctgatttcacttctttttctgttgagaagagtgtggaggcatcgaaacctgtcccaccaccacgttcttcttcgtcatagaggagtagagctgcagagttccataatttgtctgaaaagagaaggaggggtaggattaacgagaaaatgaaagccttgcagaatttaattccaaattccaacaagacagacaaagcttcaatgctagatgaggccatagaatatttaaagcagctccagcttcaagtgcaatacttgtgattgattctgcagatgttaatgatgagaaatggtttgagcttgcatccaatgtctttgccaggaggactaagacctatgataatgcctcagactggattgaatcttgatgggagtaatggatttcagaattctacctgtgcaattgcctcatcttcaaatgatgaaagcttggtgcggcatgcctttagttttccaaagcaatgcagcatctcaaataagtctattggtgtaccctccgtgaaaaacatagcaacttcggatacctcatccacttttcatccctctattaaggatgcactctacggcaacatgccacaaccgtttatggatacaacaaaga

SEQ ID NO: 964 - DNA, 670 bp, Oryza sativa
  Predicted polypeptide sequence is orthologous to G590
aactagtggatccccgggctgcaggcaatgaacctctccaccccaccccgcgacgcgacgcgacgagccgtacaccgaccgccccgcgccgctgctgccggagccggagagagaagctgaagccgaagcagaggcagccgcagcggcaaaactcaaaagacgtcgtcaaaagctctgccgcgcttgcagctttctcgggctcaaggaaaagccatcacaaaaccagagacacacagagagagagagagagagagagagagagagagactgaagaaaggtggcaactcctgcagcagctgcagcagcaagcgctagtgtttgtggtttgctggtgctgtggcgaggcgatgatggatgggcgaggaagccaggaggaggagcacctggatttgatcatgcgacaccacgccagcatggggctggatcgctgcgagagcgaggaggcgctggggtcgtcggagtcggagcagcccaccaggccggcgcggccgcgcggcaagaggagccgcgccgccgaggtgcacaacctctccgagaagaggaggaggagcagaatcaatgagaagatgaaggccctgcagagcctcattcccaactccagcaagacggacaaagcctccatgcttgacgatgccatcgagtacctgaagcagcttcagctccaggtcca

SEQ ID NO: 965 - DNA, 908 bp, Zea mays
  Predicted polypeptide sequence is orthologous to G590
  misc_feature (6)..(6): n is a, c, g, or t
cggggnaaccgtcccgtctccaatcctaaatgcacccgccgtttgcgatgcgacggacgacgacgcggccggaggagagggaggcccgcgaccgaggcgaagcgcaggaccgccggcactgcagccgatcgaaaggcgctctcaaaagctctgcgctgcgctggcagctttgagctttctcgggccggagaaaagccgaaacaaacaaacggactggccgagtcgaggagagagagagggtgagagggagaagagaaggcggagagagaaagcgagctgaggagcgcaggcgctgtcgctggcgaggacatgctcgcggcagcgcggtatgggctcaaaccataggcgtgtcaggaacggtggagagcggcgaccactactcgccttcgtctcggtcctcgcgcgctcctgggctgcctcttggtgctagaaaccctcgcgtcgcgggtgcttggttgcgactgcaagcgccaagctgctgtgctgtgccgtgggtggcggcggcgggagtggaagtggaaccgcagccggtgctgtgatggacgcgcagcagcagctggatttggtcatgcgtcaccagagcatggccaccgtctgcgagagcgaggacgcgctggggtcgtcggagtcggatcccgcgaggccggcgcgcccgcgcggcaagaggagccgcgccgccgaggtgcacaacctctccgagaagaggaggaggagcaggatcaacgagaagatgaaggcgttgcagaccctcatacccaactcgagcaagacggacaaggcttccatgcttgatgatgccattgagtacctgaagcatcttcagctccaggtgcagatgttgtctatgaggaatggcctctatctgcccccaggaaacctggtctggagcacccgagactctggcaccc

SEQ ID NO: 966 - protein, 315 aa, Oryza sativa
  Orthologous to G590
MGLDRCESEVGVRCPRLIRSDAGGDLAALGSSESEQPTRPARPRGKRSRAAEVHNLSEKRRRSRINEKMKALQSLIPNSSKTDKASMLDDAIEYLKQLQLQVQMLSMRNGLYLPPVNLSGAPEHLPIPQMSAALDQNSAKASDPSVVLQPVNQTSGALLPFELASQHKPLFLPGVPNATALEPRFLVESSRSNLQSLRFTEPAEMIYPDEMMLKHRLTSASESTIVPGTDEKSVRQNTYMMNADRFDRYALSKDQLQHIMPKNTESVLDMPHLQRILTKVLIVSDYKLTIQLPILDRLQTSDTKVRVEGRIKVNP

SEQ ID NO: 967 - protein, 315 aa, Oryza sativa
  Orthologous to G590
MDEQRGRGGFDELVLLHQQQEQRRRREQQQEEEEEEEVRRQMFGAVVGGLAAFPAAAAALGQQQVDCGGELGGFCDSEAGGSSEPEAAAGARPRGGSGSKRSRAAEVHNLSEKRRRSKINEKMKALQSLIPNSNKTDKASMLDEAIEYLKQLQLQVQMLSMRNGVYLNPSYLSGALEPAQASQMFAALGGNNVTVVHPGTVMPPVNQSSGAHHLFDPLNSPPQNQPQSLILPSVPSTAIPEPPFHLESSQSHLRQFQLPGSSEFHKILFLHVLLSVKDGVSWRDNAKAPPIITSRKSARKRDELHQERIIHVEHQ

SEQ ID NO: 968 - DNA, 1309 bp, Oryza sativa
  Predicted polypeptide sequence is orthologous to G597
ccgcgcaagtacgcgcccgacgggagcatggcgctcgcgctcgcccccatctcctccgcctccggcggcgccgcgccgccgcctccgccgccagggcaccagccgcacggcttctccatcagcagcccggcgtcggatccgaacgccaagcgccgcggccggccacccggctccggcaagaagaagcagttcgaagccctaggctcatggggcatcgccttcactcctcacatcctcaccgtcaaggccggcgaggatgttgcttcaaaaattatggccttctcacagcaaggccctcgcacagtttgcattctctcagcgaatggtgcaataagcaatgtaacacttcggcagccagctacatctggtggacttgtgacttatgagggccgatttgagatcatctctctatcaggttctttcctgcttgcagaggatggcgacactcgcagcaggactggtggcctgagtgtcgcacttgcaggatctgatggccgagttcttggtggatgtgtagctggaatgctgatggccgcaacccctgtccaggttgtcgtggctagcttcatcgcggaaggtaagaaatcgaagccagtcgagacaaggaaggtcgaaccgatgtcagcgcctccacagatggcaacctacgtgccagctccggtggcgagcccgccatcggagggcacatccagtggatcgtccgatgactcgggcagcccgatcaaccacagcgggatgccgtacaaccactccgggcagcagcagcaacaccagcagcaccagcacatgccccctgcttacgcatccggtggctggtcgctctcagctcatcatcagaacaggcacgactctgacatgaagatgatgtcgaactaacactctgctcggcctcgaggcgccccatttgtttggttgggctgaagaaggagctgatgatggatggtggatcgtgttcgtacccccctctgctagctaagagatttaggaccatggtgatgaatgatctcagagagatgtgttgttgctgttgtttttccttggagtaagattaatttaggcgctgttgtaacgctgtagctgtcataattaagccgcctctaacgcaagagtttattatgtgttgtactaccggtggatatgccttctgcttgtctgtcttgctgagatcttcacctccttagtaggctagtagtagtctacatacagacttgtatgaatttacctgaatgctttgatttcaattcgagaacttttactaggttgtttcaaaaaaaaaaaaaaaaaaaacgacctgcagcccggggatcca

SEQ ID NO: 969 - DNA, 1040 bp, Oryza sativa
  Predicted polypeptide sequence is orthologous to G597
atgattaggtgacactatagaagagctatgacgtcgcatgcacgcgtacgtacttggatcctctagagcggccgcggcgccgccgcagagcgggcgcttggcgtacaccgcggacggcaccccggtgttcgccccggtgagcgccgcggtctcggcgccgccgggttaccagccgggtggcgccgccggtggcaatggcgcggcggcgctggcggactccggcggggagcccgtggccaagaagaagcgcgggcggccgaggaagtacggccccgacgggtccatgtcgctggggttggtgacctcgccgacggccgccgcgtcgacgccggtggcgcagggcgtcccagggccgttctcgccgacgcagccgaagccgccggcgagcttcttgtcgtcggggtggccggacggggtgaagaagcgtggccggcccaagggttctaccaacaagccgcgcatcgacgccgtcggatcggcgggagttggatttacaccacacgttattacagttctagctggagaggatgtgtctgcaaagattatgtcgtttgctcagcatggaaatcgtgcggtttgtgttctttcagcaaatggtgccatatcaaatgtaacacttcgccaaactgctacttcaggtggaacagtaacatatgagggccgattcgagatactatcgctgtctggctctttccttctaaccgaccatggaggccagcgtagtcgaactgggggactcagtgtttcactggctggtcctgatggtcgtctgttgggaggcggtgttgccggacttctcatagcagctactccagtccagattgtggttggaagcttcaattctgaagggaaaaaggagccaaagcagcatgctcattcagaacccgcatccgcgccatcgaaagccgtgccgacggccgggatgggacccaacagcccaccttcaagaggcacacttgagtgaatcctcaggtggagctggaagcccatggcatgctagacaagaatggcgcctcgtgccgaattcctgcagcccgggg

SEQ ID NO: 970 - DNA, 1172 bp, Oryza sativa
  Predicted polypeptide sequence is orthologous to G597
ttttttttttttttttttaccagaaggtaaaagttctgtgcctcttgctaaccgcaacatgccaacatagttacatagaagcaatgagctttttcatcggtgtctggaagatagaaaaacaatttaaccacctaaataacacattgagtctagtctccaatagtaacagcacctacaccagaagagctagctagagatgcaacggctacagttttcttccctgattcaggttcagacattacactagataggggggcctcctccgccccctcgcctcccgccgccggacctcgagtaccaccgccacgacatttcctttcgcaagttctacggcggtcagacgggaccaaggtctggtcactgatgatgaggaggaggaggagctcacttccaggataagctgggtagccctggctggccatggttgctggccgtgacaccttggttcagcgggctccccgggccgcccgatgattcactcaatgtgcccctcgatggcgggctgcttggccccgtcccgctcatcggcaccatctttagcggtgcagacattgggtctgaaggagcatgcagcttcggcccctttttcccttcggtgttgaagcttcccaccacaatctgcactggtgaagcagctgtcagaagtccagcaactccaccacccaagacgcgaccatcagggcctgctagagaaacactgagcccaccagttcgactacgatggcctccattctctgatagaaggaatgaaccggacagcgacagtatctcaaatcgtccctcgtatgttactgttccaccggaagtagcagcttgccgaagtgtcacatttgatatggcgccgtttgctgacagaacgcatactccacgagttccatgctgggagaatgacatgatctttgcagatacatcctctccagctttaacaaaaataacatgaggtgtgaatccagctcctgctgacccgatatctccaattccgaaagagggcacgtgcttcttgttcgtggagccctttggccgccccctcttcttcgcccccggcggcggcgccgacaacacggcgtccggcgacttcgcggcagccgccggcgagaaaggcccggaggccgccaccgccgcggtggacacgggcaccaatgccagcctgcagcccgggggatccactagtt

SEQ ID NO: 971 - DNA, 1923 bp, Zea mays
  Predicted polypeptide sequence is orthologous to G597
tatcgagctagtgacacccaagacgcttgacagctcagcgtcgtctgagtcagaagtacgtgtcctctattacagcactctcggatccgtcgctcgtgtcgacgttgagacatcgtactcgtctactatcgctcttgctgtcagtgtcggacgcacgcgactgtagcttcattcgctctctctttggtccgttatgcgattgtgtccctatgacttgcccaccggccccccccgacacctatacgaccactataaggaagctggtacgcctgcaggtaccggtccggaattcccgggtcgacccacgcgtccgcccacgcgtccggacgaggcgcgctgcggcacgggtgaggggagctgcgccggagcaccagccctagggttttcaccgccctgccgcgagatggacgtccgggacctgcaccagcagccgcagcagcagcaggctccgccgcgcgtgggatccccgccgcaggccggcgccggcggtgtcatgatgcagcatgccgccgcgttcggcgcggcgccgccgccgtccgggttgccgcaggcctcggcggccaacgttatgcacgggatgtcccttgcctttaaccctatggcttcgccggacgcctcgtcacccataagcagcatgaagattgtggacatgccgctggggtctatgtaccgccctgattccggcgcgacgggcttgcagcagcagcagcccggctccggtggcgttggtgccagcggtggtgctatcgtcgccgtcagcggcggggaccttgtgaagaagaagagggggaggccgaggaagtacggcccagatgggagcatcggcttgggactcaagaccgccgcggcgggggtcactgaagcgacgggtgcccagtccggtggaggcgggtctacccctaaccccgacggcaagcgtagagggcgtcctcctgggtcaggcaaaaagaaacagctggatgctttgggatcttcggggacgtcgtttactccccacataataactgtgaagcccaatgaggatgttgcgtccaaaataatggctttttcccaacaaggcccgcgcactacatgcataatttcggcaaatggtgctctgtgcacggcaacactgcggcaaccagcaacctctggtgggatagtgacatatgagggccacttcgatatactctctctttcgggctcattcttgcttgcagaggatggtgacactcgcagcagaacaggtggtttgagcgtggcactggctggaagtgatggacgcatagttggaggttgtgttgctggaatgctgatggcagcgacacctgtgcaggttgtagttggcagtttcattgctgaagctaaaaagccaaaagaagagcaacccaaacgtgagccaacatcggtgccaccgcacacagctgtctttggggcggcctcgactgccagccccccatcggatggcacatcaagtgagcactccgatgatcccgggagccccatgggaccaaacggcagtgcattcaccagcgcggggcttcccctgcactccacatatgctgcagttggttggtcactatcagaggaccaaagccgttatgatccagatctaaagatgatgaccgactgatgggtgccgtttcgcagcttccttgttagcagttgacttagctgagtaggctcaataactaaggaatcctgagagtggtaaaaccttcaggaaggagtagatcacgagtaataattagtaccagtgcatgcctttgtcttgttatatcgtagttagcagtttgtatttgtatggtttcactgtcagaaagtctatgcagcattccttctggtttccatctgtatccacgtagtgcaacaattctcatccatggattggtattgctcaccccacatcatcgtatgcttgtattgcaaaaaaaaaaaaaaaaa

SEQ ID NO: 972 - DNA, 1739 bp, Zea mays
  Predicted polypeptide sequence is orthologous to G597
attcggctcgaggaaaccatgagttctaggtttgctgaaatctccctggatctttaatctgttcatctccttgcgtgagtctgtggcgttagcgtgatgccttctcctagttcatgaacttccttccggttcgcaatccctagtcgtcttgtcctgatcttacttgagtgctcgtgagctctttccagtggctaaagagtgcagatttgagttctggcccaagaaccgcgtgctagcccgccatggaggtgaggtccgagcaagggctgatggcggggagggatctattcggcatgccgaagagcccgccggcgcccgcgccgccgtcgtccgccgccatgcagagcgtgcgcatggcgtacaccgcggacggcaccgccgtgttcgctccggtgagctcttcgcctgcgacgccgtcttaccagccgcagggcgcagcccacggcgctagcatgtccgcggcgacggtcgttggaggcaatggcgctccagctgcgccgagcatgggtgagccgctggccaagaagaagcgcggacgaccaaggaagtacgggcccgacgggtccatggcgctggcaatggtgcctgcttcggcggcttcagggtcgccggcgacagggcagggtttttctgggccgttctcaccgcctgcgttaaatccggcgagctctctggtggtggcgtcgccagacgggttcaagaagcggggccggcctaagggttctaccacaagccacgcgtggacgctgctgggtcatcaggagctggatttacacctcatgttatcacagttcaagctggggaggacgtggcatcaaagattatgtcattttcccagcatggaacacacggagtttgtgttctttcagcaaatggctccatatcaaatgtaacgcttcgtcagactgctacatcaggcagaactgtaacatacgagggtcaattcgagatactgtcgctgtcggggtcattcttcctggctgaggatggtgtccagcgcagccgaaacggaggcctcagcgtgtcgctggctggtcctgatggccgtctgttgggtggtggggtcgcaggacttctagtagcggcttcaccggttcagatagtactgggaagcttcaattctggaggcggaaaggagccacaaaagcaggctccttcagaacccacatcggctccaccgagggttgctccgacagccgggatgggaggacccagcagcccttcttcaagaggcacattgagcgagtcatccggtggcgctggaagcccaccgccactgcatcgagccatggctgctagtgctagcaatagtaaccagccaccgttcttgtccagcatgccttggagatgagtttgcagcttgcattctcttggccaattccaggcaggatgtagcaatctgcgctttcagtagcgcccgttgtgtgagtagctgtgtgtagtacaagccagaagcttgggtgggaatagaattgcgtctggtaaatctgtagctctgttgtaggttccaccctgaattcctgtgctaggtgtgttgagctgtgtaagcaatgtaatcctttcagcgttatcaaatgctatttagttaaatgtttctaccaaggcatgtcgatttgaatcataagatatcaatttgctgtttgcgtcaaaaaaaaaaaaaaaaaaaaaaaaaaaaaaaaaaaaaaaaaaaggaaaaaaaaaaaaaaaaaaaaaaaaaaaaaaaaaaaaaaaaaaaaaag

SEQ ID NO: 973 - DNA, 1775 bp, Zea mays
  Predicted polypeptide sequence is orthologous to G597
ccacgcgtccgcgtgctttacttccgcttccaatataccttttttctgcgacaaaaatcatttttgttaattgcgaaaaggaaagagcccgtgtgaacaggaggggtgaggagaagagggggaaaagagagagaaatcggagggcattagcaagaaaccatgagttctaggttcgcaatccctagtcgtcttgtcctgatcttacttgagtgctcgtgagctctttccagtggctaaagactgcagatttgagttctggcccaagaaccgcgtgctagcccgccatggaggtgaggtccgagcaagggctgatggcggggagggatctattcggcatgccgaagagcccgccggcgcccgcgccgccgtcgtccgccgccatgcagagcgtgcgcatggcgtacaccgcggacggcaccgccgtgttcgctccggtgagctcttcgcctgcgacgccgtcttaccagccgcagggcgcagcccacggcgctagcatgtccgcggcgacggtcgttggaggcaatggcgctccagctgcgccgagcatgggtgagccgctggccaagaagaagcgcggacgaccaaggaagtacgggcccgacgggtccatggcgctggcaatggtgcctgcttcggcggcttcagggtcgccggcgacagggcagggtttttctgggccgttctcaccgcctgcgttaaatccggcgagctctctggtggtggcgtcgccagacggattcaagaagcggggccggcctaagggttctaccaacaggccacgcgtggacgctgctgggtcatcaggagctggatttacacctcatgttatcacagttcaagctggggaggacgtggcatcaaagattatgtcattttcccagcatggaacacacggagtttgtgttctttcagcaaatggctccatatcaaatgtaacgcttcgtcagactgctacatcaggcagaactgtaacatacgagggtcaattcgagatactgtcgctgtcggggtcattcttcctggctgaggatggtgtccagcgcagccgaaacggagggcctcagcgtgtcgctggctggtcctgatggccgtctgttgggtggtggggtcgcaggacttctagtagcggcttcaccggttcagatagtactgggaagcttcaattctggaggcggaaaggagccacaaaagcaggctccttcagaacctacatcggctccaccgagggttgctccgacagctgggatgggaggacccagcagcccttcttcaagaggcacattgagcgagtcatccggtggcgctggaagcccaccgcccctgcatcgagccatggctgctagtgctagcaatagtaaccagccaccgttcttgtccagcatgccttggagatgagtttgcagcttgcattctcttggccaattccaggcaggatgtagcaatctgcgctttcagtagcgcccgttgtgtgagtagctgtgtgcagtacaagccagaagcttgggtgggaatataattgcgtctggtaaatctgtagctctgttgtaggttccaccctgaattcctgtgctaggtgtgttgagctgtgtaagcaatgtaatcctttcagcgttatcaaatgctatttagttcaatgtttctaccaaggcatgtcgatttgaatcataagatatgaatttgctgtttgcgtctcgggcaacttctgttctagagaacgttctactcactgaaatttgagcctgttgccaagtttgaaaacaaaaaaaaaaaaaaag

SEQ ID NO: 974 - DNA, 920 bp, Zea mays
  Predicted polypeptide sequence is orthologous to G597
cattgggtacctcgaggccggcctaagggttctaccacaagccgcgcatggatgctgctggatcgtcaggagctggatttacacctcatgttatcacagttcaagctggggaggacgtgtcatcaaagatcatgtcgttttctcagcacggaccgcgtgcagtctgtgttctctcagcaaacggtgccatatcaaatgtgacgcttcgtcagactgctacatcaggcggaactgtaacatatgagggtcggttcgagatactgtcactgtcggggtcattcctcttggtggaggatggtggtcaacgcagtcgaactggagggctcagtgtgtcgttggctggtcccgacggtcgtgtgctgggcggtggagttgcagggctcctcgtagcagcttcgccagttcagatagtactgggaagtttcaattctggaggcaaaaaagaggcaaaaaagcatgctccttcagcacccacaccagcgccactgaaggtcgctcctccgacaacaaccaggatgggacccaacagcagcagccctccttcaagaggaggtacattgagcgagtcatccggtggcgccggaagcccaccaccgccgctgcatcaaggcatggctgctagcagtagcaacgaccagccgccgttcctgtccagcatcatgccatggaaatgatcctcttatgtagtagtataagtcagaagctttgagtagggaggtaaatttgtagctctactgtaggtttaaacctgaattcctgtgctacgtaggtgtattgagctgtaacggatgtgatcatttgagagctaccaagtgttgtttagttaaatgttttaccaaggcatgtcgatctgagccagaagattcttgctatgaatttgttgtttgcgcgaaaaaaaaaaaaaaaaaaagggcggccgc

SEQ ID NO: 975 - DNA, 1810 bp, Zea mays
  Predicted polypeptide sequence is orthologous to G597
cattgggtaccgtggggccgcccgagcctgacagagctgatccgacccctcaggccaggcaaagactctccgccctcccactcccacctcgccacctcctccttcctcgctcccaattttcttttttcccttccccttcggcgcggcaggattttctccatctgctttccccatttccgccgtattttattcgatttcgaggtcggttttctgttgcacagggagaaaggtcacgtccaaccgccgcgaactgcgcatgtgaactgtgcccgacgaggcgcgctgcggcacgggtgaggggagctgcgccggagcaccagccctagggttttcaccgccctgccgcgagatggacgtccgggacctgcaccagcagccgcagcagcagcaggctccgccgcgcgtgggatccccgccgcaggccggcgccggcggtgtcatgatgcagcatgccgccgcgttcggcgcggcgccgccgccgtccgggttgccgcaggcctcggcggccaacgttatgcacgggatgtcccttgcctttaaccctatggcttcgccggacgcctcgtcacccataagcagcatgaagattgtggacatgccgctggggtctatgtaccgccctgattccggcgcgacgggcttgcagcagcagcagcccggctccggtggcgttggtgccagcggtggtgctatcgtcgccgtcagcggcggggaccttgtgaagaagaagagggggaggccgaggaagtacggcccagatgggagcatcggcttgggactcaagaccgccgcggcgggggtcactgaagcgacgggtgcccagtccggtggaggcgggtctacccctaaccccgacggcaagcgtagagggcgtcctcctgggtcaggcaaaaagaaacagctggatgctttgggatcttcggggacgtcgtttactccccacataataactgtgaagcccaatgaggatgttgcgtccaaaataatggctttttcccaacaaggcccgcgcactacatgcataatttcggcaaatggtgctctgtgcacggcaacactgcggcaaccagcaacctctggtgggatagtgacatatgagggccacttcgatatactctctctttcgggctcattcttgcttgcagaggatggtgacactcgcagcagaacaggtggtttgagcgtggcactggctggaagtgatggacgcatagttggaggttgtgttgctggaatgctgatggcagcgacacctgtgcaggttgtagttggcagtttcattgctgaagctaaaaagccaaaagaagagcaacccaaacgtgagccaacatcggtgccaccgcacacagctgtctttggggcggcctcgactgccagcccccccatcggatggcacatcaagtgagcactccgatgatcccgggagccccatgggaccaaacggcagtgcattcaccagcgcggggcttcccctgcactccacatatgctgcagttggttggtcactatcagaggaccaaagccgttatgatccagatctaaagatgatgaccgactgatgggtgccgtttcgcagcttccttgctagcagttgacttagctgagtaggctcaataactaaggaatcctgagagtggtaaaaccttcaggaaggagtagatcacgagtaataattagtaccagtgcatgcctttgtcttgttatatcgtaggtagcagcctgtatttgtatggtctcactgtcagaaagtctatgcggcattccttctggtgcagaaggcatatatcacatatttcaaaccaaacaaagg

SEQ ID NO: 976 - DNA, 1393 bp, Zea mays
  Predicted polypeptide sequence is orthologous to G597
  misc_feature (60)..(60): n is a, c, g, or t
gcggccccggcggcagcctcgtcgcccgccgcgtccatgcccggcggggtgcgcctttcnttcgaccggccgcgcagacttcaaagacgggagcatggctctggcgctggcccccatctcctccgcctccgccggcggcggcggcggcgccgcagcccccgggcagcagcagcaccgcggcgggttctccatcggcagccccccgtccgaccccagcgccaagcgccgcggccggccccccggctccggcaagaagaagcagttcgaggccctgggttcctggggcatcgctttcacccctcacatcctcgccgtcaaggcaggcgaggatgttgcttcaaaaataatgacattctcacagcaaggccctcgcacagtctgcatcctctcggcgaatggcgcgattagcaacgttacgcttcggcagccagccacatctggtggactagttacttatgaggggcgcttcgagataatctcgctgtccggttctttcctgctcgcggaggatggtgacactcgcagcaggactggtggcttgagcgtcgcgctcgcgggatctgacggccgagttcttggagggtgtgtcgctggaatgcttatggctgcaactcctgtccaggtcgtggtggctagttttatcgcagaggggaagaaatctaagccagccgaagcgcggaaggtcgaaccgatggctgctcccccgccgccgccgccacagatggctgccttcgtgccggctccggtggccaccagccctccgtcggaggggacgtccagcgcgtcgtctgatgactccggcagcccgatcaaccacggtgcgatgccgttcagccactccagtcagcaccagcaccctcaccagcaccagcagcacatgccgcctgcctacgcgtccgggggctggtccctctcggtgcaccagcagaacaggcatgattctgacatgaagatgatgtcgaactaacaggcgccccattcgttggtgtttgggctggagaggaaggaaaggaacctgctgatggttaggttggtactgctgctatgaaacggtcctcttgcgcgtcgtctgtgctctggtcagtgacgacgtgtcgatctgctacttaagctaagctagctaggagagttagggttcatggtctcaccccccgctgttgtgcccctgagtaagattaatttaatttgaattagtcgctctcataatgctgcgagttgtgatggtttcctgatcagatcttcaccttctaggctagttaaaatatcatttctctagtactatggatcatggatttacttggatacttgggtttaattcaggaatttgatcgtaaaaaaaaaaaaaaaaaaaaaaaaaaaaaaaatcgagagtaaaaaaaaagggtttttaaaa

SEQ ID NO: 977 - DNA, 1789 bp, Zea mays
  Predicted polypeptide sequence is orthologous to G597
cgacaggaccactgccactgtgaagcacagcgtcagcggcgacaagacgaaggggcggaagctgccaagccgatagatctacgcaaatggagaccaaggacgtgtcgccgctcgccgccgccaccaccaccaccgcggcgcccgtgcctgcaccgacctctcaaccgcctccgccgccgccggccccttcttctatggcgccgccgcagcaccagcaccagcaccatccgccgccgccgttcgcgcagcaggcggccccggttccgtcgcctgccgcgtccatgcccggcggcatgcggctctcgttcgaccagatgtccgggaaggcgcccggggagcagcaccaccactccgcgcccatgctgtacacggtgccaccaccgcagtccgccgcgggcgcgggcgcaccgggggccaatgtgctgggcatgggcgagctgatgcgcaagaagcgcggccggccgcgcaagtacgcgcccgacgggagcatggctctggcgctggcccccatctcctccgcctccgccggcggcgccgcagcccccggacagcagcagcacggcggcgggttctccatcagcagtcccccgtccgaccccaacgccaagcgccgcggccggccccccggctctggcaagaagaagcagttcgaagccttgggctcctggggcatcgccttcacccctcacatcctcaccgtcaaggccggcgaggatgttgcttcaaaaataatgacattctcacagcaaggccctcgcacagtctgcatcctttccgcgaatggtgcaattagtaatgttacacttcggcagccagccacatctggtggactagttacttatgaggggcgctttgagataatctcgctatctggttctttcctgcttgcggaggatggtgatactcgcagcaggactggtggcttgagtgtcgcacttgcaggatctgatggccgagttcttggagggtgtgttgctggaatgcttatggctgcaactcctgttcaggttgtggtggctagctttatcgcagagggaaagaaatcaaagccagcggaagcacggaaggttgaaccgatggctgctcctccaccgcagatggctacctttgttccacctccgctggccaccagccctccatcggagggaacatccagcgcatcatctgatgactctggcagcccaatccaccacagtgcgatgccgttcagcaactccagccagcatcaacaccctcaccagcaccagcaccagcacatgccgcctgcctacgcatccgggggttggtccctctcagtgcaccagcagaataggcatgattctgacatgaagatgatgtcgaactaacagtgctcaacctaggcgtcccatttgttggttgggctggagaggaaggaagctgctgatggttggtactgccgctatgaaatggtcttcttgcgccgtctgtcctgatcagtgaccccgtgttgctctggtcaatgacggtgtgtctgctatagctaagatagctaggaaggattagagtttatgggctcacttgctgttgttcccctgggtaagattaatttaatttgaattagccgctgttgtaatgctgtagccagtgtcctgaagtcgcttatcagtcagtccctgacgcgagctgtgatggttgcctgatgagatcttcacctcctagtcctaggctagttaaaatatcatttctctagtactatgaatcatgaatttacttggatgcttcggtttgattcaggaatttgatcgtattatgtttcgttttgttcccc

SEQ ID NO: 978 - DNA, 1295 bp, Zea mays
  Predicted polypeptide sequence is orthologous to G597
ccacgcgtccgggtggcgcgcccgtgcactcgggtggcgcgggtgagccggggaccaagaaaaagcgtggccggccaagaaagtacggccccgacggctccatgtcgctggcattggtgcccgcatccatggctggggagccggcgccggcggctcttggagcttccggtcctttctcgcctaacggcccgaaggcgccgaacactgcgccgtcagcgtcgccggacggcgcgaagcagcggggccggccgaagggctccaccaacaagaagcacgtggctgcgctcgggccagcgggggcaggttttacgcctcatcttatttttgtaaaagccggagaggacgtatcggcaaagatcatgtcgttctcgcagcacgggacacgcgcggtctgcatcctttcagcaaacggcgccatatcaaatgtgacgcttcggcaatctgccacttcgggtggaacggtgacatacgagggtcgtttcgagatactgtctctgtccgggtcgtttcttctgtcagagaacggtggccagcgcagtcgaactggtgggctcagcgtttcgctagcaggccccgacggccgtgtcctgggtggctgtgttgccggactcctgacggctgcttcaccggtacagatcgtagtggggagcttcgacgccggtggaaagaagcagccgaagcagcagcagcagcagcagcttgctccgtcaccggcgccactaaatctcgcgccgacgggcgtggcggcagggccgagcagcccgccgtccagaggcacattgagcctaagcgagtcgtccagtggcgccccgccgagcccgccgcacgcaggggccagcggtggccatgggcagcagcagcagcagccacagccaggtggcttctccggtctgttctggaaatgacgagacccccggacaccgtctgaccgtggtagaactggcagaaaggactaaaggcgcgtgaggcactcgtcgaggccgaagctcactcggtgagaagcagcggtagcttgtaggtggtgtcaagactgtgtagctcttgctgttgctgtaggtgtaaatcgtgcgttgtgattgtgaggtggttgcttattgtctgtcgtctggaatggatgccgtgtactgaacctgtgcccccaatgcagcatgtcggaagttcttggtttcttctgcttgggtgcatcggcttgccgcacgatatgcatccatgcccataataatacgtgtatagatccaccttgttgtgaaggtcacaccaactccaaaaaaaaaaaaaaaaaaggcgacgcggcc

SEQ ID NO: 979 - DNA, 973 bp, Zea mays
  Predicted polypeptide sequence is orthologous to G597
tgggtacctcgaggccggccgaaggctccaccaacaagaagcacgtggctgcgctcgggccagcgggggcaggttttacgcctcatcttatttttgtaaaagccggagaggacgtatcggcaaagatcatgtcgttctcgcagcacgggacacgcgcggtctgcatcctttcagcaaacggcgccatatcaaatgtgacgcttcggcaatctgctacttcgggtggaacggtgacatacgagggtcgtttcgagatactgtctctgtccgggtcgtttcttctgtcagagaacggtggccagcgcagtcgaactggtgggctcagcgtttcgctagcaggccccgacggccgtgtcctgggtggctgtgttgccggactcctgacggctgcttcaccggtacagatcgtagtggggagcttcgacgccggtggaaagaagcagccgaagcagcagcagcagcagcttgctccgtcaccggcgccactaaatctcgcgccgacgggcgtggcggcagggccgagcagcccgccgtccagaggcacattgagcctaagcgagtcgtccagtggcgccccgccgagcccgccgcacgcaggagccagcggcggcggtggcggccatgggcagcagcagcagccaggtggcttctccggtctgttctggaaatgacgagacccctggacaccgtctgaccgtggtagaactggcactcggtgagaactgagaagcagcggtagcttgtaggtggtgtcaagactgtgtagctcttgctgttgctgtaggtgtcaatcgtgcgttgtgattgtgaggtggttgcttattgtcgtctggaatgcatgccgtgtactgaacctgtgcccccaatgcagcatgtcggaagttcttggtttcttctgtgtgggggcatcggctttccgctcgatatgcatccatgcccataataataggtgtatgtatctaaaatacatggt

SEQ ID NO: 980 - DNA, 917 bp, Zea mays
  Predicted polypeptide sequence is orthologous to G597
  misc_feature (896)..(896): n is a, c, g, or t
gggctcacacacaagaagcacgtggctgcgctcgggttcgcgggggcaggttttacgcctcatcttatttttgtaaaagccggagaggacgtatcggcaaagatcatgtcgttctcgcagcacgggacacgcgcggtctgcatcctttcagcaaacggcgccatatcaaatgtgacgcttcggcaatctgctacttcgggtggaacggtgacatacgagggtcgtttcgagatactgtctctgtccgggtcgtttcttctgtcagagaacggtgggcagcgcagtcgaactggtgggctcagcgtttcgctagcaggccccgacggccgtgtcctgggtggctgtgttgccggactcctgacggctgcttcaccggtacagactgtgcagatcgtagtggggagcttcgacgccggtggaaagaagcagccgaagcagcttgctccgtcaccggcgccactaaatctcgcgccgacgggcgtggcggcagggccgagcagcccgccgtccagaggcacattgagcctaagcgagtcgtccagtggcgccccgccgagcccgccgcacgcaggagccagcggcggccatgggcagcagcagcagccaggtggcttctccggtctgttctggaaatgacgagacccctggacaccgtctgaccgtggtagaactggcagaaaggactaaggcgcgtgaggcactcggtgagaagcagcggtagcttgtaggtggtgtcaagactgtgtagctcttgctgttgctgtaggtgtaaatcgtgcgttgtgattgtgaggtggttgcttattgtctgtcgtctggaatggatgcccgtgtactgaacctgtgcccccaatgcagcatgtcggaagttcttggtttcttcaaaaaaaaaaatncagtggcgggcgggcggggag

SEQ ID NO: 981 - DNA, 448 bp, Oryza sativa
  Predicted polypeptide sequence is orthologous to G634
gcagaattggccataaaaatgcattcttttgcacaagcacaggagaagaaaaaaagatggaatttttactccccccctgcagcattctctctagtctcttcttgggatttgattcatcctagtttagctagctattgctgcatgtatgcacacaccttcctttctttatcttttccgatgggtgcccaaatcgagtaaaattctactccatgcatgcaactttcctgaagctggcggaggagggttaccggaggagcgcgaagaagtgcaaggagaagttcgagaacgtgcacaagtattacaagcgcaccaaggagagccgcgcggggcgcaacgacggcaagacgtaccgcttcttcacgcagctcgaggcgctgcacggcaccgccgccggcgtcgtggcagcgccatcgccggtgacgtcgctggccccgccgccggcgacggc

SEQ ID NO: 982 - DNA, 381 bp, Oryza sativa
  Predicted polypeptide sequence is orthologous to G634
gcggtggcgccggagatgtcgtcattcttgctctgcgggaggaggcggcggggggcggatctccatggcggaggccgcgtcgcccatcagcagccggccgccgccggcgcagcagcagttcgacgagctcggcgtaggcggcggaggcggaggcggaggtgggtttgacgccgaggcgctggcggcggcggcggtcggcgaggagggagccagcggcggcgcggtggggaaccggtggccgcggcaggagacgctggcgctgctcaagatccggtcggacatggacgccgcgttccgggacgccaccctcaagggcccgctctgggaggaggtctccaggaagctggggaggagggttacccgaggagcgcgaagagtgca

SEQ ID NO: 983 - DNA, 469 bp, Oryza sativa
  Predicted polypeptide sequence is orthologous to G634
  misc_feature (405)..(405): n is a, c, g, or t
ttgtttgcggcggcggcggtcggcgaggagggagccagctgttgcgcggtggggaaccggtggccgcggcaggagacgctggcgctgctcaagatccggtcggacatggacgccgcgttccgggacgccaccctcaagggcccgctctgggaggaggtctccaggaagctggcggaggagggttaccggaggagcgcgaagaagtgcaaggagaagttcgagaacgtgcacaagtattacaagcgcaccaaggagagccgcgcggggcgcaacgacggcaagacgtaccgcttcttcacgcagctcgaggcgctgcacggcaccgccgccggcgtcgtggcggcgccatcgccggtgacgtcgctggccccgccgccggcgacggctgtgggggtgtccggcggngtgcgcgcccccgacgagccgtcgtccgcggtggtgatggggaacgtgatgagcttttcgacgt

SEQ ID NO: 984 - DNA, 660 bp, Zea mays
  Predicted polypeptide sequence is orthologous to G634
gactagttctagatcgcggcggccgctcgcgatctagaactagcccacgcgtccgcggacgcgtgggcggcgcacagcaggtggagatgccgccgccattctcgccggctggcggcgccgggcagcggatctcgctggcggaggcgccgtcgcccatcagcagccggccgccggcatcgacgccggcgaagcagtacgacgagctcggcgcgtccggcgccggcgccgtgggcttcgacgccgagggcctggccgccgcagcagctggcgaggagggcgccagcggcggctcggcgggcaaccggtggccgcggcaggagacgctggagctgctcaagatccggtccgacatggacgccgccttccgggacgccaccctcaagggtcccctctgggagcaggtctccagtcccaccactacgctgccaagaacggaggcaccgggaacgggaacggcggcggcgcatcagagcacggctccagaggcatgcaaacgcaggcgagcaacggcagcgttggagccagcaggttcgtcggcgaaggcggcggcgcggcctcggcggcgaagaagccagaggacattatgaaggagatgatggagcagaggcaggcgccgcagcagcagcagcagcagacgcaggcggtgggtcagtggctata

SEQ ID NO: 985 - DNA, 649 bp, Zea mays
  Predicted polypeptide sequence is orthologous to G634
  misc_feature (545)..(545): n is a, c, g, or t
aattcggcacgaggagcctccttcccttctccactcttatccctctctgagtggtaacacacctggcgacgtgcacgagtgcgcgtgtgcgggagcagtagctgtactgtaagcatgcagcagcagcagcacgggggaggcggcggagcaagcggtggaggcccagcgcagcagttctgcgcacagcaggtggagatgccgctgccattctcgccggtcggcggcgctgggcagcggatctcgctggcggaggcaccgtcgcccatcagcagcgccgggcgcggcgcccggcgccggctcagcagtatgacgagctcggcccgtccggcgccggcgcagtgggctttgacgccgagggcctggccgccgccgcagctggtgaggatggcgccagcggcggctcggcgggcaaccggtggccgcggcaggagacgctggagctgctcaagatccggtcggacatggacaccgccttccgggacgccaccctcaaggcccccctctgggagcaggtctccaggaagctggctgagaaagggtacaanccggagcgccaagaagtgcaaggagaagttcgagaacgtgcacaagtactacaagcgcacaaaggagagccgcgccggccggaacgacggcaagacgtaccgat

SEQ ID NO: 986 - DNA, 750 bp, Zea mays
  Predicted polypeptide sequence is orthologous to G634
cattgggtacctcgaggccggccgggaagactatcagaaggtgaaggagagcaacaagaagcggcccgaggactccaagacctgcccatacttccaccagctcgaggccatctacaacagaaagcacctccgcagtctcacaaccgcggcgggtcgtcgggcgcgtccagcaaccggtggccgcgggaggagacgcaggcgctcatcaggatccggtcggagatggacgcaaccttccgcgacgcgacgctcaaaggccccctctgggaggacgtctccgggaagctcgccgacctgggctacaagaggagcgccaagaagtgcaaggagaagttcgagaacgtgcacaagtactacaagcgcacaaaggaaggccgcgccggcaggcaggacggcaagagctaccgcttcttcgacgagctggaggccttgcacgcagccgcgccgcagccgccgccgccgctcctgccgccgcccagcaccgccccgcagttgcacgccctcgccgcgccagtatccccgccgccccagcagcagttgccggcatccagcgccgccccgccgttgcacgccttccccgcgccagtatccgcgccgccgccgctcctcgtcccgcctacccagatcagctgaacccgagcaggcaagagatagaggggaagaacatcaacgatgacaagagggacaacggtggatcaggtggaggcacgcaggtgccgaccagcaatggcgagacagcgacgacgacga

SEQ ID NO: 987 - protein, 186 aa, Oryza sativa
  Orthologous to G634
MGLTWTPHISVPRHHPLFTIFSPFLLLSLSQSCLCRPPAGGEEAGGELLLRDRELRGRTRRRGRRVPPHLLNSHHSFYDGLYVGGVADARIRPALRTLKQNMSLLLSVLIDRVQPVAQPLVAGVGDGKGAAQRELLEHNGLLGGEEGDRSGSRAGNRWPRQETLALLKIRSEMDVAFREAVLKGPL

SEQ ID NO: 988 - protein, 737 aa, Oryza sativa
  Orthologous to G634
MQQHQGGGSQYGAVPPDMGPFSPTHHASAPAPLPLSTATAAALSQPPPPQQQQQQPRTSYDELAAATSAGAGGFPDDDMLGDAGGSGGGGGSGAAGNRWPREETLALIRIRSEMDATFRDATLKGPLWEEVSRKLAELGYKRSAKKCKEKFENVHKYYKRTKEGRAGRQDGKSYRFFTELEALHAAAPQTPQPQQQQQQQLPPVTSSAPAMHAFAPPVPAPPPMSAMPPPPGPIQPAPISSAAPAVPLELPPQPPINLQGLSFSSMSGSESDDESEDDEMTAETGGSQDRLGKRKQAPAAKGWRLSSRGSSSKSSTGRRRCSGGFWRLWRSERRTHGREEAWRRQEVARLNREQEQLAQERAAAASRDAAIISFLQRIGGQSVQVPPAATVIQMPTPVQLQTPPPVKQPARQHQPQPTPPPPQAAPIPAAPLQQQPPQPQHKETIHHEAVTPRRAPPTSGSSLELVPAAEQHVESGLGGGEGGSASSSRWPKTEVQALIQLRMELDMRYQETGPKGPLWEEISSGMRRLGYNRSSKRCKEKWENINKYFKKVKESNKKRPEDSKTCPYFHQLDVIYRRKHLTGGGGGGASAANVAATAIEHQNPNRHEIEGKNINDNDKRKNGGGGGAQVPTSNGDTAPTTATFDVDSGMKKPEDIVRELSEQPPREFTTDETDSDDMGDDYTDDGEEGEDDGKMQYRIQFQRPNPGGANTAPPPATTPASAVPTSTPTSTFLAMVQ

SEQ ID NO: 989 - DNA, 2267 bp, Glycine max
  Predicted polypeptide sequence is orthologous to G635
gttattacaacccagtttgcgtcaaatctacatcggcttggtagtgtgaaagctgctgctgatttaactggcagaaagttggtatttgttggcatgtctttaaggacttatttagatgcagcttggaaggatggaaaggctccaattgatccatccactctggtgaaagcggaggatattgatgcttatgcgccaaaggatctgcttattgtgacaacgggttctcaagcagaaccacgtgctgccttgaacctcgcatcttatggaagtagtcatgctttcaaactagccaaggaagatgttgttttgtattcagctaaggttatccctggtaatgagtctcgtgtaatgaaaatgctaaaccgcatatcggagattggatcaacaattgttatgggaaaaaatgaaggtttgcacacatctggccatgcatatcgtggagaattggaagaaatacttagaatagtgaagccacaacattttcttcccatccatggagaacttttgttcctgaaggaacatgaattacttggaaaatcaactgggattcggcacactgctgttattaagaatggagagatgcttggtgtttcacatttgagaaatagaagagtcctttctaatggtttcatttcccttggaaaagagaatttacagttgaaatatagtgatggtgatagagcatttggtacatctagtgatctcttcattgatgaaagattgagaattgcattagatggcatcattgtcattagcatggaaatatttcgccctaaaattttagatggttcagctgaaaacaccttgaaagggaagataaggattaccacgagatgcttatggcttgacaaggggaagctgatggatgcactctacaaagctgcccgtgcagctctttcaagctgccctgtaaagagtccactggctcacatcgaaagaattgtgtctgaggtattgaggaagatggtgaggaagtacagtggtaaacggcctgaagttattgccattgccatagaaaaacctgcggccattcttgctgatgagataaacacaaaattgtctggcaaatcccatgtgggtcttggaatgtcaacattaagtaaagcagtggatggacatgggaagggaaatcagtccactgcactgcaggttaaagatgatagtattgataatgcaagtggagctgagggtgatttatctgaggaagacaacactgcaagtgggcctgagggttatttatctgaggaagacaacactgcaagtggagccgagggtgatttatctgagtcagaggattcagatgaattttggaaaccattcattacatcattaccagttgagaagtcaatcaatgctgacaatggttatgtttcaccaaaggagcaaaaatccaatttgaagaaagatgagtctgaagacattgatgaagccaagtcagaagaaacatctaattctgaagccaagtcttcaaaatcggttaagagaaataaatggaaaactgaggaagttaagaagctaattggtatgcgtgaggaactaagtgaaagatttcaagttgtgaagggaaggatggccctctgggaagagatttctcaaaaattgttggctgatgggatctgcagaagtcctggacagtgcaaatctctgtggacatctttggtagtcaaatatgaggggatcaagaatgaggataggaagaaaagttggccatacatagaggacatggaaaggataatgtctgataaagaagcccctgcaaaatgattggaaatatggtggacactggacaggataagaaatattttggagaaccatctacattaaaattgttgataagtttgagtgtggtgaccgggaagataatccatgacttgcatgacattgaagatccctagtgttttttagggctgagggatagacagcataaaggggttggctttcatactggcacgggaatgtctgagtttatgggacgatttattctccacctccaatgcctgtccccgtttttttattacatttgtgtcataatttataatatttgttggtggcacatattgggtgccctaagcaaccatggaaatgtctacctcttttccagacattgaacactgaaaagaaagttttcatacttttacttgcgagtgccaacttaaaaaaaaagtgtgtttgaatgtgcatttggagctccaaattttttagaatgagtcaaatatgatttttgtattgaccaatatgtttggatgtgggcttgaaacacgattctg

SEQ ID NO: 990 - DNA, 1380 bp, Glycine max
  Predicted polypeptide sequence is orthologous to G635
ggctcgaggtgcatggaaatatttcgccctcaaaatttagacagtccagttgagaacaccttaaaaggaaaaataagaattaccaccagatgcctgtggcttgacaaggggaagctgttggatgctctccataaagctgctcatgctgctcttgcaagctgccctgtaagctgtccactggctcatatggaaaaaattgtgtctgagatgttgagaaaaatggtgaggaagtacagtggcaaacggcctgaagttattgccattgccatagaaaatcctgcagctgttcttgctaatgagataaacacaaagttgtctggaaaattaaatgtggatgggatgtcggcattgagaaaagtggtggatggacatgagaaagagaatcagagaaccgaaatgcaaataagagatcgtattgatgtaggtggtctactacctacaaaagacaatgctatctcaagtggagctgaggatggcttgtctgatgcggaggatccaaatgattattttaaaccatttgttgaatcctctccagttgagaagtcaattaaaactaacaatggttatgttccacgaaaggagaagtcatccccattgaaggatgactgttctgaagacactgaagaatgcaattctgtaaatacatcagattctgaacccaaatcttcaaaatcagcaaagagaaataaatggaaacatgaagaagttaagaagctgattgatatgcgtggggaactgaatgacagatttcaagttgtgaagggaaggatggccctctgggaagaaatatctcagaatttgttggctaatgggatcagcagaagtcctgggcagtgtaaatctctgtggacttctttgttacagaaatatgagcaggaggtgaagaatgaaaagaagaacaagaaaaaatggccgtattttgaggacatggaaaggattctagctgataacaagacactagaaacaaaatgattataaaggtgatgcaccagacaagaaaaatttgcaagagttttctgcattatgattggtaatatgtctgagcatggtcgctgggaaggtaatccatcagttgcattattcttgcatcttgaactccttcattgaatatccatagttttgtgaggagatggacagcgttaaatgcattgacattttacattaacacaagttaatgagggagactatgctggttcaggggatgatttatccccttcctcaaaaggtaactacctacccagtgacagcattttagggtcattttgatgatattgattgacatattgaacaactattttaatgatagtgaagggttaatataatgtaacgagaccaaagtacattttttctgttacttataattaatttcattattttgtt

SEQ ID NO: 991 - DNA, 1794 bp, Oryza sativa
  Predicted polypeptide sequence is orthologous to G635
cgggctgcaggtgttctcgctttggctcgtgggtagctcaattgaaagccttcggattagcatttggtgtcttcttacaccaaaaataatagcacaacaaaacttagctattcaattacttaatctagtatagttgatcaaataatatcagctatccctagccctgtagcacactcatggtgaatacgtagcagcttagtcattccaagtgcctgcctcccttttcgtggaatgaattatggcatgtatattctctggagaagaacacgctgcagccatctcatcctgccacttgattgattatgccatcactctccaaaattacaaccactaaactacggccttgggatcattgggttgccatttccccttggcttgataaaaccctgtccatgtccaagaaatacggccacgtctttacgctttcctcatctttcttgctctcctcatatttctgaaccaatgatgtccatagagacttgcactgtgctggtgtacgacttatcccctggctcaacatgctagaagatatctcttcccacagaaccattctccctttcacagtctgaaattgctcattcatttcgccacgcatctgaattaagctcttaatttcctcaggcttccacttgttctttttagaagatttaactggagcagaagaaggatcgctagagtccttacccactatgctgatcttgccaatctttgatttactcccttgagctgaaccatggacaattcttgcaatttttacagctgtaggggatttgaatgagtcccttaaatgctctagtgttttaggctatatgcaaatctgaggagaaaaatgcttcgccattggagcttgtggttgcatcatcacgtgttgttctcaggacatcaggaagattttctttagcctctccctctgtattctctgggcatgatttatcactttcttcaagactcctacctgaactcctgctcgaatgcctaggagctgagaaagatccaaactttccagatgatttagtttctgagtcttctacaaaactcactgttgtgttctctgtagcaaccgcaatgacatcaggcctcttcccactatacttccttaccattttcctcaagatttcagataccatcctctccatgtgactaagtggacaattcactggacaacttgataatgcagcatatgcagctttgtaaagtgcatctaatagtcttccattatcaagccataggcatcttgttgttattttgaacttccctttcaatcctgactgtgatgaagcaagttccttctgaggtcggaagatttccatgctgacaaaaataacgccatcagatgcaatccttaatctctcatcaatgcagagatcagtggatgttccaaaagctttatcgccatcactatacattagccgcaaatcttccttccctaatgcaacaaacccattagacaaaactcttctgtttcttaaatgtgacacgccaagcatctctccatttttaattacagtggtgtgccttatgccagtagatcttccaagtaattcatgttctttaagaaacaggagttctccatgaacaggcaagaaatgctgtggtttgacaatctgtaggacttcctcaagttcatcgtgataggcatgcccagaggtatggagaccagcatcctttcccatcacaatttttggaccaagctcagtaaggcgatttaacatcttcattacacgtgactcatttccagggataaccttagcagaatacagaaggacatcctcttggatagttaagcatcctcag

SEQ ID NO: 992 - DNA, 633 bp, Oryza sativa
  Predicted polypeptide sequence is orthologous to G635
ggagtcttgaagaaagtgataaatcatgcccagagaatacagagggagaggctaaaggtactattcgcaaagtatcttaatcttacctttgaaaatgtggcggtctaaccctatattattatctgtattaagtgtcccatcatactgattttcttgttcactgttcagattcatgaaattctgtgcatttgattccatgccttttgtgctgtctaagatgtatcgacactgtcgttactttgttacacagaaaatcttcctgatgtcctgagaacaacacgtgatgatgcaaccacaagctccaatggcgaagcatttttctcctcagatttgcataagcctaaaacactagagcatttttgggactcattcaaatcccctacagctgtaaaaattgcaagaattgtcaatggttcagctcaagggagtaaatcaaagattggcaagatcagcatagtgggtaaggactctagcgatccttcttctgctccagttaaatcttcaaaaaagaacaagtggaagcctgaggaaattaagagcttaattcagatgcgtggcgaaatgaatgagcaatttcagactgtgaaagggagaatggttctgtgggaagagatatcttctagcatgttgagc

SEQ ID NO: 993 - DNA, 2332 bp, Zea mays
  Predicted polypeptide sequence is orthologous to G635
ttttccatactggtgactggaaaattgatgaatcaccagtggatggaaaaaaatttgaccgacaagcattggaggagctctccaaagaaggtgttactcttatgatgagtgactcaacaaatgttctttcccctggaagatcaatcagcgaatctgttgttgctggttcattgctgcgacatatttcggaagcaaaaggaagagtaattacgacacaatttgcttcaaacatacatcgaattgggagcatcaaagctgctgcagatttaactggtcgaaaaatggtgtttgttggaatgtcactcaggacataccttgaagctgctttcaaggatggaaaggcaccactggatccatcaaccttgatcaaggtagaggatatggatgcgtatgcccctaaagatcttttggttgtcactacaggttcacaaggagagccacgtgcagctctgaatcttgcatcttatgggggaagtcacgctcttaaactatcaaaagaggatgtccttctttattcagctaaggttattcctggaaatgagacacgggtaatgaagatgatgaatcgtctcactgatcttggcccaaaaattatcatgggtaaagattctggcctgcatacctctgggcatgcctaccgagaggagctggaggaagttcttcggattgttaaaccacaacatttcttgcctgttcatggagaactcctatttctcaaagaacatgaatcacttggaagatcaactggcatacggcacacaactgtaataaaaaatggagaaatgcttggtgtatcgcatctaagaaacagaagagttttgtccaatgggtttgtttcattagggaaggaggatcttcagctcatgtatagtgatggtgataaggcttttggtacatccactgatctctgcgttgatgagagactaagaattgcatctgatggcattatttttgtaagtatggagatcttccgacctcagaaggaacatgggttagcgcagtcaggtttgaaaggaaaatttaagattaccacaagatgtctatggcttgataatggaagattattggacgcgctctacaaagcagctcatgctgcattgtcaagctgtcctgtgaattgtccacttagtcacatggagaggatggtagctgaaatcttgaggaaaatggtacggaagtatagtggaaagaggcctgacgtcattgctgttgctacagagaacaccacagcaggtttctcagaacacctcgacactaaagcatctggaaattttggaccgtcctcagctactagccacctgagcaggagtccagctacgagtcttgaaggcagttataaaacacacccagacaacccagaggtggatgctgaagaaatccttcccgagactgtgagaacaacacccgacgatgcaaccacaagctccaatggcgaagcattattctcttcagatttacatcagcctaaaacattggagcacttttgggagtcattcaaatcccctacagctgtcaaaattgcacggatcgtcaatggggggaacaaacaaaatttcggcaagattggcataatgggtcaggactcattaatccagtcagctcctgctccagttaaatcctcaaaacggaacaagtggaaacctgaggaaattaagagcttaatacagatgcgtggcgaaatgaatgagaaatttcagagtgtgaaaggaagaatggtactgtggaaggagatttctgataccatgttgaaccaaggagtaagtcgtactccggcacagtgcaaatctctatggacatcgctagttcagaaatatgaggaaagcaaggatacggaaagcatgaagacttggccgtatttctcggccatggataagattctatcgcagcaaggggagatggcaaccaaaggatagaaaaaggcttgtagcttagtggtagaaatttagaatattgattggtatgttgcagcagagcccagtcagtctagtaatataaagatgaaatatctgtctacaggtacagcacctggcgatttattgggatcggattcttttgttttgtgtaagacatgcagtagcacaagatcgagatgcatcgactggcttggaattaagcttcagggcccgtggactcagagcggggtagccaggagcgctctattcttagcaacaggcagacatgtgtggttttatctgccagataacgtttgtaactcctataatgtaatagcctacacggtaggcgaacggcgaacccctaaaagacaactgatgtatcatatgttttgaggagttatgtaatcgcctgcacggcatatacgtgactttttttc

SEQ ID NO: 994 - protein, 422 aa, Oryza sativa
  Orthologous to G635
EEVLQIVKPQHFLPVHGELLFLKEHELLGRSTGIRHTTVIKNGEMLGVSHLRNRRVLSNGFVALGKEDLRLMYSDGDKAFGTSTDLCIDERLRIASDGVIFVSMEIFRPQKELASSQSGLKGKFKITTRCLWLDNGRLLDALYKAAYAALSSCPVNCPLSHMERMVSEILRKMVRKYSGKRPDVIAVATENTTVSFVEDSETKSSGKFGSFSAPRHSSRSSGRSLEESDKSCPENTEGEAKENLPDVLRTTRDDATTSSNGEAFFSSDLHKPKTLEHFWDSFKSPTAVKIARIVNGSAQGSKSKIGKISIVGKDSSDPSSAPVKSSKKNKWKPEEIKSLIQMRGEMNEQFQTVKGRMVLWEEISSSMLSQGISRTPAQCKSLWTSLVQKYEESKKDEESVKTWPYFLDMDRVLSSQGEMATQ

SEQ ID NO: 995 - DNA, 2438 bp, Glycine max
  Predicted polypeptide sequence is orthologous to G636
ttgaattcccgggtcgacccagcgtccgcccacgcgtccgggtggatcaaataattcgggggacgatgagaggggtagaatcgaagaaggtgaacgtagcttcggcggtaaccggtggccgcgacaagagactttggccttgttaaggatacgctccgatatggacgtggcgtttcgagatgcaagtgtcaagggtcccttgtgggaagaagtatccaggaagatggcagagcttgggtatcacagaagctccaagaagtgcaaagagaaattcgagaacgtgtacaagtaccacaagagaaccaaagaaggccgaagtgggaaacaagatggcaaaacctatcgtttctttgatcaactacaagcccttgagaaccactctccaacaccccattctcccaacccttcaccaaaacccccacaatcagcaccatcaagagtagtagcatcatcggtgtcactaccaattgcaacaacaacaacagtgtcactaccaattccaacaccaacaacagtgccaatgcagcctatattgtccaacaacgctatactcactagtagtgtccccaatatcactgttccatcaacaacaccactccctataaccattcctcaacccattctcacctccccatcaataaacctcacaatcccttcttaccctccaacaaaccctaccaatttcccaccaccaccaaaccctaccctaccatcctctttccccaccgacaccttctccaattccagctcctcctccacctcctccgaggaaacattggaagggagacgcaagaggaagcgcaagtggaaagatttcttcgagagactaatgaaagaagtgatcgagaagcaagaggagctacaaaagaagttcctggaagccatagagaaacgcgaggacgacagaatagcaagagaagaagcatggagagtacaagagatgaaaagaatcaatagggaaagagaaatcttagcacaagaaagatccatagccgcagccaaagacgcagccgttatgtcattccttcaaaaaatagccgaacaacaaaacctcggtcaagtatcgaccaacatcaacctcgtacaacaaccacaacctcaattacaaccgcagccaccactacaacaacaagtgacacaacctagtattgcagcagcacaacctcccgtacaacagccaccgcccgtggttgttacacagcccgtggtgctgccagtggtgtcacaagtgacgaatatggagatagtgaaagccgataataatagtaacaacaataataacggcgagaatttcttggcaccaagttcttctcggtggccaaaagtggaggttcaggcattgataaagcttcggacgagcatggatgagaagtatcaagagaatggaccaaagggtcctctctgggaggagatctcagcctcaatgaagaagctcgggtacaaccgaaacgcgaaaaggtgcaaagagaaatgggagaacatcaacaagtacttcaagaaagtgaaggaaagcaacaagcggagaccggaagattccaagacgtgcccttatttccaccagctggacgcgctgtacaggcagaagcacaggggcgaagagagccccgcggcggtggaggcgaagccggagagcgcggtggcgccgttgatggtgcagccggagcagcaatggccacctcagcagcagcagcaggatagggacatcacaatggaagacatggagaacgaagatgatgaatatgaagaagagagggaaggagaggaagaattagaggatgatgaagatgaagaggatgaagaaggtggtggtggtggtgggaactatgagatagtggcaaacaaaacaagtggtggtggtggtgcttctgctgcttcagtgggggcttcaacggagtagtagtgtgaagaaaccaggtttagcgtgggggtgggtcagagagagtgcaggggttgtcggaggtggccattgtggtggagaaattaagaatttgaatattcacgtacggtgaagttacacatggcaatggttatggtatcgacctgtggtggaaagatgaggtttgctttggttggttggtactttgttgtagcatatagtcagtaagattatatgtttcttttttctgttttataaaaaaagttgtttattttttgggagaataaataaaagtccgatcagagagggaatttaagatagagaccaataaagaagaagaggggccttaattaaggttgtatttttttttttttttatcttcatcttgttttttatgttcgttcctggtgctgtaaatgggaggagagattaattcgggttttgtccttttcttatctctttaagttttgacatcttgttactcttcaaatgactgacattgacttctctttcaaaaaaaaaaaaaaaaaaaaaaaaaaaaaaaaaaaaaaaaagggcggcc

SEQ ID NO: 996 - DNA, 1338 bp, Glycine max
  Predicted polypeptide sequence is orthologous to G636
cggcttgagcgaacaacaaaacctcggtcaagcgttgaccaacatcaacctcgtacaaccacaaccacaactacaaccacaaccaccggtacaacaacaagtgacaccacctaatatagtaccagctcctatgcaacaaccactgcctgtgattgttacacagcctgtggtgttgccagtggtatcacaagtgaccaatatggagataatgaaagccgataataataacaacaataacaataataacaactgcgaaaatttcttgccaccgagttcttctcggtggccgaaagtggaggttcaggcattgataaagcttcgaacgagcatggatgagaagtatcaagagaatggaccaaagggtcccctctgggaggagatctcagcctcaatgaagaagctggggtacaaccgaaacgcgaaaaggtgcaaggagaaatgggagaacatcaacaagtacttcaagaaagtgaaggaaagcaacaagcggagaccggaagattccaagacgtgcccttatttccaccagctggacgcgctgtacaggcaagaagcacaggggcgaagagagccccgcggcggtggaggcgaagccggagagcgcggtggcgccgttgatggtgcagccggagcagcaatggccacctcagcagcagcagcaggatagggacatcacaatggaagacatggagaacgaagatgatgaatatgaagaagagagggaaggagaggaagaattagaggatgatgaagatgaagaggatgaagaaggtggtggtggtggtgggaactatgagatagtggcaaacaaaacaagtggtggtggtggtgcttctgctgcttcagtgggggcttcaacggagtagtagtgtgaagaaaccaggtttagcgtgggggtgggtcagagagagtgcaggggttgtcggaggtggccattgtggtggagaaattaagaatttgaatattcacgtacggtgaagttacacatggcaatggttatggtatcgacctgtggtggaaggaggatgatgaggtttggttggtactttgttgtagcatataatcagtaagattagatttttttttttcttttctgttttataacagtttgtttattttttgggagaataaataaagtccgatgagagagggaatttaagatacagaccaataaagaagagagggaccttaattaaggttgtattttttcttttcttttatcttcatcttatttttttttaatgttcgttcttggtgctgtaaatgggaggagagattaattcgggtttaaaaaaaaaaaaaaaaaaaaaaaaaaaaaaaaaaaaaaaaaaaaaaaag

SEQ ID NO: 997 - DNA, 869 bp, Glycine max
  Predicted polypeptide sequence is orthologous to G636
  misc_feature (784)..(784): n is a, c, g, or t
  misc_feature (833)..(833): n is a, c, g, or t
cggctcgagcggctcgagcggctcgagcggctcgagaaaaaatttgaaagaattcaccaccctttttgctctgtttatatttttaatttttctcctgctctcagctgctgtaagtaattgttgcggtgctgttttggcaaagagggagagagagagagacccaaaagagactatgctcggggactcagctctgttgggaggaggaggaggagaaggtggtgcctccgccgatgtagtggcggcgaccgccacgcatgatgcgacaacgacgacgacgaccggaggaggcggtggcggatcaaataattcgggggacgatgagaggggtagaatcgaagaaggtgaacgtagcttcggcggtaaccggtggccgcgacaagagactttggctttgttaaggatacgctccgacatggacgtggcgtttcgagatgcaagtgttaaaggtcccttgtgggaagaagtatccaggaaaatggcagagcttgggtatcacagaagctccaagaagtgcaaagaaaaattcgagaacgtgtacaagtaccacaagagaaccaaagaaggtcgaagtgggaaacaagatggaaaaacatatcgtttctttgatcaactacaagcccttgagaaccactctccaacaccccattcccccaacccttcatcaaaaccactacaatcagcaccatcaagagtagtagcaacaacaactgcatcatcaatgtcactaccaattccaacaccaacaacaacagtgccaatgcagccaatattgtccaacactatnacccacaagtagtgtccccaatatcactgttccatcaacaacaatactncctataaccatacctcaacccattctcaccacccca

SEQ ID NO: 998 - DNA, 1546 bp, Glycine max
  Predicted polypeptide sequence is orthologous to G636
ggctcgagaaacttgtcagtaacaataatggtttggtagaagtagtagtcgcccttgaaacaggacaaacgatacgaactttccccaactcaaaacaacacacagactccagttactgaaattgccctgtttcatttttctcccctaaatttcaccgacgctgtcttttttctcttttgccctcacccttttgagagcatcatagctgtaacttgggcgttaccgatgctggaaatctcaacttcacaggaaaccccgctagagaacgcggacggcggctccgcggcggtctcggacgggtcgaaagccgagcacggcgaggacgatgaccggaatcccgccgcgaaccggtggccgacagaggagacaatggctttgctcaagacaaggtccgtaatggacgttgcttttcaaagaacgcacaccctcaaagccccctctctgggaaacaagcctcaaggaaattatcggagctaggatataatagaagtgctaagaagtgcaaggagaaattcgagaacgtttacaagtaccataggagaaccaaagaaggtcgttttggaaaatcaaacggtgcaaaaacttatcgatttttcgagcagttggaagccttagacggaaaccactcacttcctcctccgacaacaaccgacgacaccgacaacaacaacaacgttggtgatgatgttgttatcctgaacgcggttccgtgttcggttagtgcggcggcgcacgagcactcgagttcgacgacgtcgtcttcggggaagatgaagaggaagctgacgcggtttctggaggggctgatgagggaagtgatagagaagcaagagacgctgcagaggaagttcgtggaagtgttggataagtgtgaaaaagatcgaatggcgagggaggaagcgtggaagaaggaggaactcgaaaggatcaagaaagaacgcgagcttctggctcaggaaagatcaattgctgctgccaaagacgaagctgttcttgcttttcttagaaagtttgcagaagcagaagacacggtgcagttactcgagaaaattcaggttcaaaacgacaaacagaaaaacatgaaacaaaatggcggtaatgataatgctaatggaggtggtggtgtcgcagttgtcactgatatggataaacaagaatgtggaaataatggtgttagtgttgggaattttgtgcacatgagtagttcgcggtggccgaaggatgaagtggaggctttgataaggttaaggactgagtttgatgtgcaggcacaagggaataataataatagtaataatgggtctaaagggcctctttgggaggagatatctttggctatgaagagcaccggttatcgcccgaagtgcaaaccggtgtaaagagaaatgggagaacataaacaagtacttcaagaggatcccggcggtcgtcttctcgaaacctcaggattccaagacgtgtccttattatcaccaccttgaggctttgtacagtaagaagcctaagaaggtggtggatcatgggaacgagttgaagcctgaggagc

SEQ ID NO: 999 - DNA, 2165 bp, Glycine max
  Predicted polypeptide sequence is orthologous to G636
  misc_feature (2147)..(2148): n is a, c, g, or t
  misc_feature (2161)..(2163): n is a, c, g, or t
ggctcgaggctgtaattgcatagggacacaacatctctatagctatatgcagctaggagactcaagtgtgttggagatctcctcccatacccagcctgagatggcggtgacggcagcagtgttgccaccagaagaagtagcccatgatggcagcgacaacagtggtggtggtggtggtggtgagatgattgggatggacttggatgcaaattcaggtgaaggaaatgaaggtaataataagatgagctttggagggaaccggtggccccgccaagaaactttggctctcttgaagataaggtcggatatggatacagtttttcgagattcaagtcttaaaggtccactttgggaagaagtttcaaggaaattggcagagcttggatatcaaaggagtgcaaagaagtgcaaggaaaaatttgagaacgtgtacaagtacaacaagagaaccaaagagaacaaaagtggcaaatcacatggaaaagcctataaattctttgatcaattacaagccctcgagaaccaattcacagtctcttacccgccaaaaccacaacctacttctactttgactacaacaaacacattgacaagtgatcatggtaacaaagttatctcttatgtcacaccttttccttccacaaaccctactctcattccaccttctccacaaaccaacaccaccaccaccaccaccacaacaacaacatccactaccgaccctagagactcatcaccaccacaaaccaacaacaacaataatagtgtcacacactctttgccaaacatgaacacctctttctctaccaccactgcctccacctcatcctccacagcatcagatgaagacttggaagagaggtataggaggaagagaaagtggaaggactacttcaggaggctcactaggaaggtcttgttgaagcaagaggagatgcaaaagaagttcttggaagccatggaccaaagggagagggaaagggtggcacaacaagacaattggaggatgcaagaaatggcaaggatcaatagggagcatgagattcttgttcaagagagatcaacagcagcagccaaagatgctacagtcattgcattattgcaaaagatgtatggccaacaaaaccccacacaacaagttgaagtagagccaccaccacaacagaagcaaacaattccccaatcgctgcctccaatattaatgccaaacaataatttcgaggtcaagaaaataaataatggtcacagtgttactagtactactactggtactgttgctactgctactactactactacttcgccggtgaattcttcttcttctcggtggccgaaggcggaagttcatgctttgataaggataaggacaagtctagaaaccaagtatcaagagaatggaccaaaagctccattgtgggaagatatctcaattgcaatgcaaaggctagggtacaaccggagtgcaaagagatgcaaggaaaaatgggagaacatcaacaagtacttcaagagagtgagggagagtagcaaagaaaggcgtgaagatagcaagacatgtccctatttccacgagcttgaagctctatacaaagaaaagagcaaatcgtccaagaacccctttggcatcttccagaatatgaagcctaatgagatgatgctgatgatgacggagccactgatggtgcaaccggagcaacaatggaggcccccacctcaatcattggaagagggtgtagggatggagaatgcaagtgaagaatatcatgaaaatgaagaaaatggtggtgacgatgatgataatattgaagaagatggagatagtgtggaagatgcaggaccaaacccgtgtgagattgcgacaaataattaaacgtgcttcagtggacaccgttgaagtagacaagataaggaattttctgaatggagaaaaatttacgtgtgtgcttaatttacttttacttatttcggaaaaaaatagtcctttattttttttatcattttattaaacttcaaaatgtgattatttcttaaggaaaacaattgttgggtatagtatagtcaatcaggttttatttttcttatggggtcgtaagttgtaacacctgcaaaaaaaaaaaattgtcataaattgttgacattaaagacanngcacaaacacctnnnct

SEQ ID NO: 1000 - DNA, 1676 bp, Glycine max
  Predicted polypeptide sequence is orthologous to G636
gacaatagggagagacgacaagtggctcaacaagaggcttggaggatccaagaaatggcaaggatcaatagagaacacgaacttcttgtccaagaaagatcaactgccgcagccaaaaatgctgcagttattgcttttttgcaacagttatctggtcagcaccaaaattccacaacacaagccaatttccctcaacaaccacctccacaaaaagttacaatagtacaaccaccaccacaacaagctccacaaccacaagctccattggtgttgtcaaatagtgacaacatggagattcagaaaatgaataatggtcacagtgttgttactgctactgttactgctactgctactcctactcctactactactttcgttgctgctgctactgctattactactactccttcttcattgagttctttatcttcttctaggtggccaaagacagaagttcatgctttgataagactgaggacaagtcttgaaaccaagtaccaagaaaatggaccaaaggctccattgtgggaggatatatcagcaggaatgctgaggctcgggtacaacaggagtgccaagagatgcaaagagaaatgggagaacatcaacaagtacttcaagaaggtcaaggagagcaacaagcaaaggcgcgaggatagtaagacatgtccctattttaatgaacttgaagctttatacaaagaaaagagcaagactcagaacccctttggcgcttcgttccacaacatgaagccacatgagatgatggagccattgatggtgcaacccgagcagcaatggagacctccctctcagtacgaacaaggtgcagcgaaggagaacaataataatgaaagaaaagaaagagccggggaggaagaagatgaagaagaagaagaagaagaagaagaggatgaaaatgaagagggagatctagagagtgtggaagatgaaggaggtaaccgttatgagattgcgacaaataaactttcttcagtggacaccgttgaatgagacaagataaggaagtttctgattggatggagagttttaattttaattttaattttaattttaattttaatatatatttttttcttcttctgggggatggatttttaattattatgtaagttgattttaatttttccaaaattggggttaggagatgtcactgaaagggcatgatgatggcacaaacaccggcactataaaattcaattctttaataatgaatgacccatctaaaagcatggtggtgcagaagcagaagcagaagcagaagcacaaggtacctatctgacacactttctgatcatgggccagcttaaaagcagatcattggagctgtgggtcacattccggccgccatgaactgggatcagagatcgttaattaacactaagaaacaacagttcacatgggccagcaaagcagaagcatagctatagtgggtgtacatgtttttgcgctcataaatttatgtgtaaagtgtaaattgaagatgagagagagagagagagaaaaaaagaatacgaggtcccatagcagtttaatgaaatgaaataaaataaaaaagtcacatgcatgatgcaactcttgtaattttcctttactttcattatatatcacggaacccactgtgtggtactgctttcaaaaaaaaaaaaaaaaag

SEQ ID NO: 1001 - DNA, 1830 bp, Glycine max
  Predicted polypeptide sequence is orthologous to G636
attcggctcgaggaagtttcaaggaaattggcagagcttggatatcaaaggagtgcaaagaagtgcaaggaaaaatttgagaacgtgtacaagtacaacaagagaaccaaagagaacaaaagtggcaaatcacatggaaaagcctataaattctttgatcaattacaagccctcgagaaccaattcacagtctcttacccgccaaaaccacaacctacttctactttgactacaacaaacacattgacaagtgatcatggtaacaaagttatctcttatgtcacaccttttccttccacaaaccctactctcattccaccttctccacaaaccaacaccaacaccactaccaccacaacaacaacatccactaccgaccctagagactcatcaccaccacaaaccaacaacaacaacaatagtgtcccacattctttgccaaacatgaacgctcctttcttaaccaccaccacctccacctcttcctccacagcatcagatgaagacttggaagagaggtataggaggaagagaaagtggaaggactacttcaggaggctcactaggaaggtcttgttgaagcaagaggagatgcaaaagaagttcttggaagccatggaccaaagggagagggaaagggtggcacaacaagacaattggaggatgcaagaaatggcaaggatcaatagggaacatgagattcttgttcaagagagatcaacagcatcagccaaagatgctgcagtcattgcattattgcaaaagatgtacggccagcaaaaccccacacaacatgttgaagtagagccaccacagcaacagaagcaaacaatgccacaatcacagcctccaatattaatgccaaacaataattttgaggtcaagaaaatgaataatggtcacagtgctacaagtactactactactactacttctccggtgagttcttcttcttcttctcggtggccaaaggccgaagttcatgatttgataaggttggcgccaggtcttgaaatcaagtatcaagagaatggaccaaaggcttccattgttgggaagatatgtcaattgcaatgcaaaggcttgggtccaaccggagtgcaaagagatgcaaggaaaaatgggagaacatcaacaagttcttcaagaaagttagggagagtagcaaagaaaggcgtgaagatagcaagacatgtccctatttccacgagcttgaagctctatacaaagaaaagggaaaatctcagaacccctttggcatgtttcagaatatgacgccaaatgagacgatgatgatggagccatttgatggtgcatccggagcaacaatggaggcctccacctcaatcattggaagagggtatagggaaggataatgccagtgaagaatataatcaagaaaaagaagaagaagtagaagaaaatggtggtgatgatgatgataatattgaagaagatggagatagtgtggaagatgcaggaccaaacccgtgtgagattgcgacaaataattaaacgtgcttcagtggacaccgttgaagtagacaagataaggaattttctgaatggagaaaaatttacgtgtgtgcttaatttacttttacttatttcggaaaaaaatagtcctttattttttttatcattttattaaacttcaaaatgtgattatttcttaaggaaaacaattgttgggtatagtatagtcattcaatttttatttttcggatggggttgtaacatgctactgaaaaaaattgtcatagattgatgacattaaagacgaaaaaatttaaaatttcgaactattaaaaagcggcgctctagaggatc

SEQ ID NO: 1002 - DNA, 2149 bp, Glycine max
  Predicted polypeptide sequence is orthologous to G636
attcggctcgagcaaaatttcgatatgtgatgtggttttctgacagtcattttgatacatacatggtgtgttttccaaataagttaccaaatcaaattggttcttcaaaagcaacattttcttcctcccttatttcggttacccactcttggttgggaatgaatgaaggaagctggcagagcttggctacaacagaaatgccaagaaatgcaaagagaagtttgagaacgtttacaagtaccacaagagaaccaaagaaggacgaagtgggaaatcagaaggcaaaacttatcgcttctttgatcaattacaagcccttgaaaacaaccctgcaattcatggaaagcaatctccaacacctccaaagccgccaccacaaacaacagcactatcagcaacaccagtgtcaatagtggtaacaacaactacaactacaccatcatcaataataatgccacttccattgccaccagtgtctaataacaacaacaacaccactgttccatccacaacatcacttcctatgcctcaaagcattctcaacataacaccaccatcaacactgaacatcacaatcccttcttttccaccatcaaaccctacaacatacttcccaacacaaacaccaaaccctactagcaacaacaacaacaaccctccaagcaccatcaccccaccttccttccccaatttccccgccgatctcttgtcgaattcgagttcttcatcgacttcttcggaggaaacaccgacgacggaggccagagggcgcaagaggaagaggaagtggaaggacttctttgagaggctcatgaaggaggtgatagagaagcaggaggagctgcaaaggaggttcttggaggccatagagaagagagaacaagagcgtgtggtgagagaggaagcgtggagaatgcaagagatgcaaaggatcaacagggaaagggagattctagcacaagagaggtccattgccgcagcaaaagatgctgctgttatgacatttttgcaaaagatagccgaacatcagcaacaagaaactatcaatcttgaaccagcattgaataacaacagcatcactgttgttccacagcaaccagtgccacaagcaacaccaacatcaactccaacaccacaacaagcacaaacaacaacagttcctgaggccccacaagtgcagccattggtcccacaactacaacaacaacaacaaatagtggtgagtaatgtggaaatcaacaaagctgataataacggtgagaatttgatgatggaagcaagctcttcaaggtggccaaaaatggaggtacaggcactgataaacctaagaacaagcctggaaacaaagtaccagagaaagtggaccaaaagggccactgtgggaggagatctcagcgttgatgaggaaaatggggtacaaccggaacgccaaaaggtgcaaagagaagtgggagaacatcaacaagtacttcaagaaggtcaaggaaagcaacaagaagaggcctgaagattcaaagacatgtccctattttcaccagttggaggctctatacagggagaagaacaagggagaggggcagatgaagccggagagcatgatggcgccgctcatggtgcagccggagcaacaatggcctcctcaaacaacgcttgtggtaccgccagaagtaaccatgggagacacccagaatgaccccatggaccggcagtaccatgaggagaatgaggatgacgaggacgacaaggaaattggagatgaagacgaggatgaggacgacgaaggaggtgataattatgagatagttgcgagcaaaccagccacagctgatgcttccggagagtgagaggaaaaaatattgaccaaaaagggcatcaattaaagaatgatggatcaatttgaattcacatattgtcggaaaaatggtggtgttgggatgaaatttggtattgatggtggatggtgatgtgattgtattgaagattttgaaaatgcacgtacttcagaatgacacatgggtataggggtagccagtagggtgggggaatctgggttggaagtacttggtacaatagcagcatatagtcagtaagattatatgttttttttgttttgaaagaagaaataattaattattttttgagctcaaaa

SEQ ID NO: 1003 - DNA, 277 bp, Oryza sativa
  Predicted polypeptide sequence is orthologous to G636
acgcccacgcgttcgcgctgatgctgatgcggacattgctgaaggataagtagcaggatccaccgctgaggggcccgctgtaggaggaggaaatcgcgcgcatggaagtcgccgtctaccagctgcacgcgtaaaggtgcaaggagaagagggagaacatccacacgtacttccgcaagggcaaggaaagcggcaagaatcggacggagcacgccaagacgtgccgctactgtgacgagctcaaccgcctctacttccgatacgtctactgcagctg

SEQ ID NO: 1004 - DNA, 985 bp, Oryza sativa
  Predicted polypeptide sequence is orthologous to G636
cgccgcaggccaccaagtcgccattgccggcgacgccgcagacgcaaagcagcatggacattgtcatgacggccgccgaggcgcacgacgcgggggtccgccgggccggcggcggcggggggcagccgtcgtcgtcgcggtggcccaaggcggaggtgcacgcgctgatccagctgcggagcaacctggacaaccggtaccaggaggccgggccgaagggccccgctgtgggaggagatctccgccggcatgcggcggctgggctacagccggagctccaagaggtgcaaggagaagtgggagaacatcaacaagtacttcaagaaggtcaaggagagcaacaagaagcgccccgaggactccaagacctgcccctacttccaccagctcgacgccctctaccgcaacaaggcggctctcaactcctcctcctcctccgccgccgccgccgcaccgggccctcccgccgccggagcacgcggagccggcggtgacagtcgccgcgccgatctcgcagacaccgccgccgccgccgccacagcccgtgacgacgaccaagaacggcaacggcaccagcagtacaaacggcgcgaacggcgaaggaggaggaggcggctccgggggcatgcaaatgcaggcgagcaacggcagcgtcgtcgccggcaacaagttcttcaccggcgcggcggcgaagaagccagaggacattatgaaggagatgatggagcagaggccgcagcagccggcggcggcgaacaacgccttcaaccgaacggacggcggcggtggcggcggcggcgtggacagcgacaacatggacgaggacgacgaggatgactacgacgacgatgacgacgacgacgacgacgacgtcgacggcaacaagatgcagtacgagatccagttccagcatcagcaccaccaccagcagccgccgcagcaccgccaccagcagagcgtcgtcagaccgaacgccgccgcctcc

SEQ ID NO: 1005 - DNA, 1260 bp, Oryza sativa
  Predicted polypeptide sequence is orthologous to G636
  misc_feature (824)..(824): n is a, c, g, or t
cccgggctgcaggacggagctcgaagcggtgcaaggagaagtgggagaacatcaacaagtacttcaagaaggtgaaggagagcaacaagaagcggcccgaggactccaagacatgcccgtacttccaccagctcgacgtcatctaccgcaggaagcacctcaccggcggtggcggcggcggcgcttccgcggccaatgtcgccgccacggcaatcgagcaccagaacccgaaccggcacgagatagaggggaagaacataaacgacaacgacaagaggaagaacggcggaggcggcggcgcgcaggtgcccaccagcaatggcgacacggcaccgaccacggccacgttcgacgtcgatagcggcatgaagaagccagaagacattgtgagggacccgcgcgtcccgccgccccgggagttcacaacggacgagaccgccagtgacgacatgggcgatgactacaccgacgacggcgtaggaaggcgaggtacgacgccaaaaatccagtacaggatacagttccagaggccgaacccgggcggcgccaacaccgcacactccgccggcagacaaccccggcggtccgcggtgccaacctcgactccgacgagcaccttcctcgccatggttcaataggcgcgcgaacgatgcatcaccaagtacgtacttgttcaaagaaaaaaaatcaaagcatcgccatcaccatcgcatcctctcactacaccaccaccatacacctaacaccatgcatgcatcagccatcagcaaccactctccttcgagttgggatctctcctgcaatgcatgtgcggtaagtgccanatgacatgtgggcccggaataggtgggacccacatgccagtgacaccagtacagcagtggatttgcatccctctccttcaccttgtaattctcccgtgccattccattatttattgatttctctgtgtaataagagccctccctgatctcaccttaacccgaggaagcagagggggtggtagagaaaatgagtccgggtaactttatctctataggtcacctcgtcgtggtaaaggaagaattgtacatcgatgtaacagtccctgatgtctctgttttttttttctctctctctttttctccttcccctccggcgacggcggtatacaagtttgtatacgggtatacaacaattacatacatttccagcaatttggagcagaaaaaaaaaaaaaaaaaaaaaaaaaaaaaactcgagactagttctccctcgtgc

SEQ ID NO: 1006 - DNA, 747 bp, Oryza sativa
  Predicted polypeptide sequence is orthologous to G636
atcgccgccgtgccaccgccgccgctgcagcccacgccggtggcttccgctgcaccaccaccaccgattcaggttcagccgcaccacataatgccgatgacgccgcagccccagctgcaaccaccgcagccgcagagcaaggaggccaacaccgtcgtccgggcggcgccgccgccgcaagagcagcacgacacggcggcgtccggcggcggcggcggcgcgtcgtcgtcgaggtggccgaaggcggaggtgcacgcgctgatccagctgcgcacagagctggagacgaggtaccaggactcggggcccaaggggcctctctgggaggacatctcggcggggatgcggcggctggggtacagccggagctccaagagatgcaaggagaagtgggagaacatcaacaagtacttcaagaaggtgaaggagagcaacaagaagcgccccgaggactccaagacatgcccctactaccaccagctcgacgcgctctaccgcaccaaggcggccaacgccgccgccgccgcctcagcctcgccggctccggcgaccaccaccgtgcttgccccggtgccgatctcccagacgccgccgcacgtcgaccacggcggcagcaacggcaatgggaatgggtgggcgagtgccaacaacggcggcggcggcagcagctccggaggcatgcaaacgaaagctagcaacaatggcacggcgaccgccggcgggctgcccgtcgtttcggtcgccggc

SEQ ID NO: 1007 - DNA, 741 bp, Zea mays
  Predicted polypeptide sequence is orthologous to G636
cctctgggagcaggtctccaggaagctggctgagaaggggtacaaccgcagcgccaagaagtgtaaggagaagttcgagaacgtgcacaagtactacaagcgcaccaaggagagccgagccggccggaacgacggcaagacgtatcgattcttcacgcagctggaggccctgcacggcaccggggcggctcccgcgtcggtggcggcgtcgcaggtgccccctgcgatctctggcggggtgtccggggcagcggggccgttagccgtgcgcttgcctgccgagccaccgcctgcggtgtcgggcggcgtggggatgccgatgacgaccgtgggctacccgagcttctcgacgtccaacacggaggactacacggacgaggacgactccgacgacgagggcacagaggagctggtgggtggcggcgggaacgagcgcgggaagaggaagagggtgtcagagggcggcgcctcggtcgccggcggaggcagcgggaagatgatgaggttcttcgagggcctgatgaagcaggtgatggagcggcaggaggcgatgcaacagaggttcttggaggccatcgagaagcgtgagcaggaccgcatgatccgcgaggaggcgtggcggcggcaggagatgacccgcctcgcgcgcgtagcaggagatcctggcgcaggagcccgccatggccgcctcacgcgacgcttgcgtcctctcctttatacagaagatcaccggacagacca

SEQ ID NO: 1008 - DNA, 1853 bp, Zea mays
  Predicted polypeptide sequence is orthologous to G636
  misc_feature (28)..(28): n is a, c, g, or t
gcgttctggtcgcccgcctcaaccgcgnagcggggcggcgcgctcaggagcgcgccgccgcgggctgcaggacgccgccatcatcgccttcctccagcgcatcagcgggcagtccgtgcagccccctaccgccgttgttgtcccaatgccggcaccggtgtcagtccataccacgccgccggagcagccggggcgccagcagcagcaaccgccgccgccgtcgccccaggcgacaccgcagtcgaagccaatctcagccgcgccgctccagcagcaaccgccacagcagcaaccgaaggatacgtcgcagcaggacgccggcacgccgcgcagcttgcccccggcgtctggccagtcactcgagctggtgcccttcgccgccacggagcatcacgtcgattccgggctaggaggaggggatggaggtgcggcgtcgtcatcgcggtggcccaagacggaggtgcacgcgctcatccagctgcgcatggacctggacatgcgctaccaggagacaggtcccaagggtcctctctgggaggatatttcgtccgggatgcggcggctgggatacaaccggagctccaagcggtgcaaggagaagtgggagaacatcaacaagtactacaagaaggtgaaggagagcaacaagaagcggcccgaggactccaagacctgcccatacttccaccagctcgaggccatctacaacagaaagcacctcagcagcctcacaaccgcggccacatcgtccaccgccgccgccgccgccgctcctcgtcccgcctacccagatcagctgaacccgagcaggcaagagatagaggggaagaacatcaacgatgacaagaggaacaacggtggatcaggtggaggcacgcaggtgccgaccagcaatggcgagacagcgacgacgacgacgacgacgcccgtcgcgttcgacgccgacaccggcatgaagaagccagaagacatcgtcagggagttgaacgagcacccgcgtcgggagttcacgacggaggacgagacggacagcgacgacatgggcgacgagtacaccgacgacggcgaggaaggcgaagacgacggcaaaatgcagtacaggatacagttccagaggccgaacccgggcggcaccaacaccgcgccagcaccggcagcagcgacgacggctgcgccagcggtgccgacttcggctccgaccagcaccttcctcgccatggttcaataggggcgcgggcggcacccctctcaaaccgtacgtacgtatatgcgtccaaaccaaaaacctgcgcgcatcaccgtcacctcctcctttactttaccagtccaccaagcatgcaccatcagtccatcacactgttctcttgttcatcctgtaatcccccgtgccattccattatttattgatttgtttcgtgtataataagatccccaccgttgcggaggatgcagagtgaggctgcggtggtagagcaaaaaggaagagtccagtccctcagtaataacttatttataggtcatcgtcgatcgcgttaaacgagaactgtacatcgatgtaacagtcagtccatgatgtttttcctcccttttttttttagttactcccttcccgggacggcagtatacaagtttgtataagggtatacaagaattacagacagttcaagcaacctggagcttgcggaggtgagaaggtgtttttgccgttgggaatctacatattttttttttgtcgatgcctttcttttaacagtggatataattaaatcctgttacttgttacagtgtacattaatcgtgttgttattccagtactctgccctttgtggcaaatatacatgagcagttttacc

SEQ ID NO: 1009 - DNA, 1324 bp, Zea mays
  Predicted polypeptide sequence is orthologous to G636
gccgccacagcagaagccgccaatgccgcaacagcaaagcatggacattgtcatggtgccggccgagacgacgccgcacgccgacatcccggtgcacgaggggtccagtggcggcgcggcgtcctcccggtggcccaaggcggaggttcacgcgctgatacagctgcggagcaaccttgacacccggtaccaggaggttgggcccaaggggcccctctgggaggagatctccgccggcatgaggcggatgggttacaaccggaacgcgaagcggtgcaaggaaaagtgggagaacatcaacaagtacttcaagaaggtgaaggagagcaacaacagccggatcgtctttcctgggcacggtccagtgatcgatccgtctgcgcgcacccaggcattatcccccggtgactctcatcctcctccacttctccatggcttcttttctttctctcgctcgcatgtgacatttgtgtctacccacctgtcgcctccatgcatgctcgtccatatctctagttctctacacctctaaaccaaaaatcacaagaactatctccctcagctcctccatgctccggcaattctccattcctcatatatgcacctagcaacacctcgatccatgtcgtgtcgtcgtcgctgctgcatgcctacccccctttttttgattcgttgctgtgttaattatagtggtcgcctctttagatgttacagtaaaaaaatattggcggtgatgcggttatttattgatttgttctggtaattaataagaaccctcaagctttggggtgttcacggagaggttgagttgatgcggtgaaaacagcacgtgaaagggtaatgagagatcgatcgcgcggttaaggagacaaggtgacaagaaaggcagatgacgcagtgggtgtttgcactgttactgcggtaaattttgtgcatgcggctactactctacagtgggctagtttgttgcaagggagctgcggaaaaaaatggaaaagaagagcttgctcgtcatgtgccatgaagaacagtcagtttgatgcatgcgggatttttatatttatccttgttttcccctctttttcatttttcaccatttcttttatgttctgcaacaagtaaactgtccattaagtattacctaagttttttctttctttctttctttctcaaactgctgttaccgaaatttacagtgtatacttgagaaatgttatatgttaaaattcttgctgttaattatatatagtattgcaattgcgcgcccgtgggattttttcaaaaaaaaaaaaaagggcggccgccaccgcggtggagtctccag

SEQ ID NO: 1010 - DNA, 716 bp, Zea mays
  Predicted polypeptide sequence is orthologous to G636
tctggccggcagccgcaccgccccgcagttgcacgccctcgccgcgccagtatccccgacgccccagcagcagttgccggcatccagcgccgccccgccgttgcacgccttccccgcgccagtatccgcgccgccgccgttgagttcaataccactgctgacagggccgatgcagccagcgcccatatcatcggcggccccagccccggcaccggtggatctgctcggggcccaccagccccataacctgcaaggcttcagcttctcttccatgtcggacgcgggggccgtcgacgagcccccggccgacgacacgacggcggagacaggcggaaaccaggaccgcctcggcaagcggaagcgcggcgacggcggcggcagcggcagcaacaagatgatgtctttcttcgaggggctcatgcagcaggtcgtcgacaggcaggaggaaatgcagcggccgttcctggagaccatggagaagcgggaggcggagcgcacggctcgggaggaggcgtggcgcaggcaggaggtcgcccgcctcaaccgcgagcaggagcagctcgctcaggagcgcgccgccgccgcctccagggacgccgccatcatcgcctttctccagcgcatcagcgggcagtccgtgcagccccctaccgcctttgttgtcccaatgccggcaccggtgtcagtccataccacgcctccgaaacaaccttatc

SEQ ID NO: 1011 - protein, 682 aa, Pisum sativum
  Orthologous to G636
MLGDSAVLGTGGGGGSSGDAAGASASGGAYHDGGDTVGGGGGSISGDDERGGGSRNEEGGDRNFGGNRWPRQETIALLKIRSEMDVTFRDASVKGPLWDEVSRKMADLGYHRNSKKCKEKFENVYKYHKRTKEGRGGKSEGKTYRFFDQLQALENNPSIQSPRTQTQLNISTLPPTTPSSSSSLPISTTSTTLTTTNPLLLPPSLLNSTSPITIHTPSITTTAAATTVPLTTTITPPIPMSLPQVQNTVSQSNPTYFPPIPSTTTATNPTNTNNPLPQITITPPPSSFPNTSTDFFSNSSSSSTSSEETMTMEGGGNRRKRKRKWKDFFERLMKEVVEKQEELHKRFLEAIEKRELERGAREEAWRLQEMQRINREREILAQERSIAAAKDAAVMAFLQKIADQQQEQQQNIVVPVALNTNIVPQQQQALQEPTSTPTPAPASTPTPAPTPVPAPALTSAPAPMQTPTPMPLPMPIQSQQQVQTPTSAVQVQQTAPVISQALPLAQPQQAQVQVQQQATNMDIVKSDNNGESLMQASSSRWPKTEVEALIRLRTTLDMKYQENGPKGPLWEEISGLMKNLGYNRNAKRCKEKWENINKYFKKVKESNKKRPEDSKTCPYFHQLDALYREKNKGEGSSASRPEGTMMAPLMVRPEQQWPPQPQPPPVTRADVTMEDAENDRPP

SEQ ID NO: 1012 - DNA, 998 bp, Glycine max
  Predicted polypeptide sequence is orthologous to G638
ataggccaagtgatcataggagggtgagaaaaagctggagaacaaaagtggaggagatagtggattcccacatgaggaagatcatacagactcaagatgcttggatggagagaatgttgagtgttgttgagcaaagagagcaagagatggcatctagggaggaagaaaggaagagaaaagagtcaatgtggtttgaccaacaggtgcatgaactgtgggccaaagagaaagcatgggttgaggcaagagatgctgcattgatagaggttgtgaggaaacacattgggatagggataggacttgaagcattgccattggtcgaagaagaatcaccgaataagaataagagccagggaagtattgatgccaatgagtttccctctgagggtgttgatcctggtagaagtagtagtagtaggtggacagaaatggagatttcaaatttgatgcagctaaggactagttttgagcaaagattcagagaaaataataatgggtacatggagaatggggtttgggatgaaatagcagcaaaaatggcttgtttggggtttgataggagtgcaagtgagtgcaagcaaatatgggaagagatcagcatctctctcagaaggacagtggatgagtgtgatgatggtgcaaaaagaaggccttggtatttgggactttagctgacggatgatgatctttgacacattcttgttctaaccgaaggcatcgatcagagagattaagtatatatgacactttgcttttgatgagttctgagcgtggaaggaaacttgtgggagaaacaagctagggcttgagagggttattaactaggatgtaacaagtttggatcattagcgaatcacaaggtattctaggccacgtgtttaactatatatttaattaatataacgtatgaggactcattcttgagtgtaagcattgactttgttgtttattattaattttatccatgcatgcatcagatgctagagtcatcagttatt

SEQ ID NO: 1013 - DNA, 1730 bp, Glycine max
  Predicted polypeptide sequence is orthologous to G638
gaaggatcatgtcctcgagccgaatcggctcgaggagtgggaaaaagtgcagggagaagtttgagaacctgtacaaatattacaagaagacaaaggaaggaaaagctggaagacaagatgggaagcattacaggttctttcgtcaacttgaagccttatatggtgaaaacagtaaccaagcctcggtgccagaaaccaattttggcagtggtagccttcgtttccacacaagcactcgagccgattcggctcgagaaacaaatcaagaaatgtttcagtctcagaagcattgtgacagcctaagcctcaccaacttcactgatttggacacttcatcatcggatgacaatgatcaaaatagcactggcagggaactcaacaaggacaatgactccatggagaagaggagaaagagggtgagtggaagaagctggaaggtgaagataaaggacttcattgactcacagatgaggaagctggtggagaagcaagaggagtggttggataaactcacaaagacactggaacagaaggaaaaagagagagtgttaagagaagaagagtggaggagacaagaatctgtaaggttggagagggaacacaaattttgggctaaagagagagcatggattgaagcaagggatgctgctttaatggaggctttgcacaaattaacacgaaatgagataatgaagagtactcattctcacgagggtctaatggtaactggaattcagaaccacagtgaaaaccagaatgaagatgggagtgaaatactaaatagcactactgccagaggtgctgaaagctggacagaatctgagattgcaaggcttcaacagttgagagctgagatggagacaaggtatatgcaaagtgggtgttcagaagaggttatgtgggaggaaatagctaccaaaatggcttgttttggttacgaaaggagtgctgtggtcttcaaagagaaatgggagagtataagcagcaactatgcaaggagtgccaaggatggaagcaagaagcgcaaggaagactcaagaagttgtttttacttcgataacagtgaccaatcttctctgtataaccaaggaggtgcctattgtgatatcaacgatcaaaggcacaagactgggaggctgcaaacaaatgatggctcttcaccttccaattcaaatgttggaaatgcagttgcgggtgataactgctttcccttcttgatgactgagggtggaaatttgtgggagaactatagcttaaaggttaataaagcatgccaaaaccagtgatgagagtgaaaaaaagtttgacacttgtaagaggcaagaaaatttcacagccttttatcagatgatctcacattatgtaagcaagagctaactgatgagggtcgtttatgtatagagactgatgatgataaggtgatcaatcttattatatttatgggaatcaaagtgaaaaataatgtgttcaagtcacgtacgtaagtttaatgagggagactagacattggcaaaatttcacaggtgagtatgacactaattcaggtgagtttctcttgtagcagatttcttttatgcgtgcaaaatggaatttgcaattttatattacttcacatgttgcatcttcaatgatgtttatatatcattagttgttaaccctcaaaaaaaaaaaaaaaaaaaaaaaaaaaaaaaaaaaaaaaaaaaaaaaaaaaaaaaaaaaaaaaaaaaaaa

SEQ ID NO: 1014 - DNA, 1221 bp, Glycine max
  Predicted polypeptide sequence is orthologous to G638
gaattcggctcgagggtaactggaattcagaaccacagtgaaaaccagaatgaagatgggagtgaaatactaaatagcactactgccagaggtgctgaaagctggacagaatctgagattgcaaggcttcaacagttgagagctgagatggagacaaggtatatgcaaagtgggtgttcagaagaggttatgtgggaggaaatagctaccaaaatggcttgttttggttacgaaaggagtgctgtggtcttcaaagagaaatgggagagtataagtaactatgcaaggagtgtcaaggatggaagcaagaagcgcaaggaagactcaagaagttgtttttacttcgataacagtgaccaatcttctctgtataaccaaggaggtgcctattgtgatatcaacgatcaaaggcacaagactgggaggctgcaaacaaatgatggctcttcaccttccaattcaaatgttggaaatacagttgcgcttgataactgctttcccttcttgatgactgagagtggaaatttgtgggagaactatagcttaaaggttaataaagcaagccaaaaccagtgatgagagtgaaattatatggttgacacttgtaagaggcaagaaaatttcgcagccttttatctcagatgatctcacattatgtaagcaagagctaactgatgagggtcgtttatgtatagagactgatgatgataaggtgctcaatcttattatatttatggaatcaaggtgaaaaataatgtgttcaagtcacgtacgtaagtttaatgagggagactacacattggcaaatatcactgaattgttggggtgtgagtatgacactaattcaggtgaatttctccattagctgatttcttttatgcgtgcaaatggaatttgcagttatattacttcacatgtcgcatcttccgataatgttcatatcattcattagttggtcaccgtctttctcctagtttccaccttccacacctatcttgccttttttttaattaattttttgggatatttatactgtgctggccttttgtgtttgtgtactgaaaggtagcaatttactttggtatttatttattggtcaatagttttatgaaccgggagaaagtgatgtattgatggatattgttgaagcatcggacattgttacaagcataaaaaaggccagattttctttaaaaaaaaaaaaaaaaagggcggccgccg

SEQ ID NO: 1015 - DNA, 516 bp, Glycine max
  Predicted polypeptide sequence is orthologous to G638
ctcgagccgtatcgcctcgaggagtgggaaaaagtgcagggagaagtttgagaacctgtgcgaatattacaagacgacaaaggaaggaaaagctggaagacaagatgggaagcattacaggttctttcgtcaacttgaagccttatatggtgaaaacagtaaccaagcctcggtgccagaaaccaattttggcagtggtagccttcgtttccacacaagcagccacaataataacccttctcaaacaaatcaagaaatgtttcagtctcagaagcattgtgacagcctaagcctcaccaactccactgatttggacacttcatcatcggacgacaatgatcagaatagcactggcagggaactcaacaaggacaatgactccatggagaagaggagaaagagggtgagtggaagaagttggaaggtgaagataaaggacttcattgactcacagatgaggaagctggtggagaagcaagaggagtggttggataaactcacaaagacactggaaca

SEQ ID NO: 1016 - DNA, 654 bp, Medicago truncatula
  Predicted polypeptide sequence is orthologous to G638
ctcatggaaatggaagaccataatcaacactatgatagtaatagtatcactgatcttagacaactcattaatattgttccaagatcaactaccaacaatttccctacggcggagctattccccgccggcaacccacatcaacaacactatgagatgatgatgtttggtagacaagtagcagatataattcctcgttgtcttcatgattttgtttcaacagattcacctgctgttgctactactgccactcctaccaacactaccactagtgcttcaactccttcatttagtggtaatttagaagctgaaactactgctttcattgctgttgatgcttcaactggaagatggcctagacaagagactcttacacttcttgagattagatctcgtcttgatcctcaattcaaagaagctactcaaaaaggtcctctttgggatcaactttctaggataatgtgtgaagaacatggctatcaaaggagtgggaaaaaatgcagggagaagtttgagaatctatacaaatactacaaaaagaccaaggaaggaaaagcaggaagacaagatgggaagcactacagattctttcgacaacttgaagccttatatggagaaaacaataacccttcttcatcttcactcccacaaaacaat

SEQ ID NO: 1017 - DNA, 487 bp, Glycine max
  Predicted polypeptide sequence is orthologous to G652
aagaattcgcggccgcaggaatttttttttttttttttttaatgaatcacactttgttgaaaagaagcgcattagataaaacaattagcaaagccctggaaaaacatatttggaaggaaggaaggaaatgccaatggctagaaacaaaaataacagaatccatttaaccaaccccaactaacagtaacagactcaattcaatagaagaaaccataacacattctcactcatttccttttccaacattcggacattccctcgcaaaatgcccttcctccccacagttaaaacaccctcctcctcctccaccaccaccgccgcgtctccgattcctaccatcatcaccaccaccaccaccctgtccatggtaacaatcccttgccaagtgacctattcttccacagttataacactcagggcctcctcctctccgaccgaaccctctgccacggccttccccgcccccgtagcgtcctcctcctctgcc

SEQ ID NO: 1018 - DNA, 860 bp, Glycine max
  Predicted polypeptide sequence is orthologous to G652
ggctcgaggaaaaagaggcgcaagatgagtggtagggtttctgggaaggtgaagtggttcaatgatcagaaggggtttggattcataagccctgacgatggcagcgacgatctcttcgttcaccaatctcagatcaaatctgacggtttccgaagcctcgccgaaggagagtccgttgagttcgccattgaatctgaatctgacggacgcgctaaggctgttgatgtcactggccccgacggcgccagcgtccagggaaccagacgaggcggtgatggtggccgaagctatggcgggggacgaggaggtggtggaggtggctacggtggaggcggtggctacggtggtggtggtggctacggtggaggcggtggttacggtggtggtggaagaggcggtggaggcggtgcttgctacaactgtggtgaatcgggacatctggctagggattgcagtggaggcggtggtggggacaggtaccgaggaggtggtggtggcagatatggaggcggcggtggcgggaggtaccgtggtggaggcggcggcggcggcggcggcggaggaagctgctacagctgtggagagtctgggcattttgccagagattgcccatcaagtgctcgttgaatttactgttagggttgtttatgttttgcggattgttttaagttttcactttaatatgtcttagggattttaatggtttctgtccaaactatgggttcttatgagtagatgtgtgggatttttcttttttggttatttaaatgaagggtttctgtgttatcgttacaatctgcaaactaaaatctgtttgaacttacattttgctataatgaatcgtatgattgttatcaatt

SEQ ID NO: 1019 - DNA, 992 bp, Glycine max
  Predicted polypeptide sequence is orthologous to G652
  misc_feature (978)..(984): n is a, c, g, or t
  misc_feature (987)..(987): n is a, c, g, or t
cccactcgtccgcccacgcgtccgaagggtttgtaagagaaagaaaaaagaggcgcaagatgagtggtagggtttctgggaaggtgaagtggttcaacgatcagaaggggtttggattcataacccctgacgatggcagcgaggaactcttcgttcaccaatctcagatcaaatctgacggtttcccgaagcctagctgaaggagagtccgttgagttcgctattgaatctgaatctgacggacgcgccaaggctgttgatgtcactggccccgacggcgccagcgtccagggaaccagacgcggcggtgatggtggccgaagctatggcgggggacgaggaggtggtggaggtggatatggcggtggcggcggctacggtggtggcggtggctatggtggaggcggtggctacggtggtggtgggcgaggcggtggtggcggggcttgctacaactgcggtgaatcgggacatctggctagggactgcagccaaggaggcggtggagacaggtacggcggaggcggtggtggtggtggcaggtatggaggcggcggtggcgggaggtacggtggtggtggaggaggtggtggcggcggaggaagctgctacagctgtggagagtctgggcatttcgccagagattgcccatcaagtgctcgttgaaattactgttatggtggtttatgttatgcggattgttttaagtttttactttaacatgttgtagggattttaatggtttctgtcaaagctgtggcttcttataagtagatgcgtgagatttttcttttttttggttatttaaatgaaagtttctgtgttatcgttacaatctgcaaacaaaatctgtttggacctacattttgctataatgaattggatgattgttatcaaaaaaaaaaaaaaaaaaaaaaaaaaaaaaaaaaaaaaaaaaaaaaaaaaaaaaaaaaaaaaaaaaaaaaaaaaaaaaaaaannnnnnnaanaaaaa

SEQ ID NO: 1020 - DNA, 906 bp, Glycine max
  Predicted polypeptide sequence is orthologous to G652
ggctcgaggtgagaacaagaaaaagaggcgcaagatgagtggtagggtttctgggaaggtgaagtggttcaatgatcagaaggggtttggattcataagccctgacgatggcagcgacgatctcttcgttcaccaatctcagatcaaatctgacggtttccgaagcctcgcccgaaggagagtccgttgagttcgccattgaatctgaatctgacggacgcgcgaaggctgttgatgtcactggccccgacggcgccagcgtccagggaaccagacgaggcggtgatggtggccgaagctatggcgggggacgaggaggtggtggaggtggctacggtggaggcggtggctacggtggtggtggtggctacggtggaggcggtggttacggtggtggtggaagaggcggtggaggcggtgcttgctacaactgtggtgaatcgggacatctggctagggattgcagtggaggcggtggtggggacaggtacggaggaggtggtggtggtggcagatatggaggccggcggtggcgggaggtacgttggtggtggaggcggcggcggcggcggaggaagctgctacagctgtggagagtctgggcattttgccagagattgcccatcaagtgctcgttgaatttactgttagggttgtttatgttttgcggattgttttaagtttttactttaatatgtcttagggattttaatggtttctgtccaaactatgggttcttatgagtagatgtgtgggatttttcttttttggttatttaaatgaagggtttctgtgttatcgttacaatctgcaaactaaaatctgtttgaacttacattttgctataatgaatcgtatgattgctatcaattattgttgtgatttgctatgaagattgaattgtat

SEQ ID NO: 1021 - DNA, 795 bp, Glycine max
  Predicted polypeptide sequence is orthologous to G652
tgttagagaaagaaaaaagaggcgcaagatgagtggttgggtttctgggaaggtgaagtggttcaacgatcagaaggggtttggattcataacccctgacgatggcagcgaggaactcttcgttcaccaatctcagatcaaatctgacggtttccgaagcctagctgaaggagagtccgttgagttcgctattgaatctgaatctgacggacgcgccaaggctgttgatgtcactggccccgacggcgccagcgtccagggaaccagacgcggcggtgatggtggccgaagctatggcgggggacaaggaggcggtggaggtggatatggcggtggcggggcttgctacaactgctgagaatcgggacatcttgcttgggactgcagccaaggaggcggtggagacaggtacggcggaggcggtggtggtggtggcaggtatggaggcggcggtggcggcaggtacggtggtggtggaggaggtggtggcggcggaggaagctgctacagctgtggagagtctgggcatttcgccagagattgcccatcaagtgctcgttgaaattactgttatggtggtttatgttatgcggattgttttaagtttttactttaacatgttgtagggattttaatggtttctgtcaaagctgtggcttcttataagtagatgcgtgagatttttcttttttttggttatttaaatgaaagtttctgtgttatcgttacaatctgcaaacaaaatctgtttggacctacattttgctataatgaattggatgattgttatcggtt

SEQ ID NO: 1022 - DNA, 704 bp, Glycine max
  Predicted polypeptide sequence is orthologous to G652
tgtgagaacaagaaaaagaggcgcaagatgagtggtagggtttctgggaaggtgaagtggttcaatgatcagaaggggtttggattcataagccctgacgatggcagcgacgatctcttcgttcaccaatctcagatcaaatctgacggtttccgaagccctcgccgaaggagagtccgttgagttcgccattgaatctgaatctgacggacgcgcgaaggctgttgatgtcactggccccgacggcgccagcgtccagggaaccagacgaggcggtgatggtggccgaagctatggcgggggacgaggaggtggtggaggtggctacggtggaggcggtggctacggtggtggtggtggctacggtggaggcggtggttacggtggtggtggaagaggcggcggcggaggaagctgctacagctgtggagagtctgggcattttgccagagattgcccatcaagtgctcgttgaatttactgttagggttgtttatgttttgcggattgttttaagtttttactttaatatgtcttagggattttaatggtttctgtccaaactatgggttcttatgagtagatgtgtgggatttttcttttttggttatttaaatgaagggtttctgtgttatcgttacaatctgcaaactaaaatctgtttgaacttacattttgctataatgaatcgtatgattgctatc

SEQ ID NO: 1023 - DNA, 840 bp, Glycine max
  Predicted polypeptide sequence is orthologous to G652
aattaagccgtccgttgcgcttcaatcttcatattcaagaggaggaacaagcctaatgaatcacactttgttgaaaagaagcgcattagataaaacaattagcaaagccctggaaaaacatatttggaaggaaggaaggaaatgccaatggctagaaacaaaaataacagaatccatttaaccaaccccaactaacagtaacagactcaattcaatagaagaaaccataacacattctcactcatttccttttccaacattcggacattccctcgcaaaatgcccttcctccccacagttaaaacaccctcctcctcctccaccaccaccgccgcgtctccgattcctaccatcatcaccaccaccaccaccctgtccatggtaacaatcccttgccaagtgacctattcttccacagttataacactcagggcctcctcctctccgaccgaaccctctgccacggccttccccgcccccgtagcgtcctcctcctctgcccctcccaccgccgccgccgcgaaatcctccgggaagacgagatctaacggctgaggtgacgtcgacggccatggtgcggccgtcgtcgccgtaatcgaggagaaactcaacggactgaccgtcggacaaagaacggtagccgtcggatcggatggaagtgaagtgcacgaagagatcatcggttccatcttggggagttatgaatccgaaacctttgtgcgcgttgaaccacttaacggtgcccgtggatctccgagtctcggccatggtggctcctgaaagaaaagaagtttctggaagattcttatttgggtttgggaaagttacgctgaattgagg

SEQ ID NO: 1024 - DNA, 1056 bp, Glycine max
  Predicted polypeptide sequence is orthologous to G652
attcggctcgagaaagaggagaaggtatagactatagagagagagagagagagagatctgatccggagcgatgagtgagagtgagaagcagagggtaacggggaaggtgaagtggttcgatgaccagaagggttttggcttcataaccaccgacgacagcggcgaggaattcttcgtccaccagtcctccatccgatccgacggcttccgcagcctcgccctcggcgagtccgtcgagttccttattgactccgatcccgaaggccgcaccaaggccgtcgacgtcaccggccctgacgaatcgccagtccagggcacccgcggtggcggaggaggaggaagaggaagctatggtggaggtggcggaagaggtggctatggtggtggcggacgcggcggaagaggtggatatggaggaggcggcggaggctatgggggaggtggctatggcggaggcggtggttatggtggaggtggcggcggcggcggcggagggggatgctataagtgtggcgagactggtcacatagctagggactgcagccaaggtgggggtggcggtggaaggtacggcggtggtgggggtggcggcggaagctgctacaactgtggggagtccgggcattttgccagggactgcccttccagtgctcgttgatacaatagtacgggggtgtggccttgcttttgtgttctgtggttcttttgttttcttttttctaaatctgaatattaccctttagaaatagggttagctagggtgtggcttctttgcgttttcttttttcttttttcgggtttacattataagcaattagcttatgattagctcttggatttattggtttgctttttgggcttagggaaatgagagttttggtgaggttctgaaaccatcgactaaatactctgtttcctgtcgtgaacgtaatatgctctgccttaccttattttgttgaaatctttgaatatatcatggtatcatggtcctgctgttcggatggatggttgtgtatattttgaatatattgtgcaggaaatattgatttgttgtcg

SEQ ID NO: 1025 - DNA, 655 bp, Oryza sativa
  Predicted polypeptide sequence is orthologous to G652
  misc_feature (1)..(1): n is a, c, g, or t
  misc_feature (7)..(7): n is a, c, g, or t
ngagcgnccgctcgcgtagcgagacgaggggaaaaaaaaatcaatcaaaccctaatcagatcagggagaggcgagggctagggtttcgactcctcggcgggcgatccatggcggcggcggcgaggcatcgggggacggtgaagtggttcaacgacaccaaggggttcggcttcatctcccccgacgacggcagcgaggatctcttcgtccaccagtcctccatcaaggccgacggcttccgctccctcgccgagggcgagcaggtcgagttcgccatctccgagagcgaggacggccgcaccaaggccgtcgacgtcaccggccccgacggatccttcgtcaagggcggcgccggcggcggcggcggtggcgggggaggcttcggatcgcgcggtgggggcggatctggcggtggcggccgcagctatggcggtagctggggccgggggaggagatccggcggtggtggacccggtgggggctgcttcaagtgtggggagtctggccacatggccagggactgcttcaacggcggcggtgtcggcgttggtggaggcggtggcggcggcggcggcgctggtggtggctgcttcaagtgcggcgagatgggccacatggctagggactgcttcaacagcggtggtggtggaagtgg

SEQ ID NO: 1026 - DNA, 635 bp, Oryza sativa
  Predicted polypeptide sequence is orthologous to G652
gatccccgggctgcaggaattcggcacgaggcaaaccctagccatcgaatcgcgagagcggaagccaccgaggcggaggcggaggcggggaggagggcgcaatggcggggaaggaggagggccggatcttcgtgggcggcctgtcgttccacaccgacgagcgcaagctggccgacgcgttccgccgcttcggcaaggtcgtcgacgcccagatcatgctggagagacacacccaacgccatcgtggttttggcttcgtgacattttcagatccagaggcagttgatagcgctattaaagaaatgcactgtcaagaattagatggcaggactatatcagtgaacaaggctgagcctaagatgaatacagatgacacaaggtatgaaagtggtggtggacgaggagagtatcgtggtggtagaggtgatggaccacccccaggcaattgctttgagtgtggccgtgctggtcattgggctcgtgattgccctaatcctggtggtggtcgttctgcgcgatactcttcttctaagttcagcgctggtggcagaggagaccgtttttctggatcagataggtttggagaccgttacatggatgatcggtatgatggtgggtaccgggaaccctgtgat

SEQ ID NO: 1027 - DNA, 469 bp, Oryza sativa
  Predicted polypeptide sequence is orthologous to G652
gagagtcatccatggcttccaccgtcgccctcaagggccgcccgctcgccaccctcctcaggcagctcctcgccgccgacgcgccgcccgccgccaccgggaggcccgtcgccgccgctcccgccgcctccgggaagcccgtgaccgcccccgccgccgcgaccgccaccaacgccgcctcccgccgcctgtacaacaccgagggcgcgccgctccgccgctacgacgtcgtcgacgagtccggcaccgacagcggcgacgagtacgacgccaccgctacggcggtgaccgcggctacggcggcggcggcggcggctacggcgggggcgaccgcggctacggaggcggcggcgggtacggcggcggcggcggaggcagccgcgcgtgctacatgtgcggcgaggagggccacatggccagggactgctcccagggaggaggcggcggcggtggctaccgtggtggtggc

SEQ ID NO: 1028 - DNA, 1377 bp, Zea mays
  Predicted polypeptide sequence is orthologous to G652
cccacgcgtccgccattagctttatctactccagagcgcagaagaacccgatcgacaccatgagggtgttgctcgttgccctcgctctcctggctctcgctgcgagcgccacctccacgcatacaagcggcgagacagcgggggacggtgaagtggttcaacgacaccaagggcttcgggttcatctcccccgaggacggcagcgaagatctcttcgtgcaccagtcgtcgatcaagtcggagggcttccgctcgctcgcggagggcgaggaggtggagttttccgtctcggagggtgacgacggccgcactaaggccgtcgacgtgaccggccccgacggatccttcgtcaggggcggcggaggcggaggaggaggcggcggcggctacggctcccgcggcggtggcggatctggcggcggcggtcgcagctacggtggtagctggggcggcggccggagatccggcggcgggggcggtcccggcgcgtgctacaagtgcggcgagcccggccacatggcaagggactgccctagcgccgacggcggaggcggctatggcggaggcggctacgggggcggcggctacggaggaggaggaggaggcggtggctgcttcaagtgcggcgagcctggccacatggccagggactgctccagcggcggcggcggctacggcggtggcggcggcggtggtggtggcggctgctacaactgcggccaggccggccacatggccagggactgcccaagcggtggcggcggtggcggagggaggttcggcggcggcgggggtggaggcgaccgctcctgctacaactgcggcgaggccggccacatcgcccgcgactgtcccacgtgaggtgtgtccgcgtccgtccagccagccagatcggatcggatcgctccaccacctgctggtctgatggcgccgcccccttctagatctcgcttaaaaaaacatccccctctcgctgtgtgtcggagtaccgctttagttttgccgatccgggcacgagtgcccgctgcctctttcgtaagaggatcccgtccgccgttttcagatttcgttcggttcgtagaagaactctcaagttaagttaagttatcatggtgtgtgcttggtcgtcgtccgtcgttcgtcgtcgtcgttaaggttttaagagatgatttggtcctgtgttgccgaggggaagtccaatctgcttttcttttcttttttgtggtttgttccatcagactgaggaaggagatgagatgattattctcccagattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaag

SEQ ID NO: 1029 - DNA, 1408 bp, Zea mays
  Predicted polypeptide sequence is orthologous to G652
cgcagcgctagggttcgggggttgcgatggcggcggcggcgaggcagcgggggacggtgaagtggttcaacgacaccaagggcttcgggttcatctcccccgaggacggcagcgaggatctcttcgtgcaccagtcgtcgatcaagtcggagggcttccgctcgctcgcggagggcgaggaggtggagttttccgtctcggagggtgacgacggccgcactaaggccgtcgacgtgaccggccccgacggatccttcgtcaggggcggcggaggcggaggaggcggcggcggcggcggctacggctcccgcggcggtggcggatctggcggcggcggtcgcagctacggtggtagctggggcggcggccggagatccgcgcccgacgccgctttcggctccgtcctctccggcaccgccggcgacgccgcccccagcgaccagtggttcgtcgacgcgctcaacgcccccgcgccgcaccccatcgagcgcgtccgatccgagtcctcctcgatcgtctccgacgtccccgactacctcttcagcctcgacagcccgtccgacgaccccagccccggcccctcggcggctcgcgccaagtccgacgccacggagactccgcaccaccacggcgacgacgtgccgccttccgctcgacagataccgcacgtcgcaggaggagcgtcatcgtggcccgccccgccgccgccgtacatggcgcagcctatgtactacttccccgtgccgccaccggtccactatctcgaccagtctgcgcagagtggctacatgcctcgcccgatctaccacattgtcggtggcggaggaagcgaggcgcctggcggagatcttcacgcggccggcggagtctacggcgtctcgcaccacatgcaggggttcccgccgatgatgtacgcgccgccgcgcgcggtcatctacaactacaagtcggaggggatgccatcgctgcctccggaaggtggggcacactcttcctaggcgcatcgactacttcacatctctgaatcctgattattgttgcagatgcctaagctaaggagttttgcgtggtattttttttatcgattcgtctaagtcttgttcgttgttttgtatagatggaggggttgatggtgatggatagatattaatgcagctttcgtctagtggaaatatattcgtgaaatgtatatcatactaaatagtatagcatttggtgtgattaattagtattctagttaatgtaatgtgggattcatataatctaggtggttctggtcttatagaaaccatttttgggcattttatatttacataaactggatgttgggtgaatgttctaagcagtatgtgctgtgttgaacctcaatcacttatgagtggttactaaatttgaatttgatgtcttc

SEQ ID NO: 1030 - DNA, 1186 bp, Zea mays
  Predicted polypeptide sequence is orthologous to G652
gcagcgagagacgggcaggggaggaaaaaaatctaaccctagcatccgcagcgctagggttcgggggttgcgatggcggcggcggcgaggcagcgggggacggtgaagtggttcaacgacaccaagggcttcgggttcatctcccccgaggacggcagcgaggatctcttcgtgcaccagtcgtcgatcaagtcggagggcttccgctcgctcgcggagggcgaggaggtggagttttccgtctcggagggtgacgacggccgcactaaggccgtcgacgtgaccggccccgacggatccttcgtcaggggcggcggaggcggaggaggcggcggcggcggcggctacggctcccgcggcggtggcggatctggcggcggcggtcgcagctacggtggtagctggggcggcggccggagatccggcggcgggggcggtcctggcgcgtgctacaagtgcggcgagcccggccacatggccagggactgccctagcgccgacggcggaggctacggcggaggcggctacgggggaggcggctaccgaggaggaggaggcggcggcggcggtggctgcttcaagtgcggcgagcctggccacatggccagggactgctccagcggccggcggcggctacggcggtggcggcggcggtggtggtggcggctgctacaactgcggccaggccggccacatggccagggactgcccaagcggtggcggcggtggcggagggaggttcggcggcggcggggttggaaggcaaccgctcctgctacaactgcggcgaggccggccacatcgcccgcgactgtcccacgtgaggtgtgtccgcgtccgtccagccagccagatcggatcggatcgctccaccacctgctggtctgatggcgccgcccccttctagatctcgcttaaaaaaacatccccctctcgctgtgtgtcggagtaccgctttagttttgccgatccgggcacgagtgcccgctgcctctttcctctcatgcgtaagaggatcccgtccgccgttttcagatttcgttcggttcgtagaagaactctcaagttaagttaagttatcatggtgtgtgcttggtcgtcgtccgtcgtcgtcgtcgttaaggttttaagagatgatttggtcctgtgttgccgaggggaagtccaatctgcttttcttttcttt

SEQ ID NO: 1031 - DNA, 1287 bp, Zea mays
  Predicted polypeptide sequence is orthologous to G652
cccacgcgtccgcccacgcgtccgcagcgagagacgggcaggggagaggaaaaaaaaaatctaaccctagcatccgcagcgctagggttcgggggttgcgatggcggcggcggcgagacagcgggggacggtgaagtggttcaacgacaccaagggcttcgggttcatctcccccgaggacggcagcgaagatctcttcgtgcaccagtcgtcgatcaagtcggagggcttccgctcgctcgcggagggcgaggaggtggagttttccgtctcggagggtgacgacggccgcactaaggccgtcgacgtgaccggccccgacggatccttcgtcaggggcggcggaggcggaggaggaggcggcggcggctacggctcccgcggcggtggcggatctggcggcggcggtcgcagcctacggtggtagctggggcggcggccggagatccggcggcgggggcggtcccggcgcgtgctacaagtgcggcgagcccggccacatggcaagggactgccctagcgccgacggcggaggcggctatggcggaggcggctacgggggcggcggctacggaggaggaggcggcggcggcggtggctgcttcaagtgtggcgagcctggccacatggccagggactgctccagcggcggcggcggctaccgcggtggcggcggcggcggcggtggtggtggcggctgctacaactgcggccaggccggccacatggccagggactgcccaagcggtggcggcggtggcggagggaggttcggcggcggcgggggtggaggcgaccgctcctgctacaactgcggcgaggccggccacatcgcccgcgactgtcccacgtgaggtgtgtccgcgtccgtccagccagccagatcggatcggatcgctccaccacctgctggtctgatggcgccgcccccttctagatctcgcttaaaaaaacatccccctctcgctgtgtgtcggagtaccgctttagttttgccgatccgggcacgagtgcccgctgcctctttcgtaagaggatcccgtccgccgttttcagatttcgttcggttcgtagaagaactctcaagttaagttaagttatcatggtgtgtgcttggtcgtcgtccgtcgttcgtcgtcgtcgttaaggttttaagagatgatttggtcctgtgttgccgaggggaagtccaatctgcttttcttttcttttttgtggtttgttccatcagactgaggaaggagatgagatgattattctcccagattaaaaaaaaaaaaaaaaaag

SEQ ID NO: 1032 - DNA, 656 bp, Zea mays
  Predicted polypeptide sequence is orthologous to G652
gtggaggcggtgaccgcggctatggcggcggcggcgaccgtgtctacggtggtggaggtgaccgcggctacggccgcggcggcggaggcggctacggtggtggtggcggcggcggtcgcggctgcttcaagtgcggcgaggagggccacatggcaagggactgctcccagggcggcggcggcggcggctacggaggtggcggcggcggtggttacggaggtggcggcggtggccgcgagtgctacaactgccaccaggagggccacatctcccgcgactgccccgagaagatgcgctaggcgcggcgccaccgtcgcgtcggatccggcggagtcccatgtcgtctctcgcccgcttccctacccgctcaaggtatcgctcggctgactctgcctgaagtcgtcggagccagttatctatcagtagtagcagtgtcgtgtttcgttctcgtcgatgctatcgtatcgtaggtggtggtagcaagaaaagcaagccgtatggggctatctttagtagtttggatctgtgttggagcagtatcagtttctttctgttggaatcgtcagttgtatggcagccattttcatggatggctctgcctaatctatcagtcatgaactatctataatatatcaatgcaatcgtgtcggttggcc

SEQ ID NO: 1033 - DNA, 534 bp, Zea mays
  Predicted polypeptide sequence is orthologous to G652
tcgttccacacccctcaccgcgtccgcctcccctaccatctagggtttctagggttttccaggaggaggaaatggcgtctgatagggtgctcgggactgtgaagtggttcaacggaaccaagggcttcggtttcatcacccccgacgatgggagtgaggacctgttcgtccaccagtcatccatcaagtccgacggctaccgcagtcttaacgacggcgatgccgtcgaatacaccgtcggcagtggcaacgacggccgcgccaaggccctggatgtcaccgcgcccggcggcggcccgcttgccggcggggaacgtcccgacggcggcaacggcggtgggcgaggcggatacggcggcggcgaccgcggttacggcggcggcggtgaccgcggctacgggggaggaggcgaccgtggctacggcggcggcgaccgtggttacggtggaggtggcgaccgcggctacggcggcgaccgtggctacgggggaggcggcggctatggcggtgggtacggtggaggcggcggtggag

SEQ ID NO: 1034 - DNA, 1273 bp, Zea mays
  Predicted polypeptide sequence is orthologous to G652
gggtacctcgaggccggccggggttcccacacccctcaccgcgtccgcctcccctaccatctagggtttctagggttttcgaggaggaggaaatggcgtctgatagggtgctcgggactgtgaagtggttcaacggaaccaagggcttcggtttcatcacccccgacgacggtagcgaggacctattcgtccaccagtcctccatcaagtccgacggctaccgcagtcttaacgacggcgatgccgtcgaatacaccgtcggcagcggcaacgacggccgcgccaaggccctcgatgtcaccgcgcccggcggcggcccgcttgccggcggggaacgtcccgacggcggcaacggcggtgggcgaggcggatacggcggcggcgaccgcggttacggcggcggcggtgaccgcggctacgggggaggaggcgaccgtggctacggcggcggcgaccgtggttacgggtggaggtggcgaccgcggctacggcggcggcggcgaccgtggctacgggggaggcggcggctatggcggtgggtacggtggaggcggcggtggaggcggccgcggctgcttcaagtgcggcgaggagggccacatggcaagggactgctcccagggcggcggctacggagggggaggcggcggcggccgcggcagcgagtgctacaactgcggccaggagggccacatctcccgcgactgccccaacaaaaggcgttaggcgcggcgccaccgtcgcgtcggatccggcggagtcccatgtcgcctctcgccgcttccctacccctccaaagtacccctccaaaggtatcgctcggccgactcttgcgtgaagtcgtcggagcaaactatctatcagtagtactagcagtgtcgtttcgttttggtctgtcgtggtggtaagaaatgcaagtagtaggtgtgaatgcaagtgagcagcaccagtatctttccgtttgaatcagttgtaaggcagtcatggtcatggttggctctgccggatctatctgtcatgaactatctatattatatcattatcaatgttgaaatatatatacttcatagactcgataggttccgatgcacgtaccctgacggtcagaatatcgcgtcccacatctacaaaggctgcatgctcatgtacccgtgcatgctggtgtagcatgctgcgatacgaccgctatcgttcgcttctggaagtacagctcaactagctctctcattggaagcccatgacgttctctagattagccgtccggacgatgtac

SEQ ID NO: 1035 - protein, 1433 aa, Oryza sativa
  Orthologous to G652
MALVPAGAGADPARGSSGSAFSYPQLTATNYTSWCIRVQAMMEDQGVWDAIEPVAGVAVDPRRDKKARSHLLQSLPEDLLMQVAKKRSAKEVWDCLKTRFVGADRVREARLQTLKGEFGAMVMEPGETLDQYAGRITAMSVRHSALGSTLGDSAMVKKLFDTVPEKFVSLVAGIEQFYDIDTMPFEEAVGRLKAYEERMRKKKAAAGGVTTDGQVLLTQAEWEAHFKKNGGESSPPQKNKPSGEGAGRGQGGRGRGRGRGAGGRGGTPRGDSGAGSGGGGRDKSHIKCFNCEEYGHYSNQCPHPKKKKGEAHLAQTEDAGPALLLAVTEDVPERASCGLVVREQRVWPKLLLADAGGHAGDVWFLDNGASNHMTGDRSKFRELDESITGRVKFGDASTVQIKGKGSILFSCKNGDQWLLQDVYYIPSLQCNMVSLGQLTETGHRVVMDEDVLEVFDKSPWRLVMKVRRTVNRLYRIELKLAHPVSLLSSLDDPAWLWHARLGHVNFQAMKLLVDKEMAGGVLAIVHPNQLCQSCLVTKQARAPFPAAAHFRAEEPLELLHIDLCGPITPSTMSGNRYFFLIVDDYSRWMWVFVLKTKDQSLDAFVKFKPLAENTAGRRVKTLRSDRGGEFLSGEFAQVCEEAGIQCHLTAPYSPQQNGVVERRNRTVMAMARSLLKGMRVPGRFWGEAVRHAVHLLNRLPTKAMGDRTPFEAWTGRKPQLGHLKVFGCTAHAKNTQPHLKKLDDKSAPYVYLGVEEGSKAHRLFDPRRGRIHVSRDVVFEENVPWEWTSAAGQEPTDFAMEEEPGEQLPSPATAAGVVPSYQAPSPGRRTGKEAVVAAEEVPSPASPVAASPTLPGTPTPGSPSTNSAGVVPSPGTDDNIDTDDGPRRYRSLADVLREAPRVDLVEDECDGEALLAESEEPSSYREAAGQPAWEEAMQREMEAIEKNKTWELAMLPAGHRAIGLKWVYKLKKNTAGEIIKHKAWLVAKGYVQKQGVDFEEVFAPVARLDTVRVVLAVAADRRWQVHHLDVKSAFLNGELEEEVYVAQPEGFARSGKEHLVLKLHKALYGLWQAPRAWNIRLDRSLRELGFDRCTQEQAVYTRGRGSDGIIVGVYVDDLIVTGENPSELKVFKEQMMGEFEMSDLGLLTYYLGIEVDQDESATTLKQTAYAKKLLSQFGMMECNSVSIPIDPRSQLSKDPEGHPVDATEYRRIIGSLRYLLHTRPDLSYAVGVASRFMERPTVMHFKAVKQILRYIKGTMDYGLVYAAGTGALKITGYTDSDLAGDLDDRRNTGGMAFYINQSLVAWSSQKQKTVALSSCEAEFMAATTAACQALWLRVLLAEVAGVEEKAVKLFVDNRLAIALMKNPVFHGRSKHIDTRYHFIRECVDGGQIVVEFVRTEEQRADALTKGLPAAKLATARHLLGVRSLGPRQN

SEQ ID NO: 1036 - protein, 405 aa, Oryza sativa
  Orthologous to G652
MSFPDEEEDEAFLLAVAATEEAALASSDSSKRRRLSMTSSTSSSPTSATPPPAAVPEGPYLAALKGSHSSAWKQQQETLSQARKRPGGSQTLATPGSGSGSGGAQVARGGACFKCGDSCHWARECPQSVPATGGGGGGGAFGGSGGGGGGYGDAGGAVEEKACPCGAGSCLVLTSNTPRNPGRKFYRCPMRDNGGCNYFEWCDNPSPGPANVSGNTVFQSDTSVAHMLCPCGAGACLILTTKTGKNVGRQFYRCPANQGISYLFLNVRSGHISREVALVAISSGVMNNSLGQLLHCKLQHNIILMLLQVAKFPARGAPPPASNAGKRTIGQRTAQINLQILILTKVGEHLLLQALPMRVSSVVRAGTGPVIAPPQIVVLVPSPAMSSPLLLWAHGTATDTDSRYL

SEQ ID NO: 1037 - protein, 1322 aa, Oryza sativa
  Orthologous to G652
MALVLATSDPARGSSGSAFLYPQLTATNYTSWVIRVQAMMEDQGVWEAIEPAAGAAVDPRKDKKAKSHLLQSLPEDLLMQVAKKRSAKETLKGKFGAMVMEPGETLDQYAGRITAMSVRHSVLGSTLTDAAMVKKLFDTVPEKFVSLVAGIEQFYNVDDMPFEEAVGRLKAYEERAEWEARFKKDGGESSSPQKGKASGEGAKGGQSGRERGRGRGAGGRGGAARGNSASGSGGGGRDKSHIKCFNCEEYGHYSNQCPHPKKKKGEAHLAQAEDAGAVLLLRVTEDAPARATQEMVVPQGCGAMAGNVWYLDNGASNHMTGDRKKFRELDESIPGSVRFGDASSVQIKGKGSILFSCKNGDQWLLQDVYYIPSLCCNMVSLGQLTETGHRVVMDEDVLEVFDKCPWRLVMKLCQACLVAKQIRASFLVVVNYRAEEPLELIHIDLCGPISPATMAGNKYFVLIVDDFTRWMWVFVIKSKDQAVEAFTKFKPLAENVAGRRIKTLRSDRGGKFLSGEFAQVCESAGIQRHLTAPYSPQQNGVVERRNRSVMVMARSLLKGMSVPGRLWGEAVRHAVYILNRLPTKAMGNRTPYEAWTGKKPHLAHLRVFGCTAHAKITTPHLKKLDDRSAPYVYLGVEEGSKAHRLFDPRRGRIHVSRDVIFEENAVWQWLGDAGEQVSVEFDVEEIVESPAGSATSLPGAVPRYQAPSPGRRLGKEPVVVEEEASSPAGTAEASPSLPTTPATPIGEQSTPHSAGEIDTDGAPVRYRHIADILRDAPRVDLVDDEQDGEALLAETEEPSAYREAAGHSAWEDAMAMEMDAIERNGTWELTTLPAGHRAIGLKWVYKLKKNTAGEVIKHKARLVAKGYVQRQGVDFDEVFAPVARLDTVHHLDVKSAFLNGELEEEEQAVYTWGIGSGGVIVGVYVDDLIVTGENPVELKMFKEQMMGEFEMSDLGLLSFYLGIEVDQGENGTTLKQTAYARKVLSQFGMLECNSTSIPIDPRMQLNKDADGHPVGYYWVYRQRPAGDVDDRRSTGGMAFYINGSLVAWSSQKQKTVALSSCEAEFMAATTAACHALWLRALLVEIVGGPAKVVKLFVDNKLAIALMKNPVFHGRSKHIDTRYHFIRECVDGGKVVIEFVRTEEQQADALTKVATVEGISLRLLADANDAVIESEEDRVGSVRDAGLQQRQEHERAHAGHVAGRGGVEPCHGGARGDLGVDVEEKAAAVERWSRQVVIARVAIDRSVEARRLYQTVFFEGFGERSGTVLMRIVNVGLVQLAVATKKAIVVRDSGAGKWWGRSMSRACLHEMNLYSLLQSMKPF

SEQ ID NO: 1038 - protein, 1409 aa, Oryza sativa
  Orthologous to G652
MALVPAGAGADPARGSSGSAFSYPQLTATNYTSWCIRVQAMMEDQGVWDAIEPAAGVAVDPRRDKKARSHLLQSQPEDLLMQVAKKRSAKEVWDCLKTRFVGADRVREARLQTLKGEFGAMVMEPGETLDQYAGRITAMSVRHSALGSTLGDSAMVKKLFDTVPEKFVSLVAGIEQFYDIDTMPFEEAVGRLKAYEERMRKKKAAAGGVTTDGQVLLTQAEWEAHFKKNGGESSPPQKNKPSGEGAGRGQGGRGRGRGRGAGGRGGTPRGDSGAGSGGGGRDKSHIKCFNCEEYGHYSNQCPHPKKKKGEAHLAQTEDAGPALLLAVTEDVPERASCGLVVREQRVWPKLLLADAGGHAGDVWFLDNGASNHMTGDRSKFRELDESITGRVKFGDASTVQIKGKGSILFSCKNDDQWLLQDVYYIPSLQCNMVSLGQLTETGHRVVMDEDVLEVFDKSPWRLVMKPRRPGLAVACAAGTRKFSSNETAGGQGDGGGVPAIVHPNQLCQSCLVAKQARAPFPAAAHFRAEEPLELLHIDLCGPITPNTMSGNRYFFLIVDDYSRWIWVFVLKTKDQSLDAFVKFKPLAENTAGRRVKTLRSDRGGEFLSGEFAQVCEEAGIQRHLTAPYSPQQNGVVERRNRTVMAMARSLLKGMRVPGRFWGEAVRHAVHLLNRLPTKAMGDRTPFEAWTGRKPQLGHLKVFGCTAHAKNTQPHLKKLDDRSAPYVYLGVEEGSKAHRLFDPRRGRIHVSRDVVFEENVPWEWTSAAGQEPTDFAMEEEPGEQLPSPATAAGVVPPYQAPSPGRRAGKEAVVAAEEVPSPASPVAASPTLPGTPTPGSPSTNSAGVVPSPGTDDNIDTDDGPRRYRSLADVLREAPRVDLVEDECDGEALLAESEEPSSYREAAGQPAWEEAMQREMEAIEKNKTWELAMLPAGHRAIGLKWVYKLKKNTAGEIIKHKARLVAKGYVQKQGVDFEEVFAPVARLDTVRVVLAVAADRRWQVHHLDVKSAFLNGELEEEVYVAQPEGFARSGKEHLVLKLHKALYGLRQAPRAWNIRLDRSLRELGFDRCTQEQAVYTRGRGSDGIIVGVYVDDLIVTGENPSELKVFKEQMMGEFEMSDLGLLTYYLGIEVDQDESATTLKQTAYAKKLLSQFGMMECNSVSIPIDPRSQLSKDPEGHPVDATEYRRIIGSLRYLLHTRPDLSYAVGVASRFMERPTVMHFKAVKQILRYIKGTMDYGLVYAAGTGALKITGYTDSDLAGDLDDRRSTGGMAFYINQSLVAWSSQKQKTVALSSCEAEFMAATTAACQALWLRLLLAEVAGVEEKAVKLFVDNRSAIALMKNPVFHGRSKHIDTRYHFIRECVDGGQIVVEFVRTEEQRADALTKGLPAAKLVTARHLLGVRSLGSRQN

SEQ ID NO: 1039 - protein, 205 aa, Oryza sativa
  Orthologous to G652
MADVEEYRCFIGNLSWSTTDESLKDAFGKFGNLTEAKVVFDKYSGRSRGFGFVTFDEKKAMEDAIEGMNGLDLDGRAITVDKAQPQGPGRDRNGDRDYDRDRGSRYDRGRDFGGGGRAPRGSGGGGDCYKCGKPGHFARECPSGDGGGRGDRYGGRDDRYGGGGGGGGRYGSDRGGDRYSGRSRDGGGYGGGGGDRYSRDRSGPY

SEQ ID NO: 1040 - protein, 1433 aa, Oryza sativa
  Orthologous to G652
MALVPAGAGADPARESSGSAFSYPQLTATNYTSWCIRVQAMMEDQGVWDAIEPAAGVAVDPRRDKKARSHLLQSLPEDLLMQVAKKRSAKEVWDCLKTRFVGADRVREARLQTLKGEFGAMVMEPGETLDQYAGRITAMSVRHSALGSTLGDSAMVKKLFDTVPEKFVSLVAGIEQFYDIDTMPFEEAVGRPKAYEERMRKKKAAAGGVTTDGQVLLTQAEWEAHFKKNGGESSPPQKNKPSGEGAGRGQGGRGRGRGRGAGGRGGTPRGDSGAGSGGGGRDKSHIKCFNCEEYGHYSNQCPHPKKKKGEAHLAQTEDAGPALLLAMTEDVPERASCGLVVREQRVWPKLLLVDAGGHAGDVWFLDNGASNHMTGDRSKFRELDESITGRVKFGDASTVQIKGKGSILFSCKNGDQWLLQDVYYIPSLQCNMVSLGQLTETGHRVVMDEDVLEVFDKSPWRLVMKVRRTVNRLYRIELKLAHPVSLLSSLDDPAWLWHARLGHVNFQAMKLLVDKEMAGGVPAIVHPNQLCQSCLVAKQARAPFPAAAHFRAEEPLELLHIDLCGPITPSTMSGNRYFFLIVDDYSRWMWVFVLKTKDQSLDAFVKFKPLAENTAGRRVKTLRSDRGGEFLSGEFAQVCEEAGIQRHLTAPYSPQQNGAVERRNRTVMAMARSLLKGMRVPGRFWGEAVRHAVHLLNRLPTKAMGDRTPFEAWTGRKPQLGHLKVFGCTAHAKNTQPHLKKLDDRSAPYVYLGVEEGSKAHRLFDPRRGRIHVSRDVVFEENVPWEWTSVAGQEPTDFTMEEEPGEQLPSPATAAGVVPSYQAPSPGRRAGKEAVVAAEEVPSPASPVAASPTLPGTPTPGSPSTNSAGVVPSPGTDDNIDTDDGPRRYRSLADVLREAPRVDLVEDECDGEALLAESEEPSSYREAAGQPAWEEAMQREMEAIEKNKTWELAMLPAGHRAIGLKWVYKLKKNTTGEIIKHKARLVAKGYVQKQGVDFEEVFAPVARLDTVRVVLAVAADRRWQVHHLDVKSAFLNGELEEEVYVAQPEGFARSGKEHLVLKLHKALYGLRQALRAWNIRLDRSLRELGFDRCTQEQAVYTRGRGSDGIIVGVYVDDLIVTGENPSELKVFKEQMMGEFEMSDLGLLTYYLGIEVDQDESATTLKQTAYAKKLLSQFGMMECNSVSIPIDPRSQLSKDPEGHPVDATEYRRIIGSLRYLLHTRPDLSYVVGVASRFMERPTVMHFKAVKQILRYIKGTMDYGLVYAAGTRALKITGYTDSDLAGDLDDRRSTGGMAFYINQSLVAWSSQKQKTVALSSCEAEFMAATTAACQALWLRVLLAEVAGVEEKAVKLFVDNRSAIALMKNPVFHGRSKHIDTRYHFIRECVDGGQIVVEFVRTEEQRADALTKGLPAAKLATARHLLGVRSLGPRQN

SEQ ID NO: 1041 - protein, 197 aa, Oryza sativa
  Orthologous to G652
MASERVKGTVKWFDATKGFGFITPDDGGEDLFVHQSSLKSDGYRSLNDGDVVEFSVGSGNDGRTKAVDVTAPGGGALTGGSRPSGGGDRGYGGGGGGGRYGGDRGYGGGGGGYGGGDRGYGGGGGYGGGGGGGSRACYKCGEEGHMARDCSQGGGGGGGYGGGGGGYRGGGGGGGGGGCYNCGETGHIARECPSKTY

SEQ ID NO: 1042 - protein, 309 aa, Oryza sativa
  Orthologous to G652
MAEKEVGRIFVGGLSWDTTERTLERAFSEYGKVIETQMVVLERDTGRSRGFGFVTFSEPRAVDAAIRGMHNGELDGRTISVNKAQPRMNTDDGYGYGGGGGGGGTYSSGARGGYRGGGDAVPSANDDCFKCGRAGHWARECPYSSGGGGGRTGRYSPPSRYGSGTGGGRGDRFGGSDRFANRYVDDRYDGGRYVDDRYGGGGRDRYATDRYPPTADRFTGDRYGGSDRYASSGFTRERSYERDGGRSGGSYYRDEPRGSGGYDKGGMRMGSGDRYGTGGPARFAGSYRDRPAPYDRPSRAAARTYDDRY

SEQ ID NO: 1043 - DNA, 976 bp, Glycine max
  Predicted polypeptide sequence is orthologous to G663
acgtaagctcggaattcggctcgaggaagtagaggtcttaagagtttgagaactgagaagagatgggtggtgttgcatggacagaagaagaagatcacttgctcaagaaatgcatacaacaatatggagaaggaaagtggcatcgtgttcctttactggctggtttaaacaggtgccggaagagttgtaggctaagatggctgaactatctccgtcctaacatcaagagaggaaattttgcggaggaagaagtggaaatgataatcaaactccataaattactaggcaacagatggtcgttgattgcaggaaggctaccaggaaggactgccaatgatgtgaaaaactattggaactgtcatctgagcaaaaaactaaatgtaatagaagctgaagatagaccaataacaagagatgttcaagtcattaggccccagcctaggaacattgttggttcaagctcagtgaaaagaaggggtcaaaatgagtctccaactgacaaaggagttcaacaagagagtagcatgtcctcactgacgtttgatactgctgatggacagaaccatatgcttgattcacagcaagacaacaacatatatgcatgcctggaccaacagggcattgttagtgagttgtcaatggattttcagttcgaaggatttggagcaatgatgaatggggagggtagtagcagccaatgggattggggtgatttgctcttagacatggacttgtacaagtgaattaattttcttcttagttattgctcctgttgatgtggggatggcaatgttggtctcataccttggctacgtatcaatatcgaagttaagtgtttcgatggaaatggtagctaagttggttgtgtatcatgggtatgtcataatcataattaagatctagtgggtttcatcttttgacccctgtagatggtccatctcactaccatgagccatttataaaatcatcttcagtc

SEQ ID NO: 1044 - DNA, 486 bp, Glycine max
  Predicted polypeptide sequence is orthologous to G664
acgagggaaggtccccttgctgtgagaaagcacacacaaacaaaggtgcatggaccaaagaagaagatcatcgcctcatttcttacattagagctcacggtgaaggctgctggcgctctctccccaaagccgccggccttctccgttgcggcaagagctgtcgtctccgctggatcaactatctccgccctgacctcaagcgcggcaatttctccctcgaagaagaccaactcatcatcaaactccatagcctccttggcaacaagtaagcatatctataactataactattcttcatactcctatctttctcatcatcacattcctcaatcataggtggtctctaattgctggaagattgccgggtagaacggacaatgagataaagaattactggaatactcacataagaaggaagcttctgagcagaggaattgaccctgccactcacaggcctctcaacgatgacaaggtattggaacgctg

SEQ ID NO: 1045 - DNA, 1337 bp, Glycine max
  Predicted polypeptide sequence is orthologous to G664
ggccactctctctctttaacctgcctcaccaactcgcatctagaagcaattatagggtctttctctcttctctctctatgttctgtcccctctactttggagtcaaaagcctataaaaccacacccaaacttcctcttgagctcgagccgaatcggctcgaggctagccaatcctaattcctattctcctatcctttttactacataactctaaagtaagtaagaaaaatagagcaatttcacaacacaactcttataattgtgagttaagtatgggaaggtccccttgctgtgagaaagctcacacaaacaaaggtgcatggactaaagaagaagatgacagactcatatcttatattcgagctcacggagaaggctgctggcgttcactccccaaagccgccggtcttctccggtgcggcaagagctgccgtctccggtggatcaactacctccgccccgaccttaaaagaggtaactttaccgaagaagaagacgagctcatcatcaaactccacagtctcctcggtaacaagtggtctttgatagctggaagattgccggggagaacagacaatgaaataaagaactattggaatacgcacataagaaggaagcttttgaacagaggaatcgaccctgcaactcataggccactcaacgaagctgcttctgctgcaactgttacaactaatatatcttttggcaaacaacaacaacaagagacaagttcgagtaacggaagcgttgttaaaggttccatcttggaacgctgccctgacttgaaccttgagttaaccattagtcctcctcgccaacaacaacagactcagaagaatctttgtttcgtttgcagtttgggtttgcacaacagcaaagattgcagctgcaacgtttccaacgctgtcactgtcaacaacaccactccttcttctgctgctgctgctgcttatgatttcttgggcatgaaaaccagcggtgtttgggattgcacccgcttggaaatgaaatgaaaattcaaccaaattatatcaattagttagtgttgttggagagaagtgagagaatgaaattcgttaatttttgaattttctctcctattttttcttttttttcttctcttatttgtataaataattagtcgctgatatgcataatatatagtaccggtacagttgaacatttttgcccaattttcccttttgttgttactcttcactttcttttcttccggcaattgatggtagtcataaagaaaaaaaaaaaaaaaaaaaaaaaaaaaaaaaaaaaaaaaaaaaaaaaaaaaaaaaaaaaaaaaaaaaaaaaaaaaaaaatgg

SEQ ID NO: 1046 - DNA, 1265 bp, Glycine max
  Predicted polypeptide sequence is orthologous to G664
caacagccactctctctctttaacctgcctcaccaactcgcatctagaagcaattatagggtctttctctcttctctctctatgttctgtcccctctactttggagtcaaaagcctataaaaccacacccaaacttccgctcgagcccgcgccgtatcggctcgcggctagccaatcctaattcctattctcctatcctttttactacataactctaaagtaagtaagaaaaatagagcaatttcacaacacaacacaactcttagaattgtgtgagttattaattgagtatgggaaggtccccttgctgtgagaaagctcacacaaacaaaggtgcatggactaaagaagaagatgacagactcatatcttatattcgagctcacggcgaaggctgctggcgttcactccccaaagccgccggtcttctccggtgcggcaaaagctgccgtctccggtggatcaactacctccgccccgaccttaaaagaggtaactttaccgaagaagaagacgagctcatcatcaaactccacagtctcctcggtaacaagtggtctttgatagctggaagattgccggggagaacagacaatgaaataaagaactattggaatacgcacataagaaggaagcttttgaacagaggaatcgaccctgcaactcataggccactcaacgaagctgcaactgctgcaactgttacaactaatatatcttttggcaaacaagaacaacaagagacaagttcgagtaacggaagcgttgttaaaggttccatcttggaacgctgccctgacttgaaccttgagttaaccattagtcctcctcgccaacaacaacagactcagaagaatctttgtttcgtttgcagtttgggtttgcacaacagcaaagattgcagctgcaacgtttccaacgctgtcactgtcaacaacaccactccttcttctgctgctgctgctgctgcttatgatttcttgggcatgaaaaccagcggtgtttgggattgcacccgcttggaaatgaaatgaaaattcaaccaaattatatcaattagttagtgttgttggagagaagtgagagaatgaaattcgtttatttttgaattttctctcctattttttcttttttttcttctcttatttgtataaataattagtcgctgatatgcataatttttagtaacggtacagttgaacatttttgccccccaaaaaaaaaaaaaaaaaaaaaaaaaaaaaaaaaaaaaaaaaaaaaaaaag

SEQ ID NO: 1047 - DNA, 923 bp, Glycine max
  Predicted polypeptide sequence is orthologous to G664
gtggtgggcataggatgggaaggtccccttgctgtgagaaagcacacacaaacaaaggtgcatggaccaaagaagaagatcatcgcctcatttcttacattagagctcacggtgaaggctgctggcgctctctccccaaagccgccggccttctccgttgcggcaagagctgtcgtctccgctggatcaactatctccgccctgacctcaagcgcggcaatttctccctcgaagaagaccaactcatcatcaaactccacagcctccttggcaacaagtggtctctaattgctggtagattgcccggtagaactgacaatgagatcaagaattactggaatactcacatacgcaggaagcttctgagcagaggtattgaccctgccactcacaggcctctcaacgattcttctcatcaagaacctgctgctgtctctgcccctcctaaacatcaagagtcctttcaccatgaacgctgccctgacttgaaccttgagctaaccattagtcctccccatcatcctcaacctgatcatccgcacttgaagacccttgtgacaaactcaaacctttgctttccctgcagtctgggtttgcataatagcaaagattgtagctgtgccctccacactagtactgccaacgctactgctactggctatgatttcttggccttgaaaaccaccgtcgttttggattacagaaccttgcacatgaaatgaaatcatattactgaaatctctctctttctttctttctttcttttcttctctaatataatttcttacttacttacttacttacttacttacttgttaatggttgcaaatgataaaaaagttccagccagtacagttgaacaaaaaaaaaaaaaaaaaaaaaaaaaaaaaaaaaaaaaaaaaaaaaaaaaaaagggcggccgc

SEQ ID NO: 1048 - DNA, 887 bp, Glycine max
  Predicted polypeptide sequence is orthologous to G664
gtgggaaggtccccttgctgtgagaaagcacacacaaacaaaggtgcatggaccaaagaagaagatcatcgcctcatttcttacattagagctcacggtgaaggctgctggcgctctctccccaaagccgccggccttctccgttgcggcaagagctgtcgtctccgctggatcaactatctccgccctgacctcaagcgcggcattcgccccctcgaagaagaccaactcatcatcaaactccatagcctccttggcaacaagtggtctctaattgctggaagattgccgggtagaacggacaatgagataaagaattactggaatactcacataagaaggaagcttctgagcagaggtattgaccctgccactcacaggcctctcaacgatgacaaggtattggaacgctgccctgacttgaaccttgagctaaccattagtcctccccgtcaacctcaatctgatcagcatcacttgaagcccgttgggagaaactcaaacctttgctttgcctgcagtttgggtttgcaaaatagcaaagatcattgtagctgtgcgctcaacactgccaacgctgcttctggccatgatttcttggccttgaaaaccagcgttttggaaatgaaatgagtcaaattcattttggaatctttcttccctaattaattagttgttaatggatgcaaatgattgcctgcccaatttcctcgtggagccctttctattattcctatgttcatgtacatgtgcgtaagactacaaactttcttgtttatacgattggttctttccaaatagaatacaactatatatttttgttatttctataacaaaagttcaattcatcacttcgatcgatggtagagagaattaccacaatcatt

SEQ ID NO: 1049 - DNA, 858 bp, Glycine max
  Predicted polypeptide sequence is orthologous to G664
attcggctcgagcatatacattttttagccttttgttagccccaaacacccacacgggcacacccctgcaggtacaaaagggggagttcacaacaaaaagaaaacaatgagaaaaccttgttgtgacaaggaaaacatcaataaaggtgcttggtccaagcaagaagaccaaaagctcattgactacatccaagtccatggtgaaggctgttggcgttccattcctaaagctgctgggctgcatcgttgtggcaaaagctgtaggatgagatggttaaactacttacgaccaggcatcaaacgtggaatctttgctgaagatgaggaagacctcatcatcaaactccatgccctccttggtaacaggtggtcactcattgctggaaggttgcctgggaggacagacaatgaggtgaagaactattggaattctcacatccgaagaaaactaataaagatgggaattgatccaaatagccataagccacaccaaagctttcctcgtcctcatgtttcttctgctgatcatcagggtgcatcaacatctgagtccatcaacaacaacaaagtccctttcttcaattcccgtggttcagctgccactgatcatcataagatttcgttcactaaagaagaaacatcaattatttcatcaccccctttgaatcttgatcttacaatttctttaccttcgcctgtggaagaaaacaaaaattctgatcatgagtccgccaagacatgtgacgtggatatagatctcaactgttagtacttttagttgttggcaagagtattaattaccagcagtagtacttcatgtttgttacaaattaattttggagaaataatcagtttttc

SEQ ID NO: 1050 - DNA, 1256 bp, Glycine max
  Predicted polypeptide sequence is orthologous to G664
ccacgcgtccgctccattcgcgaaaggctcgcagcaaaaccacgccatcgatcgccgccaccagtccagcatcctccgatcgactacgtactcccacccactccggcagcagcgaggcctctctgtctgtgcgcggcgtggctgtcgtcgatctctgcctggcgggcggccggcatggggaggtccccgtgctgcgagcaggcgcaccaacaagggcgcgtggaccaaggaggaggaccagcgcctcgtcgcctacatcaaggcccacggcgagggctgctggagatcgctaccaaaagccgcaggtctgctgcgctgcgggaagagctgccggctgcggtggatcaactacctgcgcccggacctcaagcgcggcaacttcaccgaggaggaggatgacctcatcatcaagttccacgagctcttcggcaacaagtggtcgctcatcgccgggaggctgccgggcaggacggacaacgagatcaagaactactggaacacgcacatcaagcgcaagctcctcgcccgcggcatggacccgcagacgcaccgcccgctcgccagcgcgaccgcggggcagcagcattaccagctgcaggagccgcagaagcgagcggccggcggcggtccagcaggccatccgcaccaggaccacttggaggtcgtcgtcatctcgaactcgccggacgaggcctacagccgtagcagcgacgacgagccgcggtccgccacgccgccgcggcgccacctcgacatcgacctcaacctgtccatcagcctagcggcctaccagccgccggaggaaaccggcatcatcaagcagccactggtgatgaagcaggagcaggaaacggcggcgggcggcaccaatgccgcggcggtgtgcctgtgcctcaacagcctcgggtaccggccgggcgtcgagtgcgtctgcggcgacggcagctcctcctcctcctcctcgcactcccactcccactcccaccaatgggctctgaattttttacaggcggcggcgccctgctacagaggccaatagtgtagtaagagcgatcagtgacatcattaaaatgggagcgttattacgatcgagactgagggtgagggaggggggcagagctgagcagggatagtagttaactacagctagtagtagtagtagtacgtaaaagacacacatgcttaggctttaacaagtctctgaaacacgcatcatgggttatgagttgtgctctaaaaaaaaaaaaaaaaaaaag

SEQ ID NO: 1051 - DNA, 1177 bp, Oryza sativa
  Predicted polypeptide sequence is orthologous to G664
ccgggctgcaggcgacgacgacgactcgccgccggccgagaccaacagcgatggggaggtcaccgtgctgcgagaaggagcacaccaacaagggcgcgtggaccaaggaggaggacgagcgcctcgtcgcctacatccgcgcccacggcgagggctgctggcgctcgctccccaaggccgccggcctcctccgctgcggcaagagctgccgcctccgctggatcaactaccggcgccccgacctcaagcgcggcaacttcaccgccgacgaggacgacctcatcatcaagctccacagcctcctcggcaacaagtaactacgcttctcttttcttgccttctgcctcacctcgcctctcttccatccatcgattgctcatcgattttcatcatccctcgcgtccgctctgatcgcggcgaggctgccggggaggacggacaacgagatcaagaactactggaacacgcacatccgccggaagcttctcggcagggggatcgaccccgtcacgcaccgccccgtcaacgccgccgccgccaccatctccttccatccccagccgccgccaacgacgaaggaggagcagctcatactcagcaagccgcccaagtgccccgacctcaacctggacctctgcatcagcccgccgtcgtgccaggaagaagacgatgactatgaggcgaagccggcgatgatcgtgagggcgccggagctgcagcgccgccgcggcggcctctgcttcggctgcagcctcggcctccagaaggagtgcaagtgcagcggcggcggcgccggcgccggcgccggcaacaacttcctcggcctcagggctggcatgctcgacttcagaagcctccccatgaaatgaaatgatcctgcaaaccaatccatgatcgttacactttctcttctcttttgggttcttgatttcttagctagctttggttactgcttagtgttagtccttcttaattaggatcagatagaggaatacttcctttggggagatgatcagtgatcttgttgatcacttcctccattttgtgtaaatactgttccactcatacttagttcagttgatgatatggttatttaggttgttggatgtaaatttgttctcggtctgaaaatctatggtatttgtcatgccttgccgagaaaaaaaaaaaaaaaaaa

SEQ ID NO: 1052 - DNA, 496 bp, Oryza sativa
  Predicted polypeptide sequence is orthologous to G664
cttccactgaaacaacccaccgaggcagcagaagaaaggaaagaatcaagaaagcttcatcgtcttcatggggaggtcaccgtgctgcgagaaggcacacaccaacaagggagcatggaccaaggaggaagatgaccggctcattgcctacatcaaggcgcacggcgaaggttgctggcgatcgctgcccaaggccgccggcctcctccgctgtggcaagagctgccgcctccggtggatcaactacctccggcctgacctcaagcgcggcaacttcaccgaggaggaggatgagctgatcatcaagcttcacagccttttaggcaacaaatggtctctgatagccgggaggttgccaggaagaacggacaacgagatcaagaactactggaacacgcacatcaggaggaagctgctgagccgtggcatcgacccggtgacacaccggccgatcaacgacagcgcgtccaacatcaccatatcattcgaggcggcc

SEQ ID NO: 1053 - DNA, 1070 bp, Oryza sativa
  Predicted polypeptide sequence is orthologous to G664
cgccatggcgccaccatgcatataaactcgagctccctctcctcctcttcttcctcctctccactctccaccatcgtcttcgtcgtcgtcttcctcagctcggagcgatggggaggtcgccgtgctgcgagaaggcgcacacgaacaagggcgcgtggaccaaggaggaggaccagcgcctcatcgcccacatcaaccagcacggcgagggctgctggaggtcgctccccaaggccgccgggttgctgcgttgcgggaagagctgccgcctccggtggatcaactacctccgccccgacctcaagcgcggcaacttcaccgacgaggaagacgagctcatcatcaagctccacgagctcctcggcaacaagtggtcgctgatcgccgggaggctgccggggaggacggacaacgagatcaagaactactggaacacccacatcaagcgcaagctcctcgcccgcggcctcgacccgttacgcaccgcccgctcaatgccgccgccgccgtcgccggccaccaccacctcgcgccggcggctccagctgctcgcccgacgcaacaagcggccacagcagctgcagcgacggcgacgagtaccgcggcggcatcgacctcaacctgtccataagcccgccgtcgtcgtcgtcccagccgtcttccccgccgccgccgccgcacgaagcagaggcgagacgcgccggagcgccggcgagctacacctaccaccaccactactcggagacgagggagaagatatgcctgtgcttgaaccacctcgggctgcacggcggcgacgagtgcagctgcggcggctcgtcggcctcttcctcctcctcgccgccgccggcgacggcgagctcgcgagcgttcacattcgccaatgcatcgtcgtcaacagtgtaaaacacagagaaattcagcgattttcagactaagagaattaatgagaggtagagcacatgcatgctgaattaattgaattaactcaatccaagcttgagctaggcatctagctaactttgtgatttgatcatgcatcagctagcaaaatcatcataatcatcatc

SEQ ID NO: 1054 - DNA, 1200 bp, Oryza sativa
  Predicted polypeptide sequence is orthologous to G664
gcacgaggaaaaagctcccacaaagcatcacctgcaaccagcccccgctcatctccatcttcctcctccctccctcgctcctgtgcttcttctcttcatcaacaagagagctttccctcgatctgtgtgtgtatatatatagagagagagggactgatctgggtgtagcgagctaggtagcctagctagcatggggaggtccccatgctgcgagaaggcgcacacgaacaagggagcctggacgaaggaggaggaccagcggctcatcgcctacatcaaggccaacggcgagggatgctggaggtcgctccccaaggccgcagggttgctgcggtgcgggaaaagctgccggctgcgatggatcaactacctgagaccggacctcaagcgaggtaatttcaccgaggaggaggacgagttcatcatcaagctccatgagcttctaggcaacaagtggtcactgatcgccgggaggctgccggggaggacggacaacgagatcaagaactactggaacacgcacatcaagcgcaagctcctcgcccgcggcgtcgacccgcagacgcaccgcccgctcaatgccgccgccgaccaccaccagcagcagcagctccaggcgccacggcggttcgccgccgcgccagccggccaccaccaccaccaccctgaccatttcgccgtcctctccaactcgccggaggcctgcagccacagcagcgacgacgagcccagctccgccacgccgccgccgccgccgcgtcacctcggcatcgacctcaacctttccatcagcctagctcctttccagccgcaggatcagaccagcgagccgatgaaccaggaggagggcgacgaagcgtcagcgacggcgaacggcgccggcaatgcagcgatgacgacgacggcgacgacggcggcggtgtgcctgtgcttgaaccgcctcgggctccacggcggcgaggtgtgcagctgcggacgcgggggcgccccctccatgcaggccagcacacacatgtttagattcatcacgccgctaggaggaagccccccccccagtagtagcccaccaatgacataattaattaagttgagggaggagatatatataccctacttaattcgcaattaaaacccagccccacatgcttagctctttgtaatattcatcaggaaaggtgatctctttctcttttttttttt

SEQ ID NO: 1055 - DNA, 1274 bp, Zea mays
  Predicted polypeptide sequence is orthologous to G664
ttgggtacctcgaggccggccgggggctccttgcctttgttctgttctccattcgcgaaaggctcgcagcaaaaccacgccatcgatcgccgccaccagtccagcatcctccgatcgactacgtactcccacccactccggcagcagcgaggcctctctgtctgtgcgcggcgtggctgtcgtcgatctctgcctggcgggcggccggcatggggaggtccccgtgctgcgagcaggcgcacaccaacaagggcgcgtggaccaaggaggaggaccagcgcctcgtcgcctacatcaaggcccacggcgagggctgctggagatcgctaccaaaagccgcaggtctgctgcgctgcgggaagagctgccggctgcggtggatcaactacctgcgcccggacctcaagcgcggcaacttcaccgaggaggaggatgacctcatcatcaagttccacgagctcttcggcaacaagtggtcgctcatcgccgggaggctgccgggcaggacggacaacgagatcaagaactactggaacacgcacatcaagcgcaagctcctcgcccgcggcatggacccgcagacgcaccgcccgctcgccagcgcgaccgcggggcagcagcattaccagctgcaggagccgcagaagcgagcggccggcggcggtccagcaggccatccgcaccaggaccacttggaggtcgtcgtcatctccaactcgccggacgaggcctacagccgtagcagcgacgacgagccgcggtccgccacgccgccgcggcgccacctcgacatcgacctcaacctgtccatcagcctagcggcctaccagccgccggaggaaaccggcatcatcaagcagccactggtgatgaagcaggagcaggaaacggcggcgggcggcaccaatgccgcggcggtgtgcctgtgcctcaacagcctcgggtaccggccgggcgtcgagtgcgtttgcggcgacggcagctcctcctcctcctcctggcactcccactcccactcccaccaatgggctctgaattttttacaggcggcggcgccctgctacagaggccaatagtgtagtaagagcgatcagtgacatcattaaaatgggagcgttattacgatcgagactgagggtgagggaggggggcagagctgagcagggatagtagttaactacagctagtagtagtagtagtacgtaaaagacacacatgcttaggctttaacaagtctctgaaacacgcatcatgggttatgagttgtgctctta

SEQ ID NO: 1056 - DNA, 1305 bp, Zea mays
  Predicted polypeptide sequence is orthologous to G664
ccgggtcgaccccgcgtccgcggacgcgtgggtcgccgtgctgcgagaaggcgcacaccaacaagggcgcgtggaccaaggaggaggacgagcgcctggtcgcgcacatcagggcgcacggcgaggggtgctggcgctcgctgcccaaggccgccggcctcctgcgctgcggcaagagctgccgcctccgctggatcaactacctccgccccgacctcaagcgcggcaacttcacggaggaggaggacgagctcatcgtcaagctgcacagcgtcctcggcaacaagtagggccgccgcgcgcctctccctctccctcctacccctcgtcattcgtttcgtttcctaaactggccgggtacgttacgtgcaggtggtccctgatcgccggaaggctgcccggcaggacggacaacgagatcaagaactactggaacacgcacatccggaggaagctgctgagcagggggatcgacccggtgacgcaccgcccggtcacggagcaccacgcgtccaacatcaccatatcgttcgagacggaggtggccgccgctgcccgtgatgataagaagggcgccgtcttccggctggaggacgagaggaggaggagcgcaacaaggcgacgatggtcgtcggccgcgaccggcagagccagagccacagccacagccaccccgccggcgagtggggccaggggaagaggccgctcaagtgccccgacctcaacctggacctctgcatcagcccgccgtgccaggaggaggaggaggagatggaggaggctgcgatgagagtgagaccggcggtgaagcgggaggccgggctctgcttcggctgcagcctgggactccccaggaccgcggactgcaagtgcagcagcagcagcttcctcgggctcaggaccgccatgctcgacttcagaagcctcgagatgaaatgagcgcgcttctaccctctctgtgtagcttctccccccccgtcgtcctcgtttttgttttgccacacctcacatggatgatgaattgatgatacgtggttggttagttttttcgtaggtgaaaaatacgcgatggtgagcgagtgaaagagagattttgtgccctgggtcctcctccctgctctctcttgctgctccattttgcctccctctgtcctctctctctctctctctctctctctctctctctctctctctctctctctgtatctctgtaattaccatcgccaaatgatcatgggggcaatatcatgctaggtctctggaaaaaaaaaaaaaaaaaaagttgacgctaatcccgtttccagg

SEQ ID NO: 1057 - DNA, 1014 bp, Zea mays
  Predicted polypeptide sequence is orthologous to G664
  misc_feature (32)..(32): n is a, c, g, or t
gaggccaacccttttcaccactctaaagagcnctcgcgatccagtcaagtgcggtatggcggcccgccccccggcccggctcccacccttgcgcgcgcagtcgcagcaacgatggggaggtcgccgtgctgcgagaaggcgcacacgaacaagggcgcgtggaccaaggaggaggacgaccgtctggtggcgtacatcaaggcgcacggcgaggggtgctggcgctcccttcccaaggccgccggacttgtgcgctgcggcaagagctgccgcctccggtggatcaactacctgcggcccgacctcaagcgcggcaacttcacggaggaggaggacgagctcatcatcaagctccacagcctactcggcaacaaatggtccctgatcgctggaaggctgccgggcaggaccgacaacgagatcaagaactactggaacacgcacatccggcggaagctgctgagcagggggatcgacccggtgacacaccgccccatcaacgagcacacgtccaacataaccatatcgttcgaggactggggccaggggaaggcgctcaagtgccccgacctgaacctggacctctgcatcagcccgccgtgccaggaggaggaggaggccatgctgctgaggccggtgaagcgggaggaggccgggctctgcttcagctgcagcctggggctccccaagagcgcggactgcaagtgcagcaacttcctcgggctcaggaccgccatgctcgacttcagaagactcgagatgaaatgagagcttccatccatctctgtctgtctctctctgtaacttcacccctgataacacgcagtagtagtagtcaccaactgatttgtcgctccattaattctgtctctctctctctctctctcgctatgtaaattagcatcaccaactgattgattgatcatgggcaattaataatacttgttgctgctgcaaattgacattaaaaaaaaaaaaaaaaaaaaaaaaaaaaaaaaaaaaaaaaaaaaaaag

SEQ ID NO: 1058 - DNA, 1334 bp, Zea mays
  Predicted polypeptide sequence is orthologous to G664
cattgggtacctcgaggccggccggggattcctcagtcaagtgcctatgcctatctatggtaccctcccccgcctcccggcacacccttggccttggcctggcgctcgcacctcacagcagcagcagcaacaacaacctccactgccgcaacccaccgagaggcgagaccggcggcggcaaaaggacgatacaaaagcagccagggttgctggcaacagcgtcggtcgcccgcccgctcgccatggggaggtcgccgtgctgcgagaaggcgcacaccaacaagggcgcgtggaccaaggaggaggacgagcgcctggtcgcgcacatcagggcgcacggcgaggggtgctggcgctcgctgcccaaggccgccggcctcctgcgctgcggcaagagctgccgcctccgctggatcaactacctccgccccgacctcaagcgcggcaacttcacggaggaggaggacgagctcatcgtcaagctgcacagcgtcctcggcaacaagtggtccctgatcgccggaaggctgcccggcaggacggacaacgagatcaagaactactggaacacgcacatccggaggaagctgctgagcagggggatcgacccggtgacgcaccgcccggtcacggagcaccacgcgtccaacatcaccatatcgttcgagacggaggtggccgccgctgcccgtgatgataagaagggcgccgtcttccggctggaggacgagaggaggaggagcgcaacaaggcgacgatggtcgtcggccgcgaccggcagagccagagccagagccacagccaccccgccggcgagtggggccaggggaagaggccgctcaagtgccccgacctcaacctggacctctgcatcagcccgccgtgccaggaggaggaggaggagatggaggaggctgcgatgagagtgagaccggcggtgaagcgggaggccgggctctgcttcggctgcagcctggggctccccaggaccgcggactgcaagtgcagcagcagcagcttcctcgggctcaggaccgccatgctcgacttcagaagcctcgagatgaaatgagcgcgcttctaccctctctgtgtagcttctccccccccgtcgtcctcggttttgttttgccacacctcacatggatgatgaattgatgatacgtgggtggttagttttttcgtaggtgaaaaatacgcgatggtgagcgagtgaaagagagattgtgtgccctgggtcctgctcgctgctctctgttgctgctgcattgtgcctcgctgtgggctctgtgtctctgtgtgtgtggggagtgtgtgtgtgattctgtgggtgg

SEQ ID NO: 1059 - DNA, 1315 bp, Zea mays
  Predicted polypeptide sequence is orthologous to G664
cttttttttttttttttttttttgagcagactgcaatgaatcatatcctcaagaggataaaaaaactattacctcctgtgcagggcatcagcgacaggaaaagagagatgaatgaacgaacctaatccatccatcagcagcgtaaccaaatcaggcacaggtttgagtattaaaccagtggaagtgatgagctgggagcaggcctaacccttttccaccaactctacaagagctcccgcgatccagtcaagtgccctataaaatccagccccgcttggcttcacccacccttgggctcgcaatcgcagcaacgatggggagatcgccgtgctgcgagaaggcgcacacgaacaagggcgcgtggaccaaggaggaggacgaccgtctggtggcgtacatcaaggcgcacggcgaggggtgctggcgctcccttcccaaggccgccggacttgtgcgctgcggcaagagctgccgcctccggtggatcaactacctgcggcccgacctcaagcgcggcaacttcacggaggaggaggacgagctcatcatcaagctccacagcctactcggcaacaagtaggcagcccgaccgacctcaagcactaaggcacccactaaggcactaactgtgttgtctgtgtatgatctgtttgttgggtcacagatggtccctgatcgctggaaggctgccgggcaggaccgacaacgagatcaagaactactggaacacgcacatccggcggaagctgctgagcagggggatcgacccggtgacacaccgccccatcaacgagcacacgtccaacataaccatatcgttcgaggactggggccaggggaaggcgctcaagtgccccgacctgaacctggacctctgcatcagcccgccgtgccaggaggaggaggaggccatgctgctgaggccggtgaagcgggaggaggccgggctctgcttcagctgcagcctggggctccccaagagcgcggactgcaagtgcagcaacttcctcgggctcaggaccgccatgctcgacttcagaagactcgagatgaaatgagagcttccatccatctctgcccacgcgtccgcggacccgcgcccctgataacacgcaggagtagtagtcaccaactgatttgtcgctccattaattctgtctctctctctctctctcgctatgtaaattagcatcaccaactgattgattgatcatgggcaattaataatacttgttgctgctgcaaattgacattaaaaaaaaaaaaaaaaaaaaaaaaaaaaaaaaaaaaaaaaaaaaaaaaaaaaaaaaaaaag

SEQ ID NO: 1060 - DNA, 865 bp, Zea mays
  Predicted polypeptide sequence is orthologous to G664
  misc_feature (13)..(13): n is a, c, g, or t
  misc_feature (717)..(718): n is a, c, g, or t
gcccgggcccgtnagcacttagcccccaacaacaacaacagcaccaacttccactcctgcaaacccaacccaacccaacccaccaccgagcacaagaaaaaggagagccatcggcggcggcagaccatcgtctaaaggcaaaggccctgttcgataatacgatggggcggtcgccgtgctgcgagaaggcgcacaccaacaggggcgcgtggaccaaggaggaggacgagcggctggtggcctacgtccgcgcgcacggcgaagggtgctggcgctcgctgcccagggcggcgggcctgctgcgctgcggcaagagctgccgcctgcgctggatcaactacctccgcccggacctcaagcgcggcaacttcaccgccgacgaggacgacctcatcgtcaagctgcacagcctcctcgggaacaagtggtcgctcatcgccgcgcggctcccggggcggacggacaacgagatcaagaactactggaacacgcacatccggcgcaagctgccgggccgcggcatcgaccccggtcacccaccgccccgtcaacagcgaccacgccgcgtccaacatcaccatatccttcgaggcggcgcagagggacgacaagggcgccgtgttccggcgagacgccgagcccaccaaggcagcggcagcggcgatcacccacgtcgaccaccatcaccgtagcaacccccaccaccagatggactgnnggccagggaagccgctcaagtgcccggacctgaacctggacctgtgcatcagccccccgtcccacgagggacccatggtggacaccaagcccgtcgtgaaagaggaggccggcgccggcggtcggcgtcgtgggcctctgcttcagc

SEQ ID NO: 1061 - DNA, 1239 bp, Zea mays
  Predicted polypeptide sequence is orthologous to G664
gtgcggacgctcgaggccggccgggttgcgaggcctaacccttttccaccaactctacacagagctcccgcgatccagtcaagtgccctataaaatccagccccgcttggcttcacccacccttgggctcgcaatcgcagcaacgatggggagatcgccgtgctgcgagaaggcgcacacgaacaagggcgcgtggaccaagaaggaggacgaccgtctggtggcgtacatcaaggcgcacggcgaagggtgctggcgctccctgcccagggccgccggcctgctgcgctgcggcaagagctgccgcctccgctggatcaactacctccgccccgacctcaagcgcggcaacttcaccgccgacgaggacgacctcatcgtcaagctccacagcctcctcggcaacaagtggtccctcatcgccgcgcggctcccgggccggaccgacaacgagatcaagaactactggaacacgcacatccggcgcaagctgctgggcagcgccatcgaccccgtcacgcaccgccgcgtcgcggggggcgccgcgaccaccatctcgttccagcccagccccaacaccgccgtcgccgccgccgcagaaacagcagcgcaggcgccgatcaaggccgaggagacggcggccgtcaaggcccccaggtgccccgacctcaacctggacctctgcatcagcccgccgtgccagcatgaggacgacggcgaggaggaggaggaggagctggacctcatcaagcccgccgtcgtcaagcgggaggcgctgcaggccggccacggccacggccacggcctctgcctcggctgcggcctgggcggacagaagggagcggccgggtgcagctgcagcaacggccaccacttcctggggctcaggaccagcgtgctcgacttcagaggcctggagatgaagtgaacgaaacgaagcccacacgtcctttcttctccttttgttgtcggttttagtcttggcttgttggatttggatagagctagttggttactagttgttagttagaagatagtgcaggatgatcactagctactggctacctcaacacagtagctgctcccttcttctcttccattctatgtaaaccccccccaaaaatacttagtacctggttgatgaactttaggaataatcatgtgtactttcttctgactccgggttgcttcccggattctttgtgttgtaatgtaactactactactacaagtagtagg

SEQ ID NO: 1062 - DNA, 1027 bp, Zea mays
  Predicted polypeptide sequence is orthologous to G664
tgttgtaggaaggtggggcgcgagtcgcacctcgcagcagcagcagcagcagcaacaacaacctccactgcgcgcaacccaccgagaggcgagagcggcggcaaaaggacgatacaaaagcagccagggttgctggcaacagcgtcggggggtgtttttttttttccatggggaggtcgccgtgctgcgagggggggcacaccaacaagggcgcgtggaccaaggaggaggacgagcgcctggtcgcgcacatcagggcgcacggcgaggggtgctggcgctcgctgcccaaggcggccggcctcctgcgctgcggcaagagctgccgcctccgctggatcaactacctccgccccgacctcaagcgcggcaacttcacggaggaggaggacgagctcatcgtcaagctgcacagcgtcctcggcaacaagtggtccctgatcgccggaaggctgcccggcaggacggacaacgagatcaagaactactggaacacgcacatccggcggaagctgctgagcagggggatcgacccggtgacacaccgccccatcaacgagcacacgtccaacataaccatatcgttcgaggactggggccaggggaaggcgctcaagtgccccgacctgaacctggacctctgcatcagcccgccgtgccaggaggaggaggaggccatgctgctgaggccggtgaagcgggaggaggccgggctctgcttcagctgcagcctggggctccccaagagcgcggactgcaagtgcagcaacttcctcgggctcaggaccgccatgctcgacttcagaagactcgagatgaaatgagagcttccatccatctctgtctgtctctctctgtaacttcacccctgataacacgcagtagtagtagtcaccaactgatttgtcgcaacattctgtctctctctctctctctctctctctctctctctctctctcgctatgtaaattagcatcaccaactgattgatcatgggcaattaataataaaaaaaaaaaaaaaaaaa

SEQ ID NO: 1063 - DNA, 1152 bp, Lycopersicon esculentum
  G3509  Predicted polypeptide sequence is orthologous to G664
cacaacaaagccaaaaaaacttccattatccttctctcaattggtatatcacacttgcaaaaaccaaaaaaaataaaggtatagtttcttaaatactcttatttgtctaaatgggaaggtcaccttgttgtgagaaggcacatacaaacaaaggagcatggactaaagaagaagatgaaagactaatttcttacattagagctcatggtgaaggttgttggaggtctcttcctaaagctgctggacttcttcgatgcggtaaaagttgtcgtctccgatggattaattacttaagacctgaccttaaacgtggtaactttactgaagaagaagatgaactcattatcaaactccatagcctccttggaaacaagtggtcgcttatagcaggaagattaccaggaagaacagataacgagataaaaaactattggaacacacatataagacgaaagctcttgagtcgaggtattgatccaacaacacatagatcaatcaatgatcctactacaataccaaaagttacaacgattacttttgctgctgctcatgaaaatattaaagatattgatcaacaagatgagatgataaatatcaaagctgaattcgttgaaacaagcaaagaatcagataataatgaaataattcaagaaaagtcatcatcatgtcttcctgacttaaatcttgaactcagaattagtcctccacatcatcaacaactcgatcatcatcgtcatcatcaacgatcaagctctttatgttttacatgtagtttgggaattcaaaatagtaaagattgcagttgtggaagtgaaagtaatggaaatggatggagtaataatatggtaagtatgaacattatggctggttatgactttttgggcttgaagactaatggtcttttggactatagaactttggaaactaagtgattcgattcgattcgaatttatgcataaatcatcttaatttgatgtatatgtagaaaagaaaaagagtttgaggatattatttcttctagctaataattttctcatggttgtaaactttgcaatatagtaattacatttaattcaaagcagtaaaaatatagcactaatgattctatgaagataatttttctttttcctctaaaaaaaaaaaaaaaaaaaa

SEQ ID NO: 1064 - protein, 287 aa, Oryza sativa
  G3506  Orthologous to G664
MGRSPCCEKAHTNKGAWTKEEDQRLIAYIKAHGEGCWRSLPKAAGLLRCGKSCRLRWMNYLRPDLKRGNFTDDDDELIIKLHALLGNKWSLIAGQLPGRTDNEIKNYWNTHIKRKLLSRGIDPQTHRPVSAGSSAAAASGLTTTASTAAFPSLAPAPPPQQHRLHNPVHAAAPSNASFARSAASPPSEDGHSSSGGSSDAPRCPDLNLDLDLDLSMSLPSSPPKTPAAASSTTASRHHHHQQQKTICLCYHLGVRNGDVCSCKAAAPSPAGPRAFRFLRPLEEGQYI

SEQ ID NO: 1065 - protein, 243 aa, Oryza sativa
  G3504  Orthologous to G664
MGRSPCCEKEHTNKGAWTKEEDERLVAYIRAHGEGCWRSLPKAAGLLRCGKSCRLRWINYLRPDLKRGNFTADEDDLIIKLHSLLGNKWSLIAARLPGRTDNEIKNYWNTHIRRKLLGRGIDPVTHRPVNAAAATISFHPQPPPTTKEEQLILSKPPKCPDLNLDLCISPPSCQEEDDDYEAKPAMIVRAPELQRRRGGLCFGCSLGLQKECKCSGGGAGAGAGNNFLGLRAGMLDFRSLPMK

SEQ ID NO: 1066 - protein, 2359 aa, Oryza sativa
  Orthologous to G664
MGRSPCCEKAHTNKGAWTKEEDQRLIAYIKANGEGCWRSLPKAAGLLRCGKSCRLRWINYLRPDLKRGNFTEEEDEFIIKLHELLGNKWSLIAGRLPGRTDNEIKNYWNTHIKRKLLARGVDPQTHRPLNAAADHHQQQQLQAPRRFAAAPAGHHHHHPDHFAVLSNSPEACSHSSDDEPSSATPPPPPRHLGIDLNLSISLAPYQPQDQTSEPMKQEEDDEASATANGAGNAAMTTTATTAAVCLCLNRLGLHGGEVEMDRQWMYADRRSKEFIDGVHYFLRVAEANRQRGFICCPCNKCKNQKEYSASRTIHFHLFESGFMPSYNCWTSHGEQGVEMEEDEVEDDNIPDFAQYVGFEGNQTGEEEIAADGNDVADDLGQMLQDAREDCESEKEAHKLDKMLEDHRNSLYPGCEQGHKKLDTTLELLQWKAKNGVSDKAFGDLLKLVKNILPGGNKLPETTYEAKKIVCPLGLEVHKIHACPNDCILYRGEEYENLEACPVCKALRYKIRRDDPGEVNGQLTKKRIPAKVMWYFPIIPRLRRLFRNKGNARMLRWHAEERQQDGMLRHPADGSQWRNIDRKFKEFGKDARNIRFGPKQPGNDIDVYLRPLVEDLKQLWKKEGVPVWDEDKQEEFNLRALLFVTINNWPALSNLSGQSNKGYKACTHCMDETESTYLKHCRKVVYMGHRRFLAANHPVRKKGKHFEHKADHRTKPKHRSGKTVFAMVKDLKVVFGKGPGSQHIESEDGHAAMWKKNSIFWELPYWEFLDVRHAIDVMHLTKNLCVNLLGFLGVYGKSKDTLEARNDLKHMEQRGDLHPEPKEKGSHYLSPASYTLSKAEKESMFECLESIKVPSGYSTNIKRIISTKEKKFTNLKSHDCHVLMTQLLPVVIRGILPDNVRATITKLCAFMNAISQKVIDPDRLEALQNEVVQCLVSFELIFPPSFFNIMTHLLCHLVKEIRILGPMYLHNMFPFERYMGVLKKYVRNRARPEASIAKGYGTEEVIEFCVEFIEDLRPIGVPESRHEGRLRGKGTLGRKAIMTVDNNLFRKAHFTVLQHSSLVAPYIEEHLALVRARNIGKSDAWITRHHIDTFPAWLRQHLMGNESINQQLAFLARGPSGSIATFQGYEINGYTFYTRAQDMKSTNQNSAVRVDAMGHDGTTATYYGAIEDIWELDYGPLKVPLFRCQWVRLTGGGVMIDDSGMTTVDLNKVGYSDEPFVLANDVTQVFFVKDMSSKGKKGRGPDEPKRQVVLPGKRKIVGVEDKTDEDYDQLDGQPPFTVTIDPSILLSNEDTPYSRSDHKEGTIMADRDEEQILYDTIAEGSSQYWNEEEGNEDPNQYLNEEGNVERDAEGNQQGHVERDVEGNQEEEASGSQPSVGQKRARGQRGAAKKLEGRHIITEVEEDGRPSAPAEAAKNYVRHSGWVVRDNVPVSTVYWRRTRARGDHESFVQDSEKEMLWTTMLETFTLPAGTEDKVKRWTLKKMAEQFQSFKGDLYQKYILKGQTPNFDTFPKLRDHWDEFVAYKTGEQGKAMMERNKENAAKKKYHHHLGSGGYSVAMPKWEQMEASLIERGIEPATANWPERSKFWYYAHGGTLNPADGSLVFGYQIQEAVRRLTDAVEASSQGTFRPDRDRDELTLALQTPEHPGRTRGKGVIPWKIGFKEDIHTYRSRIRSKRDTEAKIADLEFRVSSYELNMQEEVARKVDERMAAHRSHDPQPTIPPAMVSPSGNRSSCASTGQVGSQSMDAMQTQDESTCPVDDITQRTPCELHIPFKNLSIKVASGMAIPTDPSGTYHCRPIPAGYSKVEVELVEGAYEDLELDYPGGDGETHLRDTCHAIILWRRRYIILPGRQAASRAPSPPAPPSPPQDPAPSPPHAPPAPSPPQAPASTPQDPAPTPPRAPTPTPPQAPVPAPSKSRAPPAPPLAHTRATKKAKVDAAKNKDPGYDCTQEELDAYVASEVKRQFKPRSPEKKIPIDPSVRNFFRGMSASVKEAIKLSDYEQTLKKASSGKSKPVPQLGEQPNQEIEPLVTGKEMTIEQFITDTGLTTDQLLGVAPIEKAEVKYMYELGKPLVKPELLQSLPTQMYKFHQLYMEMSATGREMIGARIRDTDFLQGDDILWINFRGIYELYQLDALDVSIMSCWILMEIQRARRRRVFDTGFIDPRKVNVAMLDQYPQETEDNLVHLLKAQHYKTFILLPYNTEFHWVLLLIDLEACTVNVYDSMDKKESTFDKVFELIDRAWYRFRHLVRGKWRERLRRKFKFPCAKQKQGTNLCGYYVCEYCHCLADQIITTRELDFIRMRDNLTTHKEFIAAVQEQLMGFINEEILDPKGEFYYDGNTIHRSLASELAASTTTSKS

SEQ ID NO: 1067 - protein, 261 aa, Oryza sativa
  Orthologous to G664
MGRSPCCEKAHTNKGAWTKEEDQRLIAYIKANGEGCWRSLPKAAGLLRCGKSCRLRWINYLRPDLKRGNFTEEEDEFIIKLHELLGNKWSLIAGRLPGRTDNEIKNYWNTHIKRKLLARGVDPQTHRPLNAAADHHQQQQLQAPRRFAAAPAGHHHHHPDHFAVLSNSPEACSHSSDDEPSSATPPPPPRHLGIDLNLSISLAPYQPQDQTSEPMKQEEDDEASATANGAGNAAMTTTATTAAVCLCLNRLGLHGGEPRPE

SEQ ID NO: 1068 - protein, 251 aa, Oryza sativa indica
  G3503  Orthologous to G664
MGRSPCCEKAHTNKGAWTKEEDDRLIAYIKAHGEGCWRSLPKAAGLLRCGKSCRLRWINYLRPDLKRGNFTEEEDELIIKLHSLLGNKWSLIAGRLPGRTDNEIKNYWNTHIRRKLLSRGIDPVTHRPINDSASNITISFEAAAAAARDDKAAVFRREDHPHQPKAVTVAQEQQAAADWGHGKPLKCPDLNLDLCISLPSQEEPMMMKPVKRETGVCFSCSLGLPKSTDCKCSSFLGLRTAMLDFRSLEMK

SEQ ID NO: 1069 - protein, 260 aa, Oryza sativa japonica
  G3505  Orthologous to G664
MGRSPCCEKAHTNKGAWTKEEDQRLIAYIRAHGEGCWRSLPKAAGLLRCGKSCRLRWMNYLRPDLKRGNFTDDEDELIIRLHSLLGNKWSLIAGQLPGRTDNEIKNYWNTHIKRKLLARGIDPQTHRPLLSGGDGIAASNKAAPPPPHPISVPAKAAAAAIFAVAKPPPPPRPVDSSDDGCRSSSGTTSTGEPRCPDLNLELSVGPTPSSPPAETPTSARPVCLCYHLGFRGGEACSCQADSKGPHEFRYFRPLEQGQYI

SEQ ID NO: 1070 - protein, 266 aa, Oryza sativa japonica
  G3507  Orthologous to G664
MGRSPCCEKAHTNKGAWTKEEDQRLIAHINQHGEGCWRSLPKAAGLLRCGKSCRLRWINYLRPDLKRGNFTDEEDELIIKLHELLGNKWSLIAGRLPGRTDNEIKNYWNTHIKRKLLARGLDPLTHRPLNAAAAVAGHHHLAAGGSSCSPDATSGHSSCSDGDEYRGGIDLNLSISPPSSSSQPSSPPPPPHEAEARRAGATASYTYHHHYSETREKICLCLNHLGLHGGDECSCGGSSASSSSSPPPATASSRAFTFANASSSTV

SEQ ID NO: 1071 - protein, 295 aa, Oryza sativa japonica
  G3508  Orthologous to G664
MGRSPCCEKAHTNKGAWTKEEDQRLIAYIKANGEGCWRSLPKAAGLLRCGKSCRLRWINYLRPDLKRGNFTEEEDEFIIKLHELLGNKWSLIAGRLPGRTDNEIKNYWNTHIKRKLLARGVDPQTHRPLNAAADHHQQQQLQAPRRFAAAPAGHHHHHPDHFAVLSNSPEACSHSSDDEPSSATPPPPPRHLGIDLNLSISLAPYQPQDQTSEPMKQEEDDEASATANGAGNAAMTTTATTAAVCLCLNRLGLHGGEVCSCGRGGAPSMQASTHMFRFITPLGGSHHNSSSTTMT

SEQ ID NO: 1072 - protein, 273 aa, Lycopersicon esculentum
  G3509  Orthologous to G664
MGRSPCCEKAHTNKGAWTKEEDERLISYIRAHGEGCWRSLPKAAGLLRCGKSCRLRWINYLRPDLKRGNFTEEEDELIIKLHSLLGNKWSLIAGRLPGRTDNEIKNYWNTHIRRKLLSRGIDPTTHRSINDPTTIPKVTTITFAAAHENIKDIDQQDEMINIKAEFVETSKESDNNEIIQEKSSSCLPDLNLELRISPPHHQQLDHHRHHQRSSSLCFTCSLGIQNSKDCSCGSESNGNGWSNNMVSMNIMAGYDFLGLKTNGLLDYRTLETK

SEQ ID NO: 1073 - protein, 267 aa, Hordeum vulgare subsp. vulgare
  Orthologous to G664
MGRSPCCEKAHTNKGAWTKEEDDRLTAYIKAHGEGCWRSLPKAAGLLRCGKSCRLRWINYLRPDLKRGNFSHEEDELIIKLHSLLGNKWSLIAGRLPGRTDNEIKNYWNTHIRRKLTSRGIDPVTHRAINSDHAASNITISFESAQRDDKGAVFRRDAEPAKAAAAAAAISHHVDHHHRSNPQLDWGQGKPLKCPDLNLDLCISPPIHEDPMVDTKPVVKREAGVGVGVVGLCFSCSMGLPRSSDCKCSSFMGLRTAMLDFRSIEMK

SEQ ID NO: 1074 - DNA, 1531 bp, Oryza sativa
  Predicted polypeptide sequence is orthologous to G680
cactctcagaaagattttcttgatttggatcaggagtattgccgttctactgtaggccagtacgatgctgcaagcctggcagctgcatggattgcagggtttgacaacaatgtggagacaagcatgctggagaaggtggatgacatattggcaaaagatctgtaggcatcttggttgcagtggcattgcatcattggtgcaaaggctgcatagttgtgaggaaagggctgtgctgcggcattgccgtcgaattttggatccacaggaagtgttggatggatgcattgattcatagttccgctggctcctcccatttgatcacttgtttgatcaggatggcttccttcagttccagtggcttgaaagccagtaaccccatttctgtccatttggtagtgtgaagcttttgcagcagaccaatccacatatgttgtctccacagagtttgattttggcttaaattgttggcttgaggtatccaaacagttttcatgagaatgatcaggcttcgagctgatgtgtatcccattgagcctttccatttcttgatcattgatatcttttgcatccttccctgcaccattggaaatagaatccctttccaagatgaccacatctttgacttctgttttagtcggttccagccccctggatgcaccatgatttgaagagcttttgttaactgaagaaaatgatgccgatgggacttctcgaaagagattaagaacttcggagcaacttcctttttcagatatctcctttctttgaagtttctcccttcctggaagtttctcaagagctgcatcacctgccatttgtgcagtgctattgttcgtcatatttgatattgttgccttatcattttgaacttccctggtggatgtctcagagctgagacaactttttcgaggatatggactgttaggttttctttttggtcgtggtggaggtatgtcgatgtcatgagcttgtcctggagaagtgccattgttgatagcttccttttccaacttggtgaagaacttttgagcatgacttctgatctgcacagctgtctttgtcccaacatgctcttctatgcgctgccaggctctcccatacagtttcaaggcttcaaggaacctgttgtgctctgcctcagtccaacgctccctctgctttgtgattgtgtatggcttcctcacctttaccaccgcttcctcaccagaggaattaatctccattcccaattcaagaaaaagaagaaatataacagaagtgttggcaattggtcgctttgtcagttagagttgaggtcttccacaaacaaaagcactcctccttccatatctccaaccaaacgctggacctgacacaagtagtacctcatacctcctcctagacctctacttcacccgcgccccgtgctcccgctctactaaatcctcagctgcagttggtctgtgcacacaaaaaccaagtcagcagagttcacccttgctcctttcgttatcttcaactctagaatcagattaaaactcgcagttctcaa

SEQ ID NO: 1075 - DNA, 1310 bp, Zea mays
  Predicted polypeptide sequence is orthologous to G680
cctgccgggcttctattcgtcttcctcctcttccacccatcctgcctgctcacttccgttccgtagtccagctagatccccgggcaaccgatccaccgagaagcttgtggttgtggcggcggcggagagggaagcggggagcgggaggtcggaggtaggcgcggatgccactgttgtgccggcgccggcggggccggtgatgcccgcttgagctgggcctccgtgcgtcggaggtggacgagggagcgaggcggcgccagaccgaggttgcgtcgggctcgatttctactgggctgctgtctgctgagagtaacagaaattggatcaattcaagtagaggtctaggaggagatatgaggtactacttgcgtcaggtccagcgtttggttggagatatggaaggaggagctctcttgtttatagacgacctcaactccaagtgacaaagcgaacagctgttgaacgtttcccttctatttctgtttctttttgccggatttggagatggagatgaattcctctggcgaggaaactgtggtaaaggtaagaaagccgtacacaataacgaagcagcgggtagcggtggactgaggctgaacacaaacggttccttgaagccttgaaactttatggttgagcatggcagcgcatagaagagcatgttgggacaaagacagccgtgcagatcagaagtcacgctcaaaagttcttcactaagttgacctcaacaagaatgccacaagcattgatcatgatgacctcgacacaatggatgagcccagggcttcctttcccaatgaattgtcgcacctgaagctgaaatcgcgccgtacaggcttcaaaccatacaagagatgttctgtggaagcgaaggaaaaccgggtgccgactagcgacatggttggtaccaagaggattcgtcttgatagcgaagcatccccataattgatttcttcaaagttatatttacatctaagctactatagggcttcagatcctgcaatgcagtgcttccttaaaactcaatctgttgtgtgctgtattttaatgcttgtcaagcaggcccctaggctgctttaaaaccttatctcgtagactttgatttaagcatcatgcaactatcaaacttttttttggtcaaaaaaaaaaaaaaaaactcgagggccatcgatgagcgctgtcctcaagatgctggaggaggagatcttgtccccctgcatgagcgagctgtgctacgagcagcacctggagctctgagctgaggaggaagatggtgctggctgcgtgcgtgaagcgtcatggatgagact

SEQ ID NO: 1076 - DNA, 882 bp, Glycine max
  G3450  Predicted polypeptide sequence is orthologous to G226, G682
  misc_feature (430)..(430): n is a, c, g, or t
  misc_feature (871)..(871): n is a, c, g, or t
tctgcacccctccctccttgtttgtatcatatcaggcagctcagaaggcaaagatagatccatgtccaccaccgcaactacaacctctgaagaagttagcagcaatgagtggaaagtcatacacatgagcgagcaagaggaggatctcattcgcaggatgtacaagctagtcggggacaagtggaatttgatagctggtcgcattcccggtcgtaaagcagaagaaatagagagattctggattatgagacacggcgatgctttttctgttaaaagaaacggaagtaaaacccaagactcgtgattttctctggtcatgtatcttttctgggcataattctgctaaatatataaaattgggttaaatatatttttggtgtctataaaatttctttttttttttggtctctgtgaattattttgtatattnttagtctcttgtctgcacccctccctccttgtttgtatcatatcaggcagctcagaaggcaaagatagatccatgtccaccaccgcaactacaacctctgaagaagttagcagcaatgagtggaaagtcatacacatgagcgagcaagaggaggatctcattcgcaggatgtacaagctagtcggggacaagtggaatttgatagctggtcgcattcccggtcgtaaagcagaagaaatagagagattctggattatgagacacggcgatgctttttctgttaaaagaaacggaagtaaaacccaagactcgtgattttctctggtcatgtatcttttctgggcataattctgctaaatatataaaattgggttaaatatatttttggtgtctataaaatttctttttttttttggtctctgtgaattattttgtatattnttagtctcttg

SEQ ID NO: 1077 - DNA, 574 bp, Hordeum vulgare subsp. vulgare
  Predicted polypeptide sequence is orthologous to G682
cagctcatactgtaaccccccacccacaaccgtcgctacactcacaagctaacctgaccatttgagcaagcatatgagcagcaaaagcttgggcaagaactccaagatcatgagtggccgtgaaagaaaagaagttaatagcaacgcaaagcattttgttgatttcacggaggcagaggaagatcttgttttcagaatgcacagacttgtcgggaacaggtgggaacttatagctggaagaatccccggaagaacagcagaagaagtagagatgttctgggcaaaaaagcaccaggaccaatgaaagggaaagcaggatgcatccagtaaaactagattgacatatagggtgctttttcctgtccatcaaaaacctgtgttgatcttactcgtcctatcttctcacccatgctaaaagctgttaggaataagcaacttgtattcccatgaggccataggccgatatatatacatgtacaggtgatgggctatatgcaggaaaacaccttatatattgggataaatacaaaagggtacatgacttatattataaaaaaaaaaaaaaaaaaaaaaa

SEQ ID NO: 1078 - DNA, 356 bp, Populus tremula x Populus tremuloides
  Predicted polypeptide sequence is orthologous to G682
tctttcaacttaattatggctgacttggatcactcctctagtgatgacaactctgttgattctagagaggaaaccagccaagattccaagcttgaattctcagaagatgaggaaactcttatcaccaggatgtacaatctggttggtgagaggtggccattaattgctgggaggattccaggaagaacagcagaagaaattgagaagtactggacttcaagatctctacgagtcagtaaatcagggttgtccaagatgattgccctatctgatgtactagagtagcaaaattttgggtggtttgtagcgtcttctaagacctgcaatatgggtgggttgggtgtgacaagatattg

SEQ ID NO: 1079 - DNA, 819 bp, Triticum aestivum
  Predicted polypeptide sequence is orthologous to G682
  misc_feature (389)..(389): n is a, c, g, or t
  misc_feature (416)..(416): n is a, c, g, or t
  misc_feature (515)..(515): n is a, c, g, or t
  misc_feature (524)..(524): n is a, c, g, or t
  misc_feature (541)..(541): n is a, c, g, or t
  misc_feature (559)..(559): n is a, c, g, or t
  misc_feature (570)..(570): n is a, c, g, or t
  misc_feature (580)..(580): n is a, c, g, or t
  misc_feature (585)..(585): n is a, c, g, or t
  misc_feature (613)..(613): n is a, c, g, or t
  misc_feature (621)..(621): n is a, c, g, or t
  misc_feature (629)..(629): n is a, c, g, or t
  misc_feature (666)..(666): n is a, c, g, or t
  misc_feature (685)..(685): n is a, c, g, or t
  misc_feature (694)..(694): n is a, c, g, or t
  misc_feature (701)..(701): n is a, c, g, or t
  misc_feature (703)..(703): n is a, c, g, or t
  misc_feature (712)..(712): n is a, c, g, or t
  misc_feature (726)..(726): n is a, c, g, or t
  misc_feature (743)..(745): n is a, c, g, or t
  misc_feature (752)..(753): n is a, c, g, or t
  misc_feature (758)..(759): n is a, c, g, or t
  misc_feature (768)..(768): n is a, c, g, or t
  misc_feature (772)..(772): n is a, c, g, or t
  misc_feature (785)..(787): n is a, c, g, or t
  misc_feature (792)..(792): n is a, c, g, or t
  misc_feature (794)..(794): n is a, c, g, or t
  misc_feature (801)..(801): n is a, c, g, or t
  misc_feature (806)..(806): n is a, c, g, or t
  misc_feature (811)..(811): n is a, c, g, or t
  misc_feature (813)..(813): n is a, c, g, or t
  misc_feature (815)..(816): n is a, c, g, or t
  misc_feature (818)..(818): n is a, c, g, or t
ggaagaaataaggtgcagcgcctcatagtgtacccccaccaccaccaacgctacactcacaagctaacctcaccatttcaggaagcatatgagcagcgaaagcttgggcaagaactccaagatcatgggtggccgtgaaagaaaagaagttaatagcaccgcaaagcattttgttgatttcacagaagcagaggaagatcttgttttcagaatgcacaggcttgtcgggaacaggtgggaacttatagctggaagaatccccggaagaacagcagaagaagtagagatgttctgggcaaaaaggcaccaggaccaatgaaaatgaaaacaggatgcatgcagtaaaactagattgacatataggatgcacatgtccatcaaaaacctgnggtggatctactcgtctatcttctagncatgctaaaagcaacttggttctgtccaacatgggatgtacataagaaacctcaagaaaaaggaggaacatgtgctaaataacaaaaatatgaattcgntttgtccangattattctacatttcnactaatacatacatgttnaatggcccagngctattaagncccanattgccaaaaagagacctgggtgattcntaactttngttttggnggggactaatccaatgtaatcctaacatgcttaaganaattccactgcagaacatnggggatgcntctgggnanaagattttnttggcaaataaaanatgctgtgtctggaaannnaccgctnnagganngctttaaanttcnggaaagttcgttnnnaaatnangtaaaanctccngtccnangnncnt

SEQ ID NO: 1080 - DNA, 506 bp, Gossypium arboreum
  Predicted polypeptide sequence is orthologous to G682
ggaatccagtgaagattccaagcttgacttctcagaagatgaggaaaccctcattattagaatgttcaatttggttggagaaaggtggtctttgatagcagggagaatccctggaagaacagctgaggagattcagaagtattgggcttctagattctcttacaataatccaatgcccaatctgagttaggattacatccaagtgtttgggttttgcattgggtgattgtttcagttttggtttgcagcgtatatatatatataaaagcaaatgcctgggttttgtacaatgcctcatggttgctatttgctttagtatgataattccgaggttgatttctctttttctttttgaaattatcttcacttttggtgttaatattatgaatttcttgattgctttgcctagttcactggatcaccacagttaccattggacttattttgagaattcttaaatggattaatatatacttttccctaaaaaaaaaaaaaaaaaaaaaaaa

SEQ ID NO: 1081 - protein, 83 aa, Oryza sativa
  Orthologous to G682
MDSSSGSQGKNSKTSDGCETKEVNNTAQNFVHFTEEEEDLVFRMHRLVGNRWELIAGRIPGRTAKEQYTEGEIWCLETFPRRM

SEQ ID NO: 1082 - protein, 79 aa, Oryza sativa
  G3392  Orthologous to G226, G682
MESSGGSQLGKNSKTSDGRETKEVNSTAQNFVHFTEEEEDIVFRMHRLVGNRWELIAGRIPGRTAEEVEKFWAIKHQAT

SEQ ID NO: 1083 - protein, 73 aa, Glycine max
  G3445  Orthologous to G226, G682
MTDIDRSSDNVSSDSIEKSSQVSDVEFSEAEEILIAMVYNLVGERWSLIAGRIPGRTAEEIEKYWTSRFSTSQ

SEQ ID NO: 1084 - protein, 80 aa, Glycine max
  G3450  Orthologous to G226, G682
MSTTATTTSEEVSSNEWKVIHMSEQEEDLIRRMYKLVGDKWNLIAGRIPGRKAEEIERFWIMRHGDAFSVKRNGSKTQDS

SEQ ID NO: 1085 - protein, 74 aa, Glycine max
  Orthologous to G682
MADIDRSFDNNVSAVSTEKSSQVSDVEFSEAEEILIAMVYNLAGERWSLIAGRIPGRTAEEIEKYWTSRFSTSQ

SEQ ID NO: 1086 - protein, 74 aa, Glycine max
  G3446  Orthologous to G226, G682
MADIDRSFDNNVSAVSTEKSSQVSDVEFSEAEEILIAMVYNLVGERWSLIAGRIPGRTAEEIEKYWTSRFSTSQ

SEQ ID NO: 1087 - protein, 75 aa, Glycine max
  G3448  Orthologous to G226, G682
MADSDLSSSQISTHSTDSGNRGSSKVEFSEDEETLIIRMYKLVGERWSIIAGRIPGRTAEEIEKYWTSRFSGSSE

SEQ ID NO: 1088 - protein, 75 aa, Glycine max
  G3449  Orthologous to G226, G682
MADSDRSSSEVSTHSTDSGKRGSSKVEFSEDEETLIIRMYKLVGERWSLIAGRIPGRTAEEIEKYWTSRFSGSSE

SEQ ID NO: 1089 - protein, 78 aa, Zea mays
  G3431  Orthologous to G226, G682
MDSSSGSQDKKFRDNDRPEAKEANSTAQHLVDFTEAEEDLVSRMHRLVGNRWEIIAGRIPGRTAEEVEMFWSKKYQER

SEQ ID NO: 1090 - protein, 67 aa, Zea mays
  Orthologous to G682
MQLYPFTIIAEANSTAQHLVDFTEAEEDLVSRMHRLVGNRWEIIAGRIPGRTAEEVEMFWSKKYQER

SEQ ID NO: 1091 - DNA, 1063 bp, Glycine max
  Predicted polypeptide sequence is orthologous to G715, G1646
cccacgcgtccgatcgggtctcccacacacactctttctctctctctctttcccggatcatcaaaatcagaaaaaattgggggaatggagaccaacaaccagcaacaacaacaacaaggagctcaagcccaatcgggaccctaccccgtcgccggcgccggcggcagtgcaggtgcaggtgcaggcgctcctccccctttccagcaccttctccagcagcagcagcagcagctccagatgttctggtcttaccagcgtcaagaaatcgagcacgtgaacgactttaagaatcaccagctccctcttgcccgcatcaagaagatcatgaaggccgacgaggatgtccgcatgatctccgccgaggcccccatcctcttcgccaaggcctgcgagctcttcatcctcgagctcaccatccgctcctggctccacgccgaggagaacaagcgccgcaccctccagaagaacgacatcgccgccgccatcacccgcaccgacattttcgacttcctcgttgatattgtcccccgcgacgagatcaaggacgacgctgctcttgtgggggccaccgccagtggggtgccttactactacccgcccattggacagcctgccgggatgatgattggccgccccgccgtcgatcccgccaccggggtttatgtccagccgccctcccaggcatggcagtccgtctggcagtccgctgccgaggacgcttcctatggcaccggcggggccggtgcccagcggagccttgatggccagagttgagtgacatcgatgccgatgatggacagtcaggagttatgaagattctgaacttgctgcaatttagaaatggttttgtttactaaatttttatgggatgacactgtgaacctgttaactcgatgaacagcatgatttaactacttttgtacaaaaatttaaaactaaacactgatccttctgtgtgaaacatgtatgatcatctgccaatactgtttatttcctcataagtcaaaaaaaaaaaaaaaaaaaaaaaaaaaaaaaaaaaaaaaaaaaaaaaaaaaaaaaaaaa

SEQ ID NO: 1092 - DNA, 1008 bp, Glycine max
  Predicted polypeptide sequence is orthologous to G715, G1646
cccacgcgtccgcttaaatttcccaatcaattccatccatcgggtctttactctcttacccagcccacacacactctttctctctctctctttccctgatcatcaaaatcagaaaaaattgggggaatggagaccaacaaccagcaacaacaacaacaaggagctcaagcccaatcgggaccctaccccgtcgccggcgccggcggcagtgcaggtgcaggtgcaggcgctcctccccctttccagcaccttctccagcagcagcagcagcagctccagatgttctggtcttaccagcgtcaagaaatcgagcacgtgaacgactttaagaatcaccagctccctcttgcccgcatcaagaagatcatgaaggccgacgaggatgtccgcatgatctccgccgaggcccccatcctcttcgcggctcgaggcgagctcttcatcctcgagctcaccatccgctcctggctccacgccgacgagaacaagcgccgcaccctccagaagaacgacatcgccgccgccatcactcgcaccgacattttcgacttcctcgtcgacatcgtcccccgcgacgagatcaaggacgacgccgcgctcgtcggggcaacggccagtggggtgccttactactacccgcccattggccagcctgccgggatgatgattggccgccccgccgtcgatcccgccaccggagtttatgtccagccgccctcccaggcctggcagtccgtctggcagtccgccgccgaggacacgccctacggcaccggtgcccaggggaaccttgatggccagagctgagcgacaaccatgccgaaacggactgtcaggagttatgaagattctgaacttgcttggaattttgattgcttgcaatttggaaatggttttgttaactaaatttttatgggatgacactatgaacctgttaactcgatgaacagcatgatttaactacttctgtacaaaaatttaaaactaaaccagtgatccttctgtgtg

SEQ ID NO: 1093 - DNA, 615 bp, Glycine max
  Predicted polypeptide sequence is orthologous to G715, G1646
aattaagaattcataatctccaattattttattagagttccaattagacggctaaagcaggcttggccggccatgttattggagtgaaactatgaaagcttcaaaggaaatggcatatataacactcaaacttgacactgatgctacaactaagagactactaaagctgaagttaactcagaaacacataggagtgaagtagagagcaaatatgagacaagctggtgcatattcagggttactgtgtggtggggtatcgggaaggacagggccccactcactgcccttggcaaggatcaagaagatcatgaagaattctggggagggtgttaagatgatatcaggtgaggctccaattattttctccaaggcttgtgacctcttcattgaggaacttactagaaggtcctggatcatggccatccaaggcaaaaggaggactttgcacaaagaggacttggcttctgctgttatagccactgatatatttgatttcttgatcactttggtttccagttctgacagccatgcagttggtggtgccacaaatgtcatggggaggtggaaactattagattactctttaagccaccttacactacatactgcagctac

SEQ ID NO: 1094 - DNA, 1394 bp, Oryza sativa
  Predicted polypeptide sequence is orthologous to G715, G1646
ccggccgggagcttaattgcagcacgagggcaggaaccccagttgagagtggagatggccattttgttcaggcactaggcagtgggtaggacggtgaggagtgtgtcctgcactcctgcttcccctgacgatcgatccccatgcgtgccgaagcatctgatacttttgctgtgctgttctttaatttaccctgtacttttggatatctgaagcagtagagctcgttcactcaaacaggctagcctgttttgctttctgacacagcacacacagctacaaatcgactgtaattaaggtacgtatatataggtgacaatggacaaccagcagctaccctacgccggtcagccggcggccgcaggcgccggagccccggtgccgggcgtgcctggcgcgggcgggccgccggcggtgccgcaccaccacctgctccagcagcagcaggcgcagctgcaggcgttctgggcgtaccagcggcaggaggcggagcgcgcgtcggcgtcggacttcaagaaccaccagctgccgctggcgcggatcaagaagatcatgaaggcggacgaggacgtgcgcatgatctcggcggaggcgcccgtgctgttcgccaaggcgtgcgagctcttcatcctggagctcaccatccgctcgtggctgcacgccgaggagaacaagcgccgcaccctgcagcgcaacgacgtcgccgccgcacatcgcgcgcaccgacgtgttcgacttcctcgtcgacatcgtgccgcgggaggaggccaaggaggagcccggcagcgcgctcgggttcgcggcgggagggcccgccggcgccgttggagcggccggccccgccgcggggctgccgtactactacccgccgatggggcagccggcgccgatgatgccggcgtggcatgttccggcggcgcgcccggcgtggcagcaaggagcagcgccggatgtggaccagggcgccgccggcagcttcagcggggaagggcagcaaggttttgcaggccatggcggtgcggcagctggcttccctcctgcacctccaagctccgaatagtgatgatccatatggttccatgcatgcatcgctgaggtgctagctagctactatagctgctcaaatcaaatgctcaatgtgtcggtaattaattaatgtggtacgtattaacttaaccgatgtacgtaatggacgctcaagctaattaagggatgtacaatttactaattaatttaatttgtaatatatagccgattaactagcaaggtgacccagtactatttgtaatttcttttcccgttatgctactaattgtggacgcacaaaccattaccggaacagaaattactactgatgaattactatatataataagcttatataaaaaaaaaaaaaa

SEQ ID NO: 1095 - DNA, 819 bp, Oryza sativa
  Predicted polypeptide sequence is orthologous to G715, G1646
ccggccgggaaaaaaaatcaatcatcctatagttgctcccctatttcagcatctcaatttaagaaaggtgtgaaggcatgccgatcccggaaaaggacggggtggaggacaatcaagaggatgatacattttcaaggttgcaattgcttgcacaacaacgacatgccatggagaagttctggaggatgagccaggaacagatcgaagaatccgcaggcaacgaagagcttatactgccgatttcccgtgtcaagaatatcatccatgcaaaggagggtggtatgatgttatctgctgataccccagcttttgtaacaaaactttgtgaacttttcgtccaggagctcatccttcgtgcttgggtgtgcgccaactcacacaatcgtgaaatcatacttggcacagatattgctgaggcaatcaccaccacagaatcctatcactttcttgctaatgtagtccatggccaccaggcgctaggaagcaacataccagagataggggtttctgcttggaagcgccataagctagatgaaatgacctcactctgccatcctccccaagcagtgcaggtcacagatttagctaaccatccacccaatattcctgtttgtcctcctataggtcaatcgggtactcagcacacaacatctacacatgttttgatgatgcaaggagaatctattcacaaggcaagtaaagaaaaatccccactgaaggaagtgatggtgccgacccaacaaggtgggcatgaccaacagctcttatgcagttcctaatgttggtggtgctactagtagtaaagctgttattgatagc

SEQ ID NO: 1096 - DNA, 673 bp, Zea mays
  Predicted polypeptide sequence is orthologous to G715, G1646
attgggtacctcgaggccggccgggagccgccagcgatcccaacccccgactcctccggcagcccgcaacgactcgcgccgcctccggtcgcgccgggtccagggtcaggacacttattgattttgaacaaagatctagcatggaaccatcctcacagcctcaaccagtgatgggtgttgggtcacaaccttatcctgctgctgctctctatgtgccactacctggagctcttgctgttcctcctggctcacagccagcagcagcattccccaatccaactcaactcagtgctcagcaccagatggtgtaccagcaggctcagcaatttcatcaacaacttcagcaacagcaggaacaacagctcagggagttctggactacccagatggatgagatcaagcaagcaaatgacttcaagatccacaccttgccacttgcaaggataaagaagataatgaaggctgatgaggatgtgcggatgatctctgcagaagctcctgttgtgtttgcgaaggcatgcgaggtattcatattagagctgacattgaggtcatggatgcacacagaggagaacaagcgccggaccttgcagaaagacgacattgcagctgccatcacccagactgatatatatgacttcctggtggacataatcccgagggatgaaatgaa

SEQ ID NO: 1097 - DNA, 1111 bp, Zea mays
  Predicted polypeptide sequence is orthologous to G715, G1646
tttttttttttttttttttttttttttgaagagcagtaattggacaataattaccagacaaccacataatacttgtcgcattacagcatcagataagtgaggcctaggcatacactaccagcccaaacaaaggcgccccccagttacaacaaccttaccaggattctaccatcaaacaactcaattcttaatcttgagggagccccgtaaatgaccaagttttattacgcggcaacagcagcagcaactaaacagacacaaataacacatatgctattacgcggtaacagcagcagcaactaaacagacacaaataacacaactgccccggaacaataaggcaatgatgatacattattgctcaggcacatagacggaacaataacgtgatgatgatacattactgctgaggcacgtagtagtaggcgagagggtcggtggctggtactccggcggcggggcgcgggatcccggcagccgcggcagctgcggcggccgccgcatcagcgtctttaccgtcgtcgcgcggaacgatgtccacaaggaagtcgaatacctcggtgcgggcgatggcagcggcaatgtcggatttctggagcgtgcggcgcttgttctcttcggcgtgcgcccagccgcgatgggtgagctcgaggatgaacatctcgcaggcccgggcgaacaccacgggagcctcggcggcgatcatgcggacgtcctcgtcggctttcatgatcttcttgatgcgggcgagcgggaggttgtgattcttgaagtcggtagtggcctcgatctcgcggtactgctccgcccagaatatctgcagctgctgctgctgcgcggccgccgcctgctgggccgcggcagcagccggcggtgcgtagagctgcggcgggtaggcgccggcgccggcggccacaccgggagggtacgcaggcggagggtaggcaacgggggcacccatgactggaggcggcggcggggtgctggatttgttaggatccatggattcgggggcagctagggttgtgagacgagggggattcggcccgcccgccggctcgggggcccgtcttttaccggtatgaaacccggcccggccggcctcgaggta

SEQ ID NO: 1098 - DNA, 900 bp, Zea mays
  Predicted polypeptide sequence is orthologous to G715, G1646
  misc_feature (8)..(8): n is a, c, g, or t
  misc_feature (864)..(864): n is a, c, g, or t
  misc_feature (868)..(868): n is a, c, g, or t
gtaccctncgagggccccgccgccggccgggagcgatccaatccccgactcctccggcagcccgcaacgactcgcgccgcctccggtcgcgccgggtccaggtaaagcggcttccatctcctcggtctcagcgcgtcatcccctcctccttcctcttccgtttcccttagggttggagtagacacgtcggctcaaggatccttcgagggactgactggttgtgcaaatacctacttttaaattattgaaagtgggagcatgaaagggtcaggacacttattgattttgaacaaagatctagcatggaaccatcctcacagcctcaaccaatgatgggtgttgggtcacaaccttatcctgctgctgctccctatgtgccagtacctggatctcttgctgttcctcctggctcacagccagcagcagcattccccaatccaactcaactcagtgctcagcaccagatggtgtaccagcaggctcagcaattttatcaacaacttcagcaacagcaggaacaacagctcagggagttctggactacccagatggatgagatcaagcaagcaaatgacttcaagatccacaccttgccacttgcaaggataaagaagataatgaaggctgatgaggatgtgcggatgatctctgcagaagctcctgttgtgtttgcgaaggcatgcgaggtattcatattagagctgacattgaggtcatggatgcacacagaggagaacaagcgccggaccttgcagaggaacgacattgcagctgccatcaccaggactgatatatatgacttcctggtggacataatcccgagggatgaaatgaaagagggagggctcggactaatcccatagntggnctgccgcctgctatgggggctccagctgatca

SEQ ID NO: 1099 - DNA, 775 bp, Zea mays
  Predicted polypeptide sequence is orthologous to G715, G1646
aaaaaaagaagcttgccatttcgctcagggccctgcaacgcgcggcagctagcgggagagagtcttgggactgggccgcccggccgcgaggaataaactcactcctgccttcatacgtatccaatatccatagccgcggcagtacgtgtatgtggttagctatacgcgacctcagctcgggcgcaagctacaacgccgaccaggcgagaagaagcatcgatagtgtgacgagctaacccacccagcagcaacgtaatccaaatccatggacaaccagccgctgccctactccacaggccagccccctgcccccggaggagccccggtggcgggcatgcctggcgcggccggcctcccacccgtgccgcaccaccacctgctccagcagcagcaggcccagctgcaggcgttctgggcgtaccagcgccaggaggcggagcgcgcgtccgcgtcggacttcaagaaccaccagctgcctctggcccggatcaagaagatcatgaaggccgacgaggacgtgcgcatgatctccgccgaggcgcccgtgctgttcgccaaggcctgcgagctcttcatcctcgagctcactatacgctcctggctccacgccgaggagaacaagcgccgcaccctgcagcgcaacgacgtcgccgcggccatcgcgcgcaccgacgtcttcgatttcctcgtcgacatcgtgccccgcgaggaggccaaggaggagcccggcagcgccctcggcttcgcggcgcccgggaccggcgtcgtcggggct

SEQ ID NO: 1100 - DNA, 865 bp, Zea mays
  Predicted polypeptide sequence is orthologous to G715, G1646
ccctgaccgccgtaacaccctaggcaatggagcccaaatccaccacccctcccccgccccccgtgatgggcgcgcccatcgcgtatcctcccccgcccggcgccgcgtaccccgccgggccgtacgtgcacgcgccggcggccgcgctctaccctcctcctcccctgccgccggcgcccccctcctcgcagcagggcgccgcggcggcgcaccagcagcagctattctgggcggagcaataccgcgagatcgaggccaccaccgacttcaagaaccacaacctgccgctcgcccgcatcaagaagatcatgaaggccgacgaggacgtgcgcatgatcgccgccgaggcgcccgtcgtcttctcccgcgcctgcgagatgttcatcctcgagctcacccaccgcggctgggcacacgccgaggagaacaagcgccgcacgctgcagaagtccgacatcgccgccgccgtcgcgcgcaccgaggtcttcgacttcctcgtcgacatcgtgccgcgggacgaggccaaggacgccgactccgccgccatgggagcagccgggatcccgcaccccgccgccggcctgcccgccgccgatcccatgggctactactacgtccagccgccgcagtaacgaatttgcttccttatcatggcttcgcttccatgcagcctttgcgggttttagtaaactattattattactgagagtgccctgttgttacccatgctctgttgttgccacccaataactcgatgacctgatgatcatctgatgtgccccccgttccgtaacaagtgattccatttctgatttcagagaaaaaaaaaaaaaaaaaaaaaaaaaaaaaaaaaaaaaaaaaaaaa

SEQ ID NO: 1101 - DNA, 1205 bp, Zea mays
  Predicted polypeptide sequence is orthologous to G715, G1646
cccacgcgtccgggcttggcttgggactgggccgcccggccgcgaggaataaactcactcctgccttcatacgtatccaatatccatagccgcggcagtacgtgtatgtggttagctatacgcgacctcagctcgggcgcaagcctacaacgccgaccaggcgagaagaagcatcgatagtgtgacgagctaacccaccagcagcaacgtaatccaaatccatggacaaccagccgctgccctactccacaggccagccccctgcccccggaggagccccggtggcgggcatgcctggcgcggccggcctcccacccgtgccgcaccaccacctgctccagcagcagcaggcccagctgcaggcgttctgggcgtaccagcgccaggaggcggagcgcgcgtccgcgtcggacttcaagaaccaccagttgcctctggcccggatcaagaagatcatgaaggccgacgaggacgtgcgcatgatctccgccgaggcgcccgtgctgttcgccaaggcctgcgagctcttcatcctcgagctcactatccgctcctggctccacgccgaggagaacaagcgccgcaccctgcagcgcaacgacgtcgccgcggccatcgcgcgcaccgacgtcttcgatttcctcgtagacatcgtgccccgcgaggaggccaaggaggagcccggcagcgccctcggcttcgcggcgcctgggaccggcgtcgtcggggctggcgccccgggcggggcgccagccgccgggatgccctactactatccgccgatggggcagccggcgccgatgatgccggcctggcatgttccggcctgggacccggcctggcagcaaggggcagcggatgtcgatcagagcggcagcttcagcgaggaaggacaagggtttggagcaggccatggcggcgccgctagcttccctcctgcgcctccgacctccgagtgatcgatcggcgcgtctcttggtcctggcctcctggcttagctacatgtgcatgatgtcaatcgttcaatgtgccatgctgtgtatattctacagcaaacgtggtaatggagctgctatgcatatacagaacgaataaggcgtgacgtgtgagaccgtaagagtacgtagtactaatatgtagatgcacgtgacgtgcctattaatcaaaccattaactatgctagttaattaaattagatcctctct

SEQ ID NO: 1102 - DNA, 775 bp, Zea mays; identical to SEQ ID NO: 1099
  Predicted polypeptide sequence is orthologous to G715, G1646

SEQ ID NO: 1103 - DNA, 865 bp, Zea mays; identical to SEQ ID NO: 1100
  Predicted polypeptide sequence is orthologous to G715, G1646

SEQ ID NO: 1104 - DNA, 1205 bp, Zea mays; identical to SEQ ID NO: 1101
  Predicted polypeptide sequence is orthologous to G715, G1646

SEQ ID NO: 1105 - protein, 442 aa, Oryza sativa
  Orthologous to G715, G1646
MEQTLDVPRSLRLLAPKAQQQMDEFWRDRQKEIETTKDFSEHAIPMARLKKIVSSQKGNMMMTFDMPAFLSKMCELFVQELAVRAWASAQSHNRCIILDTDIAKAIASTESYDFLVDILHNHRVKHKSTPCSTLTTKRCRLVDQPSTSHMPYQHQLPQFAPTYTPAIPITPSLMPPISHYIPFQYPSLSQEVSPMMASAPIVNRSMLLIHNIARGLGLQGNNISTFANNNIPDNIVGCSSPTVLASMMSPALLEVAGTSLNPPNSHSICTMNMINSSDPSGSSIGDINVANQASLAPSGRFNPAILRESSCPSFLHSNNDTIVAIPEGVDISGTMDVASDVAAIVINGQEEHERETNVEHHQQNEIYESIDIGIINASVADDNKYSISWDELGMADDSLLDKFLEEFQVRNDGVLRTGIELHEDPFLGDVMLANPSTSNANK

SEQ ID NO: 1106 - protein, 421 aa, Oryza sativa
  Orthologous to G715, G1646
MEQTLDVPRSLRLPTPKAQQQMDEFWRDRQKEIETTKDFSEHAIPMARLKKIASSQKGNMMMSFDMPAFLSKMCELFVQELAVRAWASAQSHNRCIILDTDIAEAIASTESYDFLVDILHNHREKHKSTPCSTLTTKRCRLVDQPSTSRPPYQHQLPLFAPTYTPAIPITPSLMPPISHYIPFQYPSLSQEVSTMMASAPIVNRSMLLIHNIARGLGLQGNNISTFANNNIPDNIIGCSSPAVLASMMSPALLDVAGASLNPPNSHSICTMNMINSSDPSGSSIGDINVANQASLAPSEHFNPAILQESSCPSFLYNNNNDTIVVVPEGVDISGTMDVAGLVINGQEEEHERKTNVEQNEIYESIDIGIINASVADGNKCSIRWDELGTADDSLLDKFLEEFQARNDGVLHSGIVLHEDHS

SEQ ID NO: 1107 - protein, 246 aa, Oryza sativa
  Orthologous to G715, G1646
MDNQQLPYAGQPAAAGAGAPVPGVPGAGGPPAVPHHHLLQQQQAQLQAFWAYQRQEAERASASDFKNHQLPLARIKKIMKADEDVRMISAEAPVLFAKACELFILELTIRSWLHAEENKRRTLQRNDVAAAIARTDVFDFLVDIVPREEAKEEPGSALGFAAGGPAGAVGAAGPAAGLPYYYPPMGQPAPMMPAWHVPAWDPAWQQGAAPDVDQGAAGSFSEEGQQGFAGHGGAAASFPPAPPSSE

SEQ ID NO: 1108 - protein, 205 aa, Oryza sativa
  Orthologous to G715, G1646
MEPKSTTPPPPPPPPVLGAPVPYPPAGAYPPPVGPYAHAPPLYAPPPPAAAAASAAATAASQQAAAAQLQNFWAEQYREIEHTTDFKNHNLPLARIKKIMKADEDVRMIAAEAPVVFARACEMFILELTHRGWAHAEENKRRTLQKSDIAAAIARTEVFDFLVDIVPRDEAKDAEAAAAVAAGIPHPAAGLPATDPMAYYYVQPQ

SEQ ID NO: 1109 - protein, 197 aa, Oryza sativa
  Orthologous to G715, G1646
MDPTKSSTPPPVMGAPVGFPPGAYPPPPPAGAAAAAYAQQLYAPPAAAAAQQAAAAQQQLQMFWAEQYREIEATTDFKNHNLPLARIKKIMKADEDVRMIAAEAPVVFARACEMFILELTHRGWAHAEENKRRTLQKSDIAAAIARTEVFDFLVDIVPRDDAKDADAAAAAAAAGIPRPAAGVPATDPLAYYYVPQQ

SEQ ID NO: 1110 - protein, 444 aa, Oryza sativa
  Orthologous to G715, G1646
MKQTLDVHRSLRPPMPMAQQQMDEFWRDRQKEIEMTKDFSEHMIPMARLKKIVSSQKGNMMMTFDMPAFLSKMCELFVQELAARAWACAQSHNRCIILDMDIAEAVASTESYDFLVDILHNHSVKQKSTPCSSTKRCRLVDQPSTSHIPHQHLLPQFAPTYTLAIPITPSLMPLISQCTPSSFPSLPQEKFPLMAPTPIVNRSMLFINNIARGLGLQGNNINAVANNNILDNIVGCSSPAVLASMMNPALLGPSGAPLNPPNSQSYNCTMDIINSNDACGSNNSSVIVANQANIAPSGHFYPIALQSSCSTFLHSNNNDTITAILEGVDISDIMHVTSDVDAATKVFSGQEEQHEKETNVEWHHQNEIYESIDIRIINATTRDGNKCSISWDELGMADDSLLDNFLEELQVRKDDVSDTRIAFNKDPFLDDAVLSNPSTSNGNK

SEQ ID NO: 1111 - DNA, 950 bp, Glycine max
  Predicted polypeptide sequence is orthologous to G720
aattcggctcgaggtgttttcctgcaaccattttcttccttcgtcggttgattggtgaagttgctggtgaccccagaagaaggggtagtgttggaatattattgttaagctttgaactttgaagtagtggcagaaaggttcattgacccttttttggcagacttacttgtttgtggtccgaaactgctgattgcaactgttcagtggtcacaggaagcaccaccctccaaagccagcacttaaaacctttccttctcttccgtctctcttctttacccttctgttttattaacaatgcaataagaggagaaagaacactcagtttaattagcaatggaattgaagaagcattttcttttatgccaagaaggaattggatgctgataagtggtatcgattgatctgttattttctgtgggagactgagaaacgatgccaagccagctatggttttctctgccaatgatttacaagaatggaaagattttcccaaagggctcaaggttcttctccttgagagagacaacatttctgctgccgagataagggcaaagcttgaagccatggactacaatgtttctacattctgtgaggagaatgaagccttgtcagcaatctcaagtggactcgaaagcttccacattgccatagtggaggtgagttcaagcagtggccagggaggtttcaaatttcttgagaatgccaaggacttgccaaccattatgacttcaaacaatcattgcttgaacaccatgatgaagtgcatagcgcttggtgcagttgagttcctcagaaaaccactatctgaggacaagctcagaaatatctggcagcatgtggttcacaaggcattcaatgccagggcaagcatcctgtctgaatcacttaaacctgtcaaagaatctgtagtgtccatgttgcagctccaaacagacgatgaacaacatgaa

SEQ ID NO: 1112 - DNA, 1174 bp, Glycine max
  Predicted polypeptide sequence is orthologous to G720
cccccttcctttttcggtgagcaattagtctgctcatggcaatcttcatcatccagtaaccctgttccctgcttttatttaggggtttacggaagcggatatttatcccaatcaacagactggttatgggcattaacagttaaccctcgaccatttttttaatccattgaaatccctcctttatctggtccaatgtctgtttggagctgcagcatggattctacagattctccgacaggttttagtgattcagaaagaacattttccccagaattaaatgccttgtgaacaacatgctgccaaatatttttgagcttgtcctcagagagtggtttactgagaaactcaactgcaccaagcgcaatgcacttcatcatggtgttcaggcactggtcctttgaagtcataatggtaggcaagtcctttgaattctcaagaaatttgaaacctccaaggctacagcttgtactcacctccactatagcaacatggaagccttcaggactactcgagagtgctgacaaggcttcattctcatcgtagaaagtggaaacattatagtccacggcctcaagttgttctcttatctcagcagcagaactactatctccctccagcagaagaactctaagtccctttgggaaatctttccattcttgtaaatcattggcagtgcaaaccatagctggtttggcattcttactcggtcccctagttaagtaacagatcaatattgctgatcaacaccgaatccctttctcttctccaaaactgaacacatgaatcaaggtagaatcagcatgcacacggaaagttggttcttttcacaaagccttttttttttattgtttcctagctattaccttggctgaaaagaaaatgccccaccaactactctgcccaaagttgtgttcttttctttctgctcttattccattgaagacaaacaaagcaaatagagtgagggaaggggaagtgagttaggaggtttaactacggtcgttgaagggtgtctgtgactactgaacagttgccatcgctccttaagaaccacataatatgcagaaaaagagtctctcactatggtcaatcatggttcattttccaaatctaccctcatttcttaccatttttttctataaaaaaaaattacatgtgtttcccggacgcgtgg

SEQ ID NO: 1113 - DNA, 2757 bp, Glycine max
  Predicted polypeptide sequence is orthologous to G720
ttttaaaagaaagtaatgatcatagcttagaattattttcaaaacgttaaaaagataaagtgagcaaaaacaactgaacatgcacaaagtgttgttctcaatgctgaacttaagctaaaatagctgagtgaacaaattgaattgggaaaagaacaagttagcataaaccaaagcctggactcattttttattcacaacactatcctaactatcctttttttccattattagacctcaactagaccccctccccaacaacaccaacagaaccaagacacctccagtccctgtcatgctatttttacatggaccccgaagctggtcacttacaaccaaaaacccctcaccaccacaaccatcaaaaagtccacattgttatctttctttcagccacaatattttgtataaagcttcaacaaatgcgtggccagtccttagtttcaacaaatgatgccatgcactgcattgaaactgctgaatgctgctgcatagcttaacctttttttttaatgttatttttagcgttttgttttggcaagtggccatggaataggatcaatgtattgcccatttgtgatgcatcatggtggtgtatgacctgacctgatatcatatcatatcatatcaaccatcattgctcagcagcttaaggagagacatcttgagtggttggtgtggaggcggggatggcaaggcaaagtaaatggtcccaacttccagccaaatctaccactagttgcaacctgggagggaaatttgagaaacaaaataattacaagagtcaacagggcgttgatatgtaactggctggccccatcatcaaaaccacctactctgtgggacccagtggtggggtcggtcatacatgtcagcggagtttaggagtagaagaacgcttgttgccaagagggatgccggaaatgccttgtttggagagctcagccaacacactatccatggaaggaggtttgagtcctaagggcaatggtagccatggcttgcttattgcttcctttcacaaccttgtctaccacttcttctgccggatgatgctcaaaggaacttcgtggcatgctgaatctatagtcaactgctttaggattgtgcaatccaggtgtattttgattgtagggaaaacaaggagcttgaggaggtggcaccaacgggcatccccaagcatccacatgcacccccggataaggcttccagtgccaactttctgtaggatgccacatgggataaccaggatggccccaaatctgtacaccggctgtttgactgccaggttgtccccacataggatatataggagctggagaaagggtgtgatgtgaatgatatggagggtatgccatgattggtctttgcatataatagttcctttgcattgcatccccttgattatgccatttccgatcttcttccctgggtgcactttgtctcttgtgtattctatatttctgaagatggcttgccacattgtgccttgtcaaaccttccactttcattatctccaatattctagaaggaatggcttgatcaatacctagttgttcgacagcctttacaaattttttatgcagctcaggtgtccagtctactttcaccttcttccgattagctttaatctcacatgaatcattaagtacacccgttttatttggagatgtattaccatcggcattgctgagaaactttttattatgtggattcagtgaaacagcgctctcacccttggaaacattggcaaaatcatcttcctccctaatcagagtcttatcaggttcccttggctgaggagaactttcggcattcaaattcccacatgaagtttcgacagatttacattccctatcatgttccccactttctttttctgttgagcaattagtctgctcatggcaatctccatcatccagtaaccttgtcccctgctttaattgaggggttgacggagccggatatttatcacatacagcagactgctcatggtcattacccctaaacctcgacacattctctaaatcaattgaaatcctacttttatcttgtccaatgtctgtttggagctgcagcatggattctacagattctttgacaggttttagtgattcagaaaggacattttccccagaattaaatgccttgtgaacaacatgctgccaaatattcttgagcttgtcctcagagagtggtttactgagaaactcaactgcaccaagcgcaatgcacttcatcatggtgttcagacactggtcctttgaagtcataatggtaggcaagtcctttgcattctcaagaaatttgaaacctccaaggctacagcttgtactcacctccactatggcaacactggaagcctttaggactacttgagagtgctgacaaggcttcattctcgtcgtagaaagtggaaaccttatagtccatggcctcaagttgttctcttatctcagcagcagaactactatctccttcaagcagaagaactctaagtccctttgggaaatctttccatccttgtaaatcattggcagtgcaaaccatagctggtttggcattcttactcggtcccctactgcagcaacagatcaatattgctcatcaacaccgaatcccttcttggctgaaaagaaaatgcccccaccaagtcttctggccaaagttgtgttctttctttctgctgttcttattccattgaagacaaacaaagcaactagagtgagttaggaggtttaactacggtcggacgcgtgg

SEQ ID NO: 1114 - DNA, 684 bp, Glycine max
  Predicted polypeptide sequence is orthologous to G720
  misc_feature (563)..(563): n is a, c, g, or t
  misc_feature (611)..(611): n is a, c, g, or t
aagaacagcagaaagaaagaacacaactttggccagaagacttggtgggggcacttttcttttcagccaagtaggggaccgagtaagaatgccaaaccagctatggtttgcactgccaatgactttacaaggatggaaagatttcccaaagggacttagagttcttctgcttgaaggagatagtagttctgctgctgagataagagaaacaacttgaggccatggactataaggtttccactttctacgacgagaatgaagccttgtcagcactctcaagtagtcctaaaggcttccatgttgccatagtggaggtgagtacaagctgtagccttggaggtttcaaatttcttgagaatgcaaaggacttgcctaccattatgacttcaaaggaccagtgtctgaacaccatgatgaagtgcattgcgcttggtgcagttgagtttctcagtaaaccactctctgaggacaagctcaagaatatttggcagcatgttgttcacaaggtagactggacacctgagctgcataaaaaatttgtaaaggctgtcgaacaactaggntattgatcaagccattccttctagaatattggagataatgaaagtggnaaaggtttgacaaggcacaatgtggcaagccatcttcagaaatattagatacacaagagacaaagtgcaccca

SEQ ID NO: 1115 - DNA, 684 bp, Medicago truncatula
  Predicted polypeptide sequence is orthologous to G720
  misc_feature (646)..(646): n is a, c, g, or t
  misc_feature (674)..(674): n is a, c, g, or t
gccattttcttttcagccaagaggactagaaaaaggatgccaaaccagctatggtttgcactgccaatgatttacaaggatggaaagatttcccaaaaggacttagggttcttctccttgaaggagacaacaattctgcttctgaaataagaacaaagcttgaatctatggactataatgtttctacgttctacaatgaaaatgaagccttgtcagcaatctcaagtagtcccaaatgcttccatgttgccatagtggaggtgagtataagctgccctgatggaggtttcaaatttctcgagaatgcaaaagacttgccaaccattatgacgtcgaatagtcagtgcataaacacaatgatgaagtgcatcgcgcttggtgcagttgagttcctcactaaaccactttctgaggacaagctgaaaaatatttggcagcatgtggttcacaaggcattcaatgccgaggcaagcgctctgtctgaatcacttaaaccggtcaaagaatctgtagagtccatgttgcatctccaaacagacaacacactacatgaaagtacaatatcaatagatttagataaggtgtccaagtttagtgataatgaacatgagcattctgcggcaagcgataaatatccggctccttncaccccgcaattaaacaaggggcaaggntagtggatga

SEQ ID NO: 1116 - DNA, 747 bp, Lycopersicon esculentum
  Predicted polypeptide sequence is orthologous to G720
ctttccttttcagtttccacttctctgagatgctgaaaagtgagcatcataattaatggcttgtttgggtgcctgaaaaggatgccaattcagaaatggtttgcactgagaatgaattattggagtggaaagatttcccaaaaggacttaaagttcttcttcttgatacagactccaattttgcctcacagatgagatcaaggcttcaacaaatggactatatagtttacacattctgcaatgagaatgaggctctgtctgcaatatcaagcaagtcggaggtgttccatgttgccattgtagaggtaagtgctggcaacagcgatggaggattcaaatttctcgaaagtgctaaagatctaccaactataatggtttcagatattcactctattaacatcatgatgaagtgtatagcacttggtgcagttgagttccttcagaaaccattatcagatgataaactgagaaatatatggcagcatgtagttcacaaggcatttcattctggaggaaagagtgtctctgagtcactaaagccggttaaagaatctcttttgtccattctagagctccaaccagtaaaacacgaagcagataatgagaatactaatgaagcagaacccttgatatcagtggtggaaaaccaaaaagcatcatcatcctgctgcgataaatatccagctccttcaaccccacaacagaaacaaggagtgaggggtcagtggatgaatgttgattacccaa

SEQ ID NO: 1117 - DNA, 765 bp, Lycopersicon esculentum
  Predicted polypeptide sequence is orthologous to G720
atatgctgcagcatgtcctctatttttctttgaaaaaatttcttgtgactaactaaaaagtgtacagttttttggtgattaataaatttgttcatgtgtgcagatgctgaaaagtgagcatcataattaatggcttgtttgggtgcctgaaaaggatgccaattcagaaatggtttgcactgagaatgaattattggagtggaaagatttcccaaaaggacttaaagttcttcttcttgatacagactccaattttgcctcacagatgagatcaaggcttcaacaaatggactatatagtttacacattctgcaatgagaatgaggctctgtctgcaatatcaagcaagtcggaggtgttccatgttgccattgtagaggtaagtgctggcaacagcgatggaggattcaaatttctcgaaagtgctaaagatctaccaactataatggtttcagatattcactctattaacatcatgatgaagtgtatagcacttggtgcagttgagttccttcagaaaccattatcagatgataaactgagaaatatatggcagcatgtagttcacaaggcatttcattctggaggaaagagtgtctctgagtcactaaagccggttaaagaatctcttttgtccattctagagctccaaccagtaaaacacgaagcagataatgagaatactaatgaagcagaacccttgatatcagtggtggaaaaccaaaaagcatcatcatcctgctgcgaataatatccagcttcttc

SEQ ID NO: 1118 - DNA, 783 bp, Lycopersicon esculentum
  Predicted polypeptide sequence is orthologous to G720
ggatgagctaagtcttcttcatttcccaagagatacaggcataaatcggaaacaacctctttagttcaagattgaatagttaatgactgattaaaaagtgaccgagttggagggactaaaaaggatgcctttttagaaatgatttgcattgagaatgaattattgggttggaaagatttcccaaaggggcttaaagtcctacttcttgatgaagatagcaactctgctgctgagatgaaatcaaggcttgagaaaatggactacatagtctactcgttctgcaacgagagcgaagctttgactgcaatctcaagcaaatccgagggctttcatgttgccattgtggaggtaagtgcaggcaacagtgatggggttctacggtttcttgaaagtgccaaagatctaccaactataatgacatcaaatatacattctcttagtaccatgatgaaatgtattgcgctaggcgcagttgagttccttcagaaaccattgtcagatgataaactcaaaaatatatggcagcatgtagttcacaaggcattcaatactagaaaggatgtgtccaaatcacttgagccggtaaaagattctgtcctctcgatgctgcagttacaactagaaatgggtgaagcagatgacaaaagttcaaatggaacagaacctcccactgcagtagcggaaagcaatactgaacagtcatcgggctgtgataaataccctgctccctcaccccacaattgaaacaggagtgcgatccgtcgatgatggtgactgccatga

SEQ ID NO: 1119 - DNA, 573 bp, Solanum tuberosum
  Predicted polypeptide sequence is orthologous to G720
gtgaatgttttggagggactaatttggatgtcttaaaaaggatgcctttttagaaatgatttgcattgagaatgaattattgggttggaatgatttcccaaaggggcttaaagtcctacttcttgatgaagacagcaactctgctgctgagatgaaatcaaggcttgagaaaatggactacatagtctactcgttctgcaatgagagcgaagctttgactgcaatcttgagcaaatccgagggctttcatgttgccattgtggaggtaagtgcaggcaacagtgatggggttctccgatttcttgaaagtgccaaagacctacctactataatgacatcaaatattcattctcttagtacaatgatgaagtgtattgcgctaggtgcagttgagttccttcagaaaccattgtcagatgataaactcaaaaatatatggcagcatgtagttcacaaggcattcaatgctagaaaggatgtgtccaaatcacttgagccggtaaaagaatctctcctctcaatgctgcagttacaaccagcaaagagtgaagctgatgaccaaagttcaaatgg

SEQ ID NO: 1120 - DNA, 724 bp, Glycine max
  Predicted polypeptide sequence is orthologous to G736
gcggccgccctttttttttttttttttttttgatcaattatctgttataccttgtgtttttttatttattgagaaacaacaacaaaactacatttaaaatgataattgatacctaagtttttaagaagaattacttaaaaaacctcaaagggagatctatgtcaatacaagaaaaagggggggggggagagaaaggaatgaaagaagtgaaggcttaacaaggttgacgttgaccacctgagctcatcctccgtcttttagatggaaaaagctgccggaaatcaccatgagccacggcggcaacatgccattcatccaaagccaacctctcctcctgaccaaactgcggtttgacctttcgcctgccagctcctactggcacgttgcgaagggccccaccagccgtccagtatctctggcatcccttgcagaaatgtctgggctgattaacgttgtagttattgaagtagcaaaacttggtttccatgctcttgcatcttgggcatggtatgatcttatcaggtctctttatctcctctgtcccatcttcactatcatttctatcttcttttctttctcttccatgcaacgtaatcgttgttccaaacagtttaatcccttcactagcttggccactttgtgcttcagccattaattttagagagaggaacaaagagagaatattattattcttattgaagaaggtttagctcgagccgaattc

SEQ ID NO: 1121 - DNA, 862 bp, Glycine max
  Predicted polypeptide sequence is orthologous to G736
tttcaatcctcttatctctttgtccatggactaatatttcatctatatctgcataccatcaatttcggggatcccaatcttatgtcacagctataatgtgtaacccccttaaccaattatccgcagtctatattcatgccttaaaattaaccttgcttatggacaatggacatgagcttcgaggaaaaaaaaccaatctcagcatctcacgtctcctcatagttgaacatcatcatttttttaggtgtgttcacatcttaattctcaagacacgctttggtcccttcgctgctgaagtccttaatttcttgttcataataattccaagttgtgttttcgtacatgatttcattgaccttgatgctgagctcctgaggtgattctctggcgcttggcctgaaaaatctggcggaaatgagtgttgggcatggcaacgtgtccctgattcatctcaaacctgttttcatcttcagaagtttcataggcacgcccatccatgaagtcaccggctccatggcacggtgacttagccttccggcgcccggcgccgaccgcgacgtttcggagggccccaccagccgtccagtacctctggcagctcttgcaaaaatgcctcggctgattaacgttgtagttgttgaagtaacagaatttagtttccatgctcttgcatctcgggcagggtattatcttctctgctctcttctccaccctctcatattcgcttcctttttctcctttctttacttccccacccttcaatgtaatcagcgcaccaaacagcttaatcccttgagattcctcgcccatttcagagagagagagagagagttattcttaacggagaaggttttggttggcg

SEQ ID NO: 1122 - protein, 205 aa, Oryza sativa
  Orthologous to G736
MAPAAGGFKLFGKVIMQCGVSEGTQDKAQGFVVAREKVEPEEEEEEEQRVPAAATSGQRASIKREAADRDEEQRQGGGDAAGQPTQRRLQDSAEARAAAAAPLPCPRCRSRDTKFCYFNNYNVNQPRHFCKACHRYWTAGGALRNVPVGAGRRKNRPLGPLAVAHHNHHHRAAAGFVLGFPNPSSPTSPSPVYTDRWPVTPDRPF

SEQ ID NO: 1123 - DNA, 820 bp, Glycine max
  Predicted polypeptide sequence is orthologous to G748
  misc_feature (7)..(7): n is a, c, g, or t
gtccggnaatctcccgggtacgacccacgcgtccgcaaaacccaaacctcaataaaaccgaaactcacaaacacttaaacagaggaagtaacgaaccaaccaacctgacacagccgccacaaccataaacattagcataaacaaaaaaccgttaatctcgcgcgttcttttttgttgttgtgtcgtgtcccttttggatctccagaaaatgcaggagaataaggatccagcaattaagctcttcggccagaagattgccttcgccggagaagtcgaccctccggccatttccgccggcgaaattgactcgccgccggcgatggatgtcgacaaggacgaagaagacgactttggtgactcagagactgaagatgagaaagacaaggatccccgagctgaaaaagttagtgagaaaacgaaagaagctgatcctcctccaaatgctgcagactcaaagaagaccccagagggtattcagaacccaaacacaccttccatagacgaagaatctgcaaagtcaaaaaccaacaagtcagagaacaacaacaacaacaaaacactgaagaagccggacaaaattttgccgtgtccgcgctgcaacagcatggacaccaagttctgctactacaacaactacaacgtcaaccaaccccgctatttctgcaaggcgtgccaaaggtactggaccgcgggcggcaccatgcggaacgtgccggtgggagcggggcgaagaaagaacaagaactcagcctcgcactaccgccacatcacaatctctgaagctcttcaagcggccagaattgatgcccccaacggaact

SEQ ID NO: 1124 - DNA, 1745 bp, Glycine max
  Predicted polypeptide sequence is orthologous to G748
ggctcgaggttaaaaagaaagaaaaataaaaaaaaaccaaagaaacagaaatgttggtggcaaaagactccacgatgatgaagctcttcgggaagacgatccctgcgccggagatctccgccggagctccggcattgtcttctggtgatgctgatgctgttggtgttgttcagaaccatggttcttcaagtgtcaatggggatggtgaagagcacgagattgagcaggacataatgggagaggaaacaactgagagtgagaaggaagatgaagtgaccaatcttgatactgtctcaagaccaggggaagtgtctattaacccctctaccaagaaggaggatcttacattgaaaacttcaaaaaagaccgaacaagaacaaggtgaaaattcccaagataaaacactgagaaagccggacaaaatactgccttgcccccgctgcaatagcatggataccaagttctgctactacaataattacaatgtcaaccaaccccgccatttctgcaagaattgtcagagatactggactgccggtggagtgatgaggaatgttcctgtgggtgctggtcgcaggaagaacaagaattttacttctcagtatcgtcagataactgttcctgaagcagcactcttgagttctcagccggacttgccaaatggagtcagtcatccttccttgaactgtaatgccacactccttgcatttgggtctgatacacccttgtgtgaatcaatgacatctgttttgaaccttgctgaaaaagcagtgaacaattccacaacaaatggatttaatggctcagaagaactagaaattccttttgcttatgttgctggagaaaaagtgaatgatgattccaataaatcttctgacatgtcaacaaagccaatggaaggtgaaaccaccaataggtcccaagaacaagtcatagagaattgtcatcccttcccacctcatgctccctactttcctggtgccccttggcctttcccatggaatccagcactgtggaactccccggtaccatcaccacctgcttttttcccacaaggatttaccatgcctctctatcctgcagcagcttattggggtcttactataccgggtgcatggagcatcccatggctagcgcaaccatcattaccaaatagcacagtgtctaactctggtccagaccccattgcccgaaccatagccatgtcttgattgccacgtcccaaaaagttaacaggaggaagtggggtttcaacaagaggactcttattgctgttcaaccatattgcaatggaaagtgagggaaagtgagataaggcttctagacccacccagttactgttgatgtctctcttgatcctttagccaacaaagaatagtgggtttcctcttgggggaatgtacagggcagtgggatatgcctaaggggaaaagcaaaagtggtgaggaaaagaaagtgctctatggatgtgttgaaagcaaaatgaaatgccaatgtccaagataattagcttgatgcagaagatgtgattcaaatgtgaaagctaatgaagatagggttttgcgtgactcttgtggtagtttcaaggaacaatcctaacaaaaagaaaagcgtgagccatatcagcaatactctcaagatattgtcaaacatatttcttttaacacactttatattatgagtttaatatcttattaacagtataaaataattttacattattatttaattataatttattgttt

SEQ ID NO: 1125 - DNA, 1896 bp, Glycine max
  Predicted polypeptide sequence is orthologous to G748
  misc_feature (1859)..(1859): n is a, c, g, or t
  misc_feature (1863)..(1863): n is a, c, g, or t
  misc_feature (1872)..(1872): n is a, c, g, or t
  misc_feature (1878)..(1894): n is a, c, g, or t
ggtccggattcccgggtcgacccacgcgtccgccagaaagaaaaaaaaaatgcacgaaattagagaccctgcaattaggcttttcggtcagaagatccctttccctgaagatgttgttgttgacaaagaagaaaaagaaatagaaagtggcgaggaaagagaacaagagatggaaaaatatgaagaccaaggacacaaggatgctggagttgaaaatgttactgaggaagagctagaagttgatcctcctccaaatgctgaagagactaagaattcaggctcatcccctgaggctattgtgaaccccaaaacaccttccatagaagaagaaacagaaaaatcaaaaggtgacaaaacagagaaggaacaaggtgatgcagccaactcacaagagaaaaccctgaagaagccagataaagtgctaccatgcccccgctgcaaaagcatggacactaaattctgttactacaacaactacaatgtcaaccagcccccgcattcggctcgggacggctgcgagaagacgacagaagggggcaccatgaggaatgttcctgtgggggcaggacggcgaaagaacaagaactctacctcgcattatcgccacatcactatctccgaggcccttcaagcagcaagaattgatgctcaaaatggaactcatcttccaactttgaaaggcaatggtagagtcctcagctttggattagatgcacatgcacctatttgtgattccatggcatctctcatgaatcttggagagaaaaaggctcttaatggcacaagaaatgggtttcatcatggctttgaggatcaaagactccccgttccttgcaaaagtggggaaaatggtgatgactcttcaactacatcctccattacaatttcaagtcccaagggagaaaataacaaaagcaccttccaacaacaaccattgccccaaaatcatggtttccttcctcaagttccatgcattcctggtgttccttggccctatacatggaattctccagttcctccacctgctttgtgtccttcaggatttcccctaccattctatcctgctacattttggaattgtggcatgcctgggaattggaatgttccatggttttcctcaagttcacctgcttcaaacctcaagtctccaagctccagtcccaattctccaactttggggaagcactcgcgggacagtgacatgattaagcaagactctttgcacaaagaagaagcttcaacgccaagaaacgggagtgttttggtcccaaaaacgttgagaattgatgatccaagtgaggctgcaaagagttctatatgggcaactctaggaattaagaatgagtcagtgagtgggggagctatgtttaaggccttccaatcgaagaagggtgaaaagaatcatgttgaagcctctccaatgttgatggctaaccctgcagctttatctagatccctcaattttcatgaaaactcctgaattagtggcactggtgaaaagtccttacagcaaagttagtcacttcttgagttatttgtctagctagcaagagacggtgaccatctttgagtgacattgaccttgtatagaagaagcgaaagggtggtagtctctgatttcctcggcacaagtgagacgacgaggactaattctgtctttaatttcattcgacaatattaaaatagagtatataggttttttttcatgtgcttagtttgatgagtgagttcatgtatatgtacatatataaaaatatgtgaaatactgatctttagcctagagagacggaaaagatcttttactttcttgtagtataaaataaaaatcctgactgtagaaaagttagtcacctcccttngagnataaaatangaaatnnnnnnnnnnnnnnnnnag

SEQ ID NO: 1126 - DNA, 2093 bp, Oryza sativa
  Predicted polypeptide sequence is orthologous to G748
gtcggatctctctctctctgtctctctccctctctctctcgcccatgtaccatctccatggacgacctcgccgccgcctcccctcctcacccgccgccgccgccgccggaatcccacgtgcctccgcccccgcagacgccggagaaggattcatgtgaggatacaggagacatgaggatcagtgaagaaaagccatgcacagatcaggagttagatgctgatcagatgaatagttctagctttaatagttccagcgagtgtgagaatcaaacacctagcaatgatgaaatgactggatcagagtccaaatctgaggcagctcaaacagagggtggtggatcgagtgaagagaaggtcctgaagaagccagacaagatcctgccttgtcctcgttgcaacagcatggatacaaagttctgctactacaacaactacaacattaaccagccaagacatttttgcaagagttgtcagagatattggacggcaggtggaagcatgaggaacctccctgttggtgctggtaggcgcaagagtaagagctccactgcaaattaccgcagtatattaatcacgggcagcaatctagctgctcctgctggagatgctcccctctatcaactctctataaaaggagatcaaacagcaacggcagttaaatttgcacctgattccccactctgtaattccatggcctctgtgctgaaaattggagagcagagtaagaatgccaagcctacctcaacagcacaacccagaaatggagaaacccagacctgcccggcttcaggaacaacttcagatagtccccggaatgaaccagttaatggagcagttagtgggcatcaaaatggaattgttgggcatagtggagtccctcccatgcatcccataccatgcttccctggtcctccttttgtgtacccatggagtccagcatggaatggcattcctgccatggcaccaccggtatgcacagcaccagctgaaccagcaaattcttcagacaatggaagcacagctagtgttcagtggagcatgccaccagtgatgccggtaccaggatactttccggtaattccatcttcagtttggcccttcatttctccctggccaaatggtgcatggagctcgccatggattcaacctaattgcagcgtgtcagcttcatctcctacaagcactagtacatgttcagacaacggctctcctgtcctaggaaagcactccagggactccaaaccgcaaggagatgacaaggcagagaaaaacttgtggattccgaaaacgcttcggatcgatgatcctgacgaagctgcaaagagctcaatctggacaacccttggcattgaacctggtgaccgtagcatgttcagatcattccagtcgaaacctgaaagcagggagcagatatccggtgctgcacgagtcctgcaggcgaatccagcagctctatctcgatctcaatctttccaggagacaacgtgatgtatattgaagaaatcgtgtgacaattgtagaacatgttactactataatttaagcaagtgctacagcctgaaggatgattggcgatgtaggcgctgctgcaaacatggaggcagcgtgatctgtactattgaaacctgaagagtactattcttgacatttttctataatttgcctgtggagcatgcaccagtctactgggttcatgatcaggctgtcagcatatgttttgttgtacaataataataattgttaatagctttgcctaaaggatactgatagtattctgctgatccttcagctctgtgatcaatggcccatatatttacctgacaagtttcagaaaggaaaaaaaaaaagatctgctgcctgacaagaggttcaactccgaagaaatggttagcatttttgtactgcgtctgcgtgatgttaccttgttgctttctttggttctctaatgatcccttagttacctctatgatgacttgcattagttgaagtacctctgtccttttgttcggctgtgttgcctttatactagcatctgtgtagaatgtagaccgaagtctcaagctttcctttttgattcagtacgcttattgtgg

SEQ ID NO: 1127 - DNA, 1875 bp, Oryza sativa
  Predicted polypeptide sequence is orthologous to G748
gcacgagctcgtgccgaattccgcacgggaagatttcaagaaatccaaccaaaaatctcgcgctctcctctcctcctcctcctcctcctccgcatgagctcgtcggcgttggcgttggcctgtcgtctccgggaggagtagtgcaggcggcggcggggaagtccgaaacggagtttgttcgttttggagcggagtggtgaggtgagtcgtcgagatgggggagtgcaaggtgggaggaggaggcggaggcggagactgcttgatcaagctgttcgggaagaccatccccgtgccagagcccggcgcctgcgccgccggcgatgttgataaggaccttcaacacagtggcagcagcacgactgaaccgaaaactcaagagaacaccgttcaagactccacaagtccacctccgcagccagaggtcgtcgacaccgaggactcttcagctgataagaactcatcagagaatcagcagcagcagggcgatacggccaaccagaaggagaagctgaagaagcctgacaagatcctgccgtgcccccggtgtagcagcatggacaccaagttctgctactacaacaactacaacatcaaccagccgcgccacttctgcaagaactgccagaggtactggacagcgggtggtgccatgcgcaacgtgcctgtgggtgcaggccgacgcaagagcaagagcgtatcggccgcttcccatttcctccagagggtcagggctgctctgcccggtgatcctcctctctatgccccagtgaagactaatggcaccgttctcagcttcggctccgacctgtccaccttagacctcacagaacaaatgaagcatctaaaagataagtttatcccaacaaccggtatcaagaacaccgacgagatgccagtcggtttgtgtgctgaaggattgtcgaaaacagaagaatcgaaccaaacgaacctaaaggagaaagtttcagcagatagatctccaaatgttgcacaacacccatgcatgaacggaggagccatgtggccatttggcgtggcaccaccacctgcttattacacttcaagcattgcaattccattctatccagctgcagcagctgctgttgctgcatactggggctgcatggttccaggagcttggaacgctccatggccaccgcagtcccaatcccaatcggtttcatcatcaagtgctgcttctccagtatccacaatgaccaactgcttcagattaggaaagcaccctagagatggtgatgaggaactggatagcaagggtaatggcaaggtgtgggtgccgaagacggttcggatcgacgatgtcgacgaggtggccaggagctctatctggtcgcttattgggatcaagggtgacaaggtgggagcagatcatggcagaggatgcaagcttgcaaaggtttttgagtcaaaggatgaggcaaaggcatcaactcacacagcgatcagcagcttgccattcatgcaggggaacccggctgccctaacacgctcggtgaccttccaagagggatcttgacttgaacaacgccttggaaatttttatgctgccttctgctgctataaagacatagcgtgatacagctgaaattttgtacattagaggattgtaaagtaggtatgggagatggagtgtcagggtgtataacttaacatagctacaagcaagcccagtagctgtattagataacttgtacatagctatgtgggtttgagaaagatagggagagcaagttccccttataatatgtagataaataatataatgatttgaatatttagatcaaaaggatttcctttaaaaaaaaaaaaaaaaaaaaaaaaaaaaaaaaaactcgagggggggcccggtaccca

SEQ ID NO: 1128 - DNA, 507 bp, Zea mays
  Predicted polypeptide sequence is orthologous to G748
cgagggaagcgaagggaagctattgacagttattcttgtacaaccaagcacgcacgcgctggaaaacctgatcacctccaacccaacatgttgggggcacgctctacatggaaacaacacactgtttgaggatgcactcttccaatggttacagttacagtaacggtgcccgctgccttgtacagcagcagcacctatgttgccaatcatattgtacagaacatatatggcatgtttggtttgcttttacggacaacggaaacagggaagcctctccgccaggattagctacactactgctgcctggaacgggaatcaacacgctgcggcaactcgcgctggagctcttgctcttgcgcctcccagcaccaacggggatgtttctcatgcttccgcctgcggtccagtacctctgacagctcttgcagaaatgccttggctgcttgatgttgtagttgttgtagtagcagaacttggtgtccatgctgttgcagcgagggcacggca

SEQ ID NO: 1129 - protein, 493 aa, Oryza sativa
  Orthologous to G748
MAALRQGDDPAIKLFGRTIPLLLDPPAAAAAAADEENSVLENSVLSFLDFLATFGVMPNLGNGVKTNNDLPLVSDKLLIVKGIPFCPNNSKKNDLQGISRPDGRIEIDSMTEDVKTEPDGSVPEKILKKPDKILPCPRCNSMETKFCYFNNYNVHQPRHFCRNCQRYWTAGGAMRNVPVGAGRRRNKHVSKYCQAMMTCNNTVAPGDVSDVVHHQVITHGSSLLPATLKENETPTEFISEVPPCKSSASILDIGEPNDTDLVPLASGDNKEEKSCASSVVVSSCSENLMPDNAIMKEPNNRSGCCNGVALPFPTGPALVLPWSLGWNSVALMPATQCSMQPVLGLKDGIPCPPSWPPQLMVPAPGICTPVVPIPLVPPLWSCFPGWPNGMWNAQCPGGSSSLVLGKHSREESLQEEEKTRNYLWVPKTLRIDDPAEAAKSSIWATLGIKPDDKGIFKSFQPNVAKNGTAPESPQALQANPAAFSRSQSFQETT

SEQ ID NO: 1130 - protein, 513 aa, Oryza sativa
  Orthologous to G748
MTTRRTRKERKQMGGGGKCKRGKRGKIAAKRRRGQVRCCSSSSSSGGARRRARERESEESLGEMGECRGGGGGGDGLIKLFGKTIPVQPDAKFLILGSASLGEFSDVQQHSGSSSSSTESDVQETAAVAVADPSPRSEVVDGESPPQPGGEAASHQQQQKEMKLKKPDKILPCPRCSSMDTKFCYFNNYNVNQPRHFCKHCQRYWTAGGAMRNVPVGAGRRKNKNATAAAHFLHRVRACAAAAAMPAAPHDATNATVLSFGGGGGGHDAPPVTLDLADKMTRLGKEGLVAHARNADAAAACSEVSSNRDDEQIGNTVAKPANGLQQHPPPPHHHHHSAMNGGGIWPYYTSGIAIPIYPAAPAYWGCMIPPPGAWSLPWPATVQSQAISSSSPPTSATPSVSSFTLGKHPREGGDHEARDHHGNGKVWVPKTIRIDNADEVARSSIRSLFAFRGGDKADDNNDDDGTGVHKLATTVFEPKRDSKTAKHPAITSLPLLHTNPVALTRSATFQEGS

SEQ ID NO: 1131 - protein, 438 aa, Oryza sativa
  Orthologous to G748
MRISEEKPCTDQELDADQMNSSSFNSSSECENQTPSNDEMTGSESKSEAAQTEGGGSSEEKVLKKPDKILPCPRCNSMDTKFCYYNNYNINQPRHFCKSCQRYWTAGGSMRNLPVGAGRRKSKSSTANYRSILITGSNLAAPAGDAPLYQLSIKGDQTATAVKFAPDSPLCNSMASVLKIGEQSKNAKPTSTAQPRNGETQTCPASGTTSDSPRNEPVNGAVSGHQNGIVGHSGVPPMHPIPCFPGPPFVYPWSPAWNGIPAMAPPVCTAPAEPANSSDNGSTASVQWSMPPVMPVPGYFPVIPSSVWPFISPWPNGAWSSPWIQPNCSVSASSPTSTSTCSDNGSPVLGKHSRDSKPQGDDKAEKNLWIPKTLRIDDPDEAAKSSIWTTLGIEPGDRSMFRSFQSKPESREQISGAARVLQANPAALSRSQSFQETT

SEQ ID NO: 1132 - protein, 440 aa, Oryza sativa
  Orthologous to G748
MGECKVGGGGGGGDCLIKLFGKTIPVPEPGACAAGDVDKDLQHSGSSTTEPKTQENTVQDSTSPPPQPEVVDTEDSSADKNSSENQQQQGDTANQKEKLKKPDKILPCPRCSSMDTKFCYYNNYNINQPRHFCKNCQRYWTAGGAMRNVPVGAGRRKSKSVSAASHFLQRVRAALPGDPPLYAPVKTNGTVLSFGSDLSTLDLTEQMKHLKDKFIPTTGIKNTDEMPVGLCAEGLSKTEESNQTNLKEKVSADRSPNVAQHPCMNGGAMWPFGVAPPPAYYTSSIAIPFYPAAAAAVAAYWGCMVPGAWNAPWPPQSQSQSVSSSSAASPVSTMTNCFRLGKHPRDGDEELDSKGNGKVWVPKTVRIDDVDEVARSSIWSLIGIKGDKVGADHGRGCKLAKVFESKDEAKASTHTAISSLPFMQGNPAALTRSVTFQEGS

SEQ ID NO: 1133 - protein, 380 aa, Cucurbita maxima
  Orthologous to G748
MNPEVLSTDENDKLATRKTEKEQNDAPNSKEKLKKPDKILPCPRCNSMETKFCYYNNYNVNQPRHFCKACQRYWTEGGTIRNVPVGAGRRKNKNSASHYRHITISEALRAAQIDVPIEVNHLASKGNGRVLNFSVSPPVCESMVNVSHPAERKVLNGTRNEFEGAKGPCEGGETGDDCSSASSVTMSSSMKNGARRFPQEPHMQNINGFPSQIPCLPGVPWPCSWTAPIPPPALCPPGVPLSFYPATYWSCSASGSWNIPWVTPQPCPPIPGPNSPTLGKHSRDGDELQADNSEMKDPPKQKNGSVLVPKTLRIDDPNEAAKSSIWETLGIKNDSIKAVDLSNVFQSKGDLKSNVSEVLSPVLQANPAALSRSLTFHERS

SEQ ID NO: 1134 - DNA, 1053 bp, Glycine max
  Predicted polypeptide sequence is orthologous to G789, G1494
ccagatgcaagcagggcatcaagcaatggtgtctggactactactttatccgccgagcctgaagctgttagagaccatgtgccgagaacaagtcctcagaatgaaaaagggaaatcggagatgcttgaaccaactacaacttcatcatccggtggctcaggtagtagtcttggaaaaaattgttcgctatctacgagaaaccagggccaaaaaagaaaaggaatagatgtggaagaatctgaggagcaaagtgaggacacagaacttaaatcagcacttggaaacaagtcatctcaacgtgcagggttggctcgaaggaaccgcgctgctgaagtgcataatctatctgaaaggagaaggagagaccggatcaatgagaagatgaaggcattgcaacaactcatacctcacagtagcaagacagacaaagcatcaatgttggaagaggcaatcgaatacttgaaatcacttcagttacaacttcagctaatgtggatgggatctggcatggcaccaattatgtttccaggaattcagcactatatgtcacaaatgggtatgggaatggctacaccgcctttccctcctattcacaatccgatgcaattaccgagactgccgcttgatcagtctgtatctgcgtctcagacaccaaaccagacattaatgagccaaaatcctattttgggtgcctttaattaccacaatcagatgcaaaatccagctctttcagagcaatatgcgcgttacatgggctatcatcttatgcaaaatgcctctcagccaatgaatgtattcagatatggtccccagggggtacggcatagtcaaacaatgattacacccagcaacagcagtggaaacatgagtggagcagcaaatattgatgaggctgtgagtggcaaaatgggttaattagtttcaaagcatgcttttgagtacctatggcgtaactaacaagataattgcaagatgatagaagcccttgtaaggcttgtatgctttcacaatatgtctgcctgttcatacagtggctgatctacagttatgtga

SEQ ID NO: 1135 - DNA, 809 bp, Glycine max
  Predicted polypeptide sequence is orthologous to G789, G1494
  misc_feature (694)..(694): n is a, c, g, or t
  misc_feature (741)..(741): n is a, c, g, or t
tcgcgatctacctgattcatcccagaaagacaatgacttaggtgcatcacgaaaggttctaaattttcctcacttttcaacaccccgtaataatgtttcttcagcacctggtagtacacagtttagggaaaaaactactgctaacttgtcacaaagtgaggctagagagtactcagtgatcacagttggttcaagtcactgtggcagcagtcatatccctcaggagaaagatgtaagcagggtttcaagcagtgctgtttgggctactaataataataatagtttatctgctgagcctgaagctgtcagagattgtgtccagagaccaatttgtcctaggagtgacaaaggaaaatcagagatgattgaaccaactgtgacttcatcttctggtggctcaggcagtaccggtattggaagaacttgttccctatcaacaagagatcatggccaaaagagaaaagggacagaagaagaagcatctgaggaacaaagtgaggccacagaacttaaatcagctgatggaaacaaggcttctcagcggacggggtcttccaaaaggaaccgtgcagctgaagtgcataatcaatcagaaaggagaagaagagataggatcaacgagaagatgaggacattgcagcaactgatacctaacagtgacaagacagatgaagcatcaatgttagaagaggcnaatcgaatacttgaaatcgctccagtttcagcttcaggtaatggtgnatggggtctgcatgacaccagtgatgttcccaggaattcagcactatatgtcacaaatgggtatgggg

SEQ ID NO: 1136 - DNA, 487 bp, Oryza sativa
  Predicted polypeptide sequence is orthologous to G789
  misc_feature (382)..(382): n is a, c, g, or t
  misc_feature (439)..(439): n is a, c, g, or t
gccggtcgagcacccacgacggcgccggcacgtcgtcgtcgggcggctccggcagcaacttcggcgcttccggcttgcccagcgagagcgccagtgcccacaagaggaaaggcagagaagattcagacagtcgcagtgaggatgctgaatgcgaggcaaccgaagagaccaaatcgtcgtcgcggcgatatggatcaaagaggagaactcgtgcagctgaagttcataacctgtcagagaggagaagaagggatcggatcaacgagaagatgcgcgcattgcaagaactcatacctcattgcaacaaggtaagaaacattattatatatgcatcttttttctgatcaggtgcaagtccatggactgatacagctatgttgancggacaaggcatctatattagatgaagcaatcgagtatctgaagtcactccaaatgncaagttcagatcatgtggatgactactgggatggcaccaatgatgttc

SEQ ID NO: 1137 - DNA, 1108 bp, Oryza sativa
  Predicted polypeptide sequence is orthologous to G789, G1494
ttttttttttttttttttttttttttttttttttaaagaagggcaaagattgccactggcacttcatattataaggattattagtacatacactgggaattagcatcttagggaaggggggaaatgctatgtgcatttacagacacttgtagcatttatgtcagacagatactgattgagatacataacagcaatatggatgcaatctgttcatcatgtcaatattttcagctatctccagaaagacgaccctttgtgcaaagcctacattgaattccttatcatgtttctggtcattctaaattccatcagaggttggtggttgttcagccccagaatttggcagaacagtgctagctgacgctttcggtatctggttttgctgtgctacttgaggcccagaagcatatggtcctgatacctgtggtggcactgtttgccagccatctgggtgaaggaagggattgcttgcctctctcagttgaatgttctgcatctggtttgcaacattcattgggttcatagctggagatgaatttagagggatgtgatttggcatagaatggttcatgtatggcaatcttgacatgtgacttaggccttgtgccgcaggcatgcacgcagaattcatgcccacggccattggtggcatgaactggtgagcaccagggaacatcattggtgccatcccagtagtcatccacatgatctgaacttgcatttggagtgacttcagatactcgattgcttcatctaatcgggcgcccgggtcggtcttgttgcaatgaggtatgagttcttgcaatgcgcgcatcttctcgttgatccgatcccttcttctcctctctgacaggttatgaacttcagctgcacgagttctcctctttgatccatatcgccgcgacgacgatttggtctcttcggttgcctcgcattcagcatcctcactgcgactgtctgaatccgctctgcctttcctcttgtgggcgctggcgctctcgctgggcaagccggaagcgccgaagttgctgccgatctcgccccccatccatcccacgattcttgtgtccccccaagaaattcacaacctgcataacccctcgtgccg

SEQ ID NO: 1138 - DNA, 2125 bp, Zea mays
  Predicted polypeptide sequence is orthologous to G789, G1494
cgatatgatcgatgggcaggtaatcttgccggttgctctgctggttgttggttttttttttttttttttttttcctaggaattgactgctgattgaatattgcttgctgtacagatcagtacacacagtaggacaggagtcggagttggcatctcaggggagaggggttgctatctacctgcaactctgcatttacatgtagatgtagcattcgtgtccagacaagcattgccatattgatgtagatacactgcagcgcagctacagagatgccatccgctcctcatcacgtcagtatttccagggattgccagaaaagaaagaccctttcttgatcccattcaattctcttgaacgctgtactgcagtctgcacagcagtatgcagctcgagttcttccgtagatagaatacggcggtagacaggctgttgtcttgtaacctatacaagactcctgataataactctagaactaagcttacatgtcaaagaatatggttctgacacttctgtacagatatacagcttaaggcatgattttgatcactctaaactccatggaaagttggtggttgccctgccttagaagttggtataacagtactagctgccacttccagtatcttattgtgttcttcggcttgtgctatttgatgtccatgaacgacatggggtcctggtcctggtacctggggtaccactgctgctcgcccgccatctaggtgaaggacgtggctacctgcatccctgaggtgaccgatttgcacctggttcgcggcgttcagtggattcattagattcatagctggagacgagttcagagggatatggtttggcagggtgtggttcatgtatggtaatcttcgcatctgacttaggccctgtgctgcagggatgcaacctggattcatgcctagagccatcggtggcatgtattggtgagcaccaggaaacaccattggcgccatcccagaagtcatccacatgatctgaacttgcatttggagggacttcaggtactcaatcgtctcgtctagtatcgacgctttgtcagtcttgttgcagtgcgggatcagcccgtcccgcgcgcgcatcttttcattgatccggtcccttcttctcctctctgagagattgtgaacttcagctgcacgagtccggcgtttcgtcccatatcgccttgatggtttcgtttcctcccttgcctcctcacactcggcatcctcactcggactatctgagtcgtctctacacctccccttttctcttctgtacatggacgctgtcactgggcagcccggatccccccatagttgcttccagacccgccggatgacgatgtgccgtcgtgcgcgccggtattgctcggcaactccgactgcaatgccgcgtccttccccctgatccttgccggcgtcctgagcacctggttgcttccgcagaaggtcgagcagatgtcgccagcccagctcgactcgacgccgctgctcccaacgggcggcgaaggcgaaggctgcgaggtagggcccgggagcgttccctcgtgctgcggggcggcgtcggcgatggtgctgtaccagagctgcgtgtacaggtccttctccagcgcgtcgtcgagggtgtccgggaaccacgcggcggtctcttcgccggtgaggccgctggtgcccgggcggtcggggtcgtaggtgggcgccggcctctggtgcgcctggggctgcgcgacgacgctcccgttgtgccacagcagctccacgaggtcgtcgtccgcgacgacgggcttcttctgattcgttgccgccgacctcgcattgccgtccatctcgtcaggacttcgactcgagtgcccggagaacaacgtcttctctcctgattctgaacggagtactgctgcgtgctgctgctgcctcgcccgagcagagctaccttgcgagtcgtcgcctccgtccgtccttggcgccttgcaagctgcaaacaggagcaggctcagggagcttttatgaggcagctctgtagcagcacggcatgagagcacacaagtcggagcgctcgtacactgggtcgccgcccccgctgtcccgtttacttcgctctctcgagaaaggagagaggcccggacgcgtgg

SEQ ID NO: 1139 - protein, 451 aa, Oryza sativa
  Orthologous to G789, G1494
MAICSTDNELVELLWHNGGVVAQPQAAQARVVSSSGRGQSASVLTGDDTETAAWFPDTLDDALEKDLYTQLWRSVTGDAFPAAAAAGPSSHHAPPPDLPPPAARPPMRSGIGSSWTGDICSAFCGSNHIPETAAQRCRDAGAALPPERPRRSSTHDGAGTSSSGGSGSNFGASGLPSESASAHKRKGREDSDSRSEDAECEATEETKSSSRRYGSKRRTRAAEVHNLSERRRRDRINEKMRALQELIPHCNKTDKASILDEAIEYLKSLQMQVQIMWMTTGMAPMMFPGAHQFMPPMAVGMNSACMPAAQGLSHMSRLPYMNHSMPNHIPLNSSPAMNPMNVANQMQNIQLREASNPFLHPDGWQTVPPQDKEFNVGFAQRVVFLEIAENIDMMNRLHPYCCYQQQEQQLGEPEDYVWEPYHHCKLPSSQQKPEGGDLEFMSKLVASIISC

SEQ ID NO: 1140 - protein, 447 aa, Oryza sativa
  Orthologous to G789, G1494
MDAGATARSSSSSAMMMNQKKPLLSDGELVELLWQDGGVVGHAQTRHRSSDVLARSGVTGEEETASAWFADGGGGGGGDDDALGLGMGRDIYSQLWHSFANVDGHAAGALALATPTPTPRAAARSDDVSSRLDEADLSICGSNAVVAPALPADDDDDIDAAAPREEEEEEEEGPGAARAAGASSSGGSGSGSGSYPLFKRGREELVDSLSEVADETRPSKRPAAKRRTRAAEVHNLSERRRRDRINEKLRALQELVPHCNKTDKASILDEAIEYLKSLQMQVQIMWMTTGIVPMMFPGTHQLMPPMGMGLNTACMPGAQAQGLNQMQRTTYYMNNSLPNQMPQIPSPAMNAPSVPDDMQNDNRIRGPRNPFLHCNDTLTATAQVDYYVKFHHYRSFRLQFLFILQYQFFSGARHRQYVKNIVAVWTQLEPASQKLHKNTTVTVSLFF

SEQ ID NO: 1141 - protein, 377 aa, Oryza sativa
  Orthologous to G789, G1494
MAVAAAAATTTRWAWAWAGTSTRRLWHSFANVDGHAAGALALATPTPTPRAAARSDDVSSRLDEADLSICGSNAVVAPALPADDDDDIDAAAPREEEEEEEEGPGAARAAGASSSGGSGSGSGSYPLFKRGREELVDSLSEVADETRPSKRPAAKRRTRAAEVHNLSERRRRDRINEKLRALQELVPHCNKTDKASILDEAIEYLKSLQMQVQIMWMTTGIVPMMFPGTHQLMPPMGMGLNTACMPGAQAQGLNQMQRTTYYMNNSLPNQMPQIPSPAMNAPSVPDDMQNDNRIRGPRNPFLHCNDTLTATAQVDYYVKFHHYRSFRLQFLFILQYQFFSGARHRQYVKNIVAVWTQLEPASQKLHKNTTVTVSLFF

SEQ ID NO: 1142 - DNA, 1850 bp, Glycine max
  Predicted polypeptide sequence is orthologous to G801
cctctattctccgtctctctactctcttattctcaacgtcaaacccaaaaccccttcttcttcttcttcttctctcgcgccgcaataataatactaaaacatgtccaactctgatggagccactaacgccgtccctcccaacgacgccaacaacaacacaatcgttgagtaccagcagcgaaccaccaccaccaccaccgccgccgccgccgccctcgccgtcaagaaaccgccttccaaggaccgccacagcaaggtcgacggccgcgggcgccgcattcgcatgccgatcatctgcgccgcccgcgtcttccagctcacgcgcgagctcggccacaagtccgacggccagaccatcgagtggctcctccgccaggcggaaccctccatcatcgccgctaccggctccggcaccactccggcgagcttctccactgtctccgaccacaagcccctcctccctccccctacccccttcatcctcggcaaacgcattcgccctgacgacgactccgccgccaaagacgacgccgtctcgctcgtcgccccccccacgccgcccgccctctgggccctacctccccgccccgacttcggccaggtctggagcttcgccgccgcgcccgaactcgtgtcggtgtcgccgcagaattcaatgtttcaccatcaccatcaacaccaccagcagcaacagcaacaggccgccatgggagaggcctctgccgcaaggctcgggaattacctccccggccacctcaatttgctcgcctcgttgtccggcggccacgggaattccggccggcgggacgacgagcctcgctgaatgaatcaatttctgaaattatgatggatttgattgtgatcttcttcgtatataaatatatgtattattgtgtgtgggtgggtgagtttgtattttgtctctgtgactttgttgttgtgtgtggactactgtggacaaggagaaggattgaagattcttagtgaaatttttagggttagttttttttttatttttaatttttggtagtatttcgagtggacaagtccatgaattaaggaattcaattggattattagggttttccttgtttggaaaactgattaggttacttgttaggagatgatgatgaatttgtttagaacattgctggaggagagacaacagagagtatgatgatgagatgaataaccagggattgaggcttggaagtgggtttcaggacctcgatccattgatcggtatgcagatgcagatgcaaatgcaaatgcagacgcagatgcaagtgtaatgaaatgaaaaattaatttaatgatgttattgtggaaaatatcacaccagagtccaaggcgaatgaattcaaggttaagcttcttcttgtttcttctgtctcgctttcactgtgggttttgatcaacttgacttactttctttcactttcctaatttgctcattaaaagtgattagtgttcatagtcttagtttgagtgattgtgtgtttgacaatcaagcgtcactcccattttcttggagtaaacttctttccaatgtttattgagaattcatgttattgcgcatcattgaaggattgtggtccttctaattatgcattctaccttgcttagttgctctctccttcactttcggggatgcctaacagcctgcttctgcaatgtaagacctctgtttctagatttttatctgaaattctcagccatttcttagattcgtcagcgtgacaataatgtcttttctagtatgtaactggatttccgtggggtgttagtgaagtgaataaagacccatctgctcatttctctctaaaaaaaaaaaaaaaaagggcggccgc

SEQ ID NO: 1143 - DNA, 421 bp, Glycine max
  Predicted polypeptide sequence is orthologous to G801
gggtcgagctctactctattgttatcagcgtcttttcacagaaccacatcgtcttcttatggtctcgcgccgtaataataagactaacacatgtccaactatgctggaaccgctaacgccgtccttgctaacgacgtcaacaacatcacaatcgttgagtaccagcagcgaaccaccaccaccaccaccgccgacgccgtcgccctcgccgtcaagaaaccgccttccaaggaccgtcacagcaaggtcgacggccgcgggcgccgcattcgcatgccgatcatctgcgccgcccgcgtcttccagctcacgcgcgagctcggccacaagtccgacggccagaccatcgagtggctcctccgacaggcggaaccctccatcatcgacgctaccggctccgggaccactccggcgagcttct

SEQ ID NO: 1144 - DNA, 1219 bp, Zea mays
  Predicted polypeptide sequence is orthologous to G801
gctgggggtgtggttttttttttacaaaaaaaaagaagccgcttttataaatggctccacaccggaggggccaaggactggcgcggccctatccctatccggctatccccatcggcttcctccccacaagtcgtgtccaccaccatcccccgcgcggcccgcgcgccccgagacagtgcgtggccatggcctctcgcgacggcgccaccttccaagtgtaccgggccatgcccgcgccgacgccgatgtctctggcgtccgccgctccagccgcagccgccgccgacgccgcggcgccgaagaaggcgggcgcgggcgcgggaaaggaccggcacagcaaggtgaacgggcgcgggcggcgcgtgcggatgccgatcgtgtgcgcggcgcgcgtgttccagctgacccgcgagctggggctcaagtcggacgggcagaccatcgagtggctgctccggcaggccgagccctcgatcctggcggccacggggtccggcaccacccccgccgtcttctcctgctcctccgcaccgtccacctccgcggccagcgccggtgccggcgccggcgccggtgtctccctcccgctcctcgggaagcgcccgcgcgaggagcacgagccggcggtggcggtggcagtggcgccggcgccgttctgggccaccctgcaggcgcggcccgtggcggcggcgtgggggctctcgccggcgcaggaggcggcggcgcaggcgtacgcgtcggtggcggcgcagggacaccacctcaacctgctctccgtgctctccggcgccgcgaggcagtcggaggaggagtcccggtgactgcctgcatgccgccgccgccgcactgttgctacgtaatcgcatgcgtcgacgcgtggtggcatgccgcgcgcatgcgtctcgtttccgtgcatctccggggggtgcgttgcgcgtgttttccctgtggttttgcggtgtgagaggaacgcggcgagctggacaaggaggatccagagcgcgagatcggatcggggttagcggctgtagatagcattcgtcaggttcgtgtttgtgataatgagctcgccgtagcgcgcgcggtggttatgtggtgtggttatgtatgcatgcatgcatgccgaattgtcaactgatctgaatcctaacactaaataatgcattgcacgtcccggtgtgtgcaattccgcaaaaaaaaaaaaaaaaagggcggccgc

SEQ ID NO: 1145 - DNA, 544 bp, Glycine max
  Predicted polypeptide sequence is orthologous to G849
aaacaagttaaggatgacagtaaaactctacttcaaactggaatttctcatcataacgagttggatgctttgggtttcaccctggagcctaattcttcacaaagcctaccgattgtatgtgcttcacattctcctcgtcctaaagctgacataactgagcctgtaataaggtatccctccagtccagctgtaattcatcagaggattcaaggcaactctgacatgttacctgagcatcaagtaaccagtttaggtagacattttgaaagtgaccatgattcagcaccttctcctgtcaatgtgtctgttgacaaaaatatgaaagattccaaagaactggttactgttcctgaaatggatgaggaactagctatggtacctgtacaccagaagccaaagcgatctgagatcgtccagcgtcgaatacgcaggcctttttctgtagatgaagtagaagcactggttcaagcagttgaaaaactaggaactggaaggtaagatttacattagacttggtttggcttgacaattatatttaatgggt

SEQ ID NO: 1146 - DNA, 464 bp, Glycine max
  Predicted polypeptide sequence is orthologous to G849
accgattgtatgtgcttcacattctcctcgtcctaaagctgacataactgagcctgtaataaggtatccctccagtccagctgtaattcatcagaggattcaaggcaactctgacatgttacctgagcatcaagtaaccagtttaggtagacattttgaaagtgaccatgattcagcaccttctcctgtcaatgtgtctgttgacaaaaatatgaaagattccaaagaactggttactgttcctgaaatggatgaggaactagctatggtacctgtacaccagaagccaaagcgatctgagatcgtccagcgtcgaatacgcaggcctttttctgtagatgaagtagaagcactggttcaagcagttgaaaaactaagaactggaaggataaatggaaaacactggtgcacacggcaagaatatcccctcagcataggaggggtgaacctgttccccaagaact

SEQ ID NO: 1147 - DNA, 2804 bp, Glycine max
  Predicted polypeptide sequence is orthologous to G849
  misc_feature (7)..(7): n is a, c, g, or t
  misc_feature (33)..(33): n is a, c, g, or t
aaaagcnggagctccaccgcggtggcggccgcnctagacccagcggccgcgaaaaaaaaaagaaaaaagaaaatgaaaacgaaaacttcacgttcctgaaagagagagagagagaaagttaaggacttaaatggtttgtttcagttcgtgaattccattagatctcttgcatttgtaaacagttttgcggggtttttgctttgtacgcaacaagttgtacttttttttcctgtgtcggaaaatgagtttcatcggaaacttcgttacttgatcgaagtttggttcatcggatcgagttcgaatgctgttttttcaggagtgacaaaagaatctggtgtatttatgcttctggttattggatgagctgtatatgttttaactatggtgttgaagaagagagtagatcatggatttgatggcttacgagttcctgttatacctaaagctcctagatctgcaagaaggaggattgctttcaaaaaagcagttgaagatggtcaagtttgtgctattgaactactggcatctttagctggtcagttgttgcaggagagtgaaggttctgcttccagcaatgcatctgaaggaaatcatcatcccccctttagccaaggtgtcattgagcaagatatacaagatggagttaaaccattaaagaaggaggaaattcatcagggaagttgtgtagagagtacttttaagaccgaggtagcctcacaaaaagtagtttcagacctctttcacataccaagactggacatgtttcagttaataatagttctgactgttgtgagaaagctgaagctgatgtgaagtctgaaattttcgaatgggataataaatttgggaattattctaatagattagtagaaacacgtgaaaaatttagggtgtccactcatggtaacataaagaatggatttaaatgggaacaggaggctggaagttcatgcattcggggatcaaatttagctgataagtgtagtttggaggatcacttagaattgtatgtatctcctgcactaattgactcgaaaagtaatattaaatctccatttcataggaaattttttcccagtgcttccttttccaggtatgggaatggcattaagttaggttttagagatgatgacgaaaactttttaaggtgcaaaaagttttgcacgaagccaaaggcttttaggtctccacgacgcattgcacaccgaagaatcaggaatttgatgtcttccaaatactggaagacagctccaaagttgaaggactctgaactttctagatctgatctaggagtacctcgttatcataagaggaagacttgttacggttttgaaagatctcagcacaatgccattgttaaaaagaggaaattcgttgaccgggtttcaggagtaacttctgatggaggattcagtagtgagagtgtgtccaattcaccacagaaagggatggatggagacaagcctagctcatctgcaaaattgcatgtacctaaggctaaggattctcatgtaaagtttagcataaagtcaataaggattccagagctttatattgaggttcctgaaacttcaactgttggttcactaaagaggactatcgtggaggcagtgatggctatacttggaggtggtgcacatgttggtgttcttcttcaggggaaaaaagttagagatgacaatagaacacttgtgcagactggtatatcttgcaatgaaaatttggataccctgagtttcatgttggagcccacttcactacaagcttctccaactgtttgtgttggtgatccttcttctcaatgtgaaacatcccagcctaccaggtccacagaaattcctgtcttagattcaggaattactgataccttgcacgactcacccttgctgacatatccgggcaacctaattgaaagtaaccatgagtctacttcttcacttgcggacactacacttgacaaactaacacctgattccagagcgatagttgttgttccagctaccacagaaacattagctgtggttcctgtgagtcagaaaaccaagcgctctgagtttgtacagcgtcgaaccaggagaccattctctgtgactgaggtagaagcacttgttcatgcagttgaggaactcggaactgggaggtggcgtgatgttaagttgcgagcttttgagaatgcagaccataggacttatgtagacttaaaggataaatggaaaacattagtgcacaccgcaacaatctcccctcaacaaaggaggggagagccagtacctcaggagctcttggacagggttttggctgctcatgctttctggtctcagcaccaagccaagcaacatggcaagcatcaagctggaccaggaaccttgaagattacagaagcctcagctgaaagaccttgtgtgtgttgaaggtgagaaggtgtccacttgtgatatgatgatggtgtagaaaggagtggtggtgttgacaggaaaagaggaagacaaaaacttgtacattttgatttgattcaatttcatgtaatattctcacaccaaattctttgccggccattaattgcatgcagggttggcatttgtaaatgatttgatgcaataagattgttctaacaggaacttatgatgttctttgatttttttttcttgatttcttttgcatttatgaatgtttgtagaaatgtaaaaagaacatagaacatgacgacccaaaggaaaaggtgaaaatgttcttgttattatctttcatttcatttatggaaattattgttcccacttgtttgatacttcacttcctgtttgctg

SEQ ID NO: 1148 - DNA, 2046 bp, Glycine max
  Predicted polypeptide sequence is orthologous to G849
  misc_feature (1566)..(1567): n is a, c, g, or t
gcggccgcccttttttttttttttttaaaagaaagtaaaatttcttatctcaactactttaagtatgccaatatgtgtattactattattcatttaatattatcatttagacttatacagcgattagctcttttttattcatggataagctctagctacactcattaacattattagctcctgtgggtccataattcaatttgcagataaacttctatcatcaacacgtgcatccacgtgcccctccactccagttacacaccgaaccttgactttggagtgaaaacctatgacgcaaattctctataggcatcaccttgttctaattttacatgatagataaagtgtgacattgtactaaaaatcaaagtgataaacacactttgtcataaatacaggaagaagaaaaaatgataaatgacacttttaacaaaggcacgtggtggtgtcaagtccttattaaaggagaaggcaaggttttgtagagtggtgcttgagctgttgcttagtctgctgctgggaccaatatgcgtgggcagttaggaccctgtccaaaagttcttggggaacaggctctcccctcctttgctgagctgatattcttgctgtgtgcaccagtgttttccatttatcctgcacttcaaatccacgtatgtccgatgctttgcattgtcaaatgcacgaagtttaacatcgcgccaccttccagttccaagtttctcaactgcttgaaccaatgcttccacttcagcaacagaaaagggcctacgaattcggcgtggtgcgatctcagttcgctttgacttctgatgcacaggtagtacagctagtgcctccatacccatttcaggaacagtaataagttcttttgaatctgtcaaatttttttcacctgatgtgttgattggagaaggtgctgaatcatgatcactttcaacaaggttacctgaactggttgcttgatgcttggctaacatgttagaaaagccctgaatcctctgatgaattacagcaggacttgaagggtaccctattaaaggctgaggcatatctgcactaggaatgtggagagaatctgttgtagcacatgcagatggtcggtttcgtgaacaattaggctccaaggcgaagcccaaagcatccaggtggttatcatgagaaattccagtctgaagtagagttttactgtcatctctaaccttctttccatggagaatcacacccacacgcaatccgcctccaagtacagcagtcactgcctccatcactgtcctcttcaaggacccaacggttgcagtttctggaatctcgataaaaagctcgggcactctaaatgatttgatcctaagcttcactggataaaagaaagacatctccatgtaagaacccctttgaagacctcgggccgatctcagagtacataaagaatcattccctcaatcttcccataccgtaagaatctctagatcgtaatgcagagtgtcccaaggatgatgttccatgatcttggctcattccagaagatgaacaagaaacactttggttcgtgtcattcttgggtgaatnngcgaagtgtcatcacttctgatatatccgttagagtttgcaccagagcggcagttaaaaagcttcctctttttgaaaggaatattcatctgagaactttggtgtttattgcagttcctcttgctgaggtaagttcgcttccaatctccatcattgttagaaagtgcataattctttgttttttcagcaactttctgaaagttagaagccattcttttacctatacaagtctttggcctaaaggacttggtttcagtatttatagggtgagtacacccagaagagttttcatcatcatctctactaactactggtacattgtcacgacttttggacaacaagctacagggaatcctatcattatacccagacaatttggcattgccacctaaactgatcaatgcaggaggatttacatccaaagggtcctcaaaattacacatgtcaatcccactaccaattggcacccggacgcgtggg

SEQ ID NO: 1149 - DNA, 519 bp, Glycine max
  Predicted polypeptide sequence is orthologous to G849
ggctcgaggttcattacacttgatagtaacatatttgctctgtataccttgtgaacagtaaagtttagcataaagtcaataaggattccagagctttatattgaggttcctgaaacttcaactgttggttcactaaagaggactatcgtggaggcagtgatggctatacttggaggtggtgcacatgttggtgttcttcttcaggggaaaaaagttagagatgacaatagaacacttgtgcagactggtatatcttgcaatgaaaatttggataccctgagtttcatgttggagcccacttcactacaagcttctccaactgtttgtgttggtgatccttcttctcaatgtgaaacatcccagcctaccaggtgagccaaattttacgacgatttctttttatcaccacagctgatttatgaagggaaatggccaaggttaatttatggggtagaaataatgattcagttctattcagccgaatttttattgtgatactattgctaatgtcattatttg

SEQ ID NO: 1150 - DNA, 730 bp, Glycine max
  Predicted polypeptide sequence is orthologous to G849
cggacgcgtgggcggacgcgtgggtggaacctttggatacatggctcctgaatacttcatgtatggcaaagtaaatgacaagattgatgtctatgcattcggtgtaatgcttattgagcttttttcatggagaaagcccatatgtggtgattatcccaaaggtcaagagagccttgtcatgtggtcaagtccaattctaaatagcggaaaggtgttagtcactaaagaggactatcgtggaggcagtgatggctatacttggaggtggtgcacatgttggtgttcttcttcaggggaaaaaagttatagatgacaatagaacacttgtgcagactggtatatcttgcaatgaaaatatggataccctgagtttcatgttggagcccacttcactacaagcttctccaactgtttgtgttggtgatccttcttctcaatgtgaaacatcccatcctaccaggtccacagaaatttctgtcttagattcatgaattactgataccttgcacgactcacccttgctgacatatccgggcaacctaatggaaaagaaagttgatcctacttcttcaattggggaaactacttttgaaattctaacaacctgattacagactgaagatgtggcttcagctaccacaaaaacataagctgggggtcctggggagtaaaaaaaaccaagcccttctgagttttttaaagcgtcaaaacctggaaaacaatttttttg

SEQ ID NO: 1151 - DNA, 588 bp, Zea mays
  Predicted polypeptide sequence is orthologous to G849
tgttcattaaggtcccagaaaatgcaaccattggatcactgaaggtaaacactagatgggcatacagaagttattgctaagcaatcgtgcattcatttggcatcccaatattctttttggtgatgttgttgttaatttactatacagtgtaattgatgaaatctgcaaggttgcaagagcgcacttgagttcatagatttatctttttcattccacagttggtacgctggattcagttgactgtcatgttagatttctgcatttgaggtttattgcaatgtggaataatgagtcttcacaatagttttactggtatacagagcaaataaataatttttttagtaacagtttgtagttcgtctatgcctacagagagctgttatggatgttgtcaatagtataatggaaggcggcctacgcgttggtgttcttcttcaaggaaaagatatccaagacgacaacaagacactttgtcaggctgggatatgccacgataaaaagctaaataacatagacttcacgctggagtgcgagcgtgagcgcgagcctccctctggagtcattgtacaagaacagatggatttcctc

SEQ ID NO: 1152 - DNA, 479 bp, Zea mays
  Predicted polypeptide sequence is orthologous to G849
aaaaaaaaggggggggggttggcaaaaccacacaaactaatggggttccttgggaccccccttttaacctggttttttataacccacagttttaacaaaagaacaagttttccttggaaaaaaaaatctaagaaaaaggaagagccgggggggggggtttgcccaaaaccctcccctggtgttggtgggggaaccagaaggcctgccctagaagaacccggtttaaaattttttggggaaccgggtgccctttcggtgggggggggaatatgctcgcagggaaaaccagggttttccatttgtccttggggccaacggaggcccggggatttatttgggcgagggcgagggtttaaaagggtttcccctttccagcccaaaggtggtggaccgttcccaccagcgcttaaacctcgcggaaggggaaggcgctcctaaggcgccttggcccggtttaaaacccttgggatttacaaggg

SEQ ID NO: 1153 - DNA, 2526 bp, Zea mays
  Predicted polypeptide sequence is orthologous to G849
ggatcctaaggcgaagtctgaggtccaggacaaggaatcctccatgatcagctatacgaaggctgaattgggttgtaattttggtgtgatcgcagacaggtggtcgcctgaatccgtggaatcaggagccttcacaggagatgcagtggcgagactgatgatgacggccccggcaggatttcataagaatgcacccgaaatgtatagtttgcttgattcaatggatgtggatgtcaagccgcctcctttggtcagctctgacagcaccggcgagatgccattgcatggcgataaaattcaccgctcaacctccttaccgaggggcccaaagggggtggggttttttgctgtagatagagatgatgacgacgacaagtcctcagggtgcactcatccgagcaccgccactaacaaggatttcacatccaattgtaaagctgagtataatagggtaaggaagctgctcactagtaagcacaggaaagttgctccagcgaggattcacaaatctgatctttcctatagtgatgtcgagcggaagccttctttccggtacaaaaaaatgcatacacgacagaggacacaaaggagtacattcaagcggaggaagctctttgatcgccatttagctctagcatctgaatttggtacagcaaatggaaagggaaacacaaaggttgccggaagaaactccaatgctgtgtctttggaagcaaacaaggggactaattcaatgccattccagaaatcttgtgggtcaaatgattgccatgtgaaacttagaattaagtcttttaacgtgcctgaacttcttgttgaaatcccagacagtgcaactgttggctcactaaagaaaactgttctcgaggcagtgactgcgattcttggaggtggcctacgtgttggtgttcttcaccatggaaagaaagtcagagatgatagtaaaacgttaattcaggctgggattggtcaggatgatatgctggacaaccttggcttttcacttgaacccaactgtactcaaaacccacaagtccaagctcctgaagatgtcagtttcctcgaaaacattgatactaccgaacccctcgcaaggatcacacctgctgactcgtcttctaagcttggtgaagttgacgtatcacaggagcttgcattaaccccattagcaatgaactaccagggcagtgatcatgattccgtgcactcccctggggctgtctcgtcgcgcgataaagactcgcgagccttatttctggttccagctgcagatcccaatgcaggagctgtagttccagcaaataagactaagaggtcaccagagcagggacaccgcagaatcaggcggccgttctctgttgctgaagtagaagcacttgtgctcgcagtcgaaaagcttggaaccggaaggtggcgagatgttaaacttcgcgcttttgacaatgcaaagcaccgtacctacgttgaccttaaggacaaatggaagacgctggtacacacagcgagcatctcgccgcagcagcggcgtggcgagccggtgcctcaggagctgctcgaccgggtcctggcggcccaggcctactggtcccagcagcaagccaagctccagccgaagacgccctcgctggctgaggctcgcttgctcacccaataattcgatgatcccggctgatggcctcctctgaggccgttgcagcctttgtataaagtcagtaagtcagtcagtcccttcacaggaggtttaatgaaaatataatattaggggaaaaaaagaatgcatatataaggtacaagaagcattgaccgatttgttgtaatatctactcaccaccggttattctttaagccaggattctctctccttgtgaatttaaccaaaggaaagggcatttctttggcaattgtacattttgatgatggaagaagaagatgatccatgaactgagatctgcagtgtctacctactaatggctcacaatttttgcaattgtgattaagaaattcaaggtgctgcttgaccaagctcggctccggcttccagtttttggattctcttgtgaagaagttgctgcctcttttttatacagcagaagctgagagccgaacagtgtatttggcttgaattgcagcctatatagtttcatccactcatacagacggccacaaatgccgtaaaaggagggtagcttcttttgctgagtctagtcttgggagcaaagctcaggaccgaagtctagacttgagacggagcgggggccaaagcggcacccgaatgaaagcttcagattcttttgttcagttaaattcattctttggtagtggagactgacggaaggataggagattaggtggggtggatctttggttctctttttctcttttcttcttctattattacattattagttgtattaatgtactatattattttaccaatcttgtagttaccctcaaatttgtaattggtgaaattaacaaaattgaaggagatacatttctaccacttcgctaaaaaaaaaaaaaaaa

SEQ ID NO: 1154 - DNA, 1528 bp, Glycine max
  Predicted polypeptide sequence is orthologous to G864
ccacgcgtccgggaatctctctctctctctctctttctttccctttttcactttctcattcattcttattagtatttctatttcacttcaccaacccactccaccgtttcccctttccttccatgctattatggcttcatcttccatcaaacacactcaccaccttaaccgcacaaaactcttcatgaaagaagaaacccttttgaaaaagaagcatcactatcccaaaatcatacgaatacgtgtcaccgacgccgacgctaccgactcctccagcgacgacgacgagccctccatgtcctccacgcgccgcagagtaaaaaacttcgtcaacgaaattaccatccaaggcggcggcggtggtggtggcgacgttaacgttgtttctaagaaaagaagattcaagtccggtgccggagctccgttatgtcggcggaagacgggggcgaaagaagttccgggggagtgaggcagcggccatgggggaagtgggcggcggagataagagacccgtcgcgccgcgtccggctgtgggctgggaacctacgacaccgccgaggaagctgccattgtgtacgacaacgcggccattcagctgcgtggcgccgacgcgctcaccaatttcataacgccgccgccggagaacagaaaaaccggttactgctccggcgaggagtctcgcaacaacgacgacttgcgttcccccacttcggttcttgggcgctgttcggtgtccgaggaagctgtaactgcaaacgacgtatttggaggctctagtgagtgcgagtattcatgcgtttcggagtcagtgtttcctattcctaacgaggtggtgtttgactttgaaagcacgttagatatgtttgatgaagggattaataatgttgtggcagagactagtatattcttggcggaggatttagatttgggttttacgagttggcatagagagtgtgataatttccaagacattgggggggatttgtttgtttgggatcctcttgtcgctctttgattgagacacagacaccattctctcgtctttgtaattctattgccaacgaaaatgggttgctatcagttttgtttcttttgggggtttaggcaaaaaccttgtgtctaaggagaggttttctaattttttattctagcagtatatgtttattaaccactagttgtaaaaccgtgcttcccacggtgttgccgtctttttgtttcttatataaaattatgtctcataaaaaaacccacgcgtccgtggttctatttgtttgatggccatcttgcacgtcctgatcttattgtgttcaagtgacagacaaatcagaacagggaagagagatttgaaatgtaaatgccaagtgaaagtgaaaagtacagtccagttttagtgatctctttaatttatttgttcatagattaatatgatggtgtatgattgcttttctatttattgtggcatttttgtgttgtaccctgttgttgtgtttgcaataagtattagtaataaagcagcaaattcaatttc

SEQ ID NO: 1155 - DNA, 587 bp, Glycine max
  Predicted polypeptide sequence is orthologous to G864
ctctctctcatcctttttccctttttcctctctcacccactccctcactccaccgttttccctactactcctttcaacgtcaatgctacccccaataatctaacaacatgactgcgccaccatccaagtacactcaccactccaaactactcattccctccgaagaagaccctcccaaacacccctatcccagactcgtcagaataaccgtcacagacaccgaggccacagactcctccagcgacgaagaacagcatacttccacgcgccaccgacacagaaagttcgtcaacgagatttctatcgagtcgtcgtgcgccagcgagaacgacggcgccgcttcgaggaagagaattcgaagaagaagcaccgctacgcccaaaggcagagcttcagacactcggctcgtgtccaacggcaagaaattccgcggagtgagacagcggccttggggaaaatgggcggcggagatacgagacccgtctcgacgcgttcggttatggttgggtacctacgacactgctgaggaagctgctttggtgtacgacaacgcggccattaggctgcgtggaccccacgcgctcaca

SEQ ID NO: 1156 - DNA, 1232 bp, Zea mays
  Predicted polypeptide sequence is orthologous to G864
ctcgtctgtctctccttgcctgtgcgcttcggttattagctagctagcttgggtctagtctagtgtaactcccggccgccatctttgctgtacttcgttcgtccatgtcgcgctcgcgcacggtgcggatcttctgggacgatcctgacctgaccgattcctccggcgacgacgagggctgcggagcccggagggtcggcagaatggtgagggagctggcaccagcaccagcaccggcaccagcggctcttcccgtgccggatcagtgcaacgccggggacggcgaccgcgggaggaaggccggcgtcgctggtcccggcgtgtgcagcggggcgcggagacgggtggccaagggcgccggtggcccggcgagcaccaagttccgcggcgtgcggaggaggccgtggggcaagttcgcggcggagatccgcgacccgtggcgcggcgtgcgcgtctggctcggcaccttcgacaccgcggaggaggccgcgcgcgtctacgacaccgccgccgtccagctccgcggggccaacgccaccaccaacttcgccgcgtccgccgccactaacagcggctccggggccggggccgggcaggacccggcgacgacaccggcagcgggctacgagtccggcgcggagtcgtcgccgacgtccgtgctccgcaaggtcccctccctgtcctccctcgccgaggacgactccgacgcgccggccgccgagcgccgcagcctggccgtcctcgaggaggaggagctgggcgagttcgtgccgttcgaggacgcgcccgtctacgccaccagcggcttctgggacttcgagcccgacgcggggttcctctacgccgagccgtcgtcgccggaggcgtcgtggaatgccgccgccgccgtcgccgagcccgcctcgtctgacgacgcgcccagctgggccgcgtcgccggtgcaggagaacgactacttccaggacctgcgcgacctcttcccgctcaaccggcttcccgcgattttctgaacaggtggacggggaacgccggaaccgggaacggcgccgctggttcgtctaccgggatgttattttggacgtcgagagtgcgctgtgtctgtgtctgtgtctgtgtcgtgcctacgcgcaccgtgtacttgtacgcctttccccacgccgtttttgttactatcttcgagtcgatgagaaatgtggaaatatgctgccgaacgatgagcacgtagagttttg

SEQ ID NO: 1157 - protein, 299 aa, Oryza sativa
  Orthologous to G864
MSRSRTVRIFWDDPDLTDSSGEDEGCGGRRVGSMVRELPPAQMPVAQAGFAPAAAAAAAALPEQCSGGDGDMGRRVVGGGCTVGVGRRRLTKDGGPGAPSTKFRGVRRRPWGKFAAEIRDPWRGVRVWLGTFDTAEEAARVYDNAAIQLRGPSATTNFSASTNSAGAQDPVAVGYESGAESSPAVSSPTSVLRKVPSLCSLAEDKDDYEAGPCEPATAAGSNLTVLEEEELGEFVPFEDAPVYGGSSFWDFEPESGFLYAEPSSPETPWDAGATSSGEAQDYFQDLRDLFPLNPLPAIF

SEQ ID NO: 1158 - protein, 373 aa, Oryza sativa
  Orthologous to G864
MEEGFVALKRTEHVEVTSLAVAVEATPSAKGGKGKVVVGGGGAGGGVGPTRVRVFCDDFDATDSSSDEDEEEVTARRRVKRYVQEIRLQRAAAVAVPPVKVKGEEVFPAAVSAKMAEAAKARVVLAAGRKRKAGGVDGAEPRFRGVRRRPWGKYAAEIRDPWRRVRVWLGTFDTAEEAAKVYDTAAIQLRGRDATTNFNQSGDSASLDVPPEVAERVPQPPGASKNASPATSYDSGEESHAAAASPTSVLRSFPPSAVVATADTANKKQPPPPPLVVRETDESVDVFGCSFSDDGGFAGELPPLYTDFDLLADFPEPPLDFLSNLPVEPFSLAPFSSNNGSPDLHLDDAPSPAAAQVDDFFQDITDLFQIPVV

SEQ ID NO: 1159 - DNA, 471 bp, Glycine max
  Predicted polypeptide sequence is orthologous to G867, G1930
gtttgtacatcttttggtttggggcgaaagttcatccttttcatatatgcatcaatttcaacagataacaacgcgatctggtcagtcttctatgcttctgcatacactctagggtttccttttcctaactcgttcttctcttcaatatatgcgggtctatttgaaacgattgaggggggtagagcgaagccttcttcgatgattacatcgtcggagaaggtttctctgtccccgccgccgtcaaacagactatgccgtgttggaagcggcgcgagcgcagtcgtggatcctgatggcggcggcagcggcgctgaggtatagtcgcggaaactcccctcgtcgaagtacaagggcgtggtgcctcagccccacggccgctggggtgcgcagatctacgagaagcaccagcgcgtgtggctggtaaccgttctctaggaagacgaggcggcactgtcgtacgacataccagcg

SEQ ID NO: 1160 - DNA, 1952 bp, Glycine max
  G3451 Predicted polypeptide sequence is orthologous to G867, G1930
attcggctcgccctcgacccgaatcggctcgacctctctttgctacctcttagtcaaacaaagtaacaaaccatcctcccctctcttctcttcttttgttctctagatttcttctctcttgtttcttagaatccgtacaatctaatcaacataacaaaaatggatgcaattagttgcatggatgagagcaccaccactgagtcactctctataagtctttctccgacgtcatcgtcggagaaagcgaagccttcttcgatgattacatcgtcggagaaggtttctctgtccccgccgccgtcaaacagactatgccgtgttggaagcggcgcgagcgcagtcgtggatcctgatggcggcggcagcggcgctgaggtagagtcgcggaaactcccctcgtcgaagtacaagggcgtggtgccccagcccaacggccgctggggtgcgcagatttacgagaagcaccagcgcgtgtggcttggaacgttcaacgaggaagacgaggcggcgcgtgcgtacgacatcgccgcgcagcggttccgcggcaaggacgccgtcacgaacttcaagccgctcgccggcgccgacgacgacgacggagaatcggagtttctcaactcgcattccaaacccgagatcgtcgacatgctgcgaaagcacacgtacaatgacgagctggagcagagcaagcgcagccgcggcgtcgtccggcggcgaggctccgccgccgccggcaccgcaaactcaatttccggcgcgtgctttactaaggcacgtgagcagctattcgagaaggctgttacgccgagcgacgttgggaaattgaaccgtttggtgataccgaagcagcacgcggagaagcactttccgttacagagctctaacggcgttagcgcgacgacgatagcggcggtgacggcgacgccgacggcggcgaagggcgttttgttgaacttcgaagacgttggagggaaagtgtggcggtttcgttactcgtattggaacagtagccagagttacgtcttaaccaaaggttggagccggttcgttaaggagaagaatctgaaagctggtgacacggtttgttttcaccggtccactggaccggacaagcagctttacatcgattggaagacgaggaatgttgttaacaacgaggtcgcgttgttcggaccggtcggaccggttgtcgaaccgatccagatggttcggctctttggggttaacattttgaaactacccggttcagatactattgttggcaataacaataatgcaagtgggtgctgcaatggcaagagaagagaaatggaactgttctcgttagagtgtagcaagaaacctaagattattggtgctttgtaacgttacgttaggttttttttttctttttttttttcgggagtttttgtgactgatgaaagaaagaaggtacaagaacggcggtgtagtggcatggcaagttgctgcaaagtgcaaaaggtgaattgtatattacttaatattattagatgttgaaattaggtgtaatgtaacaaaaactgtacaagaagaagaaaaaaggttttaagaaggggagaagaaaaataaaaataaaagatatcatatgaaaactgtttaatggtatatgttgataatattgttgaatgtatgttcatggcatctgatgttgtttttttttctttttttagttgtgtgggggttgagggaagtaaacatgggtttccaaaaatatctttgttgattgttgaacgcgcacacaacaaacaatttttttggttggtgaattaaaagtagtatgatggttgaggaaactaattaattttcgtggtgtattttgggtaatcataatgaggcattttgtcaggttgtgagaattgctattataattagacaaatgttaccaagtgttttaaatatgttatttgtattttttataaaaaaaaaaaaaa

SEQ ID NO: 1161 - DNA, 1651 bp, Glycine max
  Predicted polypeptide sequence is orthologous to G867, G1930
attcggctcgggctcatctatctttgcttccccttagtcaaacaaagtaacacaccatccatcctctctctcttctcttcttctgttctctagtttcctgctcttgtttcttagaatccgtacggtctaatcaacacaacaaaatggatgcaattagttgcctggatgagagcaccaccaccgagtcactctccataagtcaggcgaagccttcttcgacgattatgtcgtccgagaaggcttctccttccccgccgccgccgaacaggctgtgccgcgtcggtagcggtgctagcgcagtcgtggattccgacggcggcggcgggggtggcagcaccgaggtggagtcgcggaagctcccctcgtccaagtataagggcgtcgtgccccagcccaacggccgctggggctcgcagatttacgagaagcaccagcgcgtgtggctgggaacgttcaacgaggaagacgaggcggcgcgtgcgtacgacgtcgccgtgcagcgattccgcggcaaggacgccgtcacaaacttcaagccgctctccggcaccgacgacgacgacggggaatcggagtttctcaactcgcattcgaaatccgagatcgtcgacatgctgcgtaagcatacgtacaatgacgagctggaacaaagcaagcgcagccgcggctttcgtacgttcgccgcggctccgccggccggcgccggaaacggaaactcaatctccggcgcgtgtgttatgaaggcgcgtgagcagctattccagaaggccgttacgccgagcgacgttgggaaactgaaccgtttggtgataccgaagcagcacgcggagaagcactttcctttacagagcgctgctaacggcgtttagcgcgacggcgaacggcggcgaagggcgttttgttgaacttcgaaagacgttggagggaaagtgtggcggtttcgttactcgtattggaacagtagccagagttacgtcttgaccaaaggttggagccggttcgttaaggagaagaatctgaaagccggtgacacggtttgttttcaacggtccactggaccggacaggcagctttacatcgattggaagacgaggaatgttgttaacgaggtcgcgttgttcggaccggttgtcgaaccgatccagatggttcggctctttggtgttaacattttgaaactacccggttcagattctatcgccaataacaataatgcaagtgggtgctgcaatggcaagagaagagaaatggaactcttttcattagagtgtagcaagaaacctaagattattggtgctttgtagcgttacgttactttttttgagttttttttttttttgagttttgtgactgatgaaagaaagaaggtacaagaagaacggcggtgtagtggcatagtggcatcgcaagttgctgcaaaaggtgaattgtatattacttaatattagatgctgaaatattaggtgtaatgtaacaaaaaactgtacaaggagaagaaaaaaggttctaagaaggggagaagctagaagaaaaaaaatgatgtcatcatgggataactgtttaattgtatatgttgataatattgttgaatgttgattattatgttcacggcaaaaaaaaaaaaaaaaaaaaaaaactcgagactagttcc

SEQ ID NO: 1162 - DNA, 1483 bp, Glycine max
  G3452  Predicted polypeptide sequence is orthologous to G9, G867, G993, G1930
ttgactcgtgggcggacgcgtgggctcaggttcctcctatatatatatatatatacatacataatatccttctccctcaaaccaaaccatacctattctcaagtttctctctgtttcttcctacttcatgctatagcacttacaatactcaacaataacctaaccaaaccaaaccaaaccaaaacccttatctgcactcacttcacacaaaccaaagttaattaattaccaacacaaaatggatggaggctgtgtcacagacgaaaccaccacatccagcgactctctttccgttccgccgcccagccgcgtcggcagcgttgcaagcgccgtcgtcgaccccgacggttgttgcgtttccggcgaggccgaatcccggaaactcccttcgtcgaaatacaaaggcgtggtgccgcaaccgaacggtcgctggggagctcagatttacgagaagcaccagcgcgtgtggctcggcactttcaacgaggaagacgaagccgccagagcctacgacatcgccgcgctgcgcttccgcggccccgacgccgtcaccaacttcaagcctcccgccgcctccgacgacgccgagtccgagttcctcaactcgcattccaagttcgagatcgtcgacatgctccgcaagcacacctacgacgacgagctccagcagagcacgcgcggtggtaggcgccgcctcgacgctgacaccgcgtcgagcggtgtgttcgacgcgaaagcgcgtgagcagctgttcgagaaaacggttacgccgagcgacgtcgggaagctgaatcgattagtgataccgaagcagcacgcggagaagcactttccgttaagcggatccggcgacgaaagctcgccgtgcgtggcgggggcttcggcggcgaagggaatgttgttgaactttgaggacgttggagggaaagtgtggcggtttcgttactcttattggaacagtagccagagctacgtgcttaccaaaggatggagccggttcgttaaggagaagaatcttcgagccggtgacgcggttcagttcttcaagtcgaccggaccggaccggcagctatatatagactgcaaggcgaggagtggtgaggttaacaataatgctggcggtttgtttgttccgattggaccggtcgttgagccggttcagatggttcggcttttcggggtcaaccttttgaaactacccgtacccggttcggatggtgtagggaagagaaaagagatggaactgtttgcatttgaatgttgcaagaagttaaaagtaattggagctttgtaacattacatagtttttgagtttcttttgtgaattttgtaactgttgaattcatgaggtagagatggtgatggtgttgttgcaagttgccactcacaaaaggtgtatagtctcagacaaaaagaaaaaggaaaaattagggcaagaaaaattgttgaacagaaattttcttaacaaaaaaaaaaaaaaaag

SEQ ID NO: 1163 - DNA, 1443 bp, Glycine max
  Predicted polypeptide sequence is orthologous to G867, G1930
acgagtatagctcttaaaatactcaacaataaccaaacctaatcaaaacccttatctacactcacttcacacaaaccaaagttagttcgttaaccgttacaaacacaaaatggatggaggcagtgtcacagacgaaaccaccacaaccagcaactctctttcggttccggcgaatctatctccgccgcctctcagccttgacggaagcggcgcaaccgccgtcgtctaccccgacggttgatgcgtctccggcgaagccgaatcccggaaactcccgtcctcgaaatacaaaggcgtggtgccgcaaccgaacggtcgttggggagctcagatttacgagaagcaccagcgcgtgtggctcggcaccttcaacgaggaagacgaagccgtcagagcctacgacatcgtcgcgcatcgcttccgcggccgcgacgccgtcactaacttcaagcctctcgccggcgccgacgacgccgaagccgagttcctcagcacgcattccaagtccgagatcgtcgacatgctccgcaggcacacctacgacaacgagctccagcagagcacccgcggcggcaggcgccgccgggacgccgaaaccgcgtcgagcggcgcgttcgacgcgaaggcgcgtgagcagctggtcgagaaaaccgttacgccgagcgacgtcgggaagctgaaccgattagtgataccaaagcagcacgcggagaagcactttccgttaagcggatccggcggcggagccttgccgtgcatggcggcggctgcgggggcgaaagggaatgttgctgaactttgaggacgttggagggaaagtgtggcggttccgttactcgtattggaacagtagccagagctacgtgcttaccaaaggatggagccggttcgttaaggagaagaatcttcgagctggtgacgcggttcagttcttcaagtcgaccggactggaccggcaactatatatagactgcaaggcgaggagtggtaaggttaacaataatgctgccggtttgtttattccggttggaccggttgttgagccggttcagatggtacggcttttcggggtcgaccttttgaaactacccgtacccggttcggatggtattggggttggctgtgacgggaagagaaaagagatggagctgtttgcatttgaatgtagcaagaagttaaaagtaattggagctttgtaacattacatagtttttgagtttcttttgttaattttgtaactgttgaattcgtgaggtagagatggtgatggcgttgttgttgcaagttgccactcacaaaacgtgtatattcttaatttgatgggaaaaaaaaggagaaattagggcaagaagaattgtataatgcaaaggtttttttcaaaagaaaggaacatggagtgccactatttatttttgtaaaaaaacagagaaaagggcggcccgc

SEQ ID NO: 1164 - DNA, 425 bp, Glycine max
  Predicted polypeptide sequence is orthologous to G867
cgtgcttaccaaaggatggagccggttcgttaaggagaagaatcttcgagccggtgacgcggttcagttcttcaagtcgaccggaccggaccggcagctatatatagactgcaaggcgaggagtggtgaggttaacaataatgctggcggtttgtttgttccgattggaccggtcgttgagccggttcagatggttcggcttttcggggtcaaccttttgaaactacccgtacccggttcggatggtgtagggaagagaaaagagatggaactgtttgcatttgaatgttgcaagaagttaaaagtaattggagctttgtaacattacatagtttttgagtttcttttgtgaaatttgtaactgttgaattcatgaggtagagatggtgatgtgggttaaaaaataaaaaaaaaaaaaagggcgg

SEQ ID NO: 1165 - DNA, 405 bp, Oryza sativa
  Predicted polypeptide sequence is orthologous to G867
gcggatgaggtgtgacgtcgaagcccgcacgcgcgtggccacatcgtcgaggtacaaggggtgtcccagccgaacggcgtggggggccagatctacgagcgccacgcgcgggtgtggctcgggacgttccccgacgaggaggcggcggcgcgggcctacgacgtggcggcagctccaggtaccgggggcgcgacgcggccaccaacttccccggggccgcggcgtcggcggccgagctcgcgttcctcgccgcagcactccaaggccgagatcgtcgacatgctgcggaagcacacctacgccgacgagctccgccagggcctccgccgcgccgctctagagatccaagcttacgtacgcgtgcatgcgacgtcatagctcttctatagtcacgtaatcatctgc

SEQ ID NO: 1166 - DNA, 381 bp, Oryza sativa
  Predicted polypeptide sequence is orthologous to G867, G1930
gcacgagggctcacctttcctcagcttagctagctagctgctcgatccggcggcgtgatcgagtcgatctctctgattctatcaggtgttcgaccagattccatcgatggacagcacgagctgtctcttggacgacgcgagcagcggcgcgtccacgggcaagaaggcggcggcggcggcggcgtcgaaggcgctgcagcgcgtgggcagcggggccagcgcggtgatggacgcggccgagcctggcgccgaggcggactcgggcggcgagtgcaagggagtcctcctcaacttcgaggacgccgccgggaaggtgtggaaattccggtactcctactggaacagcagccagagctacgtgctcaccaaggggtggagccg

SEQ ID NO: 1167 - DNA, 441 bp, Zea mays
  Predicted polypeptide sequence is orthologous to G867, G1930
agccgcgcgcagcccacgccggcctgggcgcgcgtgctgctgttcgacaaggcggtcacgcccagcgacgtcggcaagctcaaccgcctcgtggtccccaagcagcacgccgagaagcacttcccgctgaagcgcgcgccgccgtcggtggaggcgcaggcgcccaccaccgccaagggcgtgctcctcaacttcgaggacggggagggcaaggtgtggcggttccgctactcctactggaacagcagccagagctacgtgctcaccaagggctggagccgcttcgtcagggagaagggcctccgagccggggacaccatcgtcttctcccactccacgtacggctcggagaagcagctcttcatcgactgcaagaagaccaagacgacgacgcccgccaccgacggggtaccggtaccattaccagcaccagcggagaaa

SEQ ID NO: 1168 - DNA, 576 bp, Zea mays
  Predicted polypeptide sequence is orthologous to G867, G1930
gccggccgggcctccatatcctacaacacttcccgcaacagttgcatacgccgtgcccatctatctatagctagcactaggagtggtgcacactgaaatggacagcgccagcagcctcgtggacgacaccagcagcggctgcggaggcggcgcgtccacggacaagctaagggctttgggcgtcttcgccgacgactcggtgacgccgctggagcgcatgggcagcggcgccagcgcggtcgtgaacgcgcccgaggcgggcgccgaggcggactccggctccggtgccgccgtggtgagcgtcgacgggaagctgccgtcgtccagggacaagggcgtggtgacgcaggccaacgggcggtggggcgcgcagatctacgagcgccaccagcgcgtgcggctcggcaccttcgcgctcgaggccgacgcggtgcgcgcctacgacgtcgcgaagcagcggatccgcggccgcgacgcggtcaccaacttccgcccgctcgcggacgccgacccgtacgcggcgacgagctccggttcctggtgtcccgctccaaaggcgaggtcgtcgacatgctc

SEQ ID NO: 1169 - DNA, 471 bp, Zea mays
  Predicted polypeptide sequence is orthologous to G867, G1930
cccacgcgtccgcccacgcgtccgcgcaagcgcaacagaagcatactacgccgctacgcgctgggcggtgccgcacagctatagatagctagcagtgttgcatagaaatggacagcgccagcagcctcgtggacgacaccagcggcagcggcggcggcgcgtgcacggacaagctaagggctttggccgccgccgccgcctccgcctcggggccaccgccggagcgcatgggcagcggagccagcgcggtcgtggacgcggccgagccgggcgccgaggcggactccggctccgccccggcctccgtcgccgccgtcgcggcgggcgtgggcgggaagctgccgtcgtccaggtacaagggcgtggtgccgcagcccaacgggcggtggggcgcgcagatctacgagcgccacctgcgcgtgtggctcggcaccttcgcgggcgaggccgacgcggcgcgcgcctacgacg

SEQ ID NO: 1170 - DNA, 497 bp, Zea mays
  Predicted polypeptide sequence is orthologous to G867, G1930
  misc_feature (221)..(221): n is a, c, g, or t
ctgcttttgttttctgtgcgtaccgctccaaggctcgaggttcgtggacatgctccgcatgcacacatacttatgcgagctcacgcacaacaagatgcgccttcggcggcgagacgctgtcaccagatggtctctggcctataacccttacttactacgcgtcaggtatacccggggaccgagatgggaagaaccgtcgccggcgcgggagacacctgttnagacacagaaagtcaccatcggcgacaaacgcaagcagaaccggctggtgatccccaagcaccacgccgagaagcacttacagctgcagatcccgtccgtcggcgatgagagcaatggcgcgctcctcaacctggaggacgaacagggcaaagtgtggcggctccactactcgcactggaacagcagacaaagctacctgctcaccaacggctggagccaatgggtaaaagagaatggccttcaacccggagacgtagtaggcttatagcgctccg

SEQ ID NO: 1171 - DNA, 604 bp, Glycine max
  Predicted polypeptide sequence is orthologous to G867, G1930
ggacaagcaccagcgcgtgtggcttggaacgttcaacgaggaagacgaggcggcgcgtgcgtacgacatcgccgcgcagcggttccgcggcaaggacgccgtcacgaacttcaagccgctcgccggcgccgacgacgacgacggagaatcggagtttctcaactcgcattccaaacccgagatcgtcgacatgctgcgaaagcacacgtacaatgacgagctggagcagagcaagcgcagccgcggcgtcgtccggcggcgaggctccgccgccgccggcaccgcaaactcaatttccggcgcgtgctttactaaggcacgtgagcagctattcgagaaggctgttacgccgagcgacgttgggaaattgaaccgtttggtgataccgaagcagcacgcggagaagcactttccgttacagagctctaacggcgttagcgcgacgacgatagcggcggtgacggcgacgccgacggcggcgaaaggcgttttgttgaacttcgaagacgttggagggaaagtggtggggtttcgctactcgtattggaacagtagccagagttacgtcttaaccaaagggtgggagccgttggttaaagaaaag

SEQ ID NO: 1172 - DNA, 772 bp, Mesembryanthemum crystallinum
  Predicted polypeptide sequence is orthologous to G867, G1930
  misc_feature (1)..(1): n is a, c, g, or t
  misc_feature (24)..(24): n is a, c, g, or t
  misc_feature (27)..(27): n is a, c, g, or t
naaaacatagttcagagtgatggnggncgcgtcgacctccccgcctcccctaggcggcagcttatgccggatggggagcgggacgagcgtgattatcgactccgagaacgggatcgaagccgagtcgagaaagctaccctcatccaaatacaagggagtggtcccacagcctaacggccggtggggtgctcaaatctacgagaaacaccagcgggtctggctcggtaccttcaatgaggaggatgaggctgcacggtcttatgatgtcgctgctcagcggttccggggccgagacgcggttactaacttcaagccgctgtcgtcggaggaggaggctggggcggccgagctccggttcttgaattcccggtcgaaggccgagattgttgatatgctgaggaagcatacttatcatgacgagctacaccagagccgccgtaacttgaagctgctgtttgaggctgatagggcggggtgcaatagtggtaataataagtccagcctggatattatgggttataatatccacactgtacggtgatcatgacccacccgcgaacagctttttgggaatagtcttacccccagtgctgtggtaaagcttacccgctggtgattccatactgtacgcctagaagtatttcttttttcaggccttattgtcctgctcctttcactttttgcttctcccttctaacacttttcctctccaaaggctcttctgtttattttatgcttccacgccatgcgtgttgtctctttctttctctgg

SEQ ID NO: 1173 - DNA, 681 bp, Lycopersicon esculentum
  Predicted polypeptide sequence is orthologous to G867, G1930
cttcctaattttccttttctcatcaaaaaagacaaaacaacacacacaccaaaaaaaaaatggaaggaagtattagtagcatagatcaagagagtactactagtgactctctctccattgctccggccgcgtcgtcatcgacgatgattaaatcgtcgacgacgataaaactgccgccggagagtggtctttgccggatggggagtggaacaagtgtgataattgatgctgaaaatggtgttgaagctgaatcaagaaaactcccatcttcaaggtacaaaggtgtggtcccacaaccaaatggtcgttggggcgcacaaatctatgaaaagcatcagagggtatggttaggcacattcaacgaggaaaatgaagccgctagggcttatgacatcgcggcccagagattcaggggccgcgacgctgtaactaatttcaaacccttgcttgagaatcaagaaagcgatgacatggaaatcgctttcttgaattcacattccaaggcggagatcgttgacatgttacgtaaacatacgtatatcgatgagttggaacaaagcaagagattgtttggatttactaaagacggtatgataaaaaggaaagatggactagtaattagttcgttctttggtagtaaaaatgataaagtcaattgcaaagcgcgtgaacagctatttg

SEQ ID NO: 1174 - DNA, 740 bp, Solanum tuberosum
  Predicted polypeptide sequence is orthologous to G867, G1930
cttcctaattttccttttctcatcaaacaaaacaacacacacacaaaacaaaaaaagtttcaaaaaatggaaggaagtattagtagcatagatcaagagagtactactagtgactctctctccattgctccggcggcatcgtcgtcaacgatgataaaattgtcgacgacgataaaaccgccgccggagagcggcctttgccggatggggagtggaacaagtgtgataattgatgctgaaaatggtgttgaagctgaatcaagaaaactcccatcttcaaggtacaaaggtgtggtcccacaaccaaatggccgttggggcgcacaaatctatgaaaagcatcaaagggtttggttaggcacattcaacgaggaaaatgaagccgctagggcttacgacgtcgcggcccagagattcaggggccgcgacgctgtaacaaatttcaaacccttgcttgagaatcaagaaagcgatgacatggaaatcgctttcttgaattcgcattccaaggcggagattgttgacatgctacgtaaacatacgtacctcgatgagctagaacaaagtaagagattatttggatttactaaagatggtatgataaaaagaaaagaatggacaataattaagttcgttttttggtagtacaaatgataaagtcaattgcaaagcgcgtgaacagctatttgaaaaagctgttacaccaagtgacgttggaaagctaataggcttgtgatacc

SEQ ID NO: 1175 - DNA, 785 bp, Hordeum vulgare
  Predicted polypeptide sequence is orthologous to G867, G1930
  misc_feature (556)..(556): n is a, c, g, or t
gacgccgcgcgcgcctacgacgtcgccgcgcagcgcttccgcggccgcgacgccgttaccaacttccgcccgctcgcggacgccgaccccgacgccgccgccgagctccgcttcctcgccgcgcgctccaaggccgaggtcgtcgacatgctccgcaagcacacctacttcgacgagctcgcccagagcaagcgcgccttcgccgcgtcggccgcgctctccgcgcccaccacctcgggcgacgccggcggcagcgcctcgccgccctccccggccggcgtgcgcgagcacctcttcgacaagaccgtcacgcccagcgacgtcggcaagctgaacaggctggtgataccgaagcagaacgccgagaagcacttcccgctgcagctcccggccggcggcggcgagagcaagggcctgctcctcaacttcgaggacgatgcgggcaatgtgtggcggttccactactcgtactggaacagcagccagagctacgtcctcaccaagggctggagcctcttcgtgaaggagaagggcctccgggccggagacgtcgtcngggttctaccgctcccccagccgggaggaccgtgaagacaggaagttcttcattgactgcaagctgggggcaaaacccaacacgtcggccaaacatagcccggggaaattggtgggggtcggtgcaaaaggcgagagaattttcgtgagtatctaatagatgacaaggtccaggggagcagggggagagatggagggagactgggctaaggagaggggggagtagagac

SEQ ID NO: 1176 - protein, 365 aa, Oryza sativa
  G3388 Orthologous to G867, G1930
MGVVSFSSTSSGASTATTESGGAVRMSPEPVVAVAAAAQQLPVVKGVDSADEVVTSRPAAAAAQQSSRYKGVVPQPNGRWGAQIYERHARVWLGTFPDEEAAARAYDVAALRYRGRDAATNFPGAAASAAELAFLAAHSKAEIVDMLRKHTYADELRQGLRRGRGMGARAQPTPSWAREPLFEKAVTPSDVGKLNRLVVPKQHAEKHFPLRRAASSDSASAAATGKGVLLNFEDGEGKVWRFRYSYWNSSQSYVLTKGWSRFVREKGLRAGDTIVFSRSAYGPDKLLFIDCKKNNAAAATTTCAGDERPTTSGAEPRVVRLFGVDIAGGDCRKRERAVEMGQEVFLLKRQCVVHQRTPALGALLL

SEQ ID NO: 1177 - protein, 317 aa, Oryza sativa
  G3389  Orthologous to G867, G1930
MEQEAAMVVFSCNSGSGGSSSTTDSKQEEEEEEELAAMEEDELIHVVQAAELRLPSSTTATRPSSRYKGVVPQPNGRWGAQIYERHARVWLGTFPDEEAAARAYDVAALRFRGRDAVTNRAPAAEGASAGELAFLAAHSKAEVVDMLRKHTYDDELQQGLRRGSRAQPTPRWAREPLFEKAVTPSDVGKLNRLVVPKQQAERHFPFPLRRHSSDAAGKGVLLNFEDGDGKVWRFRYSYWNSSQSYVLTKGWSRFVREKGLRPGDTVAFSRSAAAWGTEKHLLIDCKKMERNNLATVDDDARVVVKLFGVDIAGDKTR

SEQ ID NO: 1178 - protein, 393 aa, Oryza sativa
  Orthologous to G867, G1930
MDSSSCLVDDTNSGGSSTDKLRALAAAAAETAPLERMGSGASAVVDAAEPGAEADSGSGGRVCGGGGGGAGGAGGKLPSSKFKGVVPQPNGRWGAQIYERHQRVWLGTFAGEDDAARAYDVAAQRFRGRDAVTNFRPLAEADPDAAAELRFLATRSKAEVVDMLRKHTYFDELAQSKRTFAASTPSAATTTASLSNGHLSSPRSPFAPAAARDHLFDKTVTPSDVGKLNRLVIPKQHAEKHFPLQLPSAGGESKGVLLNFEDAAGKVWRFRYSYWNSSQSYVLTKGWSRFVKEKGLHAGDVVGFYRSAASAGDDGKLFIDCKLVRSTGAALASPADQPAPSPVKAVRLFGVDLLTAPAPVEQMAGCKRARDLAATTPPQAAAFKKQCIELALV

SEQ ID NO: 1179 - protein, 394 aa, Oryza sativa
  G3390 Orthologous to G867, G1930
MDSTSCLLDDASSGASTGKKAAAAAASKALQRVGSGASAVMDAAEPGAEADSGGERRGGGGGKLPSSKYKGVVPQPNGRWGAQIYERHQRVWLGTFTGEAEAARAYDVAAQRFRGRDAVTNFRPLAESDPEAAVELRFLASRSKAEVVDMLRKHTYLEELTQNKRAFAAISPPPPKHPASSPTSSSAAREHLFDKTVTPSDVGKLNRLVIPKQHAEKHFPLQLPPPTTTSSVAAAADAAAGGGDCKGVLLNFEDAAGKVWKFRYSYWNSSQSYVLTKGWSRFVKEKGLHAGDAVGFYRAAGKNAQLFIDCKVRAKPTTAAAAAAFLSAVAAAAAPPPAVKAIRLFGVDLLTAAAPELQDAGGAAMTKSKRAMDAMAESQAHVVFKKQCIELALT

SEQ ID NO: 1180 - protein, 415 aa, Oryza sativa
  Orthologous to G867, G1930
MEFTTSSRFSKEEEDEEQDEAGRREIPFMTATAEAAPAPTSSSSSPAHHAASASASASASGSSTPFRSDDGAGASGSGGGGGGGGEAEVVEKEHMFDKVVTPSDVGKLNRLVIPKQYAEKYFPLDAAANEKGLLLNFEDRAGKPWRFRYSYWNSSQSYVMTKGWSRFVKEKRLDAGDTVSFSRGIGDEAARHRLFIDWKRRADTRDPLRLPRGLPLPMPLTSHYAPWGIGGGGGFFVQPLAAGHALRAPPQARPRLPRLQPRRRDGEAGPPVRLGEDSSASTTAGARAVAAAPPLHAAAERRWCKGGGLTGGARLGSGHREPHDGREARAAVRREPRQPACRRRRRRRRRRVEQSWQCTVIADARVDEEGSNTAAAGIASSPPPWRRVVRCIVSVVVVFLQEGRAFGLGSRSVAT

SEQ ID NO: 1181 - protein, 420 aa, Oryza sativa
  Orthologous to G867, G1930
MEFATTSSRFSKEEEEEEEGEQEMEQEQDEEEEEAEASPREIPFMTSAAAAATASSSSPTSVSPSATASAAASTSASGSPFRSSDGAGASGSGGGGGGEDVEVIEKEHMFDKVVTPSDVGKLNRLVIPKQHAEKYFPLDSAANEKGLLLSFEDRTGKLWRFRYSYWNSSQSYVMTKGWSRFVKEKRLDAGDTVSFCRGAAEATRDRLFIDWKRRADVRDPHRFQRLPLPMTSPYGPWGAARGRSSCRPATLFEHHRFRQGFDFRNINPAVPARQLVFFGSPGTGIHQHPPLPPPPSPPPPPHQLHITVHHPSPVVTAGLPMVVDSVPHVNNPAAASKRVRLFGVNLDNPHPDGGQSSSGHDANALSLRMPGWQRPAPLRSLELPPHMPAGAAGAESSAASSPSSSSSSKREAHSSLDLDL

SEQ ID NO: 1182 - protein, 401 aa, Glycine max
  G3451 Orthologous to G867, G1930
MDAISCMDESTTTESLSISLSPTSSSEKAKPSSMITSSEKVSLSPPPSNRLCRVGSGASAVVDPDGGGSGAEVESRKLPSSKYKGVVPQPNGRWGAQIYEKHQRVWLGTFNEEDEAARAYDIAAQRFRGKDAVTNFKPLAGADDDDGESEFLNSHSKPEIVDMLRKHTYNDELEQSKRSRGVVRRRGSAAAGTANSISGACFTKAREQLFEKAVTPSDVGKLNRLVIPKQHAEKHFPLQSSNGVSATTIAAVTATPTAAKGVLLNFEDVGGKVWRFRYSYWNSSQSYVLTKGWSRFVKEKNLKAGDTVCFHRSTGPDKQLYIDWKTRNVVNNEVALFGPVGPVVEPIQMVRLFGVNILKLPGSDTIVGNNNNASGCCNGKRREMELFSLECSKKPKIIGAL

SEQ ID NO: 1183 - protein, 351 aa, Glycine max
  G3452  Orthologous to G9, G867, G993, G1930
MDGGCVTDETTTSSDSLSVPPPSRVGSVASAVVDPDGCCVSGEAESRKLPSSKYKGVVPQPNGRWGAQIYEKHQRVWLGTFNEEDEAARAYDIAALRFRGPDAVTNFKPPAASDDAESEFLNSHSKFEIVDMLRKHTYDDELQQSTRGGRRRLDADTASSGVFDAKAREQLFEKTVTPSDVGKLNRLVIPKQHAEKHFPLSGSGDESSPCVAGASAAKGMLLNFEDVGGKVWRFRYSYWNSSQSYVLTKGWSRFVKEKNLRAGDAVQFFKSTGPDRQLYIDCKARSGEVNNNAGGLFVPIGPVVEPVQMVRLFGVNLLKLPVPGSDGVGKRKEMELFAFECCKKLKVIGAL

SEQ ID NO: 1184 - protein, 362 aa, Glycine max
  G3453 Orthologous to G867, G1930
MDGGSVTDETTTTSNSLSVPANLSPPPLSLDGSGATAVVYPDGCCVSGEAESRKLPSSKYKGVVPQPNGRWGAQIYEKHQRVWLGTFNEEDEAVRAYDIVAHRFRGRDAVTNFKPLAGADDAEAEFLSTHSKSEIVDMLRRHTYDNELQQSTRGGRRRRDAETASSGAFDAKAREQLVEKTVTPSDVGKLNRLVIPKQHAEKHFPLSGSGGGALPCMAAAAGAKGMLLNFEDVGGKVWRFRYSYWNSSQSYVLTKGWSRFVKEKNLRAGDAVQFFKSTGLDRQLYIDCKARSGKVNNNAAGLFIPVGPVVEPVQMVRLFGVDLLKLPVPGSDGIGVGCDGKRKEMELFAFECSKKLKVIGAL

SEQ ID NO: 1185 - protein, 399 aa, Zea mays
  G3433 Orthologous to G867, G1930
MDSASSLVDDTSGSGGGACTDKLRALAAAAASASGPPPERMGSGASAVVDAAEPGAEADSGSAPASVAAVAAGVGGKLPSSRYKGVVPQPNGRWGAQIYERHLRVWLGTFTGEAEAARAYDVAAQRFRGRDAVTNFRPLAESDLDPDAAAELRFLASRSKAEVVDMLRKHTYGEELAQNRRAFAAAAASLASPQLPPAKNTSPAAAREHMFDKVLTPSDVGKLNRLVVPKQHAERFFPAAGAGSTQLCFQDRGGALWQFRYSYWGSSQSYVMTKGWSRFVRAARLAAGDTVTFSRSGGGRYFIEYRHCQRRRRDVDISFGDAATVPAWPRPIVIGTAAMNNGGATVASATIAGHDIEVAVAPSGARSFRLFGFNVECSGDDAPAPAPAPAEVEYVDGDT

SEQ ID NO: 1186 - protein, 392 aa, Zea mays
  Orthologous to G867, G1930
MDSASSLVDDTSSGGGGGACTDKLRALAVFAAASGTPLERMGSGASAVVDAAEPGAEADSGSGAAAVSVGGKLPSSRYKGVVPQPNGRWGAQIYERHQRVWLGTFAGEADAARAYDVAAQRFRGRDAVTNFRPLADADPDAAAELRFLASRSKAEVVDMLRKHTYFDELAQNKRAFAAASAATASSLANNPPSYASLSPATATAAAAAAREHLFDKTVTPSDVGKLNRLVIPKQHAEKHFPLQLPSAGGESKGVLLNLEDAAGKVWRFRYSYWNSSQSYVLTKGWSRFVKEKGLQAGDVVGFYRSAAGADTKLFIDCKLRPNSVAAASTAGPSPPAPVAKAVRLFGVDLLTAPVTAAAPAEAVAVAGCKRARDLGSPPQAAFKKQLVELALV

SEQ ID NO: 1187 - DNA, 2493 bp, Glycine max
  Predicted polypeptide sequence is orthologous to G869
  misc_feature (1707)..(1707): n is a, c, g, or t
gtatttttaaaaatataaaattctcagtctggcgtgtttttatagagatttgcgttcgtttcactctctgtgtcaaggttggcttttttttttttctcttttctttttcttctggatttattgagcttgtttcacccaagtcacatgccagtgttttcgttagagcgataaaaactagtgttttgttgtacgggaagatacaatcttggccttagatttgtaatattttatctggggaactagaccagactgtttttgtttttgtttttgttttgttttttggttatatatatcagtttctttcacctgttgatgctcttttctctcctgcttgggcgagtgaagaggtgagagagcagataaaagcttgaggcttgatttctgcgtttcttggagaatttgtcttcaaaaaaagaaggggcagcagtggatttatgtcgtctgggtttattctggcagtgattggggctccgttgaagctcttcattgtttatgtttccgtttttttcttcctgactcgcttcgtgttctactgttgctgtatgctacactgcatcctgaaccacaatactgtgaacccatctgtttcaatgcgattgagaccaaaaaggacttgttgtggagtggagtgtttcggaggctttcacatacaaagattttcttatctcttcatattcttaagaggggatttcacctgataccttgagagattttgttaccctaccctttttttcttcgtttcttactttgagatttcctttctttgattccatttggtttcctttctgggtattctgaggggtttttggagggtttttctttctcattttttttccaccatgcccgagtctcggaaacaaccggcttctagaccgaagcaaaagcttcatcaccactccttgcaagagtccaaggcgatgagaaaacttcgcatcatttgcgacgatcctgatgctactgattcatccgaagatgagactgagaaggttcagagcccgagaagagttaaaagaaacgtgtctgagatctctcttccccctcttcctccaccattcaccaccactcctgaaaccagctcctgtgaggtgaatagcggcaaaaatgcaacattgaagggtttcattgaaggtcaaccccagagtaagaagagggttttgactcaccccccatcaacaaggaggaacacttctgggaaattcagaggtgttaggcagagaaaatggggtaaatgggctgcagagattcgtgacccctttcagagtactcgtatatggctcggcactttcaacactgcagaagaggcttcccaagcctacgaggccagaaggcttgagtttgaggctatggcagaggctcaagcttacaaaactagttctgtttctgaacctttggctacaatttctgataataagagtaactgctgtaactcttctgccgctgctatctccgccgctgccgtctccgccgctgcatgtgtctgtatctgagaagttttctactacttttgatgacttagaagagagtgtgttgtctcacaattcaccatcctctgtgctagagttggatacattggcttccaaatcccttgagaagggtaatgtttcaaccgaggaagctattgaggctaatgatttggtggctgaacttgcagggttagaggtaccagatgtcagtctgttaaacttgttaccaccaccatctgattcntggtggtgcagctgctgctgtttcatctgggattgagccaaactttgggcttgattttgattggctatcgtttaatgattatggacaaggttttgatgatttcggtggcttggaagatattcatattggtgggtttgatgacaatgagcctactgagcttcctgattttgattttggtgattttggtgctgatgagtttgctggttggattgaggagcccctgaatataccttgtgcctaaggttttgcagagctacgtaggaatatgaggctagatttctacaatattataagttttgttatttataagttagtctttctgtgagatctcaggaatgatgagttagtttttctgtgggatctcaggaatgatgagtgagtgaatggttactatatgcgttttacatttcatttgtttttgatggagttgttagttagagcagtgagatggtgagagaatcctttgggttttcccgtgctgttaaagagccgtccaagggaatctcgaaccatgatactatgtcgtaatttcaaggttcttcaatggcagagtattaatggaatgaaagttaatgttttgcatcgttttttctccagtctcatagcatatgaattggtcgtctcattgatatttgtctttttattcacgaatttgcccatgtgcgaagatcttttttgtattttcttcatatagtcatcaaaatctcttggctggttgatctgcctaattatcagaatggatcatggtcaccctttatcgattaagattctaaaattggataaaaa

SEQ ID NO: 1188 - DNA, 2337 bp, Glycine max
  Predicted polypeptide sequence is orthologous to G869
  misc_feature (122)..(122): n is a, c, g, or t
tcgaattcgctcgaggaaaaacagataaagcgacagggcagagaaaaagaggttcctatgcattcaccataacagtgaatacacatagggacaggagcaagcataaagtgaaggtcggctanaaaaaggtcttcgattctcgtggcataaacattaaacaaaagggtgctctatgtttttattaatgcaattggggttaattgttttatagagatttgcgcctgtttcaatccgtgtaccaaggtagccacttttttttcttttcttttgttttttctgttaacccagacacaggtgatagatcggtcataaaaaaatatattttgggacagaaaaatcttggccatagatttgtaatcttttcatctcaaaaaatttctcgtgctgttgtgtctctatatatactgtgtagctctatctctaacgttttctctctttttggtcagagggagagtggggtgtgtgtgtttttgttgggatttgtgaggaatccattgaaggaggaagagcgggagatttatgtcgtcttggttttatttggaagtagtgattggagctttgttgaagctcgggttcggttacgcttgtgtttgctgcatgctactctggctggtgttgaattctgctgtttcgatgagtttgaggtcaaaaaggacatgttatggaattctggtttgttatggaggctttcagataaaaaaattctctgctttcttcctcctttggagagtggatctcacttgatgttcttgaaattatgagggattttttttttggtttattaaaaaaaattattttgttttgctgaacaatttttctgggtattttgaggggttttgacccaattttttttaccatggcggagcctcttaatcaatcgactcctaggacgaaaaatatgttacacatgcgcaatccggttcttgtctcgctaatgacccggacactgcgcatcttttgccttgatcctgatcctactgactcttcatctgatgaggatgagtattttgggaatgttaggaagatgatcgagccgctcgagccgctcgagcggctcgaggttccggttaaccctgtggttgcagatgaaactagtactgagagcacaaacaatgatgaattgaaccagacgaagagggttatggcgaaaaccccctcagtgaagaggcaatcttgtgggaaatacaaaggtgttcggatgcggaaatggggcaaatgggccgcggagattcgtgaccctttcaagggcacgcgaatctggttgggcactttcagcactgcagaagaggcttctcaagcctatgagaccagaaggcttgagtttgaggtcatggccaaggctctatctgatgagaagagcaacaatggcagcagcaacaacaatgttgttgcttctgctgaaactgaaactgtggctgcccctgaaaataacagttcaaactattgtgtttcttctgctgcaggttctgtatcagactccaagtctgcttctatggatgaatcagagagtgtgttgtcactcacatcaccatcttctgtgcttgaattggatacatctgctttcaatttgattgggagtggtaaggtttcaagcaatgaagttgttgagactaaaggattggaggctgaagttgctgagactaaaaatttggcagctgaatttgccgagctggaaatgctggaaatgccggatttgagtatgctgaatgtgccatccccatctgctgtcgctgctactgctgctgctccatctgagtttgaattggatttgttggcatttgttgattccgagtatggatttcatgatgagcatgactttgatgatgatcttgctgccctggaagactttcacatttgcggtttcgatgacaatgagcctagcgagcttcccgattacgattttgacgactttggtgctgatgagtttgctggttggattgaagaacccctcaatataccttgcgtatagattttgcagcttcataggaatgagttctatccaagagactagtactactacaacattacaagttgtgtcattgcttaaaaatgctatagttttttgagatctcaggaaaaaactagttcctgggagagttgttttgtcaggtttgttttaatttatttgtttctttagggatggaagatcaatgagaggttaagagacaatgccttggtttttcttgtgctattagagccgtccaagggtttttcaatttctattatcgtgaaagttgagtgtgtagatgtctatcaaacttgaaatctactatctttatcagaaattctatggtatccttggaaaagtaccccgcagaaaaaaaaaaaaaaaaataa

SEQ ID NO: 1189 - DNA, 1855 bp, Oryza sativa
  Predicted polypeptide sequence is orthologous to G869
gtggatccccgggcaccaggcccgttttggtcggggttttagcgagcgcgtgggaggccggaggcgacgacgacgaccgcgccgccgtcggagaagaaggccgcggaagcaccagtaccagcacccgtatatgtcttctagccccttctccgatctggtggtagtcgtgctcctcgtctgcgccgtcgtcgccgcagccgtcctcctccccctcgtctgcgcccgccgatctatgcaccagaggctccacggctggaacaagtccacgtcgatgctcagggacgggttcggggtcaagtattccgggttcctccacataaggccgtgtggtttctgtcgaggagattgacggattcgatcgattcgtgttcgtctccgtcaaatttttgcacaagagaaaaaaaaaagtttcccccttttagagtttttccccttcagttttgtcagttttggtgaggaattttagagttcttttccggcaagagttagaagaagagagaaatggccccttccaagcagcagcagcagatgctcctcaagaaggtgatggcgaagaagcccaagacgaagaggctatccgggtttggccttaaaccctctgctgctttctccaggccccatgtgccgtcggcggcggcctccctgcagccaagccgtcgcgtccgcgtcgtgttcgaggaccctgacgcgacggactccgactctgacgacgacgaggacgccggcgccgcctcaaagaagcgctactttgagctcttcattggcaagccagcttcgtcgacgaagcaggcctctccggcgtccaccgtcgctgcctacgccaacatcggcaaggttgggagcacctgctaccgtggtgtgcgcctccggaagtggggcaagtgggcggcggagatccgcaaccccttcaccggccatagggagtggcttggcacctttgacactgctgatgcggcctccgccgcctaccagtctgcctcccgcaacttcgccgaagagaagcgccgccgtggtgtggcctcctctgcctcacctgctagttcggcgacccctactccgactgcgtcctcgtcgtcctcgacttctgccgcgccattcgcccacccttcgccgtcgtctgtgctcgaagccaccaagccagctccaaagccagagtcgccgccgctgccggagcaagctgcaactcccctcctggtggaggctaccaacgagaccgccgagctgccggatgacccagagttctacaaggatatactgcgcggtctacagctgccggacattgacccgatggatttccgagctgggctggatgctctggatatctccgatgtgccggcttacatgaatggcgaacaagacgtactcttcactgaggacatgctgcttggagacttcgctgaagaagatgacctcgacctcgacgacatcggtgatgacttctgcgaggatttcccagagatacccagcggctacgacttcggccgtggtgatatgttccggcaggtggatttctgcgtgtgaattaagagcttgctaaagttattcaaaaaaaaaaaaaaaaaaaatgagaaaaagtgcttgggaggagatttcttgggttttttccccgagcaaaatcaatctgctcgtgcccttgagatttcagttccgcccataagaactccaacgcacatttagcattcggagagtaattttgttaggttaaaagtatggtaagttataggtggtatgttatgtttttctttttcttttctcaatgttatctggtacctaagtttgtcaagaaaatcatagtggacaagtcaagtatttggggctgtcgtctctgttatggaaagaaaaataagttttgatt

SEQ ID NO: 1190 - DNA, 2245 bp, Zea mays
  Predicted polypeptide sequence is orthologous to G869
cattgggtacctcgaggccggccgcccctttttgctcctctcgccgctttgggtcggggtttaagcgagtgttgagggaggccgtgacggaggcgacgacgacgacggacggacggacggtgccggcgtcggaagaacaagtagccagctctcgtatatgccttcttgccccatctccgatctggtcgtcgtagcgctcatcgcccccgtcgtcgccggcctcctcctcctcctcctccgctccctcgcctgctccagccgatctatgcgcaaggggctcaacggatggaacaaatcctcgtcgatgctcagggacgggttcggggtcaagtattccggattcctccacatacggccgtgcggtttctgtagaggagactgacggattcgtcctcaaggccgtgccgtttctgtagaggaggctgacggattcgaccgatttgcgctcgtctccgttatatttttgcacccagagttttttttgttttttttcttcagaagcttttccccgtagttttggctggagttctccccggcagaggagatacaagagacatggccccgttgaaccaccaccagcatgtcctcctcaagaaggccctggcgaagaaacccaaagctaagcggatgtccaggtttggccttaaaccctccgctgaagccctcctgaagtcccggccgcagcagccggcgcctgccccggcccagccgaggcgccgcgtccgggttctcttcgaggaccctgacgccacggactcggactccgacgacgaggaggccggcgcccctacgtgcccggcggaggccaagcgcttctccttcgaggcgttcgtcggcaaggtcccagccaagccggtccttccggcggccgctgtcgccgcgtgcaccagcggcggggcgccggagcgctaccgcggagtgaggctccgcaagtggggcaagtgggcggcggagatccgcaacccgttcaccggcaagaggcagtggcttggcaccttcgacaccgctggcgcggcctccgcggcctacctgtccgcctcccggagcttcgccgacgagaagcgccgccgccgcgggctgcccgtggccgcgtcctcaccagacactccggcaagcggcagcaccccgacggcttcctcctcgtcgtccgcctcgaccgctccattcgcgcacccgtcgccgtcgtccgtgcttgaaccgagcaaggaagcgcggaacacgcagtccccagaggcgacgcccgcccggccgtcgaccgactcagcgcagctgccggaggacccagagttctaccaggaccttctgcgcggcctgcagctgcccgacatcgacccgctggacttccgcgccgggctggacgctctggatctctccgatgcggacttcggcctggacgacgaacatgacctcctgctcggggacttcggggacgaggagatggagatcgacctcgacctcgacgacatcaacgacgtcttcccggagatgcccggctgcgacctcggccgcggcatggacgacttcctgcaaaccgttgatttctgcgtgtgaattgaaagggagtgtgcccttgatatgttagggttgtttggtttcataaacgagcccctgagagtgtgcttggaaaggggagatgagatatcttgggttttttccccgggcaagttggatctgctcgtgcccaggagatttcctctttgccgaacacaccaccattagcggccggagagaagaggtaattttggtaggttatattatgtttaaggtttaaggtatagtgcctaagtgtttgctttgttatttggtaattggtaatgcttgtcaaagacattgtagtggacaagttcattgagctgttactattaagcaatgaaagggaaaaaaataagtttcgtggtaaaaaaaaaaaaaaaaactcgagcccggggggctcatttaccccatcaggtaccacagagaaatcagtgatcactctagtgtatttacccatggccttagtgacaaagacgaaggggcagacggtcttgcagatgcaacacttgttgtcgcccatcacgaaacggaggcggacgatgcatgtggagcacacgtcgcggtgcccgcacgacccataggccacccactccagcgtatctgcgcacaccgcacaaaagtcttccatggctatctgcgcagctctaatctccgaagtccgaatatatcttcaaatctggtaagatagggatcgattctatctcgaacaggg

SEQ ID NO: 1191 - protein, 444 aa, Oryza sativa
  Orthologous to G869
MAPSKQQQMLLKKVMAKKPKTKRLSGFGLKPSAAFSRPHVPSAAASLQPSRRVRVVFEDPDATDSDSDDDEDAGAASKKRYFELFIGKPASSTKQASPASTVAAYANIGKVGSTCYRGVRLRKWGKWAAEIRNPFTGHREWLGTFDTADAASAAYQSASRNFAEEKRRRGVASSASPASSATPTPTASSSSSTSAAPFAHPSPSSVLEATKPAPKPESPPLPEQAATPLLVEATNETAELPDDPEFYKDILRGLQLPDIDPMDFRAGLDALDISDVPAYMNGEQDVLFTEDMLLGDFAEEDDLDLDDIGDDFCEDFPEIPSGYDFGRGDMFRQDSHASAHLGRGTAQLEATLRRWSEIRIYTNPARVLTGSMLRVADQEYTTATIPLAIAAYGEDKTSKSQTCPYTTTAGDKSVLLREDPKLPRLTDQLPVDMVSSAPDFSTFS

SEQ ID NO: 1192 - DNA, 1262 bp, Oryza sativa
  Predicted polypeptide sequence is orthologous to G877
ttttttttttttttttttcttttttcaccatcagcacttccgatgaatgttttgcctttgtcctgaacactaccaccaccttttttttccaattacaacataaacaaaacgggtaacatcttctgcattcttggcttccaaaaaataaaagcccaaagaaaaaataacaggtaaaagctagaacaacaagagctatgttgtagcatgctaccatgtatagaagctgaagcacatctatcattttcttttctttctttaatattattatttacatctgaggtccaaatgatggaggcctgttcatcatctgttggaaggatgatgaagattggtttaccgcggggaagccgagctgcgacatgggctctgtcttcatctctccttccggaatcatgagcccctggtagccctgcatggtggatggatgaccagcatctttgctggagcaagagaccctagagatggcatgggaatcgccatgcctggcgggaccatcccaaaggggaaattgctcgccgatggtccaaatgtggtttcttggtgggagaacgaaggagctgaagggagccgcgccaccaaactggctgaagctggcttgcccttgttcttgcctgcgctgagagccgttagattgcggtgcagatggagcgtttccagatccagagctcccatgtccactatttctggcagctggaacttcatggttgtgcttcccctcgtacgtcgtgatgacggattttagatcatgcgatgctctctccacgtgcttgcgcaccgaacacccttggtgcgtacatttgtaatagctccttgggtttggatttcctttaacaaccttctgtccatacttgcgccagcggtaaccgtcatcaaggatgtcaacctcacttgttgtctgaacaacaacacgaggctcccggacacctctcgatgccgcagctcccatgtcaatgttactggtggtggtaatagcagcagttgcagctgtcaaagcatccagcttccttctcttggaatcagtctcatctccatccccgttgcactctatagaagccgtgccatgcgttgccctatcatcctcctcattagatagtgttgacgacacatcaactgcatcttgggactccatgatagatgtatcacaattggttgatactggaagacaagcagctgttcttgtttcaataacttcactttgaacatcttgaaggcaatcatttttggcattgtcccacaaggatgcagagttatggccctcgtgc

SEQ ID NO: 1193 - DNA, 1091 bp, Glycine max
  Predicted polypeptide sequence is orthologous to G881
gcacgagcttcaatattctatgttaatttacttgctattgtttgcttatcatcctttcaattaagttatatgtagttgtgcttgatggtcgttcaactcttcaacacagaaatcataatggatgaaaaggtggaaactattaaagctgagttaaaacgagtgagagaggagaacaacactctaagaatgatgcttgaagttctaagcagcaagtacacaaagcttgagacccatcttcaagaaataaacaagacacggcactagggcctgaggtcaaatcaaatagggtcagtaacagtaccacctatgtttcatacaaacaagagaccgagactagagcttcccacagcaaaaaagccattacaaatctttgtcagaacacaccccaaggatgatagtttgatagtaaaagatggctatcagtggaggaagtatgggcagaaggttaccaaagacaatgcttcaccaagagcttatttcaggtgctccatggctcccatgtgcccagtcaaaaagaaggtgcaaagatgcttacatgataagtcaatcgttgttgcaacttatgatggagagcacaaccatgcggccattcatgagtcatcttcatccacatctaaaggctcatcaccagtggttaataacttacctctgatgacaagcatattaaatgacaaagaacccatgaacattggcttggctctttcagggtggtctcaaacagatagaagacattgtgaagatgtcatgcaacagaataataacaatggtggtagcaacatcaaaattgaagaatatgtaagttctctaatcaaggatccagacttcaccatgtcattagctgaagcagttgcccgcaccatcactggccagcagaagcaacaagatctaaacctcaatttggagcttcctgaagagtgaaatcaatcatttttttcccacaaaagccataatgcaagtgtaaagatgaattttagttcagtgaattgtagtccagtagcactgaaaaagcgaggaaaacttctttagaatggtttactttaagaaaacattataggttgttttcgttttccgtttccactttaattgcaaaa

SEQ ID NO: 1194 - DNA, 467 bp, Oryza sativa
  Predicted polypeptide sequence is orthologous to G881
  misc_feature (121)..(121): n is a, c, g, or t
gtggatccccgggctgaggcttctctccttggctcagcttgacatcgtcggagcagcagaaaagtttgctcgatcgagctagctactaggtcgcggatcagtgataaatcgttcgccgatngatccgtggattagcacccagccttcgctgagcctggacctccgcgtcgggctgccggcgacggcggccgtcgccatggttaagccctgcaagcgcatccgcgaggagtgcaagcccaagatctccaagctctacgtccacgccgacccatccgacctcagcctggtggtgaaagatgggtaccaatggaggaagtatggtcagaaggtcaccaaggacaacccctgcccaagagcctacttcagatgctcatttgctcccgcctgccctgtcaagaagaaggttcagagaagcgcggaggacaacacgatcctcgtggcgacgtacgagggggagcacaaccacg

SEQ ID NO: 1195 - DNA, 456 bp, Oryza sativa
  Predicted polypeptide sequence is orthologous to G881
gcacgaggggctgctgcagagccagttcagcgacatggtcaccgccgccggctacgccgaccgaagaccgagtgcacctccggcgagccctgcaagcgcatccgcgaggagtgcaagcccaagatctccaagctctacgtccacgccgacccatccgacctcagcctggtggtgaaagatgggtaccaatggaggaagtatggtcagaaggtcaccaaggacaacccctgcccaagagcctacttcagatgctcatttgctcccgcctgccctgtcaagaagaaggttcagagaagcgcggaggacaacacgatcctcgtggcgacgtacgagggggagcacaaccacggccagccgccgccgccgctgcagtcggcggcgcagaacagcgacggctccggcaagagcgccgggaagccaccccatgcgccggcggcggcgccgccggcgccggtg

SEQ ID NO: 1196 - DNA, 388 bp, Zea mays
  Predicted polypeptide sequence is orthologous to G881
  misc_feature (52)..(52): n is a, c, g, or t
gtcggccgcagccaccgccgccgccgtcttccaccacgagccgggcgagccnccgccgggaggagtggatgtccggggtgtcccggcgatacgtccacgccgacccctctgacctcagcctcgcggtgaaggacgggtaccaatggcggaagtacgggcagaaggtgaccaaggacaacccctgcccgcgcgcctacttccggtgctccttcgcgccgtcgtgcccggtgaagaagaaggtgcagcgcagcgccgacgacaggaccatcctggtggccacgtacgagggcgaccacaaccacgcccagcctccgcggcacaacggcggcggcagcaaggccgcgacgaggtcgacgccagcggcgaccgaggccgcgcgaccggcgcc

SEQ ID NO: 1197 - DNA, 1136 bp, Zea mays
  Predicted polypeptide sequence is orthologous to G881
gtcggccgcagccaccgccgccgccgccttccaccacgagccgggcagccgcgtccgggaggagtgcaagtccaaggtgtcccgcccgtccgtccacgccgaccccgccgacctcagcctcgcggtcaaggacgggtaccagtggcgcaagtacgggcagaaggtcaccaaggacaacccctgcccgcgcgcctacttccgctgctccttcgccccggcctgcccggtcaacaagaacgtgcagcgcagcgccgacgaccccaccatcctggtcgccacgtacgagggcgaccataaccacggccagcccccgccacaggcgcaggcgccgcacgacggctccagccctggcgccagcaagaagccgccgtcgccgccgaggccggtcgccgccgctccggcgccgctccaccaccagcaggtccagcagcaccagcagcagcaggcggttggcgcggtgaaatgcgagccgcccgtggccgcggcggcgtcggagctcatccggcggaacctcgcggagcagatggccatgacgctgacgcgggaccccagcttcaaggcggcgttcgtcaccgcgctgtccggccggctcttcgagatgtcgccgaccaaggactgacggaacggatcggatggattgggcgattggcatcgcaggagattctggatcagattgtcttcgagcgcacgccgcaatggtcaactgcgcagcgctggcttggctgctgcctccgttcactcttcgctgtcagagcgaaacagcggtaacagagcaagacacgaggggtctgcactctgcagttgtgcaggaggaggaacagacacagggagaggagggcgcgcggccggacatggcgtggaacagagatcgtcgtcaccgccggcgggggtgtggtcgacgacgcgacatgcgaaacactacgtgctagctagcataggaaaaaacaacatgaaatcgtacaaccaaccaatccctcgcactgttttagttgttagctgtaggcgaaactgttcatccaattgatcaaatgaaaattatttttccctagcactatgtttcatgagaatgagaccaggaatgaaccaacttgagtttgaaaatttccataggggagtaataataacagaggtatact

SEQ ID NO: 1198 - DNA, 994 bp, Zea mays
  Predicted polypeptide sequence is orthologous to G881
tagcgagtaccgtcgaattccgggcaccccccgcaggtcggctcgacctcagctcaaacatccctactctcctgctcctcttcttcctcctcctctcgctctcaagcgcgtcttcactccggcctagctcggacggatcgacatcgaggggaaagggaataagtgggggcgccagcagatggatccatggatcagcagccagccttctctgagccttgacctgcgcgtcggcctgccgccgctcagcctccaccaggcgccggtggccgtcgccttggccaggcccaaggtgctcgtcgaggagaacttcctgctgcctcccaagaaagaaccagaggtggcggcgctcgagacggagctgcggcggatgagcgaggagaaccgacgcctggcggaggcgctggccgcggtggcctccaagtacgaggcgctgcgcagccagcacaaggagatggtgtccgcggcgcccgccggcgggaacgcgtcgtccgcgtcggagggcgggtccgtgtcgccgtcgcggaagcgcaagagcgagagcgcggacacggcgccggcgcctgcgcagcgcccgcacccggcggcggacctgtcggagtgcacctccggcggcgagccgccgtgcaagcgcgtcgtgcgtgaccgggcggaggaggtggaggaggaggaggagtgcaggcccagggtgacgaagctgtacgtgcgcgccgacccggccgacctgagcctggcggtgagggacgggtaccagtggcgcaagtacgggcagaaggtgaccaaggacaacccctgcccgcgggcctacttccgctgctccttcgccccggcctgccccgtcaagaagaaggtgcagcgcagcgcccacgacgcctccgtcctcgtggccacgtacgagggcgaccacacccacgccccgcccccctcgggctcgggcaagaacgccgcgaagccgccgtcgccggcgcgccgccaggaggctgctgtcgcggtgacc

SEQ ID NO: 1199 - DNA, 838 bp, Zea mays
  Predicted polypeptide sequence is orthologous to G881
  misc_feature (827)..(827): n is a, c, g, or t
cctcgaggccggccgggaccgttcgatccgagtgtcctgcagagcccatcctgttcctgtccccctcgagcaatcgagctcagctgcacgctcgcttacgcggagacacagacgctgagacacacgcaggtcatgatgctgctcatggactcggggagccgcggtgactgctccccggtctgcttggacctcagcgtcggcctttcgccgccgtcgccggggagcggcccggaaacgacagctgacgctgagagactcgaccgccccgccactggctgctgggggccacggacatcgtccctggctgacgggcaggacgaggccaagaccctggaggccaggctcacccaggtcagcgaggagaaccggcggctcaccgagatcatcgcctacatgtacgccagccaggtcgccgcgcggcggagtcccgacggcaggaagaggagcagggacagcctggagccgtcgaattcgggcgacgccaacgctgccgtcgagagcgccgccctcagcgacgagggcacgtgcaggcggatcaagctcaccagggtctgcaccaagatcgacccctccgacaccacgctcaccgtcaaagacggctaccagtggcgcaagtacggccagaaggtgacgcgcgacaacccgtccccgagagcctacttccgctgcgcatacgcaccatcctgccccgtcaagaagaaggtgcagaggagcgcggaggacagcgccatgctggtggccacgtacgagggcgagcacaaccacccgagcccgacgcgcgccggcgagctccccagcttcacctccatcaactcctccggcccggncatcacgctgg

SEQ ID NO: 1200 - protein, 396 aa, Oryza sativa
  Orthologous to G881
MAKMLPPPSQSVPSRPPSWLYIPPRRRHGTFTSSCAFRLSPSSPSSPPPPVLDFQYIQFMDSWIEQTSLSLDLNVGLPSTARRSSAPAAPIKVLVEENFLSFKKDHEVEALEAELRRASEENKKLTEMLRAVVAKYTELQGQVNDMMSAAAAAAVNAGNHQSSTSEGGSVSPSRKRIRSVDSLDDAAHHRKPSPPFVAAAAAAAYASPDQMECTSAAAAAAAKRVVREDCKPKVSKRFVHADPSDLSLVVKDGYQWRKYGQKVTKDNPCPRAYFRCSFAPACPVKKKVQRSADDNTVLVATYEGEHNHAQPPHHDAGSKTAAAAKHSQHQPPPSAAAAVVRQQQEQAAAAGPSTEVAARKNLAEQMAATLTRDPGFKAALVTALSGRILELSPTKN

SEQ ID NO: 1201 - protein, 335 aa, Oryza sativa
  Orthologous to G892
MSSTMPAQGGVRHHRTCRMYWCYQCGRAIRIISYPSTDVFCPRCFGRFLHEIDPPPRPAPPPPHFFPQPYHPHYDGHPRRWLIYGGEAPPVAAPGRAFRQPAPAVPGRAFRQPGPAPAPSPAPAPPRRRMPSPPPVARRPSTPPAIDPGNYFNGPNLNNLIEELTQNDRPGPAPAPSSAIDSLPTVQITGAHLSDGSQCPVCKEDFELGEAARQMPCKHVYHSDCIVPWLRLHNSCPVCRYQLLSSAAAGSNANSRARRGSANNGGGGGGGDGRDREQTIVRWGPFSWMWPPRGLEDPDDGWEYGRRGRPEAGDAGGRMCNDHGNFRKLVTMMDG

SEQ ID NO: 1202 - DNA, 579 bp, Mentha x piperita
  Predicted polypeptide sequence is orthologous to G896
aagttctcccgccacgagctgaagggatgcatcaacgacgctaagtgcatgaaatatcttctgatcaataagttccggtttccagaatcttcgatcctcatgcttactgaagaagaaactgatccgtacagaatcccaacaaagcataacatgcgaatggcgctcttttggctcttacagggatgccaagcgggagattctttggtgtttcattattctggccatggttctcgacaaaggaactacaatggagatgaagttgatggatatgatgagaccttgtgtccacttgattttgaaactcagggtatgattgttgatgatgaaattaatgcatctatagtccggcctgtacctcgtggtgctaagcttcatgccatcattgatgcttgtcatagtggaacagttcttgatttaccatatctctgcaggatgagcaggagcgggcaatatgtatgggaggaccatcgtccaccatctggtgtgtggaaaggatcaagcggtggggaatctattccttcagtggctgtgatgatgatcaaacttctgctgatacatctgctttatcaaaatcacttc

SEQ ID NO: 1203 - DNA, 632 bp, Glycine max
  Predicted polypeptide sequence is orthologous to G910
gcgataatttcatagcttttttcatgtttggaattgaagactaaggaaatggagaaggtttgtgaattctgcacagctttgaggccactcgtttactgtaaggctgatgcagcatatctttgtctttcctgtgatgcaaaggtgcatttagcaaatgcagtgtccggccggcacctccggaacctcgtgtgtaactcatgcggataccaccttgcttatgttctgtgtttggaacacaaaatgttgatatgtcgtgactgtgaccaaaagttgcacaacatttctttgccacataagaaacgagctatcagaagtttcatgggttgcccttctgctaaagactttgcagcactctggggggttgaattgaatgagattgaaaacagtgccactcaggatcagtttggttcagtttcttgtgtttctgcagatttgaatgttgcacaagtttcaggaaagcctggcattcaaactggggtcccttcaatgctatctggggccaaacttgatgggggaggatcaaccagtcaacaaggtcagatattgtatagtgatcaaaagcgtcaaacgattctgcagcagattattgattttaaatggcttcaacaaaatgaggagattgattattctgc

SEQ ID NO: 1204 - DNA, 1147 bp, Glycine max
  G3468 Predicted polypeptide sequence is orthologous to G912
tcgactcgagccgaatcggctcgagccacaactcaactaagcgcaaaccaaaccaacacaaacaaaaacatctctcagcaaatgaatattctcggacaatcactccaccaatcaaacaacggcagctactcttgttcgtcgccggagactgcaaactcctctaaccttccgaccactccgaaagccgttcactccgacgaggaagtgaacacattagcatcggctcatcctaagaaacgtgcggggcgtcgaatttttaaggagacaaggcatcccgtgtacagaggagtgcggcggaggaacaacaacaagtgggtctgcgaggttcgtgttcccaacgacaagtccacgaggatttggctcggaacgtatccaacgcctgagatggccgcacgtgcgcacgacgtcgccgcgctctcgcttcgaggtaagtcggcgtgtctcaacttcgccgactcggcgtggcggttgcccttgccggcgtcgaccaatgcgaaggagattcggcgcgtggcggcggcggctgctgtagcgattgcggcggaagacagccgcggcaagcagttgcggactaatgcgattgatgccgttgctgattgcgaagttagcagcagtgacataggcgtcgatgaaaattgcaataacaataaagcttcgcagaggttttgtgatttggatgaaattacaatgccagatgcaccggtttttgaggacatgcatgagtggcttcagactatggctgctgaaccattaagatcacctacttttgtaacatatgttaatgttagggatgtctggaactttgtggaggatgatgctgaggtttccttgtggagcttcaccgtctgaagagcatgcaatttaggctttaggtgtatttagtgtgtttagctttctttctcttcttttggtttttgtacataattaggaacggaggactacgaaaatgtacaaagaccgaaacgatataaggagatagctatctaggtaggaacataaaagtgtgaaacattgtaacttttctcattcggttgtttttgtaaaataaaaattctattttcatcaatacattatcaaagaccctccctgttagcaatcctccaaaaaaaagagagagaaaaaaaaaaaaaaaaaaaaaaaaaaaagg

SEQ ID NO: 1205 - DNA, 1014 bp, Glycine max
  G3463 Predicted polypeptide sequence is orthologous to G912
caacaacactctcaacaaatgaatattctcggacaatcattcaacgaatcaaacaacggaagctactcttgttcgtcgccggagactggtagctcctctaacattccaaacacttttcactccgacgaggaagtgcacacactagcttcggcgcgtcctaagaaacgtgcggggcgtcgaatttttaaggagacaagacacccggtgtaccgaggagtacgaaggaggaacaacaacaagtgggtctgcgaggttcgtgttcccaacgacaagtccaccaggatttggcttggaacgtatccagtgcctgagatggccgcacgtgcgcacgacgtcgccgcgctcgcgcttcggggcaagtcggcttgcctcaacttcgccgactcggcgtggcggctgcccttgccggcgtcgacaaatgcgaaggagatacggcgagtggcggcggcggctgctgtagcgattgcggcggaagacagctgcggcgagcagttacagaatagtattgtgaatgatgccgttgctgatgattgtgaagttagcagaagtgacgtcagctttgatgaagattccaatagcaacaaaggtttgagagttttttgtgatttggatgaaattacaatggcagatgcaccggtttttgaggacatgcgtgagtggcttcagagtatggcggatgagcctttaagatcgcctacttttgtaacatatgttaatgttagggatgtctggaactttgtggaggatgatgctgaggtatccttgtggagcttcacaatttagtgcgtttagtttgttctttgtcttctttcgtttttggtttttgtacataattaggaacggaggagtacgaaaatgtaccaagaccgagacgatataaggagctagctatatagggaggatcataaaactgtaagacattgcaaattttctcattcagttgtttttgtaattctcataatcatatagataaaggaaaggtttgtaaaataaaaaaaaaaaaaaaaaaaaagg

SEQ ID NO: 1206 - DNA, 1252 bp, Glycine max
  G3465  Predicted polypeptide sequence is orthologous to G912
ctcgacccactcactctatctcttttctccagcagcaccaaaaccacccaacactcgaactcaatatccattattaccaaaaaaaaagaaaaaaggatatcaaacacccttttcatcattaaaactctcagttccctctttccctatcaaaaccctttcccacaacactactcactccagtacaagaaaccctttttcaatttggtttcaacagcacacacacacacacatatatatatatatagcatgtttaccttgaatcattcttctgatttgtaccatgtttcccctgagctctcatcttccttggacacatcctcgccggcttcggagggctctcgtggcgtggcattttccgacgaggaggtgcggctggcggtgaggcacccgaagaagcgggcaggtcggaagaagttccgggagacgcgccacccggtgtaccggggggtgaggaggaggaactcggataagtgggtgtgtgaggtgagggagcccaacaagaagaccaggatttggctggggactttccccacgccggagatggcggctcgggcgcacgacgtggcggcaatggccctgaggggccggtatgcctgtctaaactttgctgactcggcctggcggttacctgttcccgccacggccgaggcaaaggatatacagaaggcagcagcagaagctgcccaggctttcagaccagatcaaaccttaaaaaatgctaatacaaggcaggagtgtgtggaggcggtggcggtggcggtggcggagacaacaacggcgacggcacaaggggtgttttatatggaggaagaagagcaggtgttggatatgcctgagttgcttaggaatatggtgctcatgtccccaacacattgcttagggtatgagtatgaagatgctgacttggatgcccaagatgctgaggtgtcactatggaatttctcaatttaataatgtgttttggtttggtttttgttgttagttttttggagtgaacagtgtctgtactggttttttattagtagtacggatactagttataggtggaaagattgcgagggaccaaaaggaattttcttttgaacccttttttgtcaatgtaatcaatatcacgtatatcatgaagtgaatcccttcaagtttatgtataaattaaataaaagaaaaatctagttttggttatgaatctttgttaaagtagaaatcgttctttggagagtctgcaggccaatgtgcataggctcaaaacagg

SEQ ID NO: 1207 - DNA, 1162 bp, Glycine max
  G3466 Predicted polypeptide sequence is orthologous to G912
ccctcattcactctcttttctccggcagcaccaaaaccacccaacacttgaaatcaatatccattgttaccaaaaaagaaaagatcaaaacaccctttacatcattatactcagttccctctttccctatcaaaaccctttcccacaacactactcactctagtagtacaagcaaaaccttctaactttggcttcagcggcacatatatatatatatatgaacatgtataccttgaaccactcttcatatttgtaccatgtttcccctgagctctcctcttccttggactcgtcctcgccggcttccgagggctctcgcggcgtggcattttccgacgaggaggtgcggctggcggtgaggcacccgaagaagcgggccgggcggaagaagttccgggagacgcgccacccggtgtaccggggcgtgaggaggaggaacacggataagtgggtaagtgaggtgagggagcccaacaaaaagaccaggatttggctggggacttttcccacgccggagatggcggcacgggcccacgacgtggcggcaatggccctgaggggccggtatgcctgtctcaacttcgctgactcgacgtggcggttaccaattcccgccactgctaacgcaaaggatatacagaaagcagcagcagaggctgccgaggctttcagaccaagtcagaccttagaaaatacgaatacaaagcaagagtgtgtaaaagtggtgacgacaacaacgatcacagaacaaaaacgaggaatgttttatacggaggaagaagagcaagtgttagatatgcctgagttgcttaggaatatggtgcttatgtccccaacacattgcatagggtatgagtatgaagatgctgacttggatgctcaagatgctgaggtgtccctatggagtttctcaatttaataacgtgcttttggtttggttttttatgttagttttggagtgtgactgtctgtactggttttttattagtagtacggatactagctataggtggcagattgaaagggaccaaaaggaattttcttttgaaaccctttttgtcaaagtaatcaatcgcgtatcatcaagtgaatcccttgatcaagtttatgtatgaattaaataaaagaagaatctagttttggtaaaaaaaaaaaaaaaagg

SEQ ID NO: 1208 - DNA, 800 bp, Glycine max
  G3464 Predicted polypeptide sequence is orthologous to G912
aattcggcaccaggttagttactactaactaccccttttgcacacgttgtctcattcactcaaacaacttcaaagaacgaagcttttcaccaagtaacatgttttccatcaatcatttctccgacccagatgccacctcgccggggtcgggaggaagctcccgaccggcgctgtcggacgaggatttttttctggcggcaagcaatcccaagaaacgcgccgggaggaagaagttccgggagacgcgccacccggtgtaccgcggcgtgagaaggcgggactccggcaagtgggtgtgcgaggtgcgcgagcccaacaagaagtccaggatttggctcgggacctttcccacggcggagatggcggcgcgtgcgcatgacgtggcggcgatcgcgctgaggggaaggtcagcctgcctcaacttcgccgactccgcgtctcggctcccggtgccggcgacggcggaggccagggacattcagaaggctgcggcggaggccgcagaggcgtttcgccctgggaaggatgatgatgcggtggcggagagggtggcagcgacggcgacggagcgtgaagaagaacaagaagaagggatggtgccggagtatctgaggaacatggtgctcatgtcgccgacgcattgcttcgggagtgatgagtatggaagtgctgacgtggaatttgacgatgctgaagtttctctgtggagttactccatttaatttaactcagttattggattttttttttactattttgagtaatgtaaagattgttcgtatgggacaagtagaatagtg

SEQ ID NO: 1209 - DNA, 974 bp, Glycine max
  G3467 Predicted polypeptide sequence is orthologous to G912
attcggctccggaaactccaaatacctcactccacagttgaacaacaacaccaacaccaacttctggaatgaacattttcaaatccccactggaccatgatttgaactgtggtggaatattccacgactcagcagaagcatcttattcgtctgaaacaaggagcaccccctcagacgaagaagtgattctagcgtcagcgcggccaaagaagcgagcgggaagaagagtcttcaaggagacaaggcaccccgtctaccgaggagtgcgtcgcaggaacaagaacaagtgggtctgcgagatgcgagtccccaacaacaactcacggatttggctcgggacatacccaacgcccgaaatggccgcacgtgcgcacgacgttgcggcgctcgcgctcaggggaaagtccgcgtgcctcaacttcgcggactccaggtggcggctgacggtgccggcgaccaccaacgcggaggagatacggcgagcggcgggggaggctgctgaggcatttgcagttgcagatggggacgacgttaatattgaacaacagcagagtgtgatggccacgaatgatgatgaagttcaagagcctctccagcaggaggaggttcaagacttgcatgatttgcttttgagtattgcgaatgagcctttgatgtctcctccaccctgtgcaagagatggtagggactggaatgacgtggacatatttgatgatgatgaaatctcactatggaacttctcaatttgacgcgtacgtcattaagagtatgactgtatgcatgtttgatgataagcgaaaacacctttttgtgtatgtgattttctatatttttagggacctgttgtgtgtagataaattaagtagcactcgattgattaagttgagtggagttaaacatattgtagttgtatctatgatttgtttcgtgattaaattttaatgacaagtacagttggcaaattcaaaaaaaaa

SEQ ID NO: 1210 - DNA, 883 bp, Glycine max
  G3469  Predicted polypeptide sequence is orthologous to G912
attcggctcgagtgggatttttagtccattgaattggatatatttatcctcatacatgatcttaggagacatttgtttttggtaaccactcgtcccaagcctaaataagttaaaacacagaagaaaatgcagaagcggagggcagggaggaagaagttccacgagacacgacacccggtgtacaagggagtgaggcagaggaacgggaagtgggtaagcgagctgcgacaacctaacaacaaaaacgcgcgggtgtggctcggaacattcgcgcaccccgacatggctgctatagcgtacgatgttgccgccttggctttcaagggcgacagtgcttccttaaacttcccgaacgccgccacctcgtttccccgccttaactcgcggacgtgttccgttagggccattcagtttgcggcgacgcaggcggcggagaagcatttttcttgtgtagagtctcaacaactccaaagggagggatcaggctccggaagcttctctttggacgatgattcttcggagttttcgtcccaaggaaggttcttttgggatgaagaggaagtgtttaacatgccggagttgctgaactgcatggcggaagcgctgattatcacaccgccggcgttggaaagagggttcaattgggttggtggcgaaacgactgtggatttgactctgtggtgaaactgatgaccacttaggttctctgcaaaccagagaggaacttgcaatttcgatctgttgcaaaatattatatatactaatagtctaaagatgtagttcatcatatatactagtactgatacattcaaaagttatatagcgtttgctgtatggttgagattttcgtcaaaaacaagctgtatcataaatcttttctgtt

SEQ ID NO: 1211 - DNA, 1014 bp, Oryza sativa
  Predicted polypeptide sequence is orthologous to G912
tttttttttttttttaacgtaaatccaaaatccttaaaatcattgttgttcttgaccaaaatagctctttggagaggagaagtaaatttacaggaattcattgactgcacattcaaaatcagatggaatcacaaaaggagggagaaatctggcacattccaaaattacaaaaattgccattcatcctcagtctcattgcctactctgttctaaattcaccaatactctgttctcttttttcccccaatttctggagaatcaaaatttgtccacacttttcagtgcgagattttgattagtagctccagagcggcatgtcggagccggcgagctcgccgtcctcccaccacgctccggcggccggcggctcgacgagcagcccctgcgccaagctcgcgtagtacgacccggcgtccatcccgccgaacctgaacccgtcgtcgagctcgaacgcccccgcgtcgaacacctccgccgccgccaccggcaacacgtccttgttgtcttcttcttcgtcgccatcgttggcgaaggtctccgccggagacgacggcgcggccgactggcgctggaacgcctcgacggccacggcgacggcgtccctgacccccctcgcgccggcgagcgcggcggacgcggggacgggcggcatccgccacgcggagtcggcgaagttgaggcaggcggccctgccgcggagcgccagcgcggcggcgtcgtgcgcgcgcgccgccgcctcggcggtggcgaacgtgccgagccacagcctggagccgcgcgccccgggcacccgcacctcgcacacccacctccccgccgcgcccggccgccccccgcgccgccgcacgccgcggtacaccgggtgcctcgtctccctgaacttggtccttcccgccggcctcttcggcggctccgaccacaccgtcctgtacgccgcctcctccacctccatggatgactctctctggttcacttcgccggccagcctgaacctcgtgccgaattcctgcagcc

SEQ ID NO: 1212 - DNA, 430 bp, Oryza sativa
  Predicted polypeptide sequence is orthologous to G912, G913
gcacgagggacacactgccacagacacaatccatagcttagctcctctccactggagggatcgatcgatcgatggactgggcgtactccggcaacagctacggctacggctactactcgtcggggacgtcatcccctccggcgggcggcgaggacgcgtacatgacggtgtcgtcggcgccgcctaagcggcgcggggggcggaccaagttcaaggagacgaggcacccggtgtacaagggcgtgcgcagccggaaccccgggcggtgggtctgcgaggtccgggagccccacggcaggcagcgcatctggctcggcaccttcgagaccgccgagatggcggcgcgcgcgcacgacgtcgccgcgctggcgctgcggggtcgggccgcctgcctcaacttcgcggactccccgcgcaggctccgcgtccc

SEQ ID NO: 1213 - DNA, 976 bp, Zea mays
  G3440  Predicted polypeptide sequence is orthologous to G912
cacgcgtccgctcgaacacaaactcaggcaaggcaaaaggaacccgcaccatccgaggctcaagcagggaagtgatcatcatcatcatcagaagaagatgtgcccaaccaagaaggggatgaccggagagccgagctcgccatgcagctcggcatcagcctcgaccttaccggagcaccaccagacggtgtggacgtcgccgccgaagcggccagcggggcggaccaagttccgggagacgcggcacccggtgttccgcggcgtccggcgccggggcagcgccgggcggtgggtgtgcgaggtgcgcgtgccggggaggcgcggctgcaggctctggctcggcaccttcgacacggccgaggcggcggcccgcgcgcacgacgccgccatgctcgccctcgccggcgcgggcgcctgctgcctcaacttcgccgactcggcctggctcctcgcggtcccggcctcgtgcgccagcctcgccgaggtccgccacgcggtcgcggacgccgtggacgacttcctccgccatcagctggtcccggaggacgacgccctcgcggccacgccgtcgtcgccttccagcgaagacggcaacacctctgatggcggggagtcctcctctgattcctctccgcccaccggggcctcgccgttcgaatttgatgtgttcaacgacatgagctgggacctgcactacgcgagcttggcgcagggattgctcgtggagccaccgtccgcggtcacggcgttcatggacgaaggcttcgccgatgtgccgctctggagctactagagactgaaattttccgtttctttgcttggcctgtggcgcctaattttggcagtgtaaaacggttacttcttttggtaatgagatggaacaagtttgcgaaacatgaaaacagagcatgctaatcgacattttcgcgcggccgaaaaaaaaaaaaaaaaaaaaaaaaaaaaaaaaaaaaaaaag

SEQ ID NO: 1214 - DNA, 543 bp, Zea mays
  Predicted polypeptide sequence is orthologous to G912
gacccacgcgtccgcccacgcgtccgagcagcgaaggtagccacaacatccactcgactgactactcgagagctaagaaactgttcaacaggtgatccagaacaagatgtgtccaaccaagaaggagatgagtgccgagtcgtcgggctcggcgagcagctggacttcggcctcgacctcgacctcgccggagcaccagaccgtgtggacgtcgccgccgaagcggcccgcggggcggaccaagttccgcgagacgcggcaccccgtgttccgtggcgtccggcgccgcggcagcgccgggcggtgggtgtgcgaggtgcgcgtgcccgggaggcgcgggtgcaggctctggctcggcacgttcgacgccgccgaggccgccgcgcgcgcgcacgacgccgccatgctcgccatcgccggcgcgagcgcgtgcctcaacttcgccgactccgcgtggctgctcgcggtccccgcctcgtacgccagccttgccgaggtccgccgtgcggtcgccgaggccgtggaggactttcagcgccgcga

SEQ ID NO: 1215 - DNA, 1065 bp, Zea mays
  Predicted polypeptide sequence is orthologous to G912, G913
cgcgcgcgtcgccgcccgcctcatcagccatcgcgttccgcatcgaaccagcacatcgcaagacaagcagcagcagccaccactgccatcacatggagtacgccgccgtcggctacggctacgggtacgggtacgacgagcgccaggagccggcggagtccgcggacggcggcggcggcggcgacgacgagtacgcgacggtgctgtcggcgccacccaagcggccggcggggcggaccaagttccgggagacgcggcaccccgtgtaccgcggcgtgcggcggcgcgggcccgcggggcgctgggtgtgcgaggtccgcgagcccaacaagaagtcgcgcatctggctcggcaccttcgccacccccgaggccgccgcgcgcgcgcacgacgtggccgcgctggccctgcggggccgcgccgcgtgcctcaacttcgccgactcggcgcgcctgctccaggtcgaccccgccacgctcgccacccccgacgacatccgccgcgccgccatccagctcgccgacgccgcctcgcagcaggatgagactgccgccgttgccgctgacgtggtcgcgccctcgcaggcggacgacgtcgccgccgccgccgccgccgccgcggcggcggcgatgtacggcggcggcatggagttcgaccactcgtattgctacgacgacgggatggtgagcgggagcagcgactgctggcagagcggcggcggcggatggcatagcagcgtggacggcgacgacgacggcgccggcgacatgacgctctggagctactgagctgtagagtctgtctccagcgcaggaggttgggagaggagaccacgctctggagctactactggacagggaagaaagtgggggagccgggagcgagttcgaatttgaattcagaaactctgtactggcactggcacacgcggggaacgcgccacgcaagagcgagcgctatttccctccctttttgggtgctgggagaataataaaaagaccaacaatgaaggcattagtactaaaaaaaaatactatagcataaaaaaaaaagggcggccgctct

SEQ ID NO: 1216 - DNA, 994 bp, Zea mays
  G3438 Predicted polypeptide sequence is orthologous to G912
ccacgcgccccctcagctcaatcccgagacaaaggaacccacctccactcccaccagcaagctcaagcaagcagccaccaccagcagcgatcagcggcagccatggacatgggccggcaccagctccagctccagcacgcggcctcctcgtcctccacctcggcgtcgtcctcgtccgagcaggacaagccgctctgctgctctggtcccaagaagcgccccgcggggcgcaccaagttccgggagacgcggcacccggtgttccgcggcgtgcggcggcggggcgccgcggggcggtgggtgtgcgaggtgcgcgtccccgggcggcgcggcgcgcggctgtggctcggcacctacctcggcgccgaggcggcggcgcgcgcgcacgacgccgcgatgctcgccctgggccgcggcgcggcctgcctcaacttccccgactccgcgtggctgctcgccgtgccgcccccgcccgcgctctcgggcggcctggacggcgcccgccgggccgcgctcgaggccgtcgcggagttccagagacgccgcttcggggcggcagccgccgacgaagcgacctcgggcacgtctcctccctcctcctcctcctcggcgacgaagccggcgccggcgattgagcgcgtgcctgtggaggccagtgagacggtggcgttggacggcgccgtgttcgagcccgactggttcggggacatggacttggacttgtactatgccagcctcgcggaagggctgctcgtggagccgccgccgccgccaccgcccgccgcctgggatcatggtgactgctgcgactccggagctgacgtcgcgctctggagctactagcaagctatagcagcaataagctccaccaactcatctgtactgtagtgtacttgtaccttgtaccttgtaccaaaatccaaattgatttgtagcgaattaacttaccaatcccccttggcaactccaaaaaaaaaaaaaaaaaaaaaaaaag

SEQ ID NO: 1217 - DNA, 1002 bp, Zea mays
  G3439 Predicted polypeptide sequence is orthologous to G912
tcgcgatctagaactagtctcagctcaatcccgagacaaaggagccctcctccacctccactcccagcagcaagctcaagcaagcagccaccacaccaccagcagtgaacagcggcagccatggacatgggccggctccagctccagctccagcacgcggcctcctcgtcctccacctcggcgtcgtcctcgtcctcgtccgagcagaacaagctggcctggtccccgtcctccccgcagccgcccaagaagcgccccgcggggcgcaccaagttccgggagacgcggcacccggtgttccgcggcgtgcggcggcggggcgccgcgggccggtgggtgtgcgaggtgcgcgtccccgggcggcgcggcgcgcggctgtggctcggcacctacctcggcgccgaggcggcggcgcgcgcgcacgacgccgcgatgctcgccctgggccgcggcgccgcctgcctcaacttccccgactccgcgtggctgctcgccgtgccgcccccgcccgcgctctcgggcggcctggacggcgcccgccgggccgcgctcgaggccgtcgcggagttccagcgacgccgcttcggggcggtagccgccgacgaagcgacctcgggcacgtctcctccctcctcctcctcgtcgccgtcgggcacttatgtctcgcaggcgccggcgccggcgattgagcgcgtgcctgtggaggccagtgagacggcggcgttggacggcgccgtgttcgagcccgactggttccgggacatggacttggacttgtactatgccagcctcgcggaagggctgctcgtggagccgccgccaccgcccgccgcctgggatcatggtgactgctcccactccggagctgacgtcgcgctctggagctactagcaagctatagcagcaataagcttggcaatgccaccaactcatctgtactgtactgtacttgtaccctgtaccaaaatccaaattgatttccagcaaattaacttaccaatc

SEQ ID NO: 1218 - DNA, 768 bp, Brassica napus
  Predicted polypeptide sequence is orthologous to G912, G913
  misc_feature (664)..(664): n is a, c, g, or t
  misc_feature (667)..(667): n is a, c, g, or t
agacacttgagtaagtttaattatcagacagactttaagcttctttgtgtttcttactatgtcgaacactagcgattctccgaccacggggaataaacaaatgacgacgtttcctctagcttcagtcgcattgccttccaaaacttctgatcatcagtctcctcaatcctctccaggctcatcttcttccccatctccgacaccgagaccttctcactccgccggtggatcttccacgaagagaacgacgacgggattatccggccggcactcatttttcagggggattcggctacggaacggaaaatgggtgtcggagattcgagagccgcgtaaaacgacgcgaatttggctcgggacttatccggtaccggagatggctgccgccgcttacgacgttgcggcgctggctctgaaaggccccgacgccgttttgaattttcctggtttggctttgacgtatgtggctccggcttcgaactctgctgcggatataagagctgccgccgcgagagccgccgagacgaagcaaccggacccgggtggagtcgagaaggtaatggaaccgggtcaacccggaagggaggaggaggaaaaagcaatgctttcttcgttggagtttatggacgaggaagccatgttggatatgccgaatttgttgacnganatggcggaagggatgctgatgagcccacccagaatgataaatccgacgatggaggatgattcccggagaatcatgaaggagatagtctctggagttccaaa

SEQ ID NO: 1219 - DNA, 775 bp, Solanum tuberosum
  Predicted polypeptide sequence is orthologous to G912
tgggtttacactcccatcaaataattaagtcagtttttaataatattattatggatatctattattcagacccactcgctgaatcatcgtcatcatcaatatctgatactaatagcaatcagtactcccctaataataatttttctgatgaggaagttattaatttagcttcaaataacccgaagaagccagctggcaggaagaagtttcgagaaactcgacatccagtatacaggggagtcaggatgaggaattctggaaaatgggtttgtgaagttagagaaccaaataagaaatcaaggatttggcttggtactttccccacagtagaaatggcagctatagctcatgacgtggcagctttagcattaagaggccgttctgcttgcttgaatttcgctgattcggcttggaggttgcctattccggcttcctctaactccaaggatattcaaaaggcagccgctgaggctgcagaaatcttccgaccagagtcgaaaagaagtttcagggagaatgtagcactactcctgaaacgctagaaaacacgttttttatgaagggaggagagttagtttgttcatgggatgagggaagcgctcttttacatgccaggattaattgcgaacatggcagaaggactcatgctacctcctccccatgtttagagatcggagatcattatggtggaattagctgatgtgcacacttatatgtctttatggaattattctatataaataaggattatttagggagattttattagtttcct

SEQ ID NO: 1220 - DNA, 640 bp, Descurainia sophia
  Predicted polypeptide sequence is orthologous to G912
gtycgtcggagaaactccggtaagtgggtgtgtgaggttagagagccaaacaagaaatctaggatttggctcgggactttcccaaccgccgagatggcagctcgtgctcacgacgtcgccgccatagccctccgtggcagatccgcttgcctcaatttcgcagactcggcttggcggctccggattcccgagtcgacctgcgccaaggaaatccagaaggcggctgctgaagcgcgctggcttttcaagatgagatgtgtgatacgacgacggatcatggcttagatatggaggagacgatggtagaagccatcgtgacggcggaacacggcgatggattttatatggatgaagaggccatgtttgggatgccgaggttgttggctaatatggcggaagggatgcttttgccgccgccgtccgtacaatggagtyataattatgacgttgacggcgatgatgacgtgtcgctatggagttattaaaaattcgatattcatttccatttttggtacttttctttttttattcttagatcctttttcagaatggatcctttatcgttttggttgagattgagaaacgaatgtaaatgatccaatttgggtgtttttcaaatgcaagtgtgaccgtgtgcagt

SEQ ID NO: 1221 - protein, 236 aa, Oryza sativa
  G3377  Orthologous to G912
MEKNTTAMGQLMSSSATTAATATGPASPKRPAGRTKFQETRHPVFRGVRRRGRAGRWVCEVRVPGSRGDRLWVGTFDTAEEAARAHDAAMLALCGASASLNFADSAWLLHVPRAPVASGHDQLPDVQRAASEAVAEFQRRGSTAATATATSGDAASTAPPSSSPVLSPNDDNASSASTPAVAAALDHGDMFGGMRTDLYFASLAQGLLIEPPPPPTTAEGFCDDEGCGGAEMELWS

SEQ ID NO: 1222 - protein, 219 aa, Oryza sativa
  G3373 Orthologous to G912
MDTEDTSSASSSSVSPPSSPGGGHHHRLPPKRRAGRKKFRETRHPVYRGVRARAGGSRWVCEVREPQAQARIWLGTYPTPEMAARAHDVAAIALRGERGAELNFPDSPSTLPRARTASPEDIRLAAAQAAELYRRPPPPLALPEDPQEGTSGGGATATSGRPAAVFVDEDAIFDMPGLIDDMARGMMLTPPAIGRSLDDWAAIDDDDDHYHMDYKLWMD

SEQ ID NO: 1223 - protein, 219 aa, Oryza sativa
  G3375 Orthologous to G912
MEWAYYGSGYSSSGTPSPVGGDGDEDSYMTVSSAPPKRRAGRTKFKETRHPVYKGVRSRNPGRWVCEVREPHGKQRIWLGTFETAEMAARAHDVAAMALRGRAACLNFADSPRRLRVPPLGAGHEEIRRAAVEAAELFRPAPGQHNAAAEAAAAVAAQATAASAELFADFPCYPMDGLEFEMQGYLDMAQGMLIEPPPLAGQSTWAEEDYDCEVNLWSY

SEQ ID NO: 1224 - protein, 214 aa, Oryza sativa
  G3372 Orthologous to G912
MEYYEQEEYATVTSAPPKRPAGRTKFRETRHPVYRGVRRRGPAGRWVCEVREPNKKSRIWLGTFATAEAAARAHDVAALALRGRGACLNFADSARLLRVDPATLATPDDIRRAAIELAESCPHDAAAAAASSSAAAVEASAAAAPAMMMQYQDDMAATPSSYDYAYYGNMDFDQPSYYYDGMGGGGEYQSWQMDGDDDGGAGGYGGGDVTLWSY

SEQ ID NO: 1225 - protein, 214 aa, Brassica napus
  Orthologous to G912
MTSFSTFSEMLGSEYESPVTLGGEYCPKLAASCPKKPAGRKKFRETRHPVYRGVRLRNSGKWVCEVREPNKKSRIWLGTFLTAEIAARAHDVAAIALRGKSACLNFADSAWRLRIPETTCPKEIQKAAAEAALAFQAEINNTTTDHGLDMEETIVEAIFTEENNDVFYMDEESMLEMPALLASMAEGMLLPPPSVHFGHNYDFDGDADVSLWSY

SEQ ID NO: 1226 - protein, 219 aa, nicotiana tabacum
  Orthologous to G912
MDIFRSYYSDPLAEYSSISDSSSSSCNRANHSDEEVMLASNNPKKRAGRKKFRETRHPVYRGVRKRNSDKWVCELREPNKKSRIWLGTFPSAEMAARAHDVAAIALRGRSACLNFADSAWKLPIPASTDAKDIQKAAAEAAEAFRSSEAENMPEYSGEDTKEVNSTPENMFYMDEEALFFMPGLLVNMAEGLMLPPPQCSQIGDHMEADVDMPLWSYSI

SEQ ID NO: 1227 - protein, 218 aa, Oryza sativa
  Orthologous to G912
MEVEEAAYRTVWSEPPKRPAGRTKFRETRHPVYRGVRRRGGRPGAAGRWVCEVRVPGARGSRLWLGTFATAEAAARAHDAAALALRGRAACLNFADSAWRMPPVPASAALAGARGVRDAVAVAVEAFQRQSAAPSSPAETFANDGDEEEDNKDVLPVAAAEVFDAGAFELDDGFRFGGMDAGSYYASLAQGLLVEPPAAGAWWEDGELAGSDMPLWSY

SEQ ID NO: 1228 - protein, 246 aa, Oryza sativa
  Orthologous to G912
MDMAGHEVNSSSSSSGAESSSSSSGRQQYKKRPAGRTKFRETRHPVYRGVRRRGGAGRWVCEVRVPGKRGARLWLGTYVTAEAAARAHDAAMIALRGGAGGGGAACLNFQDSAWLLAVPPAAPSDLAGVRRAATEAVAGFLQRNKTTNGASVAEAMDEATSGVSAPPPLANNAGSSETPGPSSIDGTADTAAGAALDMFELDFFGEMDYDTYYASLAEGLLMEPPPAATALWDNGDEGADIALWSY

SEQ ID NO: 1229 - protein, 214 aa, Oryza sativa
  Orthologous to G912
MEYYEQEEYATVTSAPPKRPAGRTKFRETRHPVYRGVRRRGPAGRWVCEVREPNKKSRIWLGTFATAEAAARAHAVVAGTRCGRGACLNFADSARLLRVDPATLATPDDIRRAAIELAESCPHDAAAAAASSSAAAVEAAAAAAPAMMMQYQDDMAATPSSYDYAYYGNMDFDQPSYYYDGMGGGGEYQSWQMDGDDDGGAGGYGGGDVTLWSY

SEQ ID NO: 1230 - protein, 238 aa, Oryza sativa
  G3379 Orthologous to G912
MCGIKQEMSGESSGSPCSSASAERQHQTVWTAPPKRPAGRTKFRETRHPVFRGVRRRGNAGRWVCEVRVPGRRGCRLWLGTFDTAEGAARAHDAAMLAINAGGGGGGGACCLNFADSAWLLAVPRSYRTLADVRHAVAEAVEDFFRRRLADDALSATSSSSTTPSTPRTDDDEESAATDGDESSSPASDLAFELDVLSDMGWDLYYASLAQGMLMEPPSAALGDDGDAILADVPLWSY

SEQ ID NO: 1231 - protein, 253 aa, Oryza sativa
  Orthologous to G912
MEKNTAASGQLMTSSAEATPSSPKRPAGRTKFQETRHLVFRGVRWRGCAGRWVCKVRVPGSRGDRFWIGTSDTAEETARTHDAAMLALCGASASLNFADSAWLLHVPRAPVVSGLRPPAARCATRCLQGHRRVPAPGRGSTATATATSGDAASTAPPSAPVLSAKQCEFIFLSSLDCWMLMSKLISSSRAKGSLCLRKNPISFCMVTNSYTALLLEYIILQMNSMIVLIHELSKYQVFLLLTMITHHLFQWRR

SEQ ID NO: 1232 - protein, 224 aa, Oryza sativa
  G3376 Orthologous to G912
MDVSAALSSDYSSGTPSPVAADADDGSSAYMTVSSAPPKRRAGRTKFKETRHPVFKGVRRRNPGRWVCEVREPHGKQRIWLGTFETAEMAARAHDVAALALRGRAACLNFADSPRRLRVPPIGASHDDIRRAAAEAAEAFRPPPDESNAATEVAAAASGATNSNAEQFASHPYYEVMDDGLDLGMQGYLDMAQGMLIDPPPMACDPAVGGGEDDNDGEVQLWSY

SEQ ID NO: 1233 - protein, 199 aa, Oryza sativa
  Orthologous to G912
MDRDESLGTQPLTGRRVRADTRHPVYRGIRLRSGKWVSEIREPGKSSRIWLGTYPTPEMAAAAYDAAALALRGADAALNFPGTATSRPAPASGSPDDIRAAAAAAAAMIGSGHRGNQRAADASTSRAAPAPEVAVAAGAGDQKRVVDEDDVFEMPRLLVSMAEGLMMNPPRLSPSTDGVGGVSPEDDEDEDGMSLWNHS

SEQ ID NO: 1234 - protein, 217 aa, Oryza sativa
  Orthologous to G912
MDDSHDLASPTSPDTASSSSSSTSTSSSSATVAPKKRPRNDGRHPTYRGVRMRSWGKWVSEIREPRKKSRIWLGTFATAEMAARAHDVAALAIKGRTAHLNFPDLAHLLPRPATAAPKDVQAAALLAAAAADFPSVSVDANAKSPDTCSVASAASPQPPPPDAEADPDSTLFDLPDLLLDLRYETSSSLSCGASWAVDDDVAGGVVFRLEEPMLWDY

SEQ ID NO: 1235 - protein, 251 aa, Oryza sativa
  Orthologous to G912
MCTSKLEEITGEWPPPALQAASTTSSSEPCRRLSPPSSKRPAGRTKFHETRHPVFRGVRRRGRAGRWVCEVRVPGRRGCRLWLGTFDAADAAARAHDAAMLALRGRAAACLNFADSAWLLAVPPPATLRCAADVQRAVARALEDFEQRESSSSVFPLAIDVVAEDAMSATSEPSAASDDDAVTSSSSTTDADEEASPFELDVVSDMGWSLYYASLAEGLLMEPPASGASSDDDDDAIVDSSDIADVSLWSY

SEQ ID NO: 1236 - protein, 191 aa, Oryza sativa
  Orthologous to G912
MEKNTAATSQLMTSSVTATPSSSKRPAARTKFQETRHPVFRGGVRRRGCAGRWVCEVRVPASRAAARGERLWVGTFDTVKETARAHDAAMLALCGASASLDFANSAWLLHVPLAPVVSTPDSDHQLPDVQRAASKAIAEGVRTATATATSGDAASTAPPWLHRHPFCVSQTMQIHLCFSTRLLDVNVKAYQ

SEQ ID NO: 1237 - protein, 185 aa, Glycine max
  G3469  Orthologous to G912
MQKRRAGRKKFHETRHPVYKGVRQRNGKWVSELRQPNNKNARVWLGTFAHPDMAAIAYDVAALAFKGDSASLNFPNAATSFPRLNSRTCSVRAIQFAATQAAEKHFSCVESQQLQREGSGSGSFSLDDDSSEFSSQGRFFWDEEEVFNMPELLNCMAEALIITPPALERGFNWVGGETTVDLTLW

SEQ ID NO: 1238 - protein, 226 aa, Glycine max
  G3467 Orthologous to G912
MNIFKSPLDHDLNCGGIFHDSAEASYSSETRSTPSDEEVILASARPKKRAGRRVFKETRHPVYRGVRRRNKNKWVCEMRVPNNNSRIWLGTYPTPEMAARAHDVAALALRGKSACLNFADSRWRLTVPATTNAEEIRRAAGEAAEAFAVADGDDVNIEQQQSVMATNDDEVQEPLQQEEVQDLHDLLLSIANEPLMSPPPCARDGRDWNDVDIFDDDEISLWNFSI

SEQ ID NO: 1239 - protein, 207 aa, Glycine max
  G3464 Orthologous to G912
MFSINHFSDPDATSPGSGGSSRPALSDEDFFLAASNPKKRAGRKKFRETRHPVYRGVRRRDSGKWVCEVREPNKKSRIWLGTFPTAEMAARAHDVAAIALRGRSACLNFADSASRLPVPATAEARDIQKAAAEAAEAFRPGKDDDAVAERVAATATEREEEQEEGMVPEYLRNMVLMSPTHCFGSDEYGSADVEFDDAEVSLWSYSI

SEQ ID NO: 1240 - protein, 255 aa, Glycine max
  G3468 Orthologous to G912
MNILGQSLHQSNNGSYSCSSPETANSSNLPTTPKAVHSDEEVNTLASAHPKKRAGRRIFKETRHPVYRGVRRRNNNKWVCEVRVPNDKSTRIWLGTYPTPEMAARAHDVAALSLRGKSACLNFADSAWRLPLPASTNAKEIRRVAAAAAVAIAAEDSRGKQLRTNAIDAVADCEVSSSDIGVDENCNNNKASQRFCDLDEITMPDAPVFEDMHEWLQTMAAEPLRSPTFVTYVNVRDVWNFVEDDAEVSLWSFTV

SEQ ID NO: 1241 - protein, 254 aa, Glycine max
  G3463 Orthologous to G912
MNILGQSFNESNNGSYSCSSPETGSSSNIPNTFHSDEEVHTLASARPKKRAGRRIFKETRHPVYRGVRRRNNNKWVCEVRVPNDKSTRIWLGTYPVPEMAARAHDVAALALRGKSACLNFADSAWRLPLPASTNAKEIRRVAAAAAVAIAAEDSCGEQLQNSIVNDAVADDCEVSRSDVSFDEDSNSNKGLRVFCDLDEITMADAPVFEDMREWLQSMADEPLRSPTFVTYVNVRDVWNFVEDDAEVSLWSFTI

SEQ ID NO: 1242 - protein, 234 aa, Glycine max
  G3465  Orthologous to G912
MFTLNHSSDLYHVSPELSSSLDTSSPASEGSRGVAFSDEEVRLAVRHPKKRAGRKKFRETRHPVYRGVRRRNSDKWVCEVREPNKKTRIWLGTFPTPEMAARAHDVAAMALRGRYACLNFADSAWRLPVPATAEAKDIQKAAAEAAQAFRPDQTLKNANTRQECVEAVAVAVAETTTATAQGVFYMEEEEQVLDMPELLRNMVLMSPTHCLGYEYEDADLDAQDAEVSLWNFSI

SEQ ID NO: 1243 - protein, 233 aa, Glycine max
  G3466  Orthologous to G912
MNMYTLNHSSYLYHVSPELSSSLDSSSPASEGSRGVAFSDEEVRLAVRHPKKRAGRKKFRETRHPVYRGVRRRNTDKWVSEVREPNKKTRIWLGTFPTPEMAARAHDVAAMALRGRYACLNFADSTWRLPIPATANAKDIQKAAAEAAEAFRPSQTLENTNTKQECVKVVTTTTITEQKRGMFYTEEEEQVLDMPELLRNMVLMSPTHCIGYEYEDADLDAQDAEVSLWSFSI

SEQ ID NO: 1244 - protein, 246 aa, Zea mays
  G3438 Orthologous to G912
MDMGRHQLQLQHAASSSSTSASSSSEQDKPLCCSGPKKRPAGRTKFRETRHPVFRGVRRRGAAGRWVCEVRVPGRRGARLWLGTYLGAEAAARAHDAAMLALGRGAACLNFPDSAWLLAVPPPPALSGGLDGARRAALEAVAEFQRRRFGAAAADEATSGTSPPSSSSSATKPAPAIERVPVEASETVALDGAVFEPDWFGDMDLDLYYASLAEGLLVEPPPPPPPAAWDHGDCCDSGADVALWSY

SEQ ID NO: 1245 - protein, 231 aa, Zea mays
  Orthologous to G912
MEYAAVGYGYGYGYDERQEPAESADGGGGGDDEYATVLSAPPKRPAGRTKFRETRHPVYRGVRRRGPAGRWVCEVREPNKKSRIWLGTFATPEAAARAHDVAALALRGRAACLNFADSARLLQVDPATLATPDDIRRAAIQLADAASQQDETAAVAADVVAPSQADDVAAAAAAAAAAAMYGGGMEFDHSYCYDDGMVSGSSDCWQSGGGGWHSSVDGDDDGAGDMTLWSY

SEQ ID NO: 1246 - protein, 231 aa, Zea mays
  G3440  Orthologous to G912
MCPTKKGMTGEPSSPCSSASASTLPEHHQTVWTSPPKRPAGRTKFRETRHPVFRGVRRRGSAGRWVCEVRVPGRRGCRLWLGTFDTAEAAARAHDAAMLALAGAGACCLNFADSAWLLAVPASCASLAEVRHAVADAVDDFLRHQLVPEDDALAATPSSPSSEDGNTSDGGESSSDSSPPTGASPFEFDVFNDMSWDLHYASLAQGLLVEPPSAVTAFMDEGFADVPLWSY

SEQ ID NO: 1247 - protein, 256 aa, Zea mays
  G3439 Orthologous to G912
MDMGRLQLQLQHAASSSSTSASSSSSSEQNKLAWSPSSPQPPKKRPAGRTKFRETRHPVFRGVRRRGAAGRWVCEVRVPGRRGARLWLGTYLGAEAAARAHDAAMLALGRGAACLNFPDSAWLLAVPPPPALSGGLDGARRAALEAVAEFQRRRFGAVAADEATSGTSPPSSSSSPSGTYVSQAPAPAIERVPVEASETAALDGAVFEPDWFRDMDLDLYYASLAEGLLVEPPPPPAAWDHGDCSHSGADVALWSY

SEQ ID NO: 1248 - protein, 145 aa, Zea mays
  Orthologous to G912
MCPTKKEMSAESSGSASSWTSASTSTSPEHQTVWTSPPKRPAGRTKFRETRHPVFRGVRRRGSAGRWVCEVRVPGRRGCRLWLGTFDAAEAAARAHDAAMLAIAGASACLNFADSAWLLAVPASYASLAEVRRAVAEAVEDFQRR

SEQ ID NO: 1249 - DNA, 2032 bp, Glycine max
  Predicted polypeptide sequence is orthologous to G922
aaacaaaaacacattatattatgtaatctactaggtacaagttagggtacaggagctcataattcataaaaaataaaatgatcagctgcaaaaaatgaaaccataaacagaaccccgattgagacttctacttcttccgtccttctaccctttttttgtcttcccaaatttcttacttgatggagttttaccaggcaatgaataaagagtatctctaaaaaactatcttgaagaacagtcattaccataagaataaaacactcatacaaataaaaagaaagaaagaaaagaaaagaaaaaacatcaatatatccctctaattctcttacttcctagatctccaagctgatattgaatacattggccgatcctcccagcaaattaacacacaaccattttcatccctcattctgtatccttcacaaccatagctctgcaggaacctccttgcttgcaccataccaaagtagctcaaaggcacgttgccaaacccagctagatcaaatctctggaaccacttttccagcttttcatgtctttcctttcgttcagatccctcacatgcaatgatgttctttatttcctccccaaaaagcatcttctccacccttaatctctccaatgatgttcttgagacagtggattccaaacaatcaaacaatgctgcataagagtatagagcttcaagaagcctatccatcagagttggaccattgtgattacagtcttgttctgtcacaaccatgacctttggtgataatccccacaaggcattaagaaagcgccccctgggccttgaattggaagtagttaaagatgatggagatgatgaggttgagtcaggacttggagtgtacccattaaccatatctttctcaagcaaatcacccaatgtgctttggcccattggcagaactctttgcaggtgaattccatttgagctttttaacagaagaggagactttctctgcatggcttcatcatcccaggccaaaagggtatgcaattggagaatggaacttattgctagtgcctccccagttttcacccgaagtttgtcaaaatcaagattttctaatttgcttgccacagggttgaattggaacggtatatccaacttttctgcttcttcagttagtctatgagccacctcatccagaatctcctttttctgatgaaccccggtgattctcaaatgaggagggccttcgggatgcgcacttaatactcgaaggagagcaatccactgagcagcttcagcagcattgagatcaattatgtgaatcactttctccccttccattgcttcaatgatggcctgatttgtgagaacaaatgctaccttcaagaaagggaaaagctcaaagaaaagcttctgaaccagaatttcgtcggatatcaaagtcattctggttgagttgagggctctgtggatcccaggccatgttttaagaatccgatcagcaagcgactccataaaatatgttgcgattcgctgcatagtgtccccatcaggggaagcaagcatggaaatttgctcaagtgtggtgtttgcattttcaaggttaccagcagctacatggtttgcacaagtgagcaacaaatggatcaagtacaaacccctttcctcggatttcatttccctaaacaagagattgttgggagaacctaagctaggtgaaagtgacatcatggagaagaactgcaggggtgaagaatttacagaagacgacccttcaaaaccaggtcagcaacagaagtaggcattgcaagttgcaagttgcaacgaggaaacgcttgcttatcccttggtgggttttcaaattgaagaataatccagacgaagcccccagaaaattccaaaacttgccacttggagcactgaaaaaatcagaaccaaaatggggttggttgtgcagcttcaatgggaatgagtttcaatgtttggacccttgttcttctggtttcagcgacttgttcatgactacgttgtccacaatgcgtgaagggtcccttttgtctttattgtttc

SEQ ID NO: 1250 - DNA, 1563 bp, Glycine max
  Predicted polypeptide sequence is orthologous to G922
gaattcggctcgaggttatcttctgtaacttcttcacctcttcagttcttttccatgatgtctctgtcagtttcacctagcttaggatctccctaccatatgaaatgcgagcttaggggtttggtattaatccatttgttgctcgctggtgctaattttgtagccaccggtgatttacaatatgcatacctcacacttgagcagatttcccagcatgcctctcttgatggggatactatgcagcgaattgcttcttatgtttctgaagcactcgctgatcggatacttaaaacatggcctggcatccacagggccctcaattccagcagaataactatggtttctgatgaaattcttgttcaaaagctcttctttgagcttttacccttcctcaagttctcatatatcctcactaatcaggctattgttgaagccatggaaggggagaaaatggtgcatatagttgatctctatggggccggaccggcacagtggatttctctcctccaagttttgagtgcacgtcctgaaggtcctccccatttgagaatcaccggggtccatcacaagaaagaggttctggatcagatggctcataaactcactgaagaggcggaaaagttggatatcccattccaattcaaccctgtgctaagcaagttggaaaatcttgatttcaacaaacttcgcgttaaaactggggaggcactggcaataagttctattatgcagttgcactcccttttggccttggatgaagatgcctcgcggagaaaatcgcctcttttgtcaaaaaactcaaatgcaattcacctgcagaaaggcctcctcatgaaccataacacactgggagatttgcttgacggctatagcccgagtcctgattcggcctcatcctcaccagcagcgtcttcatctgctttgatgaattcggagagctttcttaatgccttgtgggggttatccccaaaagtcatggttgtaactgaacaagactttaaccacaactgtttgaccatgatggagagactggcagaagctctattttcttatgctgcatattttgattgcttggagtccacggtctcaagagcatccatggacagattaaaacttgagaagatgctttttggcgaggagataaagaacatcatagcttgtgaaggatgtgaaagaaaagaaaggcacgaaaagatggataggtggatccagagacttgacttatctggatttgcaaacgtgcctataagctattatgggatgctgcagggaaggaggttcttgcagacctatggttgtgaggggtacaagatgagggaggaatgtggtcgggtgatgatatgctggcaggagcgatccttgttttccataacagcttggagaccaaggaagtaagataaagaagaaaattagtcatgtagtaatggatagagtctctttttttaagtttttcttttcttttctttgtttctaattgtatgacagagttttaccaatgtggtaatgactagtaatgaagagatacttctatttccttaaaaaaaaaaaaaaaagggcggccgc

SEQ ID NO: 1251 - DNA, 1574 bp, Glycine max
  Predicted polypeptide sequence is orthologous to G922
gaattcggctcgagaaaacaatggtctgtcactccagcagacaagtaaacaatcattctcttctcgaaatttgtatttattactatatctctgcaacagattctttgcttctaacctcccattgtagctcaaaggtaccttttcaaaaccagccatttcaagtcttcgaatccatttctcgagtttctcatgtctctcctttctatcaacaccctcacaagcaatgatgttctttatctgctctccaagaagcttgctctcaagtttttgcctctctactgatgttttcataacagtagagtccaagcagtcaaacaatgcactgtaaaagtacaatgctctatcaactctctccatcaaattggaaccattcagatttgattcttgttcagtaatcactactagttttggttgaagttttctaatagcattgagaaagatccccatcttaggtgaggcacccaaggaaagcggtgacaaagcagaatcaggactcaaggtatatgcattgatcatatctctctcaagccactctgcaaaagtcctttgacccatatgcagtgctctctgcacattcatagatgctgccgcagccggtgagatcctccccgccatgtcatcatcagtggcaagaagagaatgcagctgaagaacagaactgattgcaagagcatctcctatcttcacaggcaacttctcaaagtcaacatcttccagtttgctaacaactggatagaactgcaaaggaaaatccaatttccctgcttcagttgtcaaatgaaagttcatttggtctaatacctctttcttctcgtgaatgcctgtaattttcagatggggtggacctccctgacggtttttgaaagttagtagaagatctatccattgagttggctcacaacagtgaagatcaataatgtgaaccaccttttcgcactccatggcctcagcaatggcatggtttgtgatcaggtatgagaacttcaaaaatggacacagttcatagaagtatttctgaacaaggatatcttcagaagataatgatgtttttgatggattgagagacttatatacaccaggcaaattttttattatcctgtaaccaagtgcttcactgaaataagtgaccatcctttgcactgcattaccatcaggagatgaaatctgagatatgtactcaaggccaatatctgcattcttgatgcttccagatgcaacacatttggcacagtcaataagaaggcttattggatttaagccctgggagtcccatctcagctccctcagccactgggatggcgaacctaatccatccataatagctggattagcataaatgagagccgtaggtgtgaaaagagaaaatataggatgttcattctactcagagcatgtaaatgtttgataaaaacagttccagatacaatttgtcaatcagacaatgatacttgggagttttcttcttcctttccttttcagaagatattactttttggtagtgagaaaaaaaaaaaaaaaaaaaaaaaaaaaaaaaaaaaaaaaaaaaaaaaaaaaaaaaaaaaaagggcggccgc

SEQ ID NO: 1252 - DNA, 437 bp, Oryza sativa
  Predicted polypeptide sequence is orthologous to G922
cccacgcgtccgcgacctctgcccgttcctccgcctcgccggcgccgccgccaaccagtcgatactggaggccatggagtccgagaagatcgtgcacgtcatcgacctcggcggcgccgacgccacgcaatggctggagctcctccacctcctcgccgcgcgccccgagggcccgccgcacctgcgcctcacgtcggtgcacgagcacaaggaactcctcacccagacagccatggcgctcacgaaagaagcagagcgcctcgacgtgccgttccagttcaacccggtggtgtcccgcctcgacgccctcgacgtggagtccctccgcgtgaagaccggcgaggccctcgccatctgctccagcctccagctgcactgccttctggcgttcgacgacgacgccggcgtcgtggcgggcggcgacaaggagaggcgga

SEQ ID NO: 1253 - DNA, 487 bp, Oryza sativa
  Predicted polypeptide sequence is orthologous to G922
gccatgcggagacggagaagagggcgcgatcttgccagcagaggaagaagttgcccttctcctcccggaccttgaagccgtcgcagccgaggccctgcgccacccgccgcgcctggagcagcgcgtagtagctgagcgggacgcggccgaagccggcgccctccagccgccgcgcccaccgctccagccgctcgtgccgctcccgccgctcgccgccgtcgcacgccacgatgttcttgatctcctccccgagcagccaccgctccacgcgcgcgcgctccaccgacccgcgcgccgcccccacctccaggcagtcgaacagcgccgcgtagtagttgagcgcctccacgaacctctccgtcagccccgccgcgttgtggctcgcctcctgctccgccaccaccatcaccttcggcgacagcccccacagcgcgcccaggaacgcgtccgcgcgcgacgtcgacggcgacagcccggactccgggct

SEQ ID NO: 1254 - protein, 810 aa, Oryza sativa
  Orthologous to G922
MMHGLWVQDQGVVDHLAQLVPLLHECASHVTEGSFEKADFSFKKIRMLTIADGPLQRLSTIIVDSLAHRLLSSIQGLPGALIDPSDYFEKSTLRAARHNFFKLNPYLSTGFVTINWAIMEAMEDEKSLLSKKAESLGVSFHFISVIGRLETLDFSNLRSTFQIKFGVAVAISCALQMHRLLLVDDNLSSTSIAQLQKMANFTQPKQMASSVCSPASTLNYLQTPSPRTPKLLARLLSAIRALKPNIMLIMEQDADHNTLLFRDRFNEVLNYYAALFDCFHAVAAANPGRTDERLRVDRMILREEIKNILLRLCCTDRGMFQDDMLSSATSSPASSVYSPSPSPSNGSWVQELSHDQQSVRLIGLLYQCAAEVSAGSFDRANLCLEHITQLASLDAPHALQRLAAVFADALARKLLNLILGLSRALLSSANSADAHLVPVARRHMFDVLPFLKLAYLTTNHAILEAMEGERFVHVVDFSGPAANPVQWIALFHAFRGRREGPPHLRITAVHDSKEFLANMAAVLSKEAEAFDIAFQFNAVEAKLDEMDFDALRHDLGVRSGEALAVSVVLQLHRLLAVDDGRRHAAAGCLTPVQIIARSSPRSFGELLERELNTRLQLSPDASVVSSLSPHSPAAATAAHPTTSTPKLGSFLSAVRSLSPKIMVMTEQEANHNGGAFQERFDEALNYYASLFDCLQRSAAAAAERARVERVLLGEEIRGVVACEGAERVERHERARQWAARMEAAGMERVGLSYSGAMEARKLLQSCGWAGPYEVRHDAGGHGFFFCWHKRPLYAVTAWRPAASRRGHTRS

SEQ ID NO: 1255 - protein, 399 aa, Oryza sativa
  Orthologous to G922
MPLHPAAAASPTPPWMVRELRSDERGLCLIHLLLNCAAAAAAGRLDAANAALEHIASLAAPDGDAMQRVAAAFAEALARRALRAWPGLCRALLLPRASPTPAEVAAARRHFLDLCPFLRLAGAAANQSILEAMESEKIVHVIDLGGADATQWLELLHLLAARPEGPPHLRLTSVHEHKELLTQTAMALTKEAERLDVPFQFNPVVSRLDALDVESLRVKTGEALAICSSLQLHCLLASDDDAAAVAGGDKERRSPESGLSPSTSRADAFLGALWGLSPKVMVVAEQEASHNAAGLTERFVEALNYYAALFDCLEVGAARGSVERARVERWLLGEEIKNIVACDGGERRERHERLEPARRVAQGLGCDGFKVREEKGNFFLCWQDRALFSVSAWRGRRFD

SEQ ID NO: 1256 - protein, 223 aa, Oryza sativa
  Orthologous to G922
MALTKEAERLDVPFQFNPVVSRLDALDVESLRGLSLKVMVVTEQEVSHNAAGLTERFVEALNYYAALFDCLEVGGARGSVERTRVERWLLGEEIKNIVACDGGERRERHERLEGAGFGRVPLSYYALLQARRVAQGLGCDGFKVREEKGNFFLCWQDRALFSVSAWRGRRFAALLPLPPSTPLPCSRVIATLLSSPPPPCSPLHPYCPERRERMKGEKKGKRE

SEQ ID NO: 1257 - protein, 442 aa, Oryza sativa
  Orthologous to G922
MVQDEGSSSSVTSSPLHNFSNMPLHPAAAASPTPPWMVRELRSDERGLCLIHLLLNCAAAAAAGRLDAANAALEHIASLAAPDGDAMQRVAAAFAEALARRALRAWPGLCRALLLPRASPTPAEVAAARRHFLDLCPFLRLAGAAANQSILEAMESEKIVHVIDLGGADATQWLELLHLLAARPEGPPHLRLTSVHEHKELLTQTAMALTKEAERLDVPFQFNPVVSRLDALDVESLRVKTGEALAICSSLQLHCLLASDDDAAAVAGGDKERRSPESGLSPSTSRADAFLGALWGLSPKVMVVAEQEASHNAAGLTERFVEALNYYAALFDCLEVGAARGSVERARVERWLLGEEIKNIVACDGGERRERHERLERWARRLEGAGFGRVPLSYYALLQARRVAQGLGCDGFKVREEKGNFFLCWQDRALFSVSAWRGRRFD

SEQ ID NO: 1258 - DNA, 1062 bp, Glycine max
  Predicted polypeptide sequence is orthologous to G926
  misc_feature (1026)..(1026): n is a, c, g, or t
ccctcgcgttttcccacgcgtccgcccacgcgtccgattttctatcagaatctgagggcccaaaatctagggttttctgttcttctctggggatctgaagacatgcagtccaagtctgaaactgcaaatcgactgagatcagatcctcattcctttcaacctggcagtgtttattctgagccttggtggcgtggtattgggtacaatcctgtggcccagacaatggctggggcaaatgcatccaattcatcgtctcttgaatgccctaatggtgattctgaatccaatgaagaaggtcagtctttgtccaatagcgggatgaatgaggaagatgatgatgccactaaggattcacagcctgctgctcctaatggaacccgcgcgtccgggcaagaacagcaagggatgctgcatactgcatcatctgcaccctccatgcgtgaagaatgccttactcagacaccacagctggaacttggcggtcattcaattgttagtctatgcctttgttgttatcacttttttaagacatatacatggtccaaatattgatgacttagttcaatagcataaattgttggtgattcatgcatatcattttgataaaaaaaaaaatctgttatagaatttatagttggcttgcctttggaatggattggactcttcatattcttttgatgtaggcatgtgctacaaatccttatcaggatccgtattatgggggcatgatggcagcttatggtcaccaacagttggtatgtgacattaatctggcttaattcaatattaaagattattgcatatataggtcatagtcataaactcataattactaatttgcatttttcacaaattagcctgataagaaatgtgggtagtacataatccagaagggatatgttcctgtcataatgataaatttgtttcattttggttggtctattggcttggtaaagcaatggtgatatttggataacagagaaaaataaccatgtgatatttttaccattagggatatggctcttntataggaatgcctcatgccagaatgcctttgcccct

SEQ ID NO: 1259 - DNA, 946 bp, Glycine max
  Predicted polypeptide sequence is orthologous to G926
  misc_feature (903)..(903): n is a, c, g, or t
gttgtgttactattttttttttttaaatgtttgttttgatttttttataattttctctgttattattggtgtcgttgctattaattaatttctggtgctaaattgagataactgtgtgtgacaaagagagagagtaatcaagatagctcctttgaattttctatcagaatctgagggcccaaaatctagggttttctgttcttctctggggatctgaagacatgcagtccaagtctgaaactgcaaatcgactgagatcagatcctcattcctttcaacctggcagtgtttattctgagccttggtggcgtggtattgggtacaatcccgtggcccagacaatggctggggcaaatgcatccaattcatcgtctcttgaatgccctaatggtgattctgaatccaatgaagagggccagtctttgtccaatagcgggatgaatgaggaagatgatgatgccactaaggattcgaagcctgctgctcctaatgaaacaggaaattatgagcaagaacagcaagggatgcagcatactgcatcatctccaccatccatgcgtgaagaatgccttactcagacaccacagctggaacttgttggtcattcaattgcatgtgctacaaatccttaccaggatccgtattatgggggcatgatggcagcttatggtcaccaacagttgggatatgctccttttataggaatgcctcatgccagaatgcctttgccccttgagatggctcaagaacctgtgtatgtgaatgccaaacagtaccaaggaattctgaggcgaagacaggctcgtgcttaagctgagcttgaaagggagctcataaaatctagaaggggcataacatgctcacaaacattggacagaattgggttcctctactactagtgtncttcttaacgttttgggatcctctattgggctatatgctgaca

SEQ ID NO: 1260 - DNA, 858 bp, Oryza sativa
  Predicted polypeptide sequence is orthologous to G926
agaaggatcaacaggcaatggcatcctagagtttgcagcaccagtaatttgaggatgaacaaatgcatgtgaagtgtatcctgttaatactccaccataatatggatcagtaccatatggataagaaacacatgcaaaaggctggttgtaatcgaactttgaaggaggaaaggcagcttctgtgttccccaaagacaataccgacttagtgccatggtcccgctccccacaactatcattgttgttaatatctgaggggacaaacactgattgtggtgaggtgtgttgtccgttgagactgctgtcacttactgcagatgcttcttggtgagactccccagactttgttggtgacgactcaccaccagagttcctctgaactaactgtttcattggatagttattcctggcaagaaaatcatagttggtcttggccatgcattggacaggatgattctccatttcttgcaacagcattatcattattagaaggcattactcaagatccacaaacattttctgtcctcctattttgaagttcagaaaattttcaggtcagactgacagtggcacataaagaaagccaagttactagataaattagtaccttgaattcggtttgtatactatccacatacaatgattagggattaggttgtacaaacatccaaactcagctggatgaacagttgaaaatgatcgaagcataaaataaatcaaagaactattgtacggcctctacaatatcattaacaaacaatactatgtccacttcatgatggattaatctatctagacagtacacctccaggataagaagtagaaatcctcctcgtgccgattcctgcagcccgggga

SEQ ID NO: 1261 - DNA, 383 bp, Oryza sativa
  Predicted polypeptide sequence is orthologous to G926
agcctttggtccggcgggtggtgtggcggtggcgcgactagtggaggtagggcttcctgccttagaccagcctgttctccctctgggccttggcgcgggcacggtgacggcggaggatgccttcgtactgcttcgcgttgacatagattcggcgcatcggtatggcgcgtttagcggcatgtatgcattcgccctgccacctcatttgatttccatccgcgttaggtggtcaataagaaccatagcatttggctccataccaaggaataacttggtgagaggacctgaaaccacatggcctagtaatgttaacccaaattaggcaacgcataacacaccttgatggttactattcagaaaataaaatctttttagtaagtaca

SEQ ID NO: 1262 - DNA, 1666 bp, Zea mays
  Predicted polypeptide sequence is orthologous to G926
cccagcgtccggcccgagccacttacaataatccttgcccaatcccgtctttagccgctagggttacgcgtccacggcgacgacctctgcgcagagcgtgctgcgattggccggccttcctgggatcctccccgcgcccgacacccggaaacgcgcgcgcgcgcgagggagagacagagtgaggaaacgagggaaggagacgacgcgctcgcctattggccgccggctccgctccttcgcgcccagtgcgacggccacggcctgagcggcgctgccagcaaggcggctagtatgagcagcatggagtcgcggccgggccgaacgaacctggtggagcccatagggcacggcgccgcgctgccgtccggcggccaggcagtgcagccgtggtggacgagctccggggctgtgctcggtgcagtctcgccagccgtcgtggcggtggcgcccgggagcgggacggggattagcctgtcgaggcagcccggcaggtggtagtggtggtggcggcgcggctaaaggagccgcgagtgacgagagcagcgaggattcacggagatctggggaaccaaaagatggaagcgctagtcaagaaaagaaccatgccacatcgcagatacccgctctggcgccagagtatttggcaccatactcgcagctggaactgaaccaatcaattgcttctgcagcatatcagtacccagatccttactatgcaggcatggttgctccctatggaagtcatgctgtggctcattttcagctacctggactaactcaatctcgaatgccattacctcttgaagtatccgaggagcctgtttatgtaaatgccaagcagtaccatggtatcttaagacgacaggagtcccgtgctaaggctgaacttgagaaaaaggtgggcaaagccagaaagccataccttcacgagtctcgtcatcagcacgcgatgaggagggcaagaggaaacgggggacgcttcctgaacacaaagaaaagtgacagtggtgctcccaatggaggcgaaaacgccgagcatctccatgtccctcccgacttactacagctacgacagaacgaggcttgaagtagcggtatggctctggcatccttgaacagcagttcctgtccacgggcgtaggcattcgagaccggattcatatagctctccacagcatacgcgcagccatctctgcggtaacgcacgttctcctgaacgagctttgtagcgagataggtatgcaagtgcaatctgggcgcaggaatccatcatcaagtgcccaatgcccatggggtaggtacgctgtttcaggcaattcattcttggctttcacgttccacccttgtgtaactggtgtgttgtaaatgtgtggaaaactaagcttgtgctctgtatcgggccgttcagcggaactgcaaaacgcctgtataattaagatcgaactttggattaactcggtaatgctttgtctggttttcttttagcttttcaactgtaacacggccacagctgattcatgtgatgtgcttgcatatctttccttgtgccaatttttgtttgggggaacgcagtaattttatattttttatattcgggagtccacacaatcgtgtaaggttcctgcgaaccagttctgactttaattgaaccgcccggattcatatg

SEQ ID NO: 1263 - protein, 314 aa, Brassica napus
  Orthologous to G926
MISLTVTTPSLRETEDMHSKSESGNQIVSEAHHHTSSTSINSLNPWLRAAASCNANSSVEEAGDKSIALENQTNLESSNGSKSPSNRDENGNKESQVTASPQQSAADYSEKSQELVHPGSTPPPHPQLVSHTVGWASSNPYQDSYYAGMMGAYPLTYVPHGGMPHSRMQLPPEMAQEPVYVNAKQYQAIMRRRQARAKAELEKKLIKSRKRYLHESRHQHAMRRPRGTGGRFAKKTNTEASQQKDGEKRNACATQSPTSSHSDQHEGCSDEYRTNQSDEMQSSAYKIREEADCSGQQWNNISSNHPSQPLLAIK

SEQ ID NO: 1264 - DNA, 642 bp, Glycine max
  Predicted polypeptide sequence is orthologous to G961
  misc_feature (562)..(562): n is a, c, g, or t
tcacctcatcatctatcattatatctttctttcaattcctatcctcttccttgtagtgtacccattttgaatgtgttctctctctctctctctttctttaggtccctggtgaatatctagaaccactctctagctagtttctctcttcttgctagctagctatcgccgatcactctcttggtttaaaccacctgaatgccggaaaacatgagcatatcagtgaatggtcaatctcaagtccctcctggcttcaggtttcatccaactgaagaagagcttcttcagtactacttgaggaagaaggtctcttacgagaagattgacctcgacgtgattcgtgacgttgatctcaacaagctcgagccatgggacatacaagagaaatgcaaaataggaaccactccgcagaatgattggtacttcttcagccacaaagacaagaagtaccccacaggaacgcgcaccaatcgcgcaactgctgcagggttctggaaggccactggccgcgacaaagtcatctacagcaatggaaagaggattggaatgagaaagactctggttntctacaaaggaagagcgccacatggccagaaatccgattggatcatgcatgaatacagactagacgacaccacaccagcg

SEQ ID NO: 1265 - DNA, 497 bp, Glycine max
  Predicted polypeptide sequence is orthologous to G961
gaaagaggaagacctactctctatctttaaacatgatccgggagagaataggggactcactcttcctatatttaccatcctaccatgaaggaaatagggggccttcacacttttggtttaaaccacctgtttgccggaacacattaccctgccaggtagtgcacaagctccagtgcctcctgggttcccgactcatccgactgaagaacagcttattcaccactactagacgaagaggtctcttacgagaagaggacctcgacgtgattcgtgacgttgatctcaacaagctcgagccatgggacatacaagagaaatgcaaaataggaaccactccgcagaatgattggtacttcttcagccacaaagacaagaagtaccccacaggaacgcgcaccaatcgcgcaactgctgcagggttctggaaggccactggccgcgacaaagtcatcttcagctatggaaagaggattggaatgagaaaaaactctgttttc

SEQ ID NO: 1266 - DNA, 1034 bp, Oryza sativa
  Predicted polypeptide sequence is orthologous to G961
  misc_feature (4)..(4): n is a, c, g, or t
  misc_feature (199)..(199): n is a, c, g, or t
  misc_feature (205)..(205): n is a, c, g, or t
catngtgtcatggctccatcaccacctagcagctctacacctctctcttatattagctctctctctctctctacccccattcatgctcatctccttctagcttccagcttaatcccttccttgtcaatgttaatggacaaactctgagcattgcactacccatcatctcctagctagactcaccttagcttgtctcttngcgtcnctagtgtgtgattctttctcccatttcctgtttggtttgcactgagtgaacaagcaattaagcttggtagtagtagtagttgttgtattgatcgatcgatcgatctagagacgacgatgagcatatcggtgaacgggcagtcggtggtgccaccggggttccggttccacccaacggaggaggagctcctgacatactacctgaagaagaaggtggcctcggagcgcatcgacctcgacgtcatccgcgacgtcgacctcaaccagctcgagccatgggacatccaagagaggtgcaggattgggtcagggccgcagaacgactggtacttcttcagccacagggacatgaagttcccggcggggacgaggacgaaccgggcgacgggcggccggcttctggaaggccaccgggcgcgacaaggccatctacaacgccgtccaccgcatcggcatgcgcaagacgctcgtcttctacaagggccgcgccccccacggccagaagtccgactggatcatgcacgagtaccgcctcgacgaccccgccaccgacaccgccgccgtcacacccacggttacttctgctgctgctgcggcggcggcgatggccgcggcggcggacggcgggcaggaggatggctgcgtggtgtgcagggtgttcaagaagaagcaccaccacaaggaggcccgcgggaggcggcggcaagcacggcggtcgacggcagcgcccggcgccaagggcggcgcacgcttactcctccagcgacgacgcgctcgaccagattctgcagtacatgggcaggtcgtgcatgcaggagcacgagcttccc

SEQ ID NO: 1267 - DNA, 633 bp, Zea mays
  Predicted polypeptide sequence is orthologous to G961
  misc_feature (9)..(9): n is a, c, g, or t
  misc_feature (572)..(572): n is a, c, g, or t
ggtaccctnccgagcctggccgggctgccaccagcaattcccttccattcctcacatcgtcttcctcctctggccttcccatcttcttcctctcgtcctcgatcgatcatcctgctaactagctagaggtctggcactagctgctaactagaaaaaaggaagaaagcaagcaagctaagaaggaattgaagatcgtatcatcaatgagcatctcggtgaacgggcagtcgtgcgtgccgccggggttccggttccaccccacggaggaggagctgctcaactactacctccgcaagaaggtggcctcccagcagatcgacctcgatgtcatccgcgacgtcgacctcaacaagctcgagccatgggacatccaagagagatgcaagatcgggtcgggtccccagaacgactggtacttcttcagccacaaggacaagaagtacccgacggggacgcgcaccaaccgcgctacggccgccggcttctggaaggccaccggccgcgacaaggccatctacagcgccgtcaggcgcatgggcatgcgcaagacgctcgtcttctaccggggccgngcgccgtacggacacaagtccgactggatcatgcacgagaattgactggacaaccctgact

SEQ ID NO: 1268 - DNA, 1203 bp, Zea mays
  Predicted polypeptide sequence is orthologous to G961
ccacgcgtccgcccacgcgtccgcccacgcgtccgcccacgcgtccgcccacgcgtccgcccacgcgtccgcccacgcgtccgcccacgcgtccgcggacgcgtgggatcgtcttcctcccctcacatcctctggcctctggtcctccaccgtcctgctagccagagctgctcttgtacgcgcagctggcctctgtgcatatcaccagcacaccgcgcaggggaaggaaattaacaagagaaaaggcaaggagagcaggcaggcaaggaagctgcagaagccaaggaaggagaaggaggatcatcaatgagcatctcggtgaacgggcagtcgtgcgtgccgccggggttccgcttccaccccacggaggaggagctgctcaactactacctccgcaagaaggtggcctcccaggagatcgacctcgacgtcatccgcgacgtcgacctcaacaagctcgagccatgggacatccaagagaaatgcaagatcgggtcgggtccccagaacgactggtacttcttcagccacaaggacaagaagtacccgacggggacgcgcaccaaccgcgccacggccgccgggttctggaaggccaccggccgcgacaaggccatctacaacgccgtcaagcgcatcggcatgcgcaagacgctcgtcttctacaagggccgcgcgccgcacggccagaagtccgactggatcatgcacgagtaccgcctcgacgaccccgctgctgctgctgctgctggatccggtgatgccgtggccaacgacgacgcagccgccacggctgctgctgctgccgccgcgtcgtcggacggcgggcaggaggacggctgggtggtgtgcagggtgttcaagaagaagcaccaccacaaggagtcaggtgggggcgggggcaacaagcacggcagcagtaacagcgagcatgggcacggcggcgccggcaaggcatcggctgcggctgcggctgcggcgcaccagcaccagcaccatggaggcctgcagtactcctccagcgacgaggcgctggaccagatcctgcagtacatgggcaggtcgtgcaagcaggagcacgagctggtgtcgccggcgccggcgccgccgggacgggcggcggcgtccaggtacctccggcccatcgagaccgttctgggcgggcacgcgttcatgaagcttcccgcgctcgagagcccgtcc

SEQ ID NO: 1269 - DNA, 820 bp, Zea mays
  Predicted polypeptide sequence is orthologous to G961
  misc_feature (750)..(751): n is a, c, g, or t
  misc_feature (755)..(755): n is a, c, g, or t
  misc_feature (758)..(758): n is a, c, g, or t
gccggccggttctgggtacccggcttccctcgtcaccggctccggctccggcaccggctcaatacaatcccatcaccaatcattcattccctttgcctactactgctaccttctcctccttccatcttcgatagacgacgaaataatggcggtattcgacgtctgaatcctcgtactcttatactgcatacatacagacagacccttcttcttccttagttccctatagctctagctaggcgaccgatcatgagcatctcggtgaacgggcagtcggtggtgccgccggggttccgtttccacccgacggaggaggagctgctgacctactacctgaagaagaaggtggcgtcggagcgcatcgacctggacgtcatccgcgacgtcgacctgaacaagctggagccatgggacatccaagagaagtgccgcatcggttcgggcccccagaacgactggtacttcttcagccacaaggacaagaagtacccgacggggacgcgcaccaaccgcgccaccgccgccgggttctggaaggccaccggccgcgacaaggccatctacgcctcgccgggcgcccgccgcatcggcatgcgcaagacgctcgtcttctacaagggccgcgccccgcacgggcagaagtccgactggatcatgcacgagtaccgcctcgaggcgcccgtcgacgccggagccggcgccgcgcaccacctgctgctccccgccgccgaacatcctccctactacacnntcgncgncgcaggcggcttcttcaatactaccgcaacgatcccgtggcgcggcgggagaccagcgggca

SEQ ID NO: 1270 - protein, 395 aa, Oryza sativa
  Orthologous to G961
MSISVNGQSVVPPGFRFHPTEEELLTYYLKKKVASERIDLDVIRDVDLNKLEPWDIQERCRIGSGPQNDWYFFSHKDKKYPTGTRTNRATAAGFWKATGRDKAIYSSSNRIGMRKTLVFYKGRAPHGQKSDWIMHEYRLDDPSSASASVSVNLPSYYSSSSSSSSPMHGVAGDQGAQEEGWVICRVFKKKNLVHHGGGAAAASHHAAAKLAAAAMEGSPSNCSTVTVSDHVKAQMLHSSASDDALDHILQYMGRSGCKQETKPAAMSASSAAAAAALEQHLSTPQYGKFMKLPPLEHVAGGVGLLAAAGGGGEYCSAADASGIADWDTLDRLAASYELNGALSDVASGKNMAGFFDVVDQPAGAAAFSSGDGDLWSLARSVSSSLHADLTTMNNV

SEQ ID NO: 1271 - DNA, 1465 bp, Glycine max
  Predicted polypeptide sequence is orthologous to G974
tacggctgcgagaagacgacagaccgcgaagagtgaaactgccaaaaagtgaggccaccccaaaaacaaagtgagattataggaaacaaaaatttctttgcttaatactagttcctcctttctcctagcctggtagtcttttgaaaattctttatcttgatcacataattttcattttgaacttgaagaaagttttagtgtatttttttttccttaaagaaacagaacatatcctgttctttctttctctgtttgcatttttgttcacttctttctttctttctttctttcttattatctagttaagcatgacaacatttatggacatgtacaacactactagtagcatcatgacaccggatttcttagaccagtgtagtgatcaagagctgatgaaagcacttgagccttttatgaaaagtgattcatctagcactacttcctcatcaataacaacatacccttcattctcttctttttcttcttctcccaacttgtcctcaacaacatggagcacccaattttgctcctcaagctaccaccaaaagggtccaactccaacccaagctagttccttcaaactgaaccaactcaccccatcacaaatatttcaaattcaagcccaaatccaggttccacgagcccagtttctcagcccaaagcccattcccatgaagcacgtgcgggcttctccttcttcaaagcccacgaagctttaccgtggggtgaggcagagacactggggcaagtgggtcgctgagatcagactccccaagaaccgaacacgtctctggctaggtacatttgacaccgcagaggaagcagcgttggcttacgacaacgcagcgtttaagctaagaggagaaaacgcgaggctcaacttccctcacctgcgtcaccatggagcacgcgcgtacggtgagtttgggaactacaagcctctcccctctgcggtcgatgcgaagcttcaagccatttgtcaaagcttggggaccaattcgcagaaactcaaaactcaaaaccctattgttctagatacacacaaggcagagacagagacatcggagtttcaggattttaataaggttgagaattaccaaacatcatcgtcctcggccttctccgatgaatattcttcttcttcttcttcttcttcacctgaatccgatattaccctcttggatttctcggattcttgtgaaacaatggacaatcttgggttggacttggagaagtacccttccgtggagattgattgggcagctttatctgactcatgaataatcagtggttaacgggtatagtttagatttgatgtgttttaggttgcttttgtttgtttttttcttgttaatcagtgttttagatattgttttggaagttcttctaaatcacagcgcattataatgtcactgtgactgataaattattaagccattaatcgaataaaattttacacaatcac

SEQ ID NO: 1272 - DNA, 1245 bp, Glycine max
  Predicted polypeptide sequence is orthologous to G974
ggttctagaacttccatgagctcacctctgaatggatctgcctcaacttgttcttgtgatttcccttcctcttctttactttctccacaccccaatttctacacacacactccccccccttcctacttactccaaagccaacaatccttaataggctttgagcaaccaccgagttcccttctcgggctcaaccacctaagcccgtctcagatttctcagatccaggcccagatcgaggcccaacagagccaaaaccagaacccacactctctcaactttctcggcccgaagcccgtcccaatgaagcacgtgggcgggcctccgaagcccacgaagctgtaccggggcgtaaggcagaggcattgggggaagtgggtggcggagatcaggctcccgaagaaccgaaccaggctctggctcggaaccttcgacacggcggaggaagctgctttggcttacgacaaagccgcgtataggctccgaggcgacttcgcgaggctgaacttcccgagcctgaaaggctcgtgccccggggaggagtacaagcctgtgcattccgcggtggacgctaagctcgacgcgatttgcgccaacttggcggaaatgcagaagcaagggaagacggagaaaggtgccaggtcagcgaagaaatcgaagcaaggtccgaaccaggaggccaagcccgaacctcaagcttccgctgaaagtgagggttctgcggattcttctccgctgtctgatcttacctttgatgtaaccgagccgcaatgggaacattttaatttgcagaagtttccttcttatgagatcgattgggattctctctgaacttcgtctttgtttttatgtctagtcttgtggctaataataataataatttaggttagtcttgctaggtggctgctgcaattgagtttttgaagattgcagtgcttcttgtaggatttcgatttttttttttttagcatttggttattggctatttggtcaatatgatgtaaatctctctaccttggtcagctgggtttttttttttttattattattttcttgcttggcctgggagaatgacttctagccttctaggtgttgtctatgctttgatgttcatccaagtatgttattattattattattgttgttgatgtaattcaattttatttgcatctcagaatttatgaatatatttgtatttcagcttaaaaaaaaaaaaaaaaaaaaaaaaaaaaaaaaaaaaaaaaaaaa

SEQ ID NO: 1273 - DNA, 1881 bp, Glycine max
  Predicted polypeptide sequence is orthologous to G974
ccacgcgtccgcccagagagagtttctcaccaaacacacacttctcttctcttctcttctcttcattttctgtggttctcactttcttttctctaatcttctaatctcttattttcttcccccctctgttactccccgcttctctgaatccctttctgttaatcatctgtctttcaactcgtgattttttgggtttgcctcaccaaaaagattcaaactttgaaaatttttctcgaaagccaggtgttttcagaatcgagatccagctttttttttgtttgtttttaaaaaattattattttctttcgttcagccgcgagggttgtttttgatccctcaaaagctctctttctttttttctttcttggatttaaggggttgtctattttaaacctctcccatccttttttgttgtaatatttaaaaaccacaggttgatttttttaatctaagatctgtgtgtgtagttggaaaattgaatttttatatggcagctacgatgaatttctacaacgaaacatcacaacaagttcagtcagatccattcagaggagagctcatggaagttctagaaccttttatgaaaacttgtccttcctcaactccctctattctctcctcagattcaccatcaccttcctcttactctcctttactacctccacaccccagtttctccacatacaccccctctgcctacttattccaaaaccaacaacccttaataggctttgagcaacaaccaagttcccttctcgggctcaaccacctaagcacgtctcagatttcccagatccaagcccaagcccaagcccagaactcgctctctcttaatttcttgggccccaagcccgttcctatgaagcacgttggtgggccggcgaagcccacgaagctgtaccggggcgtgaggcagaggcattgggggaagtgggtggcggagataaggctaccgaagaaccgaaccaggctttggctcggaaccttcgacacagccgaggaagccgctttggcttacgacaaagccgcgtacaggctccgaggcgacttggcgaggctgaacttcccgaacctgaaaggctcgtgccccggcgaggagtacaagcctatgcaggctgcggtggacgctaagctcgacgcaatctgcgcgaacttggcggaaatgcagaagcaagggaagaacgagaagggtgccaggtcggggaagaagtcgaagcaaggtccgaacctggaggcgaagcccgaacctgaagcttcgggttccggtgctgctgctctgtctcctgaaagtgagggttctgcggattcttctgctttgtctgatcttacctttgatgtaaccgagccgcaatgggaggatgcttcagcacattttaatttgcaaaagtttccttcttatgagatcgattgggattctctctgaagactctttgtttttttatttttatgtctagtcttgtgggtaattaataatttagttataattaggattgctcttgtggctgctgcaattgagtttttgaagattgcagtgctacttgtaggatttggattatgttagtcttttttctttttcttttttttttttaaatttgcttattggctattcgatggtcaatatgatgtaaatctctctaccttggtcagctggttttttttttcttgcttggccatggagaatgattccgggttaggtctttgtctatgttttagtgttcgtccaagtactattattgatgtaattcaattctatttgtatctcaatttatgaatgtatttgtatttcagcttacatattgtactagtttgtttcacacttgggccctcgtggtagttgtgtttggttcttgtatgaacaatcgattttattttctttgtggc

SEQ ID NO: 1274 - DNA, 1203 bp, Glycine max
  Predicted polypeptide sequence is orthologous to G974
  misc_feature (1058)..(1058): n is a, c, g, or t
  misc_feature (1128)..(1128): n is a, c, g, or t
  misc_feature (1142)..(1142): n is a, c, g, or t
  misc_feature (1158)..(1158): n is a, c, g, or t
gatccaagagtgacccgagacacagattcttaccaaataaacaaacaaaaaaacacacacacacacactttccattttctgtggttcttcttctcacttctctaatcttctcccccctctgttactccccgcttctctgaatccctttctgttaatcatctgtctttcacctcgtgattccaaaaagattcaaactttgaaaatttttctcgaaagccaggtgttttcagaatcgagatccagtttctttttatccttttgttaagaaattattattttctttcattcagccaagagggttgtttttgatccctcaaagcttttttctttcttcttggattaaaggggttgtctattttaaacctcttccatccctttttttttataaaaaaaattattatttttttttgtaatttttaaaagaaacgcaggttgatttttttaatctaagatctgtgtggtgtagttggaaaatttttatatggcagctacgatgaatttctacaacggaacatcacaagaacaagttgagtcagatccattcagaggtgagctcatggaagttctagaaccttttatgaaaactagtccttcctcaacaactccctctattattctctcttcagattcaccttcatcttcatcttttaatttcccttcctcttctttactttctccacaccccaatttctacacacacactccccccccttcctacttactccaaagccaacaatccttaataggctttgagcaaccaccgagttcccttctcgggctcaaccacctaagcccgtctcagatttctcagatccaggcccagatcgaggcccaacagagccaaaaccagaacccacactctctcaactttctcggcccgaagcccgtcccaatgaagcacgtgggcgggcctccgaagcccacgaagctgtaccggggcgtaaggcagaggcattgggggaagtgggtggcggagatcaggctcccgaagaaccgaaccaggctctggctcggaaccttcgacacggcggaggaagctgctttggcttacgacaagnccgcgtataggctccgaggcgacttcgcgaggctgaacttcccgagcctgaaaggctcgtgccccggggnaggagtacaagccntgtgcatttccgcggntggacgctaagctcgacgcgatttgcgcccacttggcggaaatgc

SEQ ID NO: 1275 - DNA, 1785 bp, Glycine max
  Predicted polypeptide sequence is orthologous to G974
ccacgcgtccgcggacgcgtgggcggacgcgtgggcgagaggtacttgctcacagatatattttttttttttgtctccatcattttctcgagagctttcagtttctgtggttcatctttcttcttcttaatctttccccccctctctgtaacatcccgcttctctgaatccctttctgctaatcatctgtctttcaagctaagattttctggtttgtcttttaattcaccaaaaagcaaacttagaaggatttttcgaaagccaggtgttttcagaaacgagatccaggttttattgtcgaatttcgctagtcatattaatatttcatcattttttttttcctttgaaaccagccaagagggttatttttgatccctcaaagctaatttctcattttcttttccgggactgaagaggttgtctatttgaaatctccttcatcctttcctttcttgttgaaaagtttttgtttttgttttaattaaccagcagttcttcagttttagaaagacgcaggttgaattatcatggcagctatgatggatttttacagccagcagcacagagtttcaatttcactcagatccattcaggggtgaactaatggaagttcttgaaccttttatgaaaagtcctttctcaaccccttctccttcaaattcttgttttctttctacctcttactctccttcccccaacaactactctccctccctatactcaaacgggttatcatccatacccaacaccacccaaaacttaattggtttcgggcaagggcagcccacatctcttgtgggcctgaaccacctaaccccatctcagatctctcagatccaggcccaaatccagatccagaatcacagcaacacgctgagcttcctagggccgaagcccatccctatgaagcacgtgggcatgcctccgaagcccacgaagctatacagaggggttcgacagaggcactgggggaagtgggtggctgagattagactcccgaagaaccggaccaggctatggctgggaaccttcgacaccgccgaggaagccgctctggcgtacgacaaggccgcgtacaagctccgaggtgacttcgccaggctcaacttccccaacctccgacaccagggttcctccgtcggtggtgacttcggggagtataagcctcttcattccgccgttgacgccaagcttcaggccatttgcgagggccctggctgagctgcagaaacaggggaagaccgagaagcctccgaggaaaacgcgatccaaactcgcttctccgccagagaacgacaacaacaacgacaacaactcttgtaaggtcgaagctgcttcctcctcttctgaaggttcttcgccgctttcggttctgactttcgctgacgtcagcgagccgcagtgggaaggtgattcggataattttaatctccagaagtacccctcttatgagatcgactgggattctctgtgaagccgtgttttcttagtgtcctatgttgttatgtaagggtattaatcttcattatgtatggtctagtctaggtcttagtgtcttctcaggtggctgctactgcaatggagtttttggcaattgcagagcccagtcttagttaattactagtattctgtgtataatctctctctaccttgggtcatagctggtttttttcttgcttgaccagggagaattagtccacttaatatgtttctcaagtggcatcgctgtaatctactacttttaattataaaaatatggatttattattgtaaaaaaaaaacacc

SEQ ID NO: 1276 - DNA, 1911 bp, Glycine max
  Predicted polypeptide sequence is orthologous to G974
ctcgagccgcgagaggtacttactcacagatatatttttttttttttgtctccatcattttctcgagagctttcagtttgtgtggttcatctttcttcttctccttccctcccccctctgtaacaccccgcttctctgaatccctttctgttaatcatctgtctttcaagctaagattttcgggtttgtctattaattcaccaagaagcaaacttagaaggatttttcgaaagccaggtgttttcagaaacgagatccaggttttattgtcgaatttcgctagtcaaattaattttcataattatttttttctttgaaaccagccaagagggttatttttgatccctcaaagctaatttctctctctctttttttatttccgggactgaagaggttgtctatttgaaatctccttcatcctttcctttcttgtagaaaactttttaaatttttttgtcagtgggtgttttaattaaccacctgttcttcaagttttagaaagacgcaggttgaattaattagtatcatggcagctttgatggatttttacagcagcaggcccagagtttcaacttcactcagatccattcaggggagaactaatggaagttcttgaaccttttatgaaaagtccttctcccaactatttcccttcctccccctccctccctaatctttactcaaacgggttatccagcaacacccaaagcttaattgggcttcgggcaagcgcaacccacatctcttgtgggcctgaaccacctaaccccatctcagatctctcagatccaagcccaaatccagatccaggcccagcagcatcagaatcgcagcaacaccctgagcttccttgggccgaagcccatccccatgaagcacgcgggcatgcctccgaagcccacgaagctttacagaggggtgagaacagaggcactggggaaagtgggtggctgagatcagacttcccaagaaccggaccaggctgtggctgggaaccttcgacaccgccgaggaagccgctctggcatacgacaaggccgcgtacaagctccgaggtgacttcgccagggctcaactttcccaaaccctgcgacaccaggggttcctccgtcggtggtgatttcggggagtacaagcctcttcattccgctgttgacgccaagcttcaggccatttgcgaaggcctggctgagctgcagaaacaggggaagaccgagaagcctccgaggaagtcgcgttccaaactcgcggagaaggttgtttccgacaaggagaacaacaactcttgtaaggtggaagctgcgtcctggtcgtcggaaggttcttcgccgctttcggatctgacgtttgctgacgtgagcgaggctcagtgggaaggtgattcggataattataatctccagaagtacccctcttatgagatcgattgggattctctgtgaagtgtcctattatgtatggtctagtctaggtcttagtgtctcttaggtggctgctactgcaatggagtttttggcaattgcagggctagtactattctgtgtataatctctctaccttgctcacagctggtttttttcttgcttgaccagggagaattagtccgcttaatatgtttttcaagtgcatcgctgtaatctacttcaatttcatcatcttataaaatatattattctactaattctgtgttaacaattcctgaattaatgtatacactcttcattcttcaacatagcatgcaggtctatacaggaaatacactctgttcaacagctgacattcaatgagctacatgacgtcggtcacttctctacgatgttaatcttttttcccactataacactatgtttggtttggaaaagaaagtggaaggaaagaaagtggaagtaaagaaagtgattcgtgaaggct

SEQ ID NO: 1277 - DNA, 903 bp, Oryza sativa
  Predicted polypeptide sequence is orthologous to G974
gcacgagggagagaactagtctcgagtttttttttttttttttttttttttttttttttttttgggtttttgatacagttaattcacagtagttctattacaggtagttaccaacaattgattacaacaacctacatgcacaagtatttgtacatttgtagagttgtacaactactacactaacgagtcactgcttactagacatcggagacgccggacacaaaaacgacgccggcgagcagcctccggaacctaaaaaaccaacacaaaaagaaaaggatctacacaagaacgaacatataatccatcgcctcgccgccgcgcagaatgcctaaaacctcatctgcgccggccggcaatggcgggctatggaggagaagagctagttattgttgttgagcagcgagtcccagtcgatctcgtacgacgggtacttggtgagcgcgaacccctccgcctcgtcccacggcacctcgctgaagtccagctgctccatcgccagcggcgacgccgccgcagacgacgacgacgtctccgagccgccgtcgtcgccgccgccggagtggtcggagccggaggacgacgacgccgcggcgaccaggggcgcattgatgggcatggccctgccggcgccgcccctggacctggatgaggcgttcttggacgcggcgatggtgtcgcagatggcctggagcttggcgtccacggcggcgtcgagcgggccccgcgacgcggcgttgtccgggaagttgagccgcgccgcgtcgccgcggaggcggtacgcggcctggtcgtaggtgagcgccgcctcctcggcggtgtcgaaggtgccgagccagagcctggtgcggtacagcttctgcgcccgcgccgccgccgccgccggagcagccgccctcgtgc

SEQ ID NO: 1278 - DNA, 1844 bp, Zea mays
  Predicted polypeptide sequence is orthologous to G974
  misc_feature (1806)..(1807): n is a, c, g, or t
  misc_feature (1834)..(1834): n is a, c, g, or t
ctcgactggccgtgccgtgagaaaaaacaaccggcagctcaaccaggagattagcacatacttactgctgcatcacaacactggacgacgatgtactagctactagtttactcattgctactcgcagccgccatggccgatgtctaaaatgccatcgagccaccgccactgcaaaccccaaatcgaaaattacacagagctaccattgagctgacactgactgaatcttgctgctgctactactatagcagttgtagttgatcgttcacgagaggatggaatcccagtcgatctcccaggacgggtacttgcgcaggtggaaggtctccgtctcgtcccacggcgcctcggtgaagtccagcttcgccatctccggcacgggcggcgccagcgtcggggaaggaggggagccggcggagcccgactcctcctccccctccgtcgacgccgacgccgagcacttgggggagtccgggggggacccggccgactcgtcgccggacgagccgctcttggacttggactccgacagggactggcagatggcggtcagcttggcgtccacggaggcgtgcagcgggccggcgaggcgcgcgccgcccgccgcggcggagggacgggaagttgaggcgcgccgtgtcgccgcggaggcggaaggccgcctcgtcgtaggccagcgcccgcgccctccgggcgtgtcgaaggtgccgagccacagccgcgtgcggttcttggggaggcgggatctcccgccacccacttgccccagtggcgctggcgcacgccgcggtacagcttcgactgcgccggcggcgacccggacttctttcatcggctgcgcccgcgggcccagggacccccgcgtgcaggcccctctgctgctggtgctggaacatgagctgggcctggatctgctggatctgggccgggccgagctggttcaggcccatcggcccagccacgcccggacgccgtcgaagccgcgtaaggcgacgagtagagtggcggaagctgcgagaaaggcgaggaggtgggggtgggaagaggcgaggtggtgtaggagggagggtgtaggcatgtaagaatctggggccaacgagtagcgatggtagggggaggaagcactcgttataaaaggctcgagtgctttcgcgagctcctgatccgagggggacgaggaggcgataaggtgtggcgctgttattccagtacttgtacatgtatatggctgcggccattgggagctcatatatggagaaagctggactggagctagaagaagaggcctgggcaggaacttaaaacgggaagaaataaaaggaggttgtttatgaaaacaggggtaggaaaaagtttggaaatcaggccctgttcctcaataaaagtagagaaacgaggggtgtgtttgtgcagagaaaaaaaaaaaagaagcggtgagaatccagaagagaaaaaaaggttctctggatctctgctcctcctaggagaggtgtgatgaggtgagaaaaaaaaaaatcctaacccaagaacacgcttcctttgaggattctaataaacccaaaagaagagcctcttgaaccggacctttcttgtgctgcgcgtccctgctgctaaaagaaccagagagttcagagaacgaacctgcgttgctgcgcctcggttgattttttttgctcggatcgctcaaacctcaccgtggagttgggatgggatgtggcttgttgttcttgtggggggggtggggttgagttgggacgcctctctcccaggccggcctcgaggtacccattcggtaggttgttaaannggggggggggggggggggggtgggtgnggggaggggg

SEQ ID NO: 1279 - DNA, 1803 bp, Zea mays
  Predicted polypeptide sequence is orthologous to G974
ctttttttttttttttttttttttttttttttttttttttttttttttttttttttttttttttttttttttttttttttttttttttttttttttttttttttttttttttttttttttttttttttttttttttttttttttttttttttttttggggaacagccgaacacagattgtttatacaacaataaaccatacaatagtagcaccaacagtagcagttcatcaaattacaactcctggacacagctagctagctgattttacaacatacatcatacggagcactactgcttgacaagcatctcctcacatcacaccgtgctgctctttacaacctgtagagcacagcacaccatctagcacaacaaaaacagctaccaggacaacggacacctgaacggccgggggggtggggtcactgacccagtgtgacacgtaccggccaccaccggagaacgccgggacacaaaaacgccgggcttcccgtcggttgtggttctctcctcctccggagaaccaaaccctaataaataacccgagatctacaactgactcaccagtgacaaggaccaaacgaatcggacggacatctacacagaacgaaccaacgaacggacggacggggattagcactaatgatccaactagtgcccgcgcaggatgtctaaaatcccatctgcgcgacggccgttaaccttctttaaccctcctcctgctgcgcgacggcagtgtgggtaggaagggagccagccagccagccagccagccagccaacaaggggcgacggattaattggcgaggagggagtcccagtcgatctcgtacgacgggtacttggtgagcgcgaagccggcggcctcgtcccacggcgcctcgctgaagtccagctgctgcatctccggcaccgtcggccctggcgaggcggacggcgacggggaccgggacgggcacgaggactcggtggcggactcgaggcaggacgaggtcgcgtcgtcggacgacggcgaggagcagcagttgctggtgggggcggacgtcgacgtagcagctgcggcggaggctggcttcttggcgcccttcttggacgcggcgatgctctggcacaggctctggagcttggcgtccgacggaggcgtggagcgggccgcgggaggcggcgttgtcggggaagttgaggcgcgccgcgtcgccgcggaggcggtaggcggcctggtcgtaggccagcgccgcctcctcggcggtgtcgaaggtgccgagccagagccgggtgcggttgcgcgggagccggatctccgccacccacttgccccagtgccgctgccgcacgccgcggtacagcttctgcggccgcgccggggcgggggccgcggacgccgacgccttcatgggctgggcacgcgggcccagcacggaggtctgcgcctggcgacgctgcaggtggaggcgggcctggatgtactgcatctgggaagggctcagctggcccgcctcgtcggccgcggcgaacgggtagttccctccgtaggaggaggcggcggcgacggcttggtggaaggagaacggcgacgaggggctaagtggctggtgcgggtggaggagcggactggatccgtgagcagaggcatcccggataaaaggctcgacgtgctctcatcagctcctcccctgacagatctatagtagcagccatctagactgtttttttttgttttttttgttttttttcctctctctctagcaaaccaagaacaaacgaagamactggcggaacccmacagccacagtaaaaaacagatc

SEQ ID NO: 1280 - DNA, 2146 bp, Zea mays
  Predicted polypeptide sequence is orthologous to G974
  misc_feature (2134)..(2134): n is a, c, g, or t
  misc_feature (2141)..(2142): n is a, c, g, or t
ctttatcagctgaccgatccgttataaaagacgtttttattttctctttttttttttaacagacatacaccaaaagagttaattaagttgcagcagagagatcataacaggggattgcacttactttctcgactggccgtgccgtaagaaaaaacactttttttttttttttttttttttacatacatacgccagaagagttaattaagttgcaacagaggagatcataacaggggattacactgactttctcgactggccgtgccgtgagaaaaaacaaccggcagctcaaccaggagattagcacgtacgtttacttctgcatcacaacacagccgccatggccgatgtctaaaatgccatcgatccaccgcagctgcaaaccccaaatcgaaaattacacagagctatcactgactgaaccttgctgctgctgctgctactactactaaaatactagttgtagttgatcgttcatgagaggatggaatcccagtcgatctcccaggacgggtacttgcgcaggtggaaggcctccgtttcgtcccacggcgcctcggtgaagtccagcttcgccatctccggcacgggcggcgcctgcgtcggggaaggaggggagccggcggaggccgagtcctcatccccctccgtcgacgctgagcacttgggggagtccggcagggacgcggccgactcgtcgctggacggagctgttcttggacttggactccgccaggggactggcagatggcggtgagcttggcgtccacggaggcgtggagcgggccggcgaggcgcgcgccgccgccgcggcggagggacgggaagttgaggcgcgccgtgtcgccgcggaggcggaaggccgcctcgtcgtaggccagcgccgcgccctcggcggtgtcgaaggtgccgagccacagccgcgtgcggttcttggggaggcggatctccgccacccacttgccccagtggcgctggcgcacgccgcggtacagcttcgactgcgccggcgccggcgccagcggcggcggcggcgacggcgacccggactgcttcatcggttgcgcccgcgggcccaggaacgccgcgtgcaggcccctctgctgctgctgctgctgctgctggaacatgagctgggcctggatctgctggatctgggccgcggccgagctggttcaggcccatcggcccagccacgcccgacgccgtcgaagccgcataaggcgacgagtagagtggcggaagctgcgaggaggcgtggaggaggaggtggtggcggcgggagtgggaagaggcgaggtggcgtagctggtgtaagaaggtgtaggcatgtaagaatcttgggacatggatggagaggacgagtagccatggtagggggaggaggacgaagaggaggaagcactcgttataaaaggctcgagtgctttcgcgagctcctgatccgagggggaggaggaggaggcgatctggtgtgcgctggtattgtagtacttgtacatgtcgatggctgcggccattaggtctaaagcttggatggagctagaagaaagaggctgagaggttttctttatggaaaatcaaagtagattttttttttggaaaaccagctctgttcctcaataaaagtagagaaacgaggtgggtttgtgcgaagaagaaaaaaaaacagagagagggtattgcaaaacaaccccctttcgaaggccaaaaggcggcaaggatccagaagagaaaaaaggttctctggatctctgttcctcctaggagaggtgtgatgaggtgagaaaaaaatcctaacccaagaacacgcttctcttgaggattctaaaaaaacccaatagaagagcctcttgaaccggaccttttcttgtgctgtgcgtccctgctgctaaaagaagaaccagagagatcagagaacaaacctggcgtcgctgcgtcgcggatgattttttttttgctcgggtcgctcaagcctcaccgtggagatggatggatgggatgtggctttggtggtgttcttgtggtgggggtgaggcgtgtcctcgtgccgccctcccgcagaaaaaaaggcatccactagttctagagcgccgcacacggacgttttataaacacttggggagagggtgtntcaaaanngtct

SEQ ID NO: 1281 - DNA, 1765 bp, Zea mays
  Predicted polypeptide sequence is orthologous to G974
tgaggtggttggctaaagttgaagacctatgtgagaaatgcctgggtgaactgtaataatacgtttgtcctgcacgagtttgttaactgcgtccctggttctcctcaaaaaaaaaaaaaaaacatgggatccccggcccccggcactcaacccaaacaccacaatccccttcaacaaacgcaccgcactccacggcagccagaaaacacaatccacacagtctccgtgaggtctgagcgaggtaggactagctctgagcgagttcttccgtcttccaggtataatccttgcaactctcactatcctcttcgcatcgctcgtctctttttgagactagttggatttctcttctttttccttggatcctactacctactagaacagagctccggagccttttagtttctggtctctgatctactcattttcttttcttccccttttggtgacataggtaggtctagttaagatctgtcgtgcctgttctttgattttagctaagaaccaggcgatttagtcttcttcttccttacaaaaaaaatccccagaaaaaaaagttgtgagtagtatattcttgtaccatttgatggccgctgctataaatctccccgggcccagcgaggatctgatgcgagcgatggagtccttcatgcaagacgacgccccatcccctctggccatgccgccggcgccgtctttcccagcggccgcagcccacggggcccagtacccggcgacccacctgagcccggcgcagatgcagttcatccaggcccagctccacctgcagccggacccggggctgggcccgcgggcgcagcccatgaagcccgccgtcccagtgccgccggcgccggcgccgcagcggcctgtgaagctgtaccgcggcgtgcggcagcgtcactggggcaagtgggtggccgagatccggctcccccggaaccgcacccgcctgtggctcgggaccttcgacaccgccgagcaggcagcgctggcctacgaccaggcggcgtaccgcctccgcggggacgcggcgcggctcaacttccccgacaacgcggagtccagggcgccgctcgaccccgccgtggacgccaagctgcaggccatctgcgccaccatcgccgccgcgtcgtcgtcatccaagaattccaaggccaagagcaaggcgatgccaatcaacgcgtccgttctggaagcggcagcggcgtctccgagcaacagctcctccgacgaaggttccggctccgggttcgggtcggacgacgagatgtcctcgtcctccccgacgccggtggtggcgccgccggtggcggacatgggacagctggatttcagcgaggttccgtgggacgaggacgagagcttcgtgctccgcaagtacccgtcctacgagatcgactgggacgcgctgctctccaactagtcgcccttcgccgacagatgtgctgttgtagttcagtagtggcagtatctctggccgccgcagatgaggttttaggcaatctgcaggccgccggcccatgtgtattaagtaggttttgctcagttgttggccccggacttcgccggcgtttttgtgaccggcgtccccgagtgcactgcattggtgtactggtctgtctgtaaaaaaaatggatctgtgacttctatagtgtgtattcaaccattgttcttagttgtgatgttactcgtgctgaaaaaaaccgccgccgggtttcgtcaaaaaaaaaaaaaaaaaaaaaaaaaaaaaaaaaaaaaaaaa

SEQ ID NO: 1282 - DNA, 669 bp, Lycopersicon esculentum
  Predicted polypeptide sequence is orthologous to G974
cagcagatgatgttacagactgcccatcatgcttccaccatgaatttcttggctccaaagccggttccaatgaagcaatctgggtcgccaccaaaacccacgaagctctacagaggtgttagacaacgccactggggtaagtgggtcgctgagatccgtttgcctaagaaccgaacccgcctttggcttggtacatttgacaccgctgaagaagctgctctggcttacgacaaggcggcgtatatgcttcgtggcgactttgctcgactgaacttccctcaactccgccacaacggcaacctaatcggcggcgactttggtgaatacaatccattgcattcctcagttgatgctaagctaaaggacatatgccaaagcttggcacaggggaagagcattgactctaagaagaagaaaaccaaagggttgtcggcggagaaagcggcggtggtgaagatggaggaagaggagagcaaaacagcagaagttggatccgaaagtgacgggtcccattccggttccggtggatcatcgccggtgaccgaactgatattcccggagttcactgaggaagagccaacttgggacatgtcagaaaattttttgttgcagaagtatccatctcatgaaattgattgggcctctctattaaattagaaatatttagaa

SEQ ID NO: 1283 - DNA, 500 bp, Glycine max
  Predicted polypeptide sequence is orthologous to G974
  misc_feature (466)..(466): n is a, c, g, or t
agcggcctccgaagcccacgaagctgtatcggggcgtaaggcagaggcattgggggaagtgggtggcggagatcaggctcccgaagaaccgaaccaggctctggctcggaaccttcgacacggcggaggaagctgctttggcttacgacaaagccgcgtataggctccgaggcgacttcgcgaggctgaacttcccgagcctgaaaggctcgtgccccggggaggagtacaagcctgtgcattccgcggtggacgctaagctcgacgcgatttgcgccaacttggcggaaatgcagaagcaagggaagacggagaaaggtgccaggtcagcgaagaaatcgaagcaaggtccgaaccaggaggccaagcccgaacctcaagcttccgctgaaagtgagggttctgcggattcttctccgctgtctgatcttacctttgatgtaaccgagccgcaatgggaacattntaatttgcagaagtttccttcttatgagatcgat

SEQ ID NO: 1284 - DNA, 760 bp, Solanum tuberosum
  Predicted polypeptide sequence is orthologous to G974
ttttggtgagcctaatttgtatactgatttctgtgcaatcccatcaacggctacccaaatgttttctcaagggtattcatgttttaacaatatgggtgtagctgaaacaggttcaattgggcttaaccatctaaccccttctcagatattgcaaatccaagctcagatccaattccagaatcaacagcaactactacaactgcatcaacaacaacagagcttaggtttgttaacacctacttcaacatattctaagaatctgaattctacgaactttcttggtatgaaaccagtcccgatgaagcaaactggtggtgcttcttcacagaaggctactaagctttatcgtggagttagacaacgccattggggtaaatgggttgctgaaattagacttcctaagaacagaaccaggctttggttaggcacttttgatacagctgaagaagctgctttggcttatgacaaagctgcttataagctaagaggagagtttgctagacttaattttccacatctaagacatcaattaaataatgaattctcgcctttacattcctccgttgatgctaaacttcaagccatttgccaaagcttggctaatcccaaatcagatgaaacttgtgtctaaatctaattccaagccaagaaagtccaaaaccgcagcagcagcagttccagtggattcaattcagctcaagaatcttcatcaaagtccgaaatcaccatagatgattcattgaaaggagaattcagctat

SEQ ID NO: 1285 - DNA, 567 bp, Poplar xylem
  Predicted polypeptide sequence is orthologous to G974
caaatcctccaaatccaagccaaaatccacttccaacaacaacagcagcagaaaatggaaaatcttgctaccaccacatcacagtttgtccataaccaaagggctagtaacttcttggctccaaaacctgtccctatgaaacaatctgctgcttctcctcaaaagccaacaaagctttatagaggagtcaggcagaggcattggggaaaatgggttgctgagattagacttccaaagaacagaactagactctggcttggcacttatgacacagctgaagaggcagctttggcttatgataatgctgcttataagctgagaggagaatatgctaggcttaactttccacatcttcgccaccagggagctcatgtgtctggtgaatttggtgattacaagcctctccattcctctgttgatgcaaagttacaagcaatttgtcaaagcctgggcttgcaaaaacaggggaaaacaagggagcccagctctgttgctaattccaaaaagactgcaacagctcctttgcaagcaaaaattgaagatgattgttctttgagaggcgaattg

SEQ ID NO: 1286 - DNA, 568 bp, Medicago truncatula
  Predicted polypeptide sequence is orthologous to G974
caaccacttgacaccatcacaaatcaaccaaatccaagtacaaatccaacaacaaaacttcaccatgcaacatcaacaaattcaacagcaacaacaacgttgtcggagtaacactttgagttttcttagtccaaagtcaattcctatgaagcatgtgggtggtagtagtgtttcaaaacccacaaagctatacagaggagtgagacaaaggcactggggaaaatgggttgctgagataagactacctaagaaccgaacaagattatggcttggtacttttgacacagctgaagaagcagctttggcttatgataaagctgcttataagctacgtggtgactttgctaggctaaattttccaaatttgaaacaccaaggttcaattattggtggtgaatttggtgagtttaaacctcttccttcttctgttgatgctaagcttcaagctatttgtgaaggtttagctgagatgcagaaacaggggaaggctgagaagcctaagaagatgccggcgtcgaaggcgaaagcctcttcaaaggtggtttctaaagagtctggtgatgatttg

SEQ ID NO: 1287 - DNA, 570 bp, Sorghum bicolor
  Predicted polypeptide sequence is orthologous to G974
tctccttccaccacgccgccgcgtccgcagaagctgtaccgcggcgtgcggcagcggcactggggcaagtgggtcgccgagatccgcctcccgcggaaccgcacccgcctctggctcggcaccttcgacaccgccgaggaagcggcgctcgcctacgaccaggccgcctaccgcctccgcggcgacgcggcgcgcctcaacttccccgacaacgccgcctcccggggcccgctccacgcctccgtcgacgccaagctccagacgctctgccagaacatcgccgcgtccaagaagggcgccaagaagcacgcctccgcctccgccgcagctgctgccgccacgtcgtcgtccgcccccaccagcaactgctcctcgtcgccgtcctccgacgacgcgtcctcgtcctgctgcctcgagtccgccgccgagtcctcgtgcccgtccccgtccccgtccgcctcccccgagtcgtcgacggtgccggagatgcagcagctggacttcagcgaggcgccgtgggacgaggccgccggcttcgcgctcaccaagtacccgtcgtacgagatcgac

SEQ ID NO: 1288 - protein, 233 aa, Oryza sativa
  Orthologous to G974
MGLTHLGPAQIQQIQAQFLAQQQQQRALAGAFLRPRGQPMKQSGSPPRAGPFAAVAGAAQSKLYRGVRQRHWGKWVAEIRLPKNRTRLWLGTFDTAEDAALAYDKAAFRLRGDLARLNFPTLRRGGAHLAGPLHASVDAKLTAICQSLATSSSKNTPAESAASAAEPESPKCSASTEGEDSVSAGSPPPPTPLSPPVPEMEKLDFTEAPWDESETFHLRKYPSWEIDWDSILS

SEQ ID NO: 1289 - protein, 279 aa, Oryza sativa
  Orthologous to G974
MYDMVVDSKELMGALAPSMVSFSYPCSEQSASSLLAGANYLTPAQVLHVQAQLQRLRRPGRRAAASPGAAAPMKRHGAVAVAAAAAARAPVKLYRGVRQRHWGKWVAEIRLPRNRTRLWLGTFDTAEEAALAYDSAAFRLRGESARLNFPELRRGGAHLGPPLHAGVDAKLHAICHGMDLPQPQPQTQSNATTTTMSTTATNTPSPFFSSESPVVKSEPVCSASESSSSADGDVSSTGSSDVVPEMQLLDFSEAPWDESESFLLHKYPSLEIDWDAILS

SEQ ID NO: 1290 - protein, 291 aa, Oryza sativa
  Orthologous to G974
MAAAIDLSGEELMRALEPFIRDASGSPPVCSQFSPTSPFSFPHAFAYGGGLAQQPELSPAQMHYIQARLHLQRQAAQAGPLGPRAQPMKASSSSASAAGAAATPPRPQKLYRGVRQRHWGKWVAEIRLPRNRTRLWLGTFDTAEEAALAYDQAAYRLRGDAARLNFPDNAASRGPLHASVDAKLQTLCQNIAAAKNAKKSSVSASAAATSSAPTSNCSSPSSDDASSCLESADSSPSLSPSSAATTAETPATVPEMQQLDFSEAPWDEAAAFALTKYPSYEIDWDSLLAAN

SEQ ID NO: 1291 - protein, 240 aa, Atriplex hortensis
  Orthologous to G974
MSYSYPPPLPSNTLNNFLSPKPVTMKTTGGPPKPTKLYRGVRQRHWGKWVAEIRLPKNRTRLWLGTFDTAEEAALAYDKAAYKLRGDFARLNFPNLRHEGSHIGGEFGEYKPLHSSVNAKLEAICESLAKQGNEKQGKSGKSKKKDVANNNNNTSSSSSSSCCTTATAAADAPQQQQRMPENGGDVKTESTSDSEVGSGGSSPLSDLTFGDNEEMGSENFLLESCPSHEIDWDAILSSES

SEQ ID NO: 1292 - DNA, 458 bp, Glycine max
  Predicted polypeptide sequence is orthologous to G975, G2583
acgagaacactctatccctcgttctttctctctctctctctctctctctctctagccagctttggttagacaacatagttctgaccaacatggtgcaatcaaggaaattcagaggtgtgaggcaacgccattggggctcttgggtttctgagattcgtcacccattattgaaaaggagggtgtggcttgggacattcgagacagctgaggaagcagcaagagcatatgatgaggcagccattttgatgagtggaagaaatgcaaaaacaaacttcccagttggtgaaaaccaaatagtgggaaatcacagttcaaacacttcctcttcctccactacaacattgtctgcagttctgagtgcgaagctgagaaagtgttgcaagtccccttcaccttccctcacttgcctgaggcttgacactgagaattcccacattggtgtgtggcagaagcgagcg

SEQ ID NO: 1293 - DNA, 514 bp, Glycine max
  Predicted polypeptide sequence is orthologous to G975, G2583
gttacatatataaataaattaacttttccttctttttttttctcttttctcttcctatctttttgttgagtgcaggaagagaagggtgtggctagggacatttgagacagctgaggcagcagcaagggcatatgaccaagcagccattttgatgaatggtcagaatgcaaagaccaatttccccacctcaaagaaccaagctgaagctgatgacaacaacaacactgacactttcttatctccaaaagctctttcagaacttctcagcacaaagctgagaaagtactgcaaagaccctgctccttccctcacttgtctgaggctagatgctgataattcccacattggagtgtggcagaaaggggcaggaccacattctggctccaactgggtcatgaggttagagcttggaaagaaacaaattaccgaggagggtagtgagtcaacggagtcaccacaaagtagtactaatggtgctactgaaaataatgaagtagaagaggaggatagagtg

SEQ ID NO: 1294 - DNA, 867 bp, Glycine max
  Predicted polypeptide sequence is orthologous to G975, G2583
tgttttattttacatctctctctctctctctatatatatatatataatcaacaccatccactactttctcacgcgccattaacaaagatatggtacaaacaaagaagttcagaggagttaggcaacgccagtggggctcctgggtgtcagaaattcgccaccctttactgaagagaagggtgtggctagggacatttgagacagctgaggcagcagcaagggcatatgaccaagcagccattttgatgaatggtcagaatgcaaagaccaatttccccacctcaaagaaccaagctgaagctgatgacaacaacaacactgacactttcttatctccaaaagctctttcagaacttctcagcacaaagctgagaaagtactgcaaagaccctgctccttccctcacttgtctgaggctagatgctgataattcccacattggagtgtggcagaaaggggcaggaccacattctggctccaactgggtcatgaggttagagcttggaaagaaacaaattaccgaggagggtagtgagtcaacggagtcaccacaaagtagtactaatggtgctactgaaaataatgaagtagaagaggaggatagagtggctttgcagatgattgaagaactacttaattggaactagaagaagaagaaaaaaaaaagggaaccttaatccgtgtcatatatagttcttgaatagtagtccttttttcatgctatccttttcaattcgtttacttttgtgctttctgtaaaaaaaatgtttgtcaaagtgctgatatctatatgatgatggccagtttgatagttacttatattatacactttttaagatatattgtgattgatggtaattatgcatc

SEQ ID NO: 1295 - DNA, 817 bp, Glycine max
  Predicted polypeptide sequence is orthologous to G975, G2583
aattcggctcgagcgacagaagggggtcaacactgaattcaaaatcactttcgaccatattctcttcttcttctctctctccatcatggtgcaaacaaggaagttcagaggtgtcaggcagcgccattggggttcatgggtatcggaaattcgccacccttttctcaagaggagggtgtggctaggcacgttcgaaacagcagaagaagcggcacgagcttacgaccaagccgcgatattgatgagcgggcgtaacgcgaaaaccaatttcccaatactccaaaccccggagggtgacccaaagacgacgctaacacccatcgatcacgagacctcatcatcgtcgacgaccacctcgaaggaactggaagagattcttcacgccaagctccgaaagtgcgggaagcttccgtccccttccatgacctgcctgaggctcgaccccgagaattctcacatcggagtgtggcagaagcgcgccggccagcgttccgattccaactgggtcatgatggttcctcccctcggaaaaaaaggtggtgctaatgaaggaggtactggaggagatgcttcttgttctaactcctttccgttctccgagtgcgatccgaccccgcaagtggcaaggcaggagcttctgaggacggagatggacgaggaagaaagaattgcgctgcaaatgatagaagaactcctcagcaggaactgccccactagcccttcattcaataacttatattaattaagggaaatgtttcctgaagaaggataattctattcagtttctttaagggtctttagagataaattatgctgg

SEQ ID NO: 1296 - DNA, 1128 bp, Glycine max
  Predicted polypeptide sequence is orthologous to G975, G2583
ttttttttttttttaactgaaaatatatttattatttatgataaataaaccatgaacgtttcaaacaagcagcagacgatagggcctttacatatgaactctgaaaataatattctgtatacatctctcttattttcttatgtatattttcctatgcatgcatgtaatatgtatgtgtatatatatattatctacacttataataaatatgacatacatgaaaacagatatgatatgatagatatgatgtggttatatataattagcctataactaccacttccctttttttcccaaataatgacaacccttgttgaagatgaagattaaacatgcatgtgaataccataacgctgtgtggaaaaaagaagcttaaagaaaaaagtggtcatgatcagcaccatccctttcttgaatgttgttgttaaatgatgggctagggcagtttctgtcgttgaggagttcctcaatcatctgaagggcaattctctcctcttcgtcaatctctcctctcacaacttcttgatgatgaagattacctgtcacagccagtgatggagactcaatgtggtgatgttcagaagaaggtagagaagaagaaagagaactactactgctactatcagcttgatgatgagtgtcattattattaacattaacactcttctttcccagttgaaccgtcatgacccaatttgaatcagaacgcctcccagcacgtttttgccacactccgatgtgggagttctccgggtcaagcctcaaacaagtcatagaaggtgaaggtaccttcccacattttcgaagctttgcatgtaagatttcctccagatccttcgaggtggtggagggagtgtcctcactggtagtgctctttggatcaccttctggagtttgagttattgggaaattggtcttggcatttctcccactcatcagaatcgcagcttgatcataggctctagcagcttcttctgctgtttcaaatgtccctagccacacccttctcttcagaagcgggtggcgaatttcggatacccatgaaccccaatggcgttgcctgacacctctgaacttctttgattgcaccatgatgttgttagagtttgttaattgctcgagccgaat

SEQ ID NO: 1297 - DNA, 479 bp, Oryza sativa
  Predicted polypeptide sequence is orthologous to G975
cggcacgaggggaggatgctcactgtctgactgactgactggctgctgctgctgctcattccttctcctactctgcctgcctcctctgctgtgtccctgggagaattcttcagggacagtatccctgcagaggtgagatcatgggacagtcgaagaagaagttccgcggaggcaggcagcgccactggggctcctgggtctccgagatcaggcaccctctccttaagaggagggtgtggctgggtacctttgagacggcggaggaggcggcgcgggcgtacgatgaggccgccatcctgatgagcggccgcaacgccgagaccaacttcccagtcgcgaggaacgccacgggggagctcacaccggcggctgcggtggcagggcgggatggccgtgtcggcggcggcagcggcagctcgtcctcaatgacggccaacggcggcgggaacagcctgtctcagatcctcagcgccaagctc

SEQ ID NO: 1298 - DNA, 438 bp, Oryza sativa
  Predicted polypeptide sequence is orthologous to G975, G2583
ctgcaggaattcggcacgaggctcctccgttcagttcagaggcgcctagcaatagcagctcattgcctcatctctgcctcccctgtccttctgggggcagagaatctctccactgctggaaaaatggtacagccaaagaagaagtttcgtggagtcaggcagcggcactggggctcctgggtctctgagatcagacaccccctccttaaaaggagggtgtggctgggcacctttgagacggccgaggaggctgcgcgagcctacgatgaggctgctgtgctgatgagtggccgcaacgccaagaccaacttccccgtgcagaggaactccaccggtgatctcgccacggccgcagaccgggacgcccgtagcaatggcggtagcaggaactcctccgcgggcaacctgtcacagattctcagtgctaagctccgcaag

SEQ ID NO: 1299 - DNA, 434 bp, Zea mays
  Predicted polypeptide sequence is orthologous to G975, G2583
tctgaggacggcggcctcgtcgtacgcccgcgccgcctcctctgccgtctcgaaggtgcccagccacaccctcctcttactgcatattcgattcaagcatgcatgcccaccacgccgccatcgtcagaacgcatggcgaaagagaaagaccgaggcatctactactactactagagagcagcgtggctagctagtagagctgagggaagaagatctagcatggggggccaccagtttcttacagcagcgggtgcctgatctcggagacccaggagccccagtggcgctgcctgacgccgcggaacttcttctttgattgcaccatgatgcctgcagatccccgcgctctgcagggcagggacgggccggccggcaagcactgcagattctctgccaggggaaggaaggaaggagtgagcagcagtccagtcagt

SEQ ID NO: 1300 - DNA, 1039 bp, Zea mays
  Predicted polypeptide sequence is orthologous to G975, G2583
attgggtacctcgaggccggccgggcacacggccccacacacttcacttcataggcgccccagcagagctcatctctgcctcctgtgtccttctccatgacagagaatctccactccaggaaaatggtacagccaaagaagtttcgtggagtccggcagcgccactggggctcctgggtctctgagatcaggcatcccctccttaagaggagggtctggctgggtacctttgagacggctgaggaggcagcgagagcatatgatgaggctgctgtgctgatgagcggacgcaacgccaagaccaacttcccaatccaaagaagcagcacaggggagcctaccccagctgcgggaagggacgcccgcagcaacttcagcagcggctcctctaccaccaacctgtcccagattctcagtgcgaagctccgcaaatgctgcaaggcgccatcaccgtccctgacctgtctccgccttgaccctgagaagtcccacattggtgtttggcagaagcgtgcaggagcccgtgctgactccaactgggtcatgacagtggagctcaacaaagatgcagcatccactgatgctgcatcacagtccacatcagcaacaactgctccaccagccacgccgatggatgaggaggagaggatcgcactgcaaatgatcgaagagttgctgagcagcagcagcccagcttcaccctcaaacggagatgaccaaggtcgcttcatcatctgaaaagcatggatcaaacagcacaagtcaccatcccagatcagagtttcgctaggtcggttggtacacaagcagttcaggttgcttcagtaatatagatatatgtctattactaaatccaacttacaagaactataaagtttgcaattgtgtgcagttctatgtacgtgaaaagctctacatacacatgttcctatcaagatactttgttacacatcaatgtcagtgatataattgcttataaaagaaataaatagattatgattgtgttactgctcaaaaaaaaaaaaaaaaaaggccccta

SEQ ID NO: 1301 - DNA, 334 bp, Brassica rapa
  Predicted polypeptide sequence is orthologous to G975, G2583
tctggcagaaacgcgccggttcaaaatctgattctagttgggtcatgacggtggagctcggtccctccggctcagtggagctcagtccctccgggtcctcccaggagccaactagtactacagcttcaaaagacgatgttgttggaccggccactgaggttggtggcggcggagaagaaggattaatggatgaggaagagaaggttgctttgcagatgatagaggagcttctcaatacaaactaagtatcatttcttatatttatactaatatacctatttttattgctgatatacagccataatttatccgtttatacctttatattttacat

SEQ ID NO: 1302 - protein, 243 aa, Oryza sativa
  Orthologous to G975, G2583
MGQSKKKFRGVRQRHWGSWVSEIRHPLLKRRVWLGTFETAEEAARAYDEAAILMSGRNAKTNFPVARNATGELTPAAAVAGRDGRVGGGSGSSSSMTANGGGNSLSQILSAKLRKCCKTPSPSLTCLRLDPEKSHIGVWQKRAGARADSSWVMTVELNKDTAVSSAATVAAATAVSSSDQPTPSDSTVTTTSTSTTGSPSPPPPAMDDEERIALQMIEELLGRSGPGSPSHGLLHGGEGSLVI

SEQ ID NO: 1303 - DNA, 1410 bp, Glycine max
  Predicted polypeptide sequence is orthologous to G979
tcaccatccatctttgttctttctcgtgcatggtgcaaccttctccatggccaaaaaatcacagctgcgtacccagaaaaacaatgttaccaccaatgacgataataatcttaacgtaaccaacactgtgaccaccaaggtgaaacgaacaaggagaagtgtccctagagactccccacctcaacgcagctcaatataccgaggagtcactaggcaccgatggacaggccgatacgaagctcatttgtgggacaaacattgctggaatgaatcacagaacaaaaaagggcgacaagtctaccttggcgcttatgacaatgaagaggcagcagcacatgcttatgatctagcagcactgaaatactggggtcaagataccattcttaattttccgttatcaaactacctgaacgaactgaaagaaatggagggtcaatcacgggaggagtatatcggatcgctgaggaggaaaagcagtggtttttctcggggaatttctaaatacagaggtgttgcaaggcatcatcataacggaaggtgggaggctcggattggcaaagtttttggcaataaatatctttacctcggaacttatgctacccaagaagaagctgctactgcctatgacctggcagccatagaataccgtggactcaatgctgtcaccaatttcgatctcagccgttacattaagtggcttaagcctaacaacaacaccaacaacgttatcgacgaccagattagtattaatctcactaacataaacaataataataattgcactaacagcttcaccccaagtcctgatcaagaacaagaagctagcttcttccacaacaaagattcactcaataatactattgtagaagaagtcacgttggtgccacatcagcctcgtccagcgagtgccacgtcagcattggagcttctacttcagtcatcaaagttcaaggaaatgatggagatgacatctgtggccaatctttcttcaacacagatggaatctgagttgccacagtgcacatttcctgatcacattcagacgtactttgagtatgaagattccaatagatatgaggaaggagatgatctcatgttcaagttcaacgagttcagctccattgtgccgttttaccaatgtgacgagttcgagagttgaagaagtcaggtttatataatgcatggaaaaaagaaactctgatatgtttgtttatttgtttaatttgttgattatgttaaagaccatattcataaatctttagctaattaaggtttaagtttttagaagagagatcatgtcattcacaactattataataagtggacttgttttcaatttgtgaacatgaaagtttattctttttatagcaacgtcgtcattaatcacataaaaatgaatattaatgcggc

SEQ ID NO: 1304 - DNA, 4176 bp, Glycine max
  Predicted polypeptide sequence is orthologous to G979
gccctttttttttttttttttttttttttttttttttttttttttttcaacatctttcatattcatcccgtctaatcctctgtgtctcattcctatatttcaatttactttcatataataagcttatataaatatattattttcttatacaaacattttttgttttcaatttttattaattcttatttttctttatcttgttaaaagtttaacttattattcaaatttcattttttcttttggatggattttggttgacaacgtcagtgatcccagtgaaagcaatacctcgccggtgggagagttgtacttgtccttattatcggagccctgctcattgctgagcccaatatatctccacaactattaacctacctacgcaacttgtctttgaataatttaagaggaaaaaaaaaaccacacttattaatttctttttattttatcctttttcacggctcttcatggcttcatcttaccacacttatcctatatatatatatatatataggataagatcatctcacaccaagtataagtttcatgacttacacaaaatctcagccattaatctaagtaaatccaacaaatcataatatttaaacaaaataaaaataaaaaatatgaaaaagtaatcacgtgagttaagactcttcctgtgtgtaaattttgaagattaatgagttagcttttcataaaataaaataaaaaactgtttgggggtttaatcccttaaacacatcaatcacctcgtcaaaagacagtaatttgtcgcttgaataaggattaatgctgttatgattggtaattacatatacaagtttttttttataaaaaaagacaaacaagtatagttaaaaatgaaaattaatgttaaagtaacatgaaaatgtgttagctttagtgcgcctgtgtgtaaattaatgttaaagtgacatgaaactatgttagttttgttttgggtttgattccgtaaacacatcaattatttcgttgcaaatttgcataaaaagacaaaatgtgtttgtaatacaattgtgggaggcaaaaatttaaaattaatcgtgatcatatgactaattaagaaatgaaaaaaaataattatatgttaataatataaaataattttatattatcattcaataaaaaattattatttaggataaattattaattttaataaaattatcttaaaaattatatcaataataatttacaattaaatgacacacaaaatatcatcattaaacatttaaaaaatatttttattaatctttaaaacttaacaaattaaatatgatttaataatttaacatttatctttaaaaaaatattattcttattgcttataataactaaatgttgtgacatctacccacgcttgtggagacatacataataaaactaaattgttaaaatgaggcagttgtacttgtatgccatgcatcttgttctatcgcaaataaaatgatccaatccctcttccccccttgtatgttacttttaaagaatcttccactcgatctctaaaatgtttactcttaccccctaatttctttatcatcttttttggttgattacccccttttgaaaaataacgtattggccagaagaagtcctccaattctaaacatcaagctcgtaatgaaaaattggtgcaccaaaggagcccaggtcaccaaaaatgatatcatcattttcagtgtagatgcctgaatcttgattttcaaaaattgtttgaatgtcttcagggaatgtgcgacgagaaggatttgattctgaagatggtgctacaccctcttctgtgatctcatcactagccgaacctagctcaagttcagcattagagtttacattttcattgctaggaatagtttgatgattttcttctgttttaggacgtggccaattgatataacggctcaggtcaaagtttgtaaccgcgttaagtcctctgtattctattgctgccatgtcatatgctgcggctgcttcttcttgtgtagctacaatacgacataataacatatggacacacacatgtaagcaaatttaattgtattattgtttgcatatgtcggtctaggatttctctttttcttcttccgatttggtttatattaaaatgactagaaaagaatgatatcattattaaatagctctattaagcagttgaagtttggtgatctatatcacaaccaatatgatctgattgcatatgttgacctttatatttgtcctactattttgatccgcgggaccatgttgaaaccaagtaggtactttcttgttagaaccggaaagaatggtcaaatacattttcaaaatttcaggtatgggtacatcctctcttaattaattaaacatcgctacacctatattagctactttatttcgtttatattcaaccaatacataaacatacaatttaatttgttcattatttagagtgctgacataggcccatatcacatgcatgttttataattcgtagcaaatataaccaaatataaatgatgataatgaaatgctatatatgaaccatgtaaatgcattcaaatgctaaggtaaggccatatgcttctgtctaagagaattgtacatcaaatgcatagaaaatgaccttttgattaggattttaaaaaacatttcgtcccctgaactatataattgacaaattatatgtatagacgcacactttaaaatcacatattcaatttttttttaaaaaataactaacaatattcttattttgagacatcttgagatttgaataacaataatataatgcaggaaaattacttttcaaaactgttaataatatatttctgtacacatttttttattatataaattttagaaataaatgtaattatggtccctattttattttattcatattttaaaattgaaacatgtagtacttttgttttaaaaaatatacaattttagtctttcccgttttaaaatagatatttagtcttcttattttaaaaaattgtaattttgatcaaattctcaattttatcaatgttttatttttttcttttggtccaattgaattataaatctaatatattcatttaaggtatcatcaaaatttgatttaattagttacaaaataagaaataaaagaaataaagcatatacaaaattaaagattaaattaaaattatagattttctaaaaaaggaaaccagaatcgtcaattttttaaaatataaaaattaaatatttatattttgaaatagaaaaaccaaaattacaaattttttaaaataagaaaaataaatgttttaattttaaaatagaaaaattaaaattatgaattgactaaaattacatttaatcctaaattttatgtgagtcacactcaatgatataaatttattctttatttaacgaaattcacataaaatttcaataagaagtagcatccatctatgcatgcgctttctttacattagatcatagacaatgaaattaccgtaagttccaaggtatagatatttgttgccaaagacccttccaattcgagcttcccatcttccgttatggtggtgtcttgctacgcctctgtattttgaaactcctcgagagaatccactgctttttcttctcaaggatccaatatattcttcttttgactggccctccatctccttgagcttttcctcataatttgataatggaaaattgagaatggtatcttggccccagtacttcaatgctgccaagtcataggcacgtgctgcggcttcttcatcatcatatgcccctagcaaacccaagtttattgcaatcattaaatcgtcccccatccgccaatttaaggggaacaaataatgaaggtttttgttatatatgcaagctaattaattaatactctcaaatcatacctagatatactgcatccagttgttttccatagccattttcaaccaacccaacataattaatatgacaataaatcaaataatcatataagtgaaggaaatcagaaatctatatggagattatagagagcaaaataatgaagagccttgtcttcctttcttgctctgtgattcattccagcaattcttatcccacaaatgagcctcatatcgaccagtccatcgatgcctaaaacaatcacatgcacatatttgagcccacgcgtccgcggacgcgtgg

SEQ ID NO: 1305 - DNA, 684 bp, Glycine max
  Predicted polypeptide sequence is orthologous to G979
accacaatggtatgttctaaaaacatttcgtacactcgtgtgtgtatatatatattcgtgcacgccccactttctgaattcaacaaagatatcaatggtttattttgttgaccatgatgatctaccgtaaaacagattgaaaaattgcaaaacctagcattttgcagtgaacagagcagggttcaagtaccttgctacgcctctgtattttgaaactcctcgagagaacccactgctttttcttcgcaaggatccaatatattcttcttttgactggccttccatctccttgagcttctcctcataatttgataatggaaaattgagaatggtatcttggccccagtacttcaatgctgccaagtcataggcacgtgctgcggcttcttcatcatcatatgcccctagatatactgcatccagttgttttccattgccattgtcaaccaacccaagataattaatatgacaataaatcatataaagcgaaggaaatcaggaaaattaaactaaagattatagagagcaaaataatgaaaaccttgtcttcctttcttgctctgtgattcattccagcaattcttatcccacaaatgagcctcgtatcgaccagtccatcgatgccttgtgacacccctatagattgagcttcgttgaggaggtgagtctcttctcgagccgaat

SEQ ID NO: 1306 - DNA, 926 bp, Oryza sativa
  Predicted polypeptide sequence is orthologous to G979
tggcgacgcgagcgagcatattaaagctgtgccggcggctgcaactttgccgccatttatttagctccggctcttttaaaagctctcttctcctgctgccatcttcttctggttggcaccaccattccatatataccatctccctcctcctcccgcgctcgctcttcgccaatggccaagcgacgcagcaagggcgagaccgccgccgcgagcagcgacgactctagctccggcgtctgcggcggcggcggcggcggcagcggcgaggttgagccgaggcggcggcagaagcggccgcggaggagcgccccgcgggattgcccctcccagcgcagctccgcgttccgcggcgtcacacggcaccggtggacggggcggttcgaggcgcatctctcgcgcgggaacacctggaacgagtcgcagagcaagaagggcagacaagtttacctcggggcttacgacggcgaggaagcggcggcgcgcgcctacgacctcgccgcattgaagtactggggccacgacaccgtcctcaacttccctctgtcaacatatgacgaggaattgaaggaaatggaggggcagtccagggaagagtacatcggatcgctccggaggaagagcagtggcttctcaagaggggtgtccaagtacagaggagttgcaaggcatcatcacaacggcaaatgggaggctcggattgggcgtgtgttcggcaacaaatacctctatctaggtacttatgcaacacaagaggaggcggccgtggcgtacgacatcgcggcgatcgagcaccgcggcctcaacgccgtcaccaacttcgacatcaatctctacatcaggtggtaccacggctcttgccgctccagcagcgccgccgccgccaccaccatcgaagacgatgatttcgccgaagccatcgccgccgc

SEQ ID NO: 1307 - DNA, 651 bp, Zea mays
  Predicted polypeptide sequence is orthologous to G979
aggataactttggcgacacatagctctcggaattcgattcagatcaagtaaggcggacaggcttatctgggagcatatgacagtgaagaagcagcagcacatacgtacgatctggctgctctcaagtactggggacccgacaccatcttgaattttccggcagagacgtacacaaaggaattggaagaaatgcattttgtgtctgtggaagaatctttggcttctctccgccgccagagcagtggtttctccagaggcgtctctaaatatcgcggcgtcgctaggcatcaccacaacggaagatgggaggctcggatcggaagagtgtttgggaacaagtacttgtacctcggcacctataatacgcaggaggaagctgctgcagcatatgtcatttctgcgattgagtatcgaggcgcaaacgcggttactaatttcgacattaggtaattacattgaccggttaaagaagaaaggtgttttcccgttccctgtgaaccaagctaaccatcaagagggtattcttgttgaagccaaacaagaagttgaaacgagagatgcgaaggaagagcctagagaagaagtgaaacaacagtacgtggaagaaccaccgcaagaagaaagaggagacggaagaagagaaagcagagc

SEQ ID NO: 1308 - DNA, 670 bp, Zea mays
  Predicted polypeptide sequence is orthologous to G979
cgcatggttcctcttccgctgctgccgtcctgcgatcgaccgggttggcgggcggtccggcgcgtgcctgcagtttatctcggcgcgtacgacgacgaggacgcggaggagcgcgcgcacgacctggcggagctcaagtactggggccccgccggcaccgtcctcaacttcccgctgagcggctacgacgaggagcggagggagatggaggggcagccccgggaggagtacgtcgcgtcgctgcggcggcggatcagcggcttcgcgcgaggggtgtccaagtacaggggcgttgccaggcatcatcacaacgggagatgggaggcgaggatcgggcgcgtgttaggcaacaagtacctctatctcggcacttacgcaacacaagaggaggcggcagtggcgtatgacatggcggctatagaacaccgcggcttcaacgcggtcaccaacttcgacatcagccattacatcaaccactggcatcgacattgccatggcccctgcgacggcagcctcggcgcgatggacgtcgcaccgaacgtctcgctcgaactagacctactcgagtgcccagtcaccgtccggctcagcctcgaggagaccacgggcgacgatgaattccacaaccgcgaggactacctggggcaccttttcggcgtgcagcagcttc

SEQ ID NO: 1309 - DNA, 2042 bp, Zea mays
  Predicted polypeptide sequence is orthologous to G979
tcaacaactatctcaacaagttcagatgatgcagggaatggtgatgcaggtaataattttagtaatccgctcaaaatttgcccaatctcagaatttgcccatatttttttatctaactcgctctgagccttagacaacccaaaatcggtctggtcaacgttgagtgatttctgcatttattaggaggttgtcacagcctgtgatatgaacatacatactatggtgatatgaacatacatactatgtagtcatatgtatgaagaaaaaaaatagacaatgtttttttttcctcagagtaaatatagaatggtgaaaacaaaggttccttaatctggagcttactagggttacagccttggtaaactgttcaaacgaacaaatctatgctgcactggctgcgttaccatgatcatgccatgtaaactcagtgataaactgcacaagcacaaccacttcagattcaggatgtgattagttgaatctaggctaagtgagacaatgacaaacccttaacgttagccaagcagcctaggggcaaattcaaagaattaaagaacatcgacacacttgtctaacgccaaactgccatgggctttctacaagaaagttctcagctgctctggtgcagtggcactgtggcattagacagatcaaggattacccaagacaggacacctggaaagcgaaaacctcctcgggttccagaattagttgcacacactgatcatcgctggaggttgtatcccctcttccatatccgaaagaacatccttcagctggacatcacctgcctcaaacagactgaaatctgccagacctacaccatccttgcttccttcgtcagccgcagaacacccatcgaacaggcatccgatgttgcagtcgaagtctgcgtcagcgaaccactcgctcagattgattgagctgccaaagtttggtctcgacatggtgtctagctcgtaatccatgcaagggctccacaagccctcttcgatgctgtcgtcgactgtggtgaggggctccgcggtgtcgtcaggcaccgcgttctcatcgggttctgcactgccatccggtgtcttggcttcgcttgactccggctcttgctctgtagttccggtttcgctctgatcaggttgaggttcttggttgagtgccggcaccacctgtggctcctgttggagctgtgccaggaacagcgggtggtccaggtagcagctgatgtcgaagttggttacagcattgacgccacggtattcaatggccgcaaggtcataggccttggctgcctcttcttgagtgtcaaatgttcccaagtagaggtacttgttcccaaagactcgcccaatccgtgcctcccacctcccgttgtggtgatgcctggcgacgcctctgtacttggagacgcccctggagaagccgctgctcctgcggcggagggaggccaggtactcctcccgggacacggcctccatctccggcatctcgctggagtaatcctccacagggaagttgagcagagtctcaggaccccagtacttgagagctgcgaggtcataggcacgagcagctgcctcctcgctgtcatacgcccccaggtagacttgcctgcctttcttcttgttgtggagcgcggcgaggcagtgcttgtcccagagatgcgcctcgaacctgcccgtccacctgtgcctggtgactcccctgtagacggagctcctctccccggcggcgggaggaggatcagaggggtccttgcgggccctcttattaggctcggcgccggccttggccgtcgccgccctccgccgcctctttcccggagggacgaggacggtgtccgcggagacgcaggacgaggaggacgacggcgacggtggcggaggagactgccgttgagatctctccatgtccgtggtctccgtcccccctcctcctcgatgaacggtggtggtgcagcgcggacgcggttgtgcaggggagccgagtggtgaatctgacctggcggcgaggcgggggaggagcccggccggcctcgaggtacccaa

SEQ ID NO: 1310 - protein, 426 aa, Oryza sativa
  Orthologous to G979
MVSMRKKKKAFAVAAATTLLSPPRSSSSSSSTASSCIVPPRTESGKKKSKHRKRAKDGTGGDDDDAAVAAAPRKGSSIYKGVARHRGSGKYEAHLWDKQGWNPNQTRKRGRQGAYDTEEAAARTYDLAALKIWGSDHVLNFPIDTYRKELERMQRMTREEYLATLRRKSSGFSRGVSKYRGVAKHHHNGRWEARIGRAVGKKYLYLGTFDTQEEAATAYDLAAIQLRGRSAVTNFDASCYTYTDHLPPPPPPQPPSVCKTEPELEPPQPAAPPGSESLLRPKMEPCDDWEPPAICPSLRDADDADHAIAEILPALCMDRADFEARYPARRARDAAADGWSTSSDDVAAASVDDDVLRSLPDDVGFVDDVESLFLDAPGPAAAAAAAAMPDDVERAVQRAPSAASRRANAAAVSYAISSLASGRWWY

SEQ ID NO: 1311 - protein, 443 aa, Oryza sativa
  Orthologous to G979
MAKRSSPDPASSSPSASSSPSSPSSSSSEDSSSPMSMPCKRRARPRTEKSTGKAKRPKKESKEVADPSSNGGGGGKRSSIYRGVTRHRWTGRFEAHLWDKNCSTSLQNKKKGRQGAYDSEEAAARAYDLAALKYWGPETVLNFPLEEYEKERSEMEGVSREEYLASLRRRSSGFSRGVSKYRGVARHHHNGRWEARIGRVLGNKYLYLGTFDTQEEAAKAYDLAAIEYRGANAVTNFDISCYLDQPQLLAQLQQEPQLLAQLQQEPQVVPALHEEPQDDDRSENAVQELSSSEANTSSDNNEPLAADDSAECMNEPLPIVDGIEESLWSPCLDYELDTMPGAYFSNSMNFSEWFNDEAFEGGMEYLFEGCSSITEGGNSMDNSGMAEYNLFEECNMLEKDISDFLDKDISDFLDKDISISDRERISPQANNISCPQKMISVCN

SEQ ID NO: 1312 - protein, 429 aa, Oryza sativa
  Orthologous to G979
MVSMRKKKKAFAVAAATTLLSPPRSSSSSSSSTASSCIVPPRTESGKKKSKHRKRAKDGTGGDDDAAAVAAAPRKGSSIYKGVARHRGSGKYEAHLWDKQGWNPNQTRKRGRQGAYDTEEAAARTYDLAALKIWGSDHVLNFPIDTYRKELERMQRMTREEYLATLRRKSSGFSRGVSKYRGVAKHHHNGRWEARIGRAVGKKYLYLGTFDTQEEAATAYDLAAIQLRGRSAVTNFDASCYTYTDHLPPPPPPQPPSVCKTEPELEPPQPAAPPGSESLLRPKMEPCDDWEPPAICPSLRDADDADHAIAEILPALCMDRADFEARYPARRARDAAADGWSTSSDDVAAASVDDDVLRSLPDDVGFVDDVESLFLDAPGPAAAAAAAAAPMPDDVERAVQRAPSAASRRANAAAVSYAISSLASGRWWY

SEQ ID NO: 1313 - protein, 399 aa, Oryza sativa
  Orthologous to G979
METYGLVKDELLHGIGGGQGRLYCEVKPTAAPAVITAAGGGAKSVKRRKREPSAAAMSAVTVAGNGKEAGGSNAANKRSSRFRGVSRHRWTGRFEAHLWDKGTWNPTQKKKGKQVYLGAYNEEDAAARAYDLAALKYWGPTTYTNFPVADYEKELKLMQGVSKEEYLASIRRKSNGFSRGVSKYRGVARHHHNGRWEARIGRVFGNKYLYLGTYSTQEEAARAYDIAAIEYRGINAVTNFDLSTYIRWLKPPSSSSAAGTPHHHGGGMVVGADRVLAPAQSYPISAAADDDVAGCWRPLPSPSSSTTTALSLLLRSSMFQELVARQPVVEGDDGQLAVVSGDDADADADSDVKEPPPESEYGEVFASDEAAAAAAYGCSMYELDDSFALIDDSVWNCLI

SEQ ID NO: 1314 - protein, 416 aa, Oryza sativa
  Orthologous to G979
MAKRRSNGETAAASSDDSSSGVCGGGGGGEVEPRRRQKRPRRSAPRDCPSQRSSAFRGVTRHRWTGRFEAHLWDKNTWNESQSKKGRQGAYDGEEAAARAYDLAALKYWGHDTVLNFPLSTYDEELKEMEGQSREEYIGSLRRKSSGFSRGVSKYRGVARHHHNGKWEARIGRVFGNKYLYLGTYATQEEAAVAYDIAAIEHRGLNAVTNFDINLYIRWYHGSCRSSSAAAATTIEDDDFAEAIAAALQGVDEQPSSSPATTRQLQTADDDDDDLVAQLPPQLRPLARAASTSPIGLLLRSPKFKEIIEQAAAAAASSSGSSSSSSTDSPSSSSSSSLSPSPLPSPPPQQQPTVPKDDQYNVDMSSVAAARCSFPDDVQTYFGLDDDGFGYPEVDTFLFGDLGAYAAPMFQFELDV

SEQ ID NO: 1315 - DNA, 1182 bp, Glycine max
  Predicted polypeptide sequence is orthologous to G987
  misc_feature (1175)..(1175): n is a, c, g, or t
  misc_feature (1177)..(1177): n is a, c, g, or t
gattttggcatccgttatggcttccagtggccagctcttatttatcgtctatcaaaacaacccggtgggcctcccaagctgcgcattacagggatagagctcccacaacctggtttcaggccagcagagagagtccaggagacggggcttcgacttacaaggtattgtgatcgctttaatgttccatttgagttcaatgccattgcacagaaatgggaaactatcaaaattgaggacttgaagataaaggaaaatgaacttcttgttgcgaatgctatgtttcgatttcaaaatctacttgatgagacagttgtggtgaatagtccccgggatgctgttttaaagttaataaggaaggcaaatcctgctatctttttacatgctaatgtcaatgggagctataatgctccattctttgtgacacggttccgggaggcccttttccattattctactttgtttgatgtgcttgataccaatgttgcttgtgaagatccaatgaggttgatgtttgagagagagttctttgggcggcaggtaatgaatattgtagcttgtgagggttgtgagagggttgagaggcctgagacatacaagcaatggcaggttaggaacatgagagctggatttaaacaattgcccttggataaacatctcattaacaaattaagatgcaagttgaaagatgcgtaccacagtgatttcatgcttcttgaagatgacaactacatgctgcaaggttggaagggccgagtagtttatgcttcctcctgttgggtgcctgcataggccttgacaatgttcttcccaaggtagttaattaggagaagcgtttcatgagttgtaggggagacatggacttccaaaattcttgtggttgacatattctagaagctgatccctgctaatgtaatgacatagcatagttcaatttcagttctcagaatatttttaaattggtcaagtcataagtgtgtgtataatataactgataactggtgctgtgtggatgacatatttcaatgttgaacaattccttcttgagttcttctgataggcactcatgagcagcagaatcctgagattgtgagattttaggtctaaaatttgaactggtttctaagtttgtatattaagttaatattttattctgttcaattaattatttagttaananaaaaa

SEQ ID NO: 1316 - DNA, 1741 bp, Glycine max
  Predicted polypeptide sequence is orthologous to G987
atggaggtaagggtcgttcaaagaaacaagggatcaggaagaaggaaacggtggatttgaggaatcttctattgatgtgttcacaatctgtgtatcccagtgacatcagggctgccaatgaattgctaaagcagattaggcaacactcttctcccattggggatgcatcacagaggttggctcattactttgccaatggcctcgaggcacgcttggttggggatggtacaagtacccaaggaatgtatacttttctgagctctaagaacaacactttttctgagttactcaaggcataccaggttttcagttcctccagccctttcaagaagtttgcatatttatttgaaaatacaatgattatgaaagcagctgcaagtgcagaaaccgtccatattattgattttggcatcctacacggtttccagtggccaatgctcattaggcttttgtcaaatagggagggtggacctcccaagcttaggatcacagggatagagtttccccaacctggctttcgtcccacagaaaaaattgaggaaacgggtcgccacctggctaactattgtaagcgttacaatgttccctttgagtataatgccatatcatcaaggaactgggaaaccattcagcttgaagccctcaaaattgcaagcaatgagctagttgctgtctactgtcaccaggggtttgagaatttactggatgagtgtactattgaagtgaacagtcctagaaatgcagtcctgcatttgatcaggaagataaatccggatatttttactcactccatcactaacggatcatataatgcccctttctttaccacgcggtttagggaggctctctttcattattctgccatttctgataagaatgacactgtcatatctcgtgaaaacgaaaggaggttgatggttgagagagagctctatggcagggagattatgaatgttatagcatgtgaaggttctgacaggattgagaggcctgagacctacaaacggtggcaggttaggaatatgaaggctggtttcaagcagctaccactgaatgaggaattaatggccaaatttaggagtaagttaaaggaataccacagagattttgtcttagatgaaaataacaactggatgcttcaaggttggaagggccgcattttgtttgcttcctcttgttgggtgccggcataatgagatgctactgtgactcggttcagaattcatactatactaaaggtatgattccaagaatcagtcattggctttaactctatccacttctttttttccctggttctgatattcttggtctggctacctacttactctaccttcagcttttgtgatgaagattgtaccaagctttgcaccaagttccttggtaaaattatagcatcacttttctggtagattaagacttgtgaaggtaatacaatttcgttagtgatattgataagaagggcatattagtcatcagagtaggagggccattatagcatgtttgcccaagtacttgcaatcctattattgagttattttctctttaaccaacatgtatcaggcatttcacgtccttctatttaagtttgttaatttcttttacaggatacttgtcttttgagacaaattagttgagaagatgtgattaatttgaaacagatgatgactatgttccgtttgttttttccggtgatattcttgcttgcagttttgtatttctatatatagcaacttatgtg

SEQ ID NO: 1317 - DNA, 1023 bp, Glycine max
  Predicted polypeptide sequence is orthologous to G987
gaattcccgggtcgacccacgcgtccggccatagcatcgcgaaactgggaaaccattcaaattgaagacctcaaaattgagcgcaatgagctgcttgctgtgaactgtctggtaaggtttaagaatttgcttgacgagtcaattgaagtgaacagtcccagaaatgctgttctgaatttaatcaggaagatgaaaccagatatttttgttcacagcgtagtaaatggatcttataatgctcctttctttctcacacgcttcagggaggcactgttccattattcttcaatttacgatatgtttgatactctcatatcccgtgaaaatgaatggaggttgatgcttgagagagaatttttgggccgggagataatgaatgtggtagcatgtgaagctcttgagagggttgagaggcctgagacatacaaacaatggcaggctaggaatactagagctggttttaagcagctcccactggataaggagataatgaccaaatttaggggcaaattaagggaatggtaccacagggattttgtctttgatgaagatggaaactggatgcttcaaggttggaagggtcgcattttgtatgcttcaacttgttgggtgccagcataatgatgtgtgtgactcaactcttgtttcagaattcatactggatggaaggtcaccttcgctgttgtgaactgtgatgaatattcttcccaggtttgcaccaagtgaccctgtataatagtgccagaatttttcccagattagcattaaatcctacaatgacatggacgcgaacattaggagtcaaaattgttatttacgatgcttttccttttcttttcactctctaaccggcatgtactataggcacttcaggatcctaagaagtacttagtaaattggttaaaaggttttttcataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggcggccg

SEQ ID NO: 1318 - DNA, 1055 bp, Glycine max
  Predicted polypeptide sequence is orthologous to G987
gaattcggctcgagattcaatttgcaacctaagtgaggatgcaaaaacaattcacatcatagactttggcatccgctatggcttcaaatggcctgcacttatcagccgtctatcaagacgccctggtgggccacccaaacttcggatcacggggatagatgtgccacaacctggtttaagaccacaagagagggtgctcgaaacagggcgcagacttgcaaattattgcaagcgtttcaatcttccatttgagttccatgctattgcacagagatgggacaccatcagagttgaggacctcaagatagaaacagacgaatttgtggctgtgaactgcttgtttcagtttgagcatctacttgacgagaccgtggtgttgaataatcccagggatgctgttctgaggttgattaagaatgcaaatccagacatatttgtgcatggcattgtcaacggatcctatgatgtaccattctttgtgtcacggttccgggaggctctctttcattacactgcattgtttgacatgcttgacaccaacgttgctcgtcaagatcccatgaggttgatgtttgagaaggagttgtttggacgggagatagtgaacatcatagcttgcgaaggttttgagagggttgagagaccacaaacatacaagcaatggcagcttcggaacatgagaaatgggtttaggctgcttcctctggatcatcgaatcattggcaaattaaaggataggttgagagatgatgcgcacaacaataatttcttgcttgaggttgatggcgactgggtgctacaaggttggaagggtcgaattctatatgcttcctcttgttgggtacctgcatagcataggccttgaacattatttattccagattacaaaaatctagtcttacacacaactattagtacgtctccttcaatctccctagctcatttgttgttttttatgataaggaaaaaccaaagttatagttagtttctttcaatgtgtagtttgtttagtacttacatatctaacaaattcagcaaatacaattgagagccgc

SEQ ID NO: 1319 - DNA, 2281 bp, Glycine max
  Predicted polypeptide sequence is orthologous to G987
gggaatgattcaccacttgtaacataaacgagaaaataaagtttagagtacagcagtgagcattaagcaaatgaagatttataataactaccaacttctttctatgttgctcctaggcatcactagaaaactagtacattaatgtggatattagatatccttctaaaatcagtgatttcagaggagtttaagtcttctactcttgttcataaaagtgcacatataagagggtattttcactattcaaatagaaacaaaatatgatcatgattcacttctattcaaggataaatatacccttagtgcaccttacacctaaaacaattttccttgccaatgagtgggttaggagttggtcattcctcaagcaggaacccaagaggaaacagcaaaaagaattcgccctttccatccttgcaaaacccacttgccatcctcatcaaccacaaaatctttatgatgttccttcttcaccatttccttcactctattcacatgctctggggccaatggaagttgcttgaaccctgctctctggttcctaacttgccactgcttgtaggtttctggcctttcaaccctctctgccccctcacatgctatcacattgattgcatcccttccgaacacccctttctcaatcataagcctagatggatcttcacgaggcacgttaacttcaaacatgtcaaacaatgatgagaagtggaagagtgcttccctgaaccttgtcacgaaaaatggtgcattgtaagtgccattgacgaccccgtgcatgaagatgtttggattgatcctcctgatcaacctcagcaaagcatctcttggacagtttgcagtcacggtttcatcggaaaggttcttcaatctgtacaaacagttaaccacagttacttcactcctatcaattttgaggtcttcaagtcttatagtctcccatttttgtgcaaggcaattgtactcaaatgggactccaaacctcttgcagtacttctccagccaccgccctgtctcctcaaccctttccgccggcctaaatcccggctggggaagatcaattcccatcatacgaagctttggaggcccgcccggcctctctgaaagccgttggatgaggcaaggccactggaaaccatagctaatcccaaagtcaataatgtgaagactgctttcattttgcgctagcttcagaatagtgcggtttgccaagaaattagacatccttagaaatggtgatgccgagatatacactcggtatgctttcaacatatctgcggcagatgctgactgaaaggaaatgaactttggtgtcccagcagctaaccgtttctcgaggccatcggcgaagtaatgagccaaacgctgaagtccatcgccaaaaggtgaagagtgctgcctaatctgcttcagtgtttcatttgcagtcctttggtcaaagctagccacagcctgtgcacattgaattagcaaagtccataaatccaccgtcgtcacgcttgcccttgtccccttattggaacctctctttgatcgtgttttcttcccattagatcctcctgagtcagcaatctgcgatggtgatggttcacggccagcataaaaaatggatggactcttaccatccttacaaagcagcacctcatcaaacatgctagatggctccgaatcatcggagtagacagaagaaagcttgttgcttctctctcttcttcatgtgacatatcattcatgagataactcctcttctccctcaatcctgtggctgttacagaaccctgcatcacaccatcctcaatcacacgcggcttgttctgtgggtgaatcaaattccaggctccatttgaaaaatggaccccagcttgtgtctctctaaacggatcaggagctacatatgcgtgttccggagaatcaattagagatctttgtaggaaagaggaatccaagtcactagcaccgttaaaccaatcagactcgcatgaattatcagtggtataactgctaaaactctcagaactagtagttccaccaaaattatcatctgggtcaggattatcattaaattgaccagttgatgaagggtaactacgaaccaatgcatcatagaatgatttttcagcagcctgaagtctcaaacaatcctgcaacatgcagggttttcgctccaaatcaacttcttcatccatgaggatgtcactaatgtatctgagaatgggattggagtgcttagtactctctgcatgttctccattcgagcttgtcccagaagaaggaccagaatcag

SEQ ID NO: 1320 - DNA, 723 bp, Glycine max
  Predicted polypeptide sequence is orthologous to G987
ccacgcgtccgacggctttcagagaggccaggcgggcctccaaagcttcttatgacaggaattgatcttccccagccgggatttaggccggcggaaagggttgaggagacggggcggtggctggagaagtactgcaagaggtttggagtcccatttgagtacaattgccttgcacagaaatgggagactataagacttgaggacctcaaaattgataggagtgaagtaactgtggttaactgtttgtacagattgaagaacctttccgatgaaaccgtgactgcaaactgtccaaaggatcaatccaaacatcttcatgcacggggtcgtcaatggcacttacaatgcaccatttttcgtgacaaggttcagggaagcactcttccacttctcatcattgtttgacatgtttgaagttaacgtgcctcgtgaagatccatctaggcttatgattgagaaaggggtgttcggaagggatgcaatcaatgtgatagcatgtgagggggcagagagggttgaaaggccagaaacctacaagcagtggcaagttaggaaccagagagcagggttcaagcaacttccattggccccagagcatgtgaatagagtgaaggaaatggtgaagaaagacatcataaagattttgtggttgatgaggatggcaagtggggtttgcaaggatggaaagggcgaattctttttggctgtttctcttgggttcct

SEQ ID NO: 1321 - DNA, 941 bp, Oryza sativa
  Predicted polypeptide sequence is orthologous to G987
  misc_feature (789)..(789): n is a, c, g, or t
  misc_feature (794)..(794): n is a, c, g, or t
  misc_feature (866)..(866): n is a, c, g, or t
  misc_feature (928)..(928): n is a, c, g, or t
acggaattctatcagctccagaccaagccggttcgtgagaacctcccgtcgcaatcttcgtcgttcgcgtcttcgaacggcagcagtgttactttctcagaaggattcgagtcgttgctgagcccggctggtgtcttgcctgatgttagcctgaatgattttgttgtgcagaaccaacaggctttgcagttccgccgcgggtttcaagaggcaagcaagtttcttcctgatgagagcaagcttgtgattgatgtggataagctctacagtggagatgaggggagtaggttccttggtgaggttagacaagagaagaagcttgtgaaggtgaagacagaaacctctgatgttgaatcagcaggtcaccgaggaaagaagcatttctatggtgatgacctggatgcggaggaagggaggtgcagcaagcattccgcgcaagggattgacactgaccaccttgtgagggatttgatggacaaggtcttgctatgcaatggtgagacatgctcaaaaggtgttaaggagttgcgtgaggctctgcagcatgatgtggcgaaacattcaggcggaggccatggcaaagggtccagccatggcaagggtcgtggaaagaaacaacccaagaaggaggtggttgacctggagacccttctcatccattgtgctcagtctgtggccactgatgacaggcgcagtgcaactgagctcctgaagcagatcaggcagcatgctcatgccaatggtgatggtgatcagcgtttggcacactgcttcgccaacggcctcgangcgangctggcaggtactggtagtcaaatttaccaagaactacacgataactcggcttccatgcactgatgtgctgnaagcgtaccagctttatttggcagcttgcccatttaagaagatctctccattacttttgccnatcaaacaatttt

SEQ ID NO: 1322 - DNA, 1106 bp, Oryza sativa
  Predicted polypeptide sequence is orthologous to G987
tttttttttttttttttccacttcaaggcaattattatttaaaaaaccattttcacacacatcaatgggcaaaaatgtttgaccctctgttgcaacatggatcatgaatagaccaaataagttggccgaaaagatagttctcaggttgacaacagcacaagactagccaaaacccagttcaacattttgagcatattacaatgttactgtctgccacagtgcagtaagcacctagtaaaaacagagtaactggtgtcaattacaaccggatcaactgactggattgatcgcaagaaccggtgacgctgcagcgaacatcatccggaccaggacctaagtctattttctaagtggtagtgtggcactaagctgcaacatgacaacagaagcaactaattaacatcacataaaaacatggatatctacatgcatgcttggttatcttatggcttcaacaacttgggctaccaattctccctcatagcctcaagtcattgggtccatcaaaccaacaccaacaccatcgatcttcatacatgacatactgccactagccatcttattgaaatacctagatcttatatttgtcgcgatgccaaaaaaaaaaactactaaaaataagagagagcatcatttggcgtccatgttgagatggcatagagtattcgtcccttccatccttgcaagagccattggtgatctatatctatcacgaagtccttgtggtagcagtccttgaccttgttccgcactacctgaacaatttctggattcaatggcagttgcttgaagccagcccgttgattccgcacctgccattgcttgtatgtctcagggcgctccacccgatctatgccctcacacgcaatgacattcagagcagctcgtccaaagatgttttgctcaatcagcagccgctgttcgctttcccttggggtacttgcatccagaacatcgaacaaggccgagtaaaagaacaaagcctcccggaaccgtgtcacaaagaatggtgcactgaatgagccattcactattgcatggatgaacacatgaggctgcatcttccggatgttgctgagcacaatatcccttgggctgtcgatcac

SEQ ID NO: 1323 - DNA, 1278 bp, Zea mays
  Predicted polypeptide sequence is orthologous to G987
cttttttttttttttggtgacagagattttaggccccttctattagtttttttaggagctcctctccatttctagaaaaagcccatcaagaagcttccccgttattagatttttctaggagctgttggaggcccaccatagagggcctttagtcatgggtcagcatgttgtgcaacccatgtggataggccatagagaacacgtcccttccacgtgtgtagcaaccacccctggtcctcgtcgatgccgaagtccctatggtacttgtccttcaccttgtccctcaccaccttcacgacgtcagcctgcagctggagctgcttgagccccgcccgacggttccgcgcctgccactgccggtaagtctcggggcgctccactcggtcggcgccctcacacgcgatgacgttcatggcggcgcggccgaagatgtccctctccagcagcagcctctccgggctgtcccgaggcacggtggcgtccagcaggtcgaactgcgccgagtagtggaacatcgcctcgtgccgaattgtcgggaagtaggtcgtgccgtagccgccactgacgacgccgtggatgaacacgtcaggccgcatccggcggatgttgcagagcacctggtccctggcggtgggacgacgacgcccactaggcccggcggcggcggcggaggagctgatctcgacctcgatctcgtccgtgagcagcctgaaatggcagaggctgatcacgacgagcacctcggcagctgggtcgatgcccaggtcctctggagacaccgcctctcgcttggccgcgatgccccggaactcgaacggcacgcccagctgacgtgcgcaatcgctgaggcggcgcccggtgtcctcgatctgctgtgcggggcgaaagccaggctgcggcaggtcaatgccggtgatcctgaccagctccggcggtccgccctccctggcggcgaggccgcgcagcagcccgggccactggaagccgtagccgaggccgtagtcgacgatgtgcagccggcggcgcctgccggcgagcgcgaaagcgtcgtggatggtcttgttggcgaaggcgaacgccaccctcttgcagcagcaggtggtcatgtagaggcggtacgccctgaggaagtcggcgacggaggtgcggcggagcatgagcgactggtacaagcggctgcccgtgccggcgaggcgcgcctccaggccgtcggcgaagcagtgcgccagcctctgcgcagcgtcgcccgtgggcgaggagtgccgcccggacgcgtgg

SEQ ID NO: 1324 - protein, 1363 aa, Oryza sativa
  Orthologous to G987
MVIELPFDNQYTTTETEQPHDGSSCSSQQQLSLYNYSPSDPQLFSQPTTGSRTYLSGAVTIPGICNDKSNLGQQQFQIDAALSLGYQRIRSSDALCYISRVLMEDVDERVDLHQGEAALQAAEKPFYDILGQVYPPSLNRLALHSANEPDTPDESSSRNNYHNRYHSSHSSFNMLQPLPTPLSPYSYGRSLFLPNQHLVSTAWTSTFGIPGFQIRRGAEEAKRFVPIIDKLVIDLDTDRGLSISKMTTKAKVGDKKRYAIFELTDQRHSPYTTDLDILEGRNSKRYAITYCEIIRNDMFDRVLLCYGVENFAEASNLRKIMTKQARKNSLNGQTRGSAQRKLRGMKQLKKDVVDLRNLLIHCAQAVAADDRISASELVKKIRQHSSPDGDSNQRLAFYLVDGLEARLAGIGSQVYRKLMASRTSAESLLKAYSLYLSACPFERASFAYANQTILDASKGQQPRKVHIVHFGICTGFQWPSLIQRLANEEGGPPKLRITGIDMPQPGFHPCEIIEETGKRLADYANLFKVPFQYQGIASRWETVQIEDLNIDKDEVLIVNCMFRMKNLGDEMVSMNSARDRVLKIMRMMNPRVFILGIVNGSYSSPFFITRFKEVLFHYSSLFDMIDANVPRDNEARKMIEGGLFGQEALNIIACEGAERTERPESYKQWQARCLKAGFKQLPVDPATLKEIINMKKGIYHEDFVADEDGAWLLQGWKGRVIYAISTWKPNESYLDQCLPEFGGYPCQKYDLHSRILMEEDIDEKISIKKGQDALQATEKPFYDILGKAYPSSSKETAINGDSQADYPDNGSSSYHEQACSGSFVSDLLGSQDAHSITTDWSSEFDRLALQFRRGVEEAKRFIPNIEKLVDDPEKNGLYACKQTTETTEQKGKHENKIRNHPHDPHVEHIELMEARNSKHMAISTSETIRDEMFDSILLCNRQLPGEVANLRGMMAKEASDNPKKFQSKGYGKGQRKPHSSKKKQKEAIDLSVLLIQCAQAIASNNHPFASELLRKIRHHALPDGDGSQRLANCFADGLEARLAGTGSQMYEKLMAKQTSTRDMLKAYHLYFVACPFEMVTYYFSNKTIIDALEGKTTLHIVDFGILFGFQWPCLIQRLAKREGGPPKLRITGVDVPQPGFRPHERIEETGKRLAEYANMFNVPFQYHGIASRWETICIEDLSIDKDEVLIINCMSRMRKLGDETENIDSARDRVLHMMKRMNPQVFILGVVNGLYSSPFFLTRFREVLFHYSSLFDMLDNNVPRNHEARILVEKDLFGNDALNAVACEGAERIERPESYKQWQMRILRAGFKQRPVNQAILNRSVHYKEFYHEDFVIDEDSGWLLQGWKGRIIQALSTWKVET

SEQ ID NO: 1325 - protein, 423 aa, Oryza sativa
  Orthologous to G988
MLGSSPARDRGGGDDAEASEQPQPQPQPPLSPRAGGGEARGLVLACADLVHRGDLDGARRVAEAVLAAADPRGEAGDRLAHHFARALLALRGGGKGGHGGGGGGVVPSSAAYLAYIKIAPFLRFAHLTANQAILEAAAADAGGAHRRVLHIVDLDAAHGVQWPPLLQAIADRADPAVGPPPEVRLTGAGTDRDVLLRTGDRLRAFSSSLNLPFRFHPLILPCTAELAADPTAALELHPDETLAVNCVLFLHKLGGDGELAAFLRWVKSMNPAVVTIAEREGVLGGDVDDDNVPDELPRRVAAAMDYYSSVFDALEATVPPASADRLAVEQEILSREIDAAVAAPGAGGGGRARDFDAWASAARAAGLAPRPLSAFAASQARLLLRLHYPSEGYKADDDGGRGACFLRWQQRPLMSVSSWQPQP

SEQ ID NO: 1326 - protein, 411 aa, Oryza sativa
  Orthologous to G988
MLRSLHSSSSSDTDNNSGGCKNNGGGGGEAAAAVEGGGDQRAVAAAAPSTRDLLLACADLLQRGDLPAARRAAEIVLAAAASPRGDAADRLAYHFARALALRIAPFLRFAHLTANQAILEAVDGARRVHILDLDAVHGVQWPPLLQAIAERADPALGPPEVRVTGAGADRDTLLRTGNRLRAFARSIHLPFHFTPLLLSCATTAPHHVAGTSTGAAAAASTAAAATGLEFHPDETLAVNCVMFLHNLAGHDELAAFLKWVKAMSPAVVTIAEREAGGGGGGGDHIDDLPRRVGVAMDHYSAVFEALEATVPPGSRERLAVEQEVLGREIEAAVGPSGGRWWRGIERWGGAARAAGFAARPLSAFAVSQARLLLRLHYPSEGYLVQEARGACFLGWQTRPLLSVSAWQPSSS

SEQ ID NO: 1327 - protein, 447 aa, Capsella rubella
  Orthologous to G988
MLTSFKSSSSSSEDATTETPPPPFCQLASSSSSSAATSASHHLRRLLFTAADFVSQSNFTAARNLLSILSLNSSPYGDSTQRLAHLFTKALSLRINRLQQEQDPTVATCTTNEMTMSTNSTVFTSSVCKEQFLFRTKNNNSDFESCYYLWLNQLTPFIRFGHLTANQAILDATETNDNGALHILDLDISQGLQWPPLMQALAERSSSPNSPPPSLRITGCGRDVTGLNRTGDRLTRFANSLGLQFQFHKLVIVDEDLPGLLLQIRLLALSAVQGETIAVNCVHFLYKFFNDDADLIGHFLTVIKSLNPRIVTMAEREANHGDHSFLIRFSEALDHYVAIFDSLEATLPPNSRERLTLEQRWFGKEIMDVVAAEATERKQRHRRFEIWGEMMKRFGFVNVPIGSFALSQAKLLLRLHYPSEGYNLQFLNDSLFLGWQNRLLFSVSSWK

SEQ ID NO: 1328 - DNA, 515 bp, Glycine max
  Predicted polypeptide sequence is orthologous to G1040
gaattctgcattagggaacaacggctccaccatggcggcgtgtagggctgccacggccacaaggtttaatgggttctccggcgatgctttcaaatcttattttccattgcaccaatatggggtgggcccttcagaagcctcttctgggttcatgagatcaaggtttctgcagaagcttcccaacaagaggagcatgagagcccccagaatgaggtggacaagcaccctccatgcgagatttgttcatgcggttgaacttcttggtggccatgaaagagctactccaaaatcagttcttgagctcatggatgtgaaggatctaacactagctcatgtgaagagccatttgcagatgtatcgaactgttaagaccactgacaagcctgcggcatcttcaggtaattcgtattgcttaatcctcaactatttttttttctgtttttagcagccttatctttttcttaagcatgcacaaattaatataggttttttcatataatggaaataatgccact

SEQ ID NO: 1329 - DNA, 928 bp, Glycine max
  Predicted polypeptide sequence is orthologous to G1040
caagaatgcgttggactagttctcttcacaatcgctttgttcatgctgtgagctacttggtggccatgaaagggctacccctaagtcagttttggagctcatggatgtcaaagatctaacactagctcatgtcaagagtcatttgcagatgtatcggactgttaagaacactgacaaacctgcagcttcttcagatggggatgaagatttcatgtccttaacagtaccaaatgatcaaaataacagttttttacccaatcagagaggaacttcaaatgcatctatagataatgatatgggctacacttcaagcaatctatgggttaattcttcttcgagcgctagaggagcacggatacaagctaactcaagagatttggatgagcttagtccacaagaaatcctatcatctcagcatactgggaaactttctgagggtagcaactatatacaaacaagaatcttcaacaaggatcaaaatccaagcttggagttcaccttagggagatcaaattggcacaacagtgaacatgcctaattttaattggtttacatatatgatcactttattactagccaaattaatagaaaagattaatatgcacaggtatataaattaatatataggtagtgcttttgtcaagacaaagatgtctgcacttttccacaaatctaaaagcatctctgtatattctttttgggccaaagcttattataggttgtgttagtcattatataaatgttgtagttaaagtaaaagttgaagaaaagaaggaaccagatgtataataaggcctttgttccctcctttttaattcttttccttctttttctctacttttccctagaggttcctacatatttgtccgtatacataactttttttaggctcaaaaaaaaaaaaaaaaaactcgagactagttctctc

SEQ ID NO: 1330 - DNA, 866 bp, Glycine max
  Predicted polypeptide sequence is orthologous to G1040
acgcccacgcgtccgggacaagcaccctccatgcgagatttgttcatgcggttgaacttcttgggggccatgaaagagctactccaaaatcagtcctcgcgcccgtggatgtgaaggatctaacactagctcatgtgaagagccatttgcagatgtatcgaactgttaagaccactgacaagcctgcggcatcttcaggccattcagatgggtctggagaggatgatttatctccgatggttagcaccgccgatcgtggtggtctccgacaatttcccaaccacagagggcggccggagtgggcggcacaacaagacatggactactcttccaccaccactactctatggagtaattcttcaagttgtggggagtcacggctaagacctagttctaacgacatagatggtctcagatcacctatcctccattcacaaacaatatcaggagggcatcaaattcaggagtgtgattcaatccaactcaagagcaacatgccaggttctaatttggagtgcaagatcccaagcttggaattcacattaggaagaccagattgggatggcaaagaacaagcctagctaataattttgataattggttcccttgcttaatttcttttaattttgcaatttatttataaaccatggtgacaacttcgtcatcttatgaaatgtagagctaattatttagataaatataaattggtgtctaggagaggaagaaaagaccctccgtgcgtagttctacttagctagctttcgaaaagtgtttttgagtttatgaacagttttgtttatattttattttgtttttatttatttgtgaggatgagaaggagggaaattaagatgtggcaattaaca

SEQ ID NO: 1331 - DNA, 394 bp, Glycine max
  Predicted polypeptide sequence is orthologous to G1040
acgaaacacgattcgctcgaggagggcttccaggatgcgttggacttctaccctccatgctcgctttgttcatgctgttgaactcttgggtggccacgaaagggctacacccaaatccgttcttgaactaatggatgtcaaggatctcactttagctcatgttaagtctcatttacagatgtaccggacggtgaaaactacagatagggcggcggcttcatcagggcaatcagatgtgtatgataatgggtcatctggtgatacttctgatgacttaacgtttgacataaaatctttaaaaagggctgatctattaattaagcaaggaagatcaagtgttaatcaaaataagaaatatcatgggcctttggggtaactctttaaaggaaacttg

SEQ ID NO: 1332 - DNA, 849 bp, Glycine max
  Predicted polypeptide sequence is orthologous to G1040
ttttgccaaagttgccagcaaagaggagcatgagagcaccgagaatgcggtggacaagcacactccacgctcgatttgtccatgctgtggagcttcttggtggccggctcgaggctacaccaaagtcagttcttgagctcatggatgtgaaggatctcacattagctcatgtcaaaagccatttgcagatgtatcgaactgttaagaccactgacaagcctgctgcttcttcaggcctttcagatggatcaggagaagatgacatgtctccaatgggaagcagtggtggaatgcgtcaattttcagaccaaagaagcctttctgatcgaccactgcaacaagatatggactactcttcaggcaacaacactctatggagtaactcttcaagcagtagagaaacatggcaacaaaataactctaatgacgtagatggtttcagacccccaatcttccagtcacaacaaatatcaggagggcatcaaattcaggagtgtgattcaacccaactcaagaacagtttgtcaggatcaaatttagagtgcaagaacccaagtttggagttcacattaggaagaccggactggaatggcaaagggcaagcctaattttcattggttccctttattgtctctagctagtttgcttaattagtttaattacaacccggtaacatgtgacaaacttcataatctttcctgaaatagaaaggtggtactatatataaaaatatatattcaggcagaaaaagtaaaagccctatatagttccgctaagtttatccttttttggaagttttatgacttcatgaacaattttgtttagcctttttcttgtatttaacatttt

SEQ ID NO: 1333 - DNA, 425 bp, Zea mays
  Predicted polypeptide sequence is orthologous to G1040
cttaattattggtggtacatactagaataataacttaatctgagaagacatttaaattaatgcagcaatgcgaacctatcagtagtgttgactgagtttttgttgcagatttaaattagtagccgccgtccccttcaccagcgcctcttcttctgagaatgaccatgtctcccgcatggccgccatggcctgctgctgctgctacacatgatctggctgtactacccttcactgttctgtacatctgcaggtggctcttgacgtgcgctagtgtaagatccttcacgttcatcagttccagtactgacttcggtgttgctctctcggggccgcccaggagctcgacggcgtgcacgaagtgcgcgtgcagcgcgggggtccacctcatccgcggggccctggagcttctcctcccgccgccggca

SEQ ID NO: 1334 - DNA, 587 bp, Zea mays
  Predicted polypeptide sequence is orthologous to G1040
  misc_feature (33)..(33): n is a, c, g, or t
gttgtcccccaggccgcgctccggctcgcggcngaacggggcgcgcgcgcgccccggatgcggtggacgacgtcgctgcacgcgcggttcgtccacgccgtcgagctgctcgggggccacgagagagctacgcccaagtcagttcttgagctaatggacgtgaaggatctgaccttggcccatgtcaagtcgcacttgcagatgtatcgcaccatcaagaccaccgaccacaagccagctaattctgcttcatcctacgggcaagcagcagccgcgaaaccggtcatcgacatccccgaccccgacgacgacagcctgttcgacctcatcaccaccagcgccgggtctgatcagtcgtcgtcgtcggctcagcactctaaccctgacggcggcggcggcaacgagcatggctccagcatgtgcgctctgtggtgcagctcctcgacaagcatcagcagggggggctggttccatgacagaccaagagacgatgatgccgccactcccggtcccggcgacgacatcaaatccttcgaggacgtgcaatcacacagccttcttgacgatgtcgccgacctcaactcgtc

SEQ ID NO: 1335 - DNA, 722 bp, Zea mays
  Predicted polypeptide sequence is orthologous to G1040
cgggaaacccaaacacccatacaagaatgatatgccactcatgacctgatcactccagtcgaccgcagccggccattgctacctctgtggcttagtcttctgcaagctttcctcttccttctcggctttgaacaaccaagaagctcagctagcacaccgtcgtcgacgttgcaacaaaccccaaccgctaccatgaccaccaccacgatgacgacgacgacgacagcagctcctgatctctccctccacatcagccctccgtcgccaccggagccgaggctgctgctggggttggagctcgacgacgacacggcggcggcggtggcggcgaaggccgcgacgaagaaggcggacgacgcggcgatgcgggagtacaacaacctccgccaggtgcagcggcgccagctgcaccagccgagccagacggcgggccacgggttcaagaggggcacgtcgggcagcgccgccgccggcgccggcgggaggagaagttccagggcgccgcggatgcggtggaccaccgcgctgcacgcgcacttcgtgcacgccgtcgagctccttggcggccacgagagagcaacaccaaagtcggtgctggagctgatgaacgtgaaggatcttacactggcacatgtgaagagccacctgcagatgtacagaacagcgaagcagcagggcgcagacagaccatgtgtagcagttgcaggccatgggcatgccag

SEQ ID NO: 1336 - DNA, 1357 bp, Zea mays
  Predicted polypeptide sequence is orthologous to G1040
  misc_feature (1218)..(1218): n is a, c, g, or t
  misc_feature (1330)..(1330): n is a, c, g, or t
ccctaccactcctcgtcgtcgtggccctcgtacctgcagtcgacgacgacgtcgccccttggcgccgtggcgccgccggcgtccgaccccacggcgtcgtcgtacctctcgccgtccgcgtaccaccggatgctgtcgagcaccggccggctccacctccagggcgtgctcgccgacacgctccgcggctacggcggcgcgcaccaccaccgccagcacttgggcagcctggccgcggcccgctacatgccgaaactcccggcttcccggcgcggcatgcgcgcgccgcggatgcggtggacgagcagcctgcacgcgcgtttcgtccacgccgtcgagctcctcggcggccacgagcgggcgacgcccaagtcggtgctggagctgatggacgtgaaggatctgacgctagcgcatgtgaagagccatttgcagatgtataggaccgtgaagagcactgataagccgcctgcagcaacctcatcagtaggagggggagggccgcctgtggacggtcctcgcggccccggcgacgacgaccacccgagcgattggcggcgggctccatcctcatcagctggtcgggacgtcagcccgcaggcgttcactggacaccggtcagccttctcggacggcgcggcaagccatgcgggcggcgacgttgaatgctcctccgccgccgattccgacggtggcaggccgcgcagcgcttgtacgccaaggctgccgcctccaagtgcgtgcaatgcagcagacacccttcattcagttggcggcccatattccactactgaggatatggagcctgcttgtcgatcagctggcttccaacattcactcaaccatggaatgagctgccctcctagcctggagttctcgctagggcggccaaactggaatggtgcagaatagcatcaccatcagctagctactagacacatgcatggatatatggcacattattagttcaacacttcatctagactgcttacaacacctgattggtttttgcatctattagaaatttagatagttccatgtttaatccaaaaatatcatatatatagtagatttatgacaacatgtacgtgcacgtgtgaaatattactactcacaccaataacgaaaaccacaagggataaaaaaaaaaaaaaaaaaaaaaaaaaaaaaaaaaaaaaaaaaaaaaaaaaaaaacaaaaaaaaaaaaaaaaaaaaaanaaaaaaaaaaaaaattatattaaaaaaaaaaccaaatattaaaaaaaaggggggggttttttttttttttttttttaagaaattatgtttttttttttattgggaagggagngaaaccccagggaaaaaaagggttttt

SEQ ID NO: 1337 - DNA, 956 bp, Zea mays
  Predicted polypeptide sequence is orthologous to G1040
gactcatgacctaatcaccaagatccaatccctcccccttcgagcaagaacaggcgacaaggctggacctgctgccaattcacaagtgcagcagcagaagcttgtcgttgcacaatggctactactgctgctgcagcccccgacctctcgctgcatatcagccctccctcgccgcccgatgatgctaggagcagtgacatgctcttctccaagcagacgctgtgcctcggactcgttcagacgacgacggcggcggcggcgcatgatcaggatggccaatgcgacgacgtccagcagcagcagcggctgcaccagcctagccagatccagaggttcaagaaaacctcgtcatcgtcggcgccgttgttatctgccggaggaggcacgacgagatctgggaacggcaacagcgggggcgggaagaggagctccagagcgccgaggatgaggtggaccacggctcttcatgcacacttcgtccatgccgtagagctccttggcggccatgagagagcaacgccaaagtcagtgctggagctgatgaacgttaaggatctcacattggctcatgttaagagccacttgcagatgtatcgaacagtgaagggaacgacggcagacagatcatgtgctgcaggccatgtccagatgagagacatgggctttctgcacaggggttgtgaactgaatggcttcgaagcgtttagcaacggtacttctaatgctaccgccaataatagggatggaggaccagcagaggcgcgcatcagcaagacgctgccgcccccccgccgctcgtcctaggccagcaggacagtgcgcggcgtctgcatccaggcttccccgacacggccatcagcagcagcagaccgtcatcctggagcgcaggcgtggcaagccgctggtcgtcgacgacggcggcggcgccttcgccgtcaagtggcaggagtagcata

SEQ ID NO: 1338 - protein, 233 aa, Oryza sativa
  Orthologous to G1040
MATTAATAPDLSLHISPPSPPDMAAGGETMEQLAEPKLCLGFGTAAAAAAEQYNNGGCNLQQQQRLHQPSQIQRFKKSASGGSPVCSGGATGTGGVAAARSGNGGGGGKRSSRAPRMRWTTALHAHFVQAVELLGGHERATPKSVLELMNVKDLTLAHVKSHLQATYLLDLVQMYRTVKGTTDRTCAEGHGQMRDMGFLRRGGGGVDGFDVLGNTSSIAIANIRAFNLKDANI

SEQ ID NO: 1339 - protein, 191 aa, Oryza sativa
  Orthologous to G1040
MKKGKRKKKGKIDKKEKGNRPSEEYNPNHSTAWPWSSMCWRSPGAAPPPPPAALDPTTSSLLSPSAYHRMLSSTGRLHGVLADTLRGYAGAAAVAGSIGYGSAAAAAAAMGGYGGAGAGGGFASSRFMPRLLPASRRSMRAPRMRWTSSLHARFVHAVELLGGHERATPKSVLELMDVKDLTLAHVKSHLQ

SEQ ID NO: 1340 - DNA, 651 bp, Glycine max
  Predicted polypeptide sequence is orthologous to G1047
  misc_feature (497)..(497): n is a, c, g, or t
  misc_feature (508)..(508): n is a, c, g, or t
  misc_feature (516)..(516): n is a, c, g, or t
  misc_feature (519)..(519): n is a, c, g, or t
  misc_feature (590)..(590): n is a, c, g, or t
  misc_feature (602)..(602): n is a, c, g, or t
  misc_feature (613)..(613): n is a, c, g, or t
  misc_feature (616)..(616): n is a, c, g, or t
  misc_feature (621)..(621): n is a, c, g, or t
  misc_feature (623)..(623): n is a, c, g, or t
  misc_feature (625)..(625): n is a, c, g, or t
ggctcgagctcctctcctccatcacctctagtttttgtataacccccgtcactctgctcccttaattaattagccaccatgctctccgccctcactccttccgaccccttctctcccttctcccccttctccgccggcttcacgccgtgggatgacaacgacgattcccacgccctcttctcccccaaaccggtctctgcttctagctccgcctctgactataaatccgaaccgaacccaaccgaacacgtatgcgcctcgtcctcggtgatgatggacgagcggaaacggcgccgcatgatatcgaaccgggaatcggcccgcaggtccaggatgcggaaacagagacacctggagaatcttcggaaccagttgaacaagtgcagggtcgaaaaccgggaactcggtaaccggttgcagttcttcctgcaccacctgaaccgcctccgaaccgaaaacgaatggctccgctccgagcgaaccctgctacgccaaanagtcgccattntaacacanatnttgatttttcaaccaattcaaaccaccttctccctgctgcatgaccacatgcaccaacaacaacacacctngctcatgacaantaatccagtantantaaanananattatatatatatatatattatatat

SEQ ID NO: 1341 - DNA, 459 bp, Zea mays
  Predicted polypeptide sequence is orthologous to G1047
ctcgaggccggccgcgtcgtcacggcggcgctggccgaggccgaggccgaggcggcgagggacgcggacccggaggacgaggagcggctccggcgtcagcgccgcaaggtgtcgaaccggctctcggcgcagcggtcgcgcgcgcggaagcagcagcggctggaggagctccgcgaggcggcggcgcggctccgcgccgagaagcagcagctggaggcccggctgcaggccctggcgcggcacgacctcgccgtgcgctgccagaacgcgcggctcggcgccgaggcctccgcgctcgcgcgccgctcccgcgaggcgcgcaggctcctcgcgctgcgccgcctcgcgttcgccgccctgcagccgcggcccggcgtcgctcccgcgcccgcgccgccggcgcccctgctgggactggcctcgctcctgacgcatgtggcttggtggggtcgtgctgcc

SEQ ID NO: 1342 - protein, 151 aa, Oryza sativa
  Orthologous to G1047
MTSGFGFTPWAADTCPTLEQLMASSASPSPSSSLDDNAAAAEEENGEVEEEEERRRQRRKVSNRLSARRSRARKQQRLEELRGESARLRAENRELAARLHAVARHGLAARCQNARLRAEAAALARRLLALQRLARGRHMMITASPPQFSRR

SEQ ID NO: 1343 - protein, 168 aa, Oryza sativa
  Orthologous to G1047
MAGLPFPSDSDTALEAFLADIGFGAPCPEAAPAPSPSHPDTTAAAATDEPVMAGDDQADEERRRRLRRRISNRESARRSRARKQRHLDELRAKASALRATSRDLVARLRGARARAALVALTNAQLRDEAGKLALRLAAARRVIALRQLYSAAAAGGGFEMQALASLIA

SEQ ID NO: 1344 - DNA, 1492 bp, Glycine max
  Predicted polypeptide sequence is orthologous to G1051, G1052
  misc_feature (1474)..(1474): n is a, c, g, or t
  misc_feature (1489)..(1489): n is a, c, g, or t
ctagctattcggctcgagcaagagggtcaaaagaatcttggcaaatagtaatgcaaatgcaacatgttctagtgagaaaatcacagaccccaagagggtcaaaagaatcttggcaaatagacaatctgcgcaaagatcaagagtgaggaaactgcaatacatatctgagcttgagcgaagtgtgacttcattacaggccgaagtttcagtgttgtctccacgggttgcatttttggatcatcaacgtttgcttctgaatgttgacaatagtgctttgaagcaaagaatcgcagcgctggcccaagacaagattttcaaagatgcacatcaagaagcactgaagagggagatagagagacttaggcaagtttatcaccaacaaaacataaagaagatggacaatgctgcagggtcaccaccatcccaatccccaccatctccatcaccaaaaccacgatgtgaaactcacactgaaaaggaacagcttatcaatgtttgaagtttgaatttgaaccctccatttgaagactcactcactcaccctttatagactatgatcaaattaacatatcaaccacctagcttgttcaaaaaaatatcaaccacctagtgtatgctagtttagatgatctgtgattcctttcaatattaaaaaagaaattgcagaattttgaaaataggagaaaaggagaaaaaaaatatgtacaaaacttgaatgcatttataggtgattttggtattattatttttttatcagaatctgagttttatctcgataatctgtgtaattcatcaaatgccaacacaaatgccaacacagattaagtaaaaccctaattttgattagaaaataacaccaaaatacctattaaagtgcaattaagttttgtgattagaagaaaaaaaaaatgttgtgtgactgcttgtagttgtaatgtaatgaatgtcatcacgtactgttgggtagagagagggtgagaatttttattaggcaatcgatgatttgatgaagggaaatgttgttaaatgagaagagggtcatcacattacattataatgtggtgtggtgaggccacattggtggtggtaggcttttgctatcaaactgagacagtcacgtgatgtgtttactttaaagaaaagggggaccactcaagttgcatgattgagaatgcagggaaacacatgtgcaccagtgacatcaaagagagggtggaagaaaaaaacagttgtgtctgctttaactagattctttcagttattttttattatttcttattattatttgttttcttcttgattattttcttttaatttaatttttattttttcttgggttttttttcttccaatattcaagttggaaaacaaagactagtgggcgtgtgtgttgggatggatgaaaggaaggtatgtcattatcagtgaaagtctcatggctcttctctgagttttgttgcactttgtgttactncttttaaggcatgtnatt

SEQ ID NO: 1345 - DNA, 957 bp, Glycine max
  Predicted polypeptide sequence is orthologous to G1051, G1052
  misc_feature (885)..(885): n is a, c, g, or t
  misc_feature (941)..(941): n is a, c, g, or t
acgaggttgcttattcaatagcgatttcagcgctgtacgttgccgataaaatttttgagctgagatattgtcgtgggtccctttaggctcattttgtttcctctatcatttttggagtatttgatttgatctcccgtccgctggctaggtgtttttgtatcgatgtttatatatatatatatatggacacagacattgcatgtatatatatatatatatgcgtagattatcataaaacacatgtaagttttgtgtttgttggtttatatatatagttctctctttcattcttgttcttcttcattcatcttttcatcttcttgtctgagagttgtgttgattgattggtgtgacccaaaaaatggctcaattgccaccaaaaattccaaacatgacacccaattggccagacttctcttctcctcaccaaaagatgccttccctcaaaaccatgtcacctaaccaaaacccttcatgggtggatgagtttcttgaattctccgcggcgagacgtggggcccaccggcggtcggtgagcgactccatcaccttcttggaggcaccattgctggaccaccatcattgcaaaggtggcagtgttggtggtggtggcggtagcggcgacaacgagttcgagaggtttgatgatgaacaattcatgtccatgtttagtgatgaggcttcagggaataataataataataataataataataataataataataataccatgatggaaaacgcgttatcctcttccaacccttctacaccttccgatcacaacagcatcaatgatgagaaggaaatgaacaacaaggaagaggaagggaagaagcaagtgaagaatgagtccgaggaggatgaggatgaaagccaatgcanacaagatatcacgcaacttgcccaacatgatgatagtaaaaacaatagtgatgcanatgcaacatgttctag

SEQ ID NO: 1346 - DNA, 1471 bp, Glycine max
  Predicted polypeptide sequence is orthologous to G1051, G1052
gttcttcttctccttgtggccttcttccctctaacattccctgtggtttctctgaacatatttatataaaggttgtcctgtagccttagaggctcatttggtttaatttgcctatgtcatatcatatgtactccttttttcatttcctctctcatttttggagtatttgatttgatgtgcatatatatacacacacattacaggtatatatatgcttagataatcaaaaaatatataccaagttttgtgtttggtttatatatatagttctctctttctctctctttcattcgtattcgtcttcttcatcttcatcgtttcatcttcttgtcacagtgtgttgattaattggtgtgactcaaaaaatggctcaattgccaccaaaaattccaaacatgacacccaattggccagacttttcttctcttcaccaaaagatgccttccctccaaaccacgtcatcaaaccaaaacccttcatgggtggatgagattcttgagttctcagtggcgaggcgcggggccccccggcggtcggtgagcgactccgtcactttcctggaggcaccattgctggaccaccatcattgcaaaggtggcagtgttgttggtggtggcggcggcaacaacgagttcgagaggttcgatgatgaacaattcatgtccatgtttagtgatgaagcttcagggaacaataacaataataataccatgatggcacacacgttgtcctcctccaacccttctacaccctctgatcacaacagcatcaatgatgagaaggaaatggaaaataaggaagaggaagacaagaagcagttgaagaatgaatcggaggatgaggataaaagcctatgcaaacaagatatcacacaacttcccaacaatgatgacagtaataatactagtaatgcaaatgcgacatgttccagtgaaaaaatcacagaccccaagagggtcgagagaatcttggcaaataggcaatctgcgcatagatcaagagtgaggaagctgcaatacatatctgagcttgagcgaagtgtgacttcattacaggccgaagtttcagtgttgtctccacgggttgcatgtttggatcatcaacgtttgcttctgaatgtcgacaacagtgctttgaagcaaagaatcgccgcgctggcccaagacaagattttcaaagatgcacatcaagaagcactgaagagggagatagagagactgaggcaagtttatcaccaacaaaacataaagaagatggacaataatgctgcagcgtcaccaccatcccagtccccatctccatcaccaaaaccacgatgtgaaactcacactgaaaaggaacagcttatcaatgtttgaagtttgattttgaaccctccctttgaagactcactcaccctttatagactatgatcaaacatatcaaccacccagtgtaagctagtatagatgatctgtgattcttttcaatt

SEQ ID NO: 1347 - DNA, 1254 bp, Glycine max
  Predicted polypeptide sequence is orthologous to G1051, G1052
tccacgcgtccgtccacgcgtccgattatgttgttttatgttcgtgtggctttcttgcctctgacaacattcccctgtgattgctgggaacatgcacatacatatatatttataaaagggttgtgttagagcctagaggctcatttgtttccatttcttcttctcgcgcattgacacatccttgttgtgctgcatgccttatgcaatatatttgcacatacaataatgtgtgcatatatacatatatatgtatatatatcatttgttagggacatgttaatgtactacaacaaaaacattaacatcatctgaggttaatttgcattttgcaacaacagttactgatttggcgtgtttgaactttgaattcaaatgacgcaattacctccaaagatcccaaacatgtcaccaagttggccagatttctcttcacaccaccagaagatgcaattgccacctctttaattcggcggctgcaacactaacaattatcagcacaaccagaacccttcttgggtggatgagtttcttgacttctcctcggcccggcggggcgctcaccggaggtcggtgagcgattccatcacctacttggattcaccagtgaagtgtggagggaataaaaacaacaacaacaatgagaacgagtttgacaagtttgatgatgaacaattcatgtccatgttcacggatgaagtagtgctctctggggtccccttgccaccaccaaccaccttgtcctcctctaacccttcaagcccttacgatcagaacttcatcaatgatgagaaggagaagaaggaggaggaagaggagcaccaccaccaccaccaattgaaaaatgaagcagatgaggttgaaagccaatgcaaacaggaaattatgcagcttccaaatgacaccaatacttgttcttccagcgagagaattactgaccccaagagagtcaaaagaatcttggctaatagacaatctgcacaaagatcgcgagtgaggaagctgcaatacatatcagagcttgagcgaagtgtaacttcattacaggccgaagtttcagtgctgtctccaagggttgcatttttagatcatcaacgattgcttctaaatgtcgacaacagtgctctcaagcaaagaatcgctgcccttgctcaagacaagatcttttaagatgctcatcaagaggcactgaagagggagatagagagacttaggcaagtttattacccacaaagccttcagaagatggaaaatgct

SEQ ID NO: 1348 - DNA, 498 bp, Glycine max
  Predicted polypeptide sequence is orthologous to G1051, G1052
cacatcacgtgaaagttttctagttagcatgaagggacattcattcattcatccatctacagcactattccttgtctcttccccctcaactgaggagctgctccttgttgtccttgcatcccaatggttgagacactgctatcggctgctgatgatgatgaagttgcattggttgttgttgtggctgtgatgttggtgtggtttgttgaagattgctgttcatcttttgtaggttctgttggtgatagatttgccttagtctctctatttccttctttaatgcttcttggtgagcgtctttgaaaatcttgtcttgggccaaagcagcaatgcgttgcttcaaggcactattgtcgacattaagaatcaaacgttgatggtccaggaatgcaactcgaggtgacaatgctgatacctccgtctgcaaagttgttacgctcctttcaagctcagaaatgtattgcagctttcttacccttgacctctgagctgattgcc

SEQ ID NO: 1349 - DNA, 427 bp, Glycine max
  Predicted polypeptide sequence is orthologous to G1051, G1052
ggtatacatatatataatagcatttgttcgggacatgttaatgtactattgcaacaacaacaacattaacatcatctgaggttaatttgcaactacacttcctggtgtatttcaattaattcaaatggcgcaattacctccaaagatcccaaacatgtcaccaagttggccagatttctcttcacaccaacagaagatgcaattgccacctcttaataacaacggcaccatcaccaacaactatcatcagcacaatcagaacccttcttgggtggatgagtttctcgacttctcctcggcccggcgcggcgttcaccggcggtcggtgagcgattccatcacctacttggattcaccaatgaaatgtggaaggaattaaagcaacaacaacaatgggaaccagttttacaaggttgatgatgaacaa

SEQ ID NO: 1350 - DNA, 379 bp, Glycine max
  Predicted polypeptide sequence is orthologous to G1051, G1052
  misc_feature (356)..(356): n is a, c, g, or t
ttcttcattcatcttttcatcttcttgtctgagagttgtgttgattgattggtgtgacccaaaaaatggctcaattgccaccaaaaattccaaacatgacacccaattggccagacttctcttctcctcaccaaaagatgccttccctcaaaaccatgtcacctaaccaaaacccttcatgggtggatgagtttcttgaattctccgcggcgagacgtggggcccaccggcggtcggtgagcgactccatcattgcaaaggtggcagtgttggtggtggtggcggtagcggcgacaacgagttcgagaggtttgatgatgaacaaatcatgtccatgtttaatgatgaagcttcanggaataattataataataataat

SEQ ID NO: 1351 - DNA, 547 bp, Oryza sativa
  Predicted polypeptide sequence is orthologous to G1051, G1052
  misc_feature (503)..(504): n is a, c, g, or t
ctcgggtggcgtttctggatcagcagcggacgatcctgaccgtcggcaacagccacctcaagcagcggatcgcggctctagcacaggacaagattttcaaggatgctcatcaggaggcgttgaggaaggagatcgagaggctgaggcaggtataccagcagcagaacaccaagttgtccggtggtctggccgctgaccacgcacatgtccatggcggcccgccgcctgtgcgagcagagaaggagctcatgagctagctgatcaatttgcctactgtcccctgtgcagtctgccttagcattaactttggagggaacattgcatcatgaacctgtggatgttttcttcttcttcttttttttttgtttttttattcttttacattgacttgtgtattcttgattcggttgttgattggagttctggtttacaatgggaattgtgggagatgtcaataagaaaatgtgaactgcaataagattaactgtgatttttgaaagccnnaattaataataataaaaatatttaaatttaattatataataaa

SEQ ID NO: 1352 - DNA, 1490 bp, Zea mays
  Predicted polypeptide sequence is orthologous to G1051, G1052
  misc_feature (35)..(35): n is a, c, g, or t
  misc_feature (67)..(67): n is a, c, g, or t
  misc_feature (71)..(71): n is a, c, g, or t
  misc_feature (96)..(96): n is a, c, g, or t
ggtacctcgaggcggccgggaattcccgtccgtcntcatcccctcgcctcggcacaagctacccggngggnccggacgagtggtgccgtggcggtnctcgtagctactgcactgcatcactataaagctaagctccaggccccgcgcccccccgcgatcgcgagatctagcgagcgagcgcgcacactgctggcggcaccaggctacgacgatcgagagagccgccgtgccagcacattgtccattgtccgcgcggcgggggatcgggcggacgcgcacataatatggcgcagctgccgcccagggtcccgaccgcggtgcaccgctggccggagggcggccaccacggcgcggcggcgtgggccgatgacttcgccgagttcgctgcgtcgcggcggggcgcgcaccgcaggtccctgagcgactcggtcgccttcgtcgaggtggcgcccgcggccggcgagttcgacaggctcgacgacgaccagctcatgtccatgttccccgacgaggccgccgccggcggcggcggcggcgggtcgtccgcggcagggtccgagaacaacggcggcagcagcgacagttacggcgataggcgcggcggcggtggccctgcggcgggaggcaccagcaccaccaccagctgcaatggcttcgatggtggcgagcacaacgaagccgcggacgcgcaggcgacggggcaagctgccgccgccgccgccgcctccacggagctgatccgggaccccaagagggtgaagaggatccttgccaaccggcagtcagctcagaggtcgcgggtgaggaagctgcagtacatctccgagctcgagcgcagcgtcacaacactgcagaacgaggtgtccgcgctgtctccccgtgtggcatttctggatcagcagcgtaccatactgaccgtcggcaacagccacctcaagcagcggatcgcagctcttgctcaggacaagattttcaaggatgctcatcaagaggcgttgaagaaggagatcgagaggctgcgccaggtctacgagcagcagaacctcaagatgtcagccggcgctgctgcctctgaccatggcccgccaccggtgcgcgcggagaaagagctcatgagctagctacccagtcgatccacgcgtgcccgctgtgcagtgcagcccgcccgccttatcattaattaacatggagggaacattgcatcatgatttctctttttttcggattatgtggatgttttcttctttctttctttcttcttccattgacacgtgtgcgttaattctttgtatgttgattttgggatttggttcactgtgcaaattgtggtaaagtcatcagggaaactgatctgttgtgtaaatcacttttttgaagcattacattcctgggaatctggttacccatgatttttttgtggtctttctttttttcccctttagtagtgtgattagataccacaatatttggcaggtttgagttcgatgtaa

SEQ ID NO: 1353 - DNA, 990 bp, Zea mays
  Predicted polypeptide sequence is orthologous to G1051, G1052
  misc_feature (61)..(61): n is a, c, g, or t
cattgggtacctcgaggccggccgggatcgcgagatctagcgagcgagcgcgcacactgcntggcggcaccaggctacgacgatcgagagagccgccgtgccagcacattgtccattgtccgcgcggcgggggatcgggcggacgcgcacataatatggcgcagctgccgcccagggtcccgaccgcggtgcaccgctggccggagggcggccaccacggcgcggcggcgtgggccgatgacttcgccgagttcgctgcgttgcggcggggcgcgcaccgcaggtccctgagcgactcggtcgccttcgtcgaggtggcgcccgcggccggcgagttcgacaggctcgacgacgaccagctcatgtccatgttccccgacgaggccgccgccggcggcggcggcggcgggtcgtccgcggcagggtccgagaacaacggcggcagcagcgacagttacgccgccgcctccacggagctgatccgggaccccaagagggtgaagaggatccttgccaaccggcagtcagctcagaggtcgcgggtgaggaagctgcagtacctctccgagctcgagcgcagtggcgcttccctgcagaacgaggggtccgcgctgtccccccgcgtggcgtttctggaccagcagcggaccatactgagcgtcggcaacagccacctcaagcagcggatcgcagctcttgcccaggacaagattttcaaggacgctcatcaagaggagctgaagaaggagatccagaggctgcgccgggtctacgaccagcagaacctcaggatgtcagccggcggcgccgccgcttctgaccatgggccgccaccaccggtggtgcgcgctgagaaggagctcatgagctagccagccagtccatgcgtgcccgatgtgcagtccgccttatcattaacatggaaggaacattgcatcatgattttttttttcagattctgtgaatggtttcttccttcctttttttggg

SEQ ID NO: 1354 - DNA, 728 bp, Zea mays
  Predicted polypeptide sequence is orthologous to G1051, G1052
ccacgcgtccggttgttcctaagcgcgccaagaggaccctggcgaaccggctgtccgcgcagcggtcgcgcgtgcgcaagctgcactacatctcggagctggagcgcagcgtcacgtcgctccagacggaggtgtcggcgctgtccccgcgcgtggcgttcctcgaccaccagcgctcgctgctgacgctggggaacagccacctgaggcagcggatcgcggcgctcgcgcaggacaagatcttcaaagatgctcatcaggaggcactgaggaaggagatcgagaggctgaggcaaatctaccaccagcagagcctgaagagcggcagggagcccgacgcggccccgtcggtccgcgacgacaaggacatgatcggcagcgaggggaccgccgcgcccggcccgccctcgtgatgaggaggaggtggttgggggcgacacgtccagacatccgagtcggtcgctgtagtcggggatggccctgtcgcccgccctgcagcccatcacagcgaggttgccgctgccgctgctaggattggtgtgtgtgtgccgtgtgcgtgtccgtgtgtgcattctttgggggtgtgtaacgtgatgtgatgtaaagagaagaggaactgcatcggtttggtttggtttggttatccttgcatgcatatgcatctgcatcctctcctgctgccttccaccacctcccctgaattgtaatttttggtcgagcattttggg

SEQ ID NO: 1355 - DNA, 1650 bp, Zea mays
  Predicted polypeptide sequence is orthologous to G1051, G1052
tcgaggccggccgggccgggaccatttttcctccgttccattcttctctcctcgcctcccctcgcctcccctcttgaaccctccgccgctccgaggaaaatccgatttgaattgaaaatcatccggagacagagatcttttcttcctcgaagctatcttctctgtcgactcgatccatagctgctcgcgtccctgttcctcgccggctggcaagtggcggcgacgggacgaggtcttcatcgcctcttcgcgagcgacgatcacccactagtttggtcggtctgaggcacatgatgatggccaacgcgaagctccacaagcaggccctgctgccgccgcggagccccttcccgacggcggcgccgtacgccgaccgcggcccaatcgcgcggccgcaggttggctccacgcaccaccgccacggccaccaccagcgcacgtcgtccgagagcttcatcgaggagcagccgccgtcgtggctcgacgacctgctcaacgagccagagacgcccgcggcgcggcagagcggccgggctgggcaccgcaggtcgtccagtgactcgtttgcgttgtttgacggtggagctgctggtgctggtgcttacgccaatggtttcgaggggatgggggagaggaggtgggcaacctgcgccgtggggtggtgtgcaggagtactatgccaagctggccccgattgggagggcacatggccggccgtgggagcaaggcatgccgaattcggcgggcttcaggcatggtggtggcctgccgatgcccacaaaagataaggttggtgggcatcatgggccaccgaaagtgtcgagggagcatgaccatggcatggacaagagaactgatgatgctggccatgatcaaaaggttggagccaaggagggtgtgccgccgaagcatgcacagtcagaggcggacaacaagcgtgctaaacagcaatatgctcagaggtctcgtgtccggaagctgcagtatattgcagagcttgagagtagagtccaggcattacagtcagaaggggtagaagtgtctgctgaaatggagttccttagccagcagaatatcatgctagacctggaaaacaaagccttgaagcaaagagtggagagtctagcacaggaacaacttattaagcgttttcaacaggagatgtttgagcgggaaattggtcgtctcagaacaatatatcagcaacagcagcaacaacaggctcctgctcttgttcgtagtaacagcagggaccttgatgtgcagttcgccaacttgtctctgaaacacaaagaccccaacacgggccgggatgctctctctgggcctcttcgtacttagttctttccatccttccgttcttgtgggttctatcagtggccaccactgtgtctgtcatctccaccaagaaaggagaagtgcacttggattgtgtgaaaaacaccggaaaaaggctaatagctatggatctgatgtttattatttcgggatatgcacctggcggtcatcctcagctcgcgtccattggtgatgctcgaccagtcggcggtgtttagggggttttgtttttagctagatgcttttcaagcatcattgtaccatttttcatgctagggttctaatctgttactacccccgttttcctgaact

SEQ ID NO: 1356 - DNA, 919 bp, Zea mays
  Predicted polypeptide sequence is orthologous to G1051, G1052
  misc_feature (846)..(846): n is a, c, g, or t
  misc_feature (848)..(849): n is a, c, g, or t
  misc_feature (851)..(854): n is a, c, g, or t
cccacgcgtccgatctcggagcttgaacggagcgtcaccagtctccagatggaggtgtcggcgctgtccccaaaagggtcaagaggatattggcaaacaggcagtcggctcagaggtcacgagtgaggaagctgcagtacatctcggagcttgaacggagcgtcaccagtctccagatggaggtgtcggcgctgtcccctcgcgtggccttcctcgaccaccaccgctcactgctcaccgtcggcaacagccatctcaagcaaagaatcgcggcgctcgcccaggacaagatcttcaaagacgctcaccaagaggcgctggagaaggagatccagcggctgcgccaagtgtaccagcagcagcaggtcaaggtggccaccaccggcggcgccgacatcgccaccgccgcctcgccgtcgatgcaggccaggcaagagctgctcgcgtgcgagggcgctgctattcgatagcggaggcggcggcggcggcggcggcgttcacgcccctgttactgttagtagcttaattaacttttgtgcagtctgatcaatacgtgttggcttgtttgtttgctgcttcttaatttaattcgtatgtgatgtattctgctcaccctagcaaaaaaaaaaaaaaaaatgcatcgatgccaagttgtgaatgaattgtactattcagttatttggaccggcttagtcggaatatagtgagacggagtttgttggtgtgagttatccgttcttaatttattgttgtttagattgattttatttaaaaaaaaaaaaaaaaaaaaaccaagaaaaaaaaaaaaaagaaaaaaaaaaaaaaaaaaaaaaaaaaaaaaaaaananntnnnnaaaaaaaaaaaaataaaaaaaaaaaaaaaaaaaaaaaaaaaataatgggggggggcctttttagg

SEQ ID NO: 1357 - DNA, 1175 bp, Zea mays
  Predicted polypeptide sequence is orthologous to G1051, G1052
  misc_feature (1170)..(1171): n is a, c, g, or t
  misc_feature (1173)..(1173): n is a, c, g, or t
cccagcgtccgccccgcgtccgcagctagcagaagcacagtcgagcactccaccatccagcttcgcatcccgcaagttcccagtcagccgagcagccagcggcggtgccaagaaggccgagctgcgagctccactccccacacctcagaagaaaaaggtgatggcgcaactgccgccgcgggcgccgagcgccgcgccgcaggaccactggccgccggcggcgggggagttcctgggcttcgccgcggccaggcgcggcgcgcaccgccgctccgcgagcgactcggccgcgttcctcgaggccgtgcccattgacgacgacgtcgtcacgcgcggcggcggcggcggcgacgacttcgaccgcctcgaccacgaccagctcctgtccatgttctccgacgtcgacgtctccgtctccgtctccgtctccggcagcgccggggagagggcgcagctcatggacgcggggggtgcggacgacggggtggcggactcgtcgccggctgccgcggacggcgtcgctgagcccaaaagggtcaagaggatattggcaaacaggcagtcggctcagaggtcacgagtgaggaagctgcagtacatctcggagcttgaacggagcgtcaccagtctccagatggaggtgtcagcgctgtcccctcgcgtggccttcctcgaccaccaccgttcacttctcaccgtcggcaacagccatctcaagcaaagaatcgcggcgctcgcccaggacaagatcttcaaagacgctcaccaagaggcgctggagaaggagatccagcggctgcgccaagtgtaccagcagcagcaggtcaaggtggccaccaccggcggcgccgacatcgccaccgccgcctcgccgtccatgcaggccaggcaagagctgctcgcgtgcgagggcgctgccattcgatagcggtggcggcggcgttcacgcccctgttactgttagtagcttaattaacttttgtgcagtctgatcaatacgtgttggcttgtttgtttgctgcttcttaatttaattcgtatgtgatgtattctgctcaccctagcaaaaaaaaaaaaaaaaaatgcatcgatgccaagttgtgttggaccggcttagtcggaatatagtgagacggagtttgttggtgtgaaaaaaaaaaaaaaaaaaannanag

SEQ ID NO: 1358 - DNA, 624 bp, Zea mays
  Predicted polypeptide sequence is orthologous to G1051, G1052
cggacgcgtgggcggacgcgtgggcggacgcgtgggcggacgcgtgggcagcgctgtcccctcgcgtggccttcctcgaccaccagcgatcgctgctcaccgtcggcaacagccacctcaagcaacgaatcgcggcgctcgcccaagacaagatcttcaaggatgctcatcaagaggcgctgaagaaggagatcgagcggctacgccatgtgtaccagcagcagcagatgaaggtggccaccaccggcggcgccgacatcgccgcggcggcttccatgcaggccaggcaagagctgctcgcgtgcgagggcgctgccattcgatagcggatcgagggcggaggcgttcaactggcagtgccacaacaacaacaccagcaccgaactttgtgccgggttcctccttttctcagtcagacaagttgttcgtcgtgcgtgggaaatacacgtcgcctgttagtagcctattgattttatttctgtgcagtcttaattaattcgtatatgtgatgtattcgtcctcctccacccagagcaaaaaaacaaaaagaaggcccccccgtgctgggatggagacttgttgtgaatgaatgaatgaatgtatttggttatttggccgggcttg

SEQ ID NO: 1359 - DNA, 300 bp, Oryza sativa
  Predicted polypeptide sequence is orthologous to G1052
agaggattttggcaaacaggcagtcggcgcagcggtcaagggtgagaaagttgcagtacatctctgagcttgagcgcagcgtcaccactctccagatggaggtgtcagcactgtcacctcgtgtggccttccttgatcatcagcggtcgctgctcaccgtcggcaacagccatctcaagcaaagaatcgccgccctcgcacaagacaagatcttcaaagatgctcaccaggaggctctgaagaaggagattgagcggctacgccaagtgtaccaccagcagcagatcaaggccaccggag

SEQ ID NO: 1360 - DNA, 326 bp, Zea mays
  Predicted polypeptide sequence is orthologous to G1052
agcccacgcgtccggtttccggcgttgcgccaccgttcccgcgtgttgcgttgattcctcgggtcgaaccaacgcgcggcgcggggtcccggtcgcggccatggcgcggctgccgcccaagatccccaccgtagcgccggcgtggccggagttcgggggcgggcaccaacagcagcgcagcccctccgtgggcacgttcctcgccgccgcgcccatgcagccgtcgtgggtggacgagttcctcgacttctccgccgccaagcgcggcgcgcaccgccgctccgtcagcgactccgtggccttcctcgagcccgaacccggccccg

SEQ ID NO: 1361 - DNA, 627 bp, Zea mays
  Predicted polypeptide sequence is orthologous to G1052
gggccggccaaggcgtcggggtaaatctcggacctggagcgcaccgtcacgtcgctccagacggaggtgtcggcgctgtccccgcgcgtggcgttcctcgaccaccagcgctcgctgctgacgctggggaacagccacctgaggcagcggatcgcggcgctcgcgcaggacaagatcttcaaagatggtgaccgccattgccggccgcccctgctcctcccgactacgaccctcgccgctcatcaggaggcactgaggaaggagatcgagaggctgaggcaaatctaccagcagcagagcctgaagagcggcagggagcccgacgcggccccgtcggtccgcgacgacaaggacatgatcggcagcgaggggaccgccgcgcccgggcccgccctcgtgatgaggaggaggtggtggggcgacacgtccagacatccgagtcggtcgctgtagtcggggatggccctgtcgcccgccctgcagcccatcacagcgaggttgccgctgccgctgctaggattggtgtgtgtgtgccgtgtgcgtgtccgtgtgtgcattctttgggggtgtgtaacgtgatgtgatgtaaagagaagaggaactgcatcggttcggtttggtttggtt

SEQ ID NO: 1362 - protein, 346 aa, Oryza sativa
  Orthologous to G1051, G1052
MAQLPPKIPVAAPGHHQHWASAGGAGDAAWADEFAEFAASRRGAHRRSLSDSVAFVEVAPAGCGAGGEFDRLDDDQLMSMFPDEGGSSAPGSDNGGSDSDGGGDKHAAAQSDDGQHAAGEPTQEQAAATSPTELIRDPKRVKRILANRQSAQRSRVRKLQYISELERSVTTLQKWRQFETDRWTQPHWLAGNSTQCGEEMSESNEVSVLSPRVAFLDQQRTILTVGNSHLKQRIAALAQDKIFKDAHQEALRKEIERLRQAVLACYRLTAPDLLCMIWFPLLGERNHRRRKTCAAYRYRGTPLLLQFQGQVAQRAIQHLHYSEFAVYGSGSAMINHATCGVLVSRY

SEQ ID NO: 1363 - protein, 324 aa, Oryza sativa
  Orthologous to G1051, G1052
MAQLPPKIPTMATAWPEFGGGHHHHAAHGHHHQRSPSMGAFLAAPLPPFPLPPPAPANGGAQQQQQQQQHQPSWVDEFLDFSATKRGAHRRSVSDSVAFLDPVSDDNAGVGAHDFDRLDDDQLMSMFSDDLQPPPPQQQPAAPAASASSPSDHNSMNDEKQDKGETDEAQSECDGATPGQPASPATVDPKRVKRILANRQSAQRSRVRKLQYISELERSVTSLQTEVSALSPRVAFLDHQRSLLTLGNSHLKQRIAALAQDKIFKDAHQEALKKEIERLRQIYHQQSLKNAESQPADAAPVRGRDNADLIGSEGAAAAAPCPHS

SEQ ID NO: 1364 - protein, 287 aa, Oryza sativa
  Orthologous to G1051, G1052
MGAFLAAPLPPFPLPPPAPANGGAQQQQQQQQHQPSWVDEFLDFSATKRGAHRRSVSDSVAFLDPVSDDNAGVGAHDFDRLDDDQLMSMFSDDLQPPPPQQQPAAPAASASSPSDHNSMNDEKQDKGETDEAQSECDGATPGQPASPATVDPKRVKRILANRQSAQRSRVRKLQYISELERSVTSLQTEVSALSPRVAFLDHQRSLLTLGNSHLKQRIAALAQDKIFKDAHQEALKKEIERLRQIYHQQSLKNAESQPADAAPVRGRDNADLIGSEGAAAAAPCPHS

SEQ ID NO: 1365 - DNA, 1154 bp, Glycine max
  Predicted polypeptide sequence is orthologous to G1062
ggttttccccccgagggaagaggcggctcgaggagaaggacgaggaggttgaggatttgagtttcgatggctccgggttgaactatgattctgatgacttgactgagagcaattataataatgtttctgagggtaatactgggaagaatggtggggttagttccaacgcgaacagcaccgtcatcaccggtttggatcaaaaagggaagaagaagggaatgcctgctaagaatttgatggccgaacgacgccgtaggaagaagctcaatgatagactctacatgttgaggtccgttgttcccaagattagcaaaatggacagggcttcaattcttggggatgcaattgagtatctgaaggagcttctgcaaaggatcaatgatctgcataacgagttggaatcgacaccagtgggttcttcactcactcctgtctcaagtttccatcctttgacgcctactcctcctacgctgccaagccgaatcaaggaagaactgtgccccagctcattgcccagccccaatggccaacctgctagggttgaggttcggctgcgcgaaggaagggctgttaacatccacatgttttgtgcccgcaagcctagtctgttgctctcaaccatgagggctttggataaccttggattagacattcagcaggctgttatcagctgcttcaatggatttgctatggatatttttcgagccgagcaatgcaaagaaggtcaggatgtccatccggagcaaatcaaagcagtactcttggattcagctggctacaatggcatgatgtaactagttttgacaagaaacaaactggtagctgctatttcacagtcaatttggcaagttaaatcagaatcagtttttactttgttatgttcacaattcaagtgtacgatactagctctggtaacttgagttaaagttgaggtagaagaaattttcacatgaattttacccccggcagcggcagttactatttggtacctttcacttgctcatgtcgaaccgaatcttgatgctactacttcgacttcaattagttcagggacatttctgaaggcgcgttttgacgtgaagtttgtatttatgtttgtcgaacctattgtcctctttatacagttttcgcccaggacaaaactttaaagcaaa

SEQ ID NO: 1366 - DNA, 673 bp, Glycine max
  Predicted polypeptide sequence is orthologous to G1062
gatagactctacatgctgagatccgttgttcccaatattagcaaaatggacagggcttcaatccttggggatgcaatcgagtatttgaaggaacttctgcaaaggatcagtgagcttcacaatgaattggagtcaacaccagcaggtggctcttcaagctttcttcatcatcctttgacacccactactctaccagcccgtatgcaagaagaactttgtctcagctcgttgccaagccctaatggccatcctgctaatgctagggttgaggttgggttgcgcgaaggaagaggtgtaaacatccacatgttttgcgaccggaaacccggactcttgctctctaccatgacggctctcgacaaccttggactagacattcagcaggcagttatcagctatgtcaatggatttgctatggatattttcagagctgagcaacgcaacgaaggtcaggatgtccatccggaacaaatcaaagcggttttgttggattcagctgctggcttccatagcatgtcctaattgcaaaaaacaaactactactgaaaataccttttcaattagtcaatttagcaatcttaatgtttttaacgctcaaaattcaactgtactatatacaggctcttttaacttctgctcagttgaattaggagaaaatttattttaccaatta

SEQ ID NO: 1367 - DNA, 961 bp, Glycine max
  Predicted polypeptide sequence is orthologous to G1062
caaaaaagaaacgaaaagaaataaaacgatttattacatctcttaataataaagacaacagcataagttcgctttcgtcagaagcagaattgaacaaaatatcaaagctaactcctaaaactacagatttaactaacctatttgatctgggcctaaacagttcaaaggagaagaagaagcaatgcatttacaaactgcaagctacagcaactacggttggctcctctatcagggggaagcatttatcaagcattccaatcacatcataccatggaagccagcagaatccgagagcaccgctttaatttgctcagggaggacatcctggccttctctgcattgctcagctttgaacacatctaaagcaaagccattaaaacagctaataacagcctgctgtacatccaatccgaggttatccaaagccttcatggtagaaagcaaaagacctggtcggcgggtgcagaacatatgaatgttgacagttctcccttcccttactctaacctcaacctttgcagcttggtttttagggcttggcaaggtgccaggatacagttcctccttgacccggcagggaagggttggcagggtgggtgttagaggctgaaagcttgtagaagaagaaggtgtcagcgacgagccaggtggagttgactctagctcgtgatgaagatcattaatccgcggcagcaactccttcaagtagtcaattgcatccccaagtattgaagcccggtccatcttgctaatcttggggacaacagacctgagcatgtacaacctatcattgagcttcttccggcggcgcctctccgccatgagattcttggcgggcagccccttcttcttccccttgttatctccaccattctcactcagcttcaacccattgctctcattctgctcatcagactcatagttcaacccggacccacgcgtccgcggacgcgtgggtcga

SEQ ID NO: 1368 - DNA, 426 bp, Glycine max
  Predicted polypeptide sequence is orthologous to G1062
ggggcccaacccacccttttccagaagagagccgcgctcaggaagaacatgaacatgagtgacaataagaagaggaaggagaaggatgaggtggtggttgaggatgtgagtttcgacgggtctggcttgaactacgattctgacgacttaactgagagtaattataatgaccctaaggagaagaatggtggtgggggggttagttccaatgccaacagcaccgtcaccggtttggatcagaaagggaagaagaagggaatgcctgctaagaatttgatggcccaaccacgccccccgaagaagctcaatgacagactctacatgctgaggtccgttgttcccaagattagcaaaatggacagggcttcaattcttggggatgcaattgagtatctgaaggagcttctgcaaaggatcaatgatctg

SEQ ID NO: 1369 - DNA, 1517 bp, Oryza sativa
  Predicted polypeptide sequence is orthologous to G1062
  misc_feature (828)..(828): n is a, c, g, or t
cagagcgctgcgaggcaaggaggcgagcaagaagcggcggcgaggttgccatggacgaggcggaggcggcggcggcggcggcgaagatggacgagctggcgggaggaggaggaggaggcggcggcgactggtcgtacctcgcggcggacgcgctggcggcggcgtcgttcacggcgttcccgttccaccaccaccaccaccaccaccaccgcgacgtgctctcggcgtcgaccccgtcgtcgctgctcctcaacatggacgcggccaccgccgcggccatgttcgacttccaggcggccttcccgtcgtcctccgtcccgccgccgccgcccacgacgacggcggcgctcccgccgttccacgacttcgcctcctccaacccgttcgacgacgcgccgcccccgttcctcgcgccgccggggcagaagctcgggttcctggggccccccggcggcgcgttcggcggcgggatgggggtgggacgacgacgacgagatcgagcagagcgtggacgcctcgtccttgggtgtctcggcctcgctggagaatgccgcgcccgtggcggccggaggaggcggcggcggtggcggcggcggtgggaggggcaagaagaaggggatgccggccaagaacctcatggcggagcggcggcgcaggaagaagctcaacgaccgcctctacatgctgcgctccgtggtgcccaagatcagcaagatggacagagcttctatccttggtgatgcaattgagtacttgaaggagctcctgcagaggattaacgatcttcacaatgaacttgagtctgcccctagctcttcgcttactggnaccatcatgcggctgagcttccacccatcaacacccacattgcagacgtttcctggccgcgttaaggaggaactttgcccaacctcatttccaagccctagtggtcaacaagccacggtcgaagttaggatgagggaaggtcatgcagtcaatatccacatgttctgcgcacgcaggcccggcattctgatgtccacattgagggctctcgacagccttggcctcgggatcgagcaggcggtcatcagctgtttcaatgggtttgcaatggatgttttccgcgccgagcaatgcagggatggtcctggactcgggcctgaagaaattaagaccgtgctcctgcactctgctggccttcagaacgcaatgtaatcagcaagtcagaaagcagtcaagaccaatgcactgggatttgatcagtgatcatttgcatcagatgatctggtttatcaaaaagttatagtaagtatggcatatatgctgtttatctaggagaactgatgagatgaggctcgccatctagagacatgtgtgatgatgatgatgtaactgggtttctttctttctgttgtcgttttttttttctgaatgttgtttgtgatgtaataggatctttgtcccattgaaaccatgtccattatcatgatgagaatatgaacccagtgtttttggatgaaaaaaaaaagaaa

SEQ ID NO: 1370 - DNA, 484 bp, Oryza sativa
  Predicted polypeptide sequence is orthologous to G1062
  misc_feature (32)..(32): n is a, c, g, or t
  misc_feature (39)..(39): n is a, c, g, or t
  misc_feature (46)..(46): n is a, c, g, or t
  misc_feature (78)..(78): n is a, c, g, or t
  misc_feature (150)..(150): n is a, c, g, or t
cggagtcggagagagacacaagccaacctcgnaactcgnaagcagnagcaaacgcgaagcagaagcaagcgccatggnacgccgagaatggccatgggcgagagcttcgcctactactgggagacgcagcgctaccttggagtccgaggnagctcgacagcatgtacctgccgacgcaggatgactccaactacgagtcgagctcgccggacgggtcgcactcgtcgtcggcgccggcgccggcggccgtgggcggggacgcagccgccgcggtggcgggtagcggtggcgggatgacgacgatgatgatgggcggcggcggcggcggtggcgacgacgccggtggcgcgaacaagaacatcctcatggagcgcgaccgccgccgcaagctcaacgagaagctctacgcgctccgcagtgtcgtgcccaacatcaccaagatggacaaggcgtcgatcatcaaggacgcgatcgagtacatcca

SEQ ID NO: 1371 - DNA, 280 bp, Zea mays
  Predicted polypeptide sequence is orthologous to G1062
  misc_feature (200)..(200): n is a, c, g, or t
  misc_feature (203)..(203): n is a, c, g, or t
ggaagaagcttaatgaccggctctacatgctccgctccgtcgtgcccaaaatcagcgagatggacaaggcctccattctcggcgacccgatcgaatacctgaaagagcttgctgggaagatcgacgacctccaaaacgagctggagtcaccaccatccccagcttccacggcctcgctgccttcgacgcccacgagcttncgncctctgacttccacgcttgccgccctaccatctcgcgtgaaggaagagctgtgcccgagcgcgttgcctagccctac

SEQ ID NO: 1372 - DNA, 849 bp, Zea mays
  Predicted polypeptide sequence is orthologous to G1062
  misc_feature (777)..(777): n is a, c, g, or t
agatttaagggaagcaggatattctattgctgggagtagaacttgggcggcatggatcagcttgacgagcaatcgttcctggacgagctcatgtcgctgcgccgggaggaggcgccgtcgccggctccgtggcaggcgtatccgggcagcggcatgatgacgacgagcgacctcctcttctacggcggcgagggcaccaccgaggcgagcagcggcatggactttgccgggccgtttcagcagcccatggcgccaccgccggccacatctccgcaccggccgcacgagaagttcaacttcgactgcctcagcgaagtatgcaacccttacggcagctgcgtcggcggcgtacctaagcctggggtcgtccacgcggctggccaggcgtatgccctccaggatgccatggcgcagaacggcacgagtggcggcaagctgcatcacggtggtggcaggcgtcgtcgtccccggcgccgttcgtgttcgcaggtgtcgccggggagagctcggagatgaccaggggcgccttctccggcgcccacgctagaagcaagctcaacggtggcactacgtccaagaacctcatggcggaaaggcggcgccggaagcgtctcaacgaccgcctctccatgctccgctccatcgtgcccaagattaccaagatggataggacctcgatcctcggggacaccatagactacgtgaatgagctaaccgagcggatcaaacccttcgagggagagatcggcgccacgcccggaggatctgaacctgctngacaccacgaagaatttctccagcgggtacagtgaggagatgccgatgaggaatccaccaagtttgtcatcg

SEQ ID NO: 1373 - DNA, 1264 bp, Zea mays
  Predicted polypeptide sequence is orthologous to G1062
  misc_feature (1261)..(1261): n is a, c, g, or t
ggtgggttctttgcgccgctgccggcctcgggcttcaacgacgccgggatgagctgggacgacgaggacgagatcgaccaaagcgtcgacgcctcctcgatggccatctcggcctccatggagaatgctgcgggcgcggtggcgggggcaagtggcgccggcggtggcagcgggagaggcaagaagaaagggatgccggccaagaacctcatggcggagcgccggcgtcgcaagaagctcaatgaccgcctctacatgctgcgctcggtggtgccgaagatcagcaagatggatagggcttctatccttggcgacgcaattgagtatctgaaggagctcctgcagaggatcagcgatcttcacaatgaacttgagtcagctccgagctcttcgcttgttggaccaacatcagctagcttcaacccatcaacaccgacattgcagacatttcctggccaggtcaaggaagaactttgcccgggctcattcccaagccctactggacaacaagccacagtcgaagtcaggatgagggaagggcatgcagtcaatatccacatgttctgtgcgcgtaggccaggcatcctgctgtcgacaatgacggccctcgacagcctaggcctcgacatcgagcaggcggtcatcagctgcttcaatggctttgcgatggacgtgttccgagctgagtgcgcggatggtcctggaatggtgcctgaagaaattaaggccgtgctgatgcacaccgccggcctccacaacgcaatgtagccggtccgaaaacgggccaccgccaggatgacgacgatcctcctcctttctactaagggcttcggttcggaagcggcataagattaagctgtggtggccattggttttctggggcaagtgatgaattttaagatgatgaggctcgccatctcgggcatgaggcatgagtgatgatgtaactatgggattcttttttttcttctcattagcctaatgtcggattttctcctctctgatacacttgtggtgtaatagaatctatgctgcgtgttgaacaatatatggtggtgaatggtgatgcggtagctagcatcaaactcagtgcctgttggtcagagatcgatggtgcaaagagagacgagttcattcatcagcgtccagcaatgattttgactggctatgggtccgtccgtccttgattcgaatcaaatgaattgaatcctctggcttcttgttccccaaaagttgtgggatgttgggggtattaatattnggg

SEQ ID NO: 1374 - DNA, 976 bp, Zea mays
  Predicted polypeptide sequence is orthologous to G1062
  misc_feature (3)..(3): n is a, c, g, or t
ggnagggtaagaggaaggggttgccggccaataacctcatggcagtatcgcccgtcgccggtaagaagcttaatgaccggctctacatgctccggtccgtcgtgcccaagatcagcaagatggacagggcctccattctcggcgacgcaatcgagtacctgaaggagctgctgcagaagatcaacgatcttcagaatgatctggagtcgtccccttccacggcctcgctgcctccgacgcccacaagcttccaccctctgaccccgacgctgcccactttaccgtctcgcgtgaaggaagagctgtgcccaagcgcattgcctagccctacttctcagcaaccgagggttgaggtgaggatgagggaaggccgggcagtgaacatccacatgctgtgcgctcgcaggcccggtctcctgctctctgccatgagagcgatcgaaggcctcggcctcgatgtccagcaagctgtcatcagttgcttcaatgggttttccttggacatcttcaaggccgagctgtgcaaggaaggccctgggcttctgccggaggagatcaagtccgtgctcctgcagtccgctgggttccatggcggcgtgatgccgtgagctaggacaacaagaccgctgaaaaagagacagagagagagagaaaagaaagaacaatgtagctaaggggaagtttacatgaactggtgtttccagtctcagggttggttttcgtcttttaacagtttgagaccgttacagacctgctagtcttcctttaattagtctgatagagtagaaaataatgccggtgttctccttcctggtctgttctagttcttggtacatgcttttgccctgttcagttagctagctctatctcatgaaattccgaatcgaaatcaggtgccagtcaaatccgtgtcaggctctgttcggttgttatggatttgagctctggattgattcctaaaaaaaaaaaaaaaaaa

SEQ ID NO: 1375 - DNA, 489 bp, Zea mays
  Predicted polypeptide sequence is orthologous to G1062
cgctgtcaggccacagattcgtcatccgactccgatgaggctgcatcctgtcgtcctcgactgttgactgctgtcgaggtatgctgcgcccgccatggagaatcagtgaacttttaccagagcgtcgacgcgtcctccatggagaatgctgcgcccgcggcggcagcgggggaggcaagaagaaagggatgccggccaagaacctcatggccgagcgccgccgtcgcaagaagctgaatgaccgcctctacatgctgcgctcggtggtgcccaagatcagcaaggcttctgtaacacgggcgcttaagaaaggcactacactcgattctgtcatagagatgctgaagggggttacacctgagcttttcttgccccattgttcttttcacatactataatccaaatctgaaacgtggtgtgggaaacttcatgtctattatgatattatcaaacaagctggcagacatggtaaacttccattttgggttg

SEQ ID NO: 1376 - DNA, 657 bp, Medicago truncatula
  Predicted polypeptide sequence is orthologous to G1062
acttcccctgttttcatgggtgggtccctttcagcttctgagtttcctccgagtcttgaactcgatgctgctccagtaccaccttttagtgcttcgttttctatgcctcttgagctagctcaacctcaaccgcaacaacatcatcatcaacagcaacagcaacaaccaacgacgctgtttcagaagcgtcgtggggcgttggagattccgaggttggagactgtggggaacaagaagaagaggaaggtggagaagagctgggaagaagaaggaagtggtggtggtggtggtgatgatgtggatgatttttctgagttgaattatgattctgatgagaatgggaatgatttgaataattcaaatgggactgttgttactggtggagatcagaagggaaagaagaagaaggggcttccagcgaagaatttgatggctgagaggcgcaggaggaagaaactcaatgatagattgtacatgcttaggtctgttgtgcctaagattagcaagatggatagggcttcaatactcggagatgcagttgactacttgaaggagctgctgcagcggattaataatcttcataatgaactggaatcaactccacctggctcattgcttgcaaccttctgcaagtgcaagctttcacccgttgacacc

SEQ ID NO: 1377 - DNA, 753 bp, Lycopersicon esculentum
  Predicted polypeptide sequence is orthologous to G1062
gggaagagaaagtggggtagtggggaagaacttgatgatgtgagctttgatgggtgcacattgagttatgattcagatgaccttactgaaaatgttactaataaggtggatgatactgttaagaatggtggaaatagctcaaatgcaactagcactgtcacctgtgggaatcagaaaggaaagaaaaagggacttccggctaagaatttgatggctgaacgacgacgtaggaagaagctaaacgataggctttacatgttgaggtctgttgtaccaaggattagcaagatggacagggcttcaatcttaggggatgcaattgagtacttaaaggagcttttacagaaaatcaatgacctgcataatgaactggagtccacgccacctagctcttcactgacccaaacaacaagcttctatcctctaacaccaactggaccagctctgccaggccgcatcaaggaagaactctatccgagttcatttgcaagcccactgtctagcccgactggacaacctggcaagggttgaagtaaaggcaagagaaggaagagctgtgaatatccatattgttttgcagccgcagaccaggcctcttactctcaacaatgagggcactcgacaacctcggactggacatccaacaagctgttatcagctgcttcaatggatttgccttagatatctttagagctgagcatgcaaagaagtcaagactttcatcctgatcaatcaaagcagtactgctggatt

SEQ ID NO: 1378 - protein, 412 aa, Oryza sativa
  Orthologous to G1062
MASLLGLLFSSLLFSERCEARRRARSGGEVAMDEAEAAAAAAKMDELAGGGGGGGGDWSYLAADALAAASFTAFPFHHHHHHHHRDVLSASTPSSLLLNMDAATAAAMFDFQAAFPSSSVPPPPPTTTAALPPFHDFASSNPFDDAPPPFLAPPGQKLGFLGPPGGAFGGGMGWDDDDEIEQSVDASSMGVSASLENAAPVAAGGGGGGGGGGGRGKKKGMPAKNLMAERRRRKKLNDRLYMLRSVVPKISKMDRASILGDAIEYLKELLQRINDLHNELESAPSSSLTGPSSASFHPSTPTLQTFPGRVKEELCPTSFPSPSGQQATVEVRMREGHAVNIHMFCARRPGILMSTLRALDSLGLGIEQAVISCFNGFAMDVFRAEQCRDGPGLGPEEIKTVLLHSAGLQNAM

SEQ ID NO: 1379 - DNA, 423 bp, Glycine max
  Predicted polypeptide sequence is orthologous to G1063, G2143
atggcggcgatgcagccgatacacatagacccggagtcggtgaagcagccgaagcggaggaacgtgaagatttcgaaggatccacagagcgtggcggcgcggcaccgcagagagaggatcagcgagaggataaggatactgcagagactggtcccgggagggactaagatggacactgcttccatgttggacgaggccattcactacgtcaagtttctcaaaacgcaggttcagtcactccaacgcgcttcctccgctaacaacaatattaggccacttggtactagtactgttaacgcaacaggaatagggttccctgttgctatgtctaccacttccaattccaccccttattttcctctgcctaaaccttaccaagctcgccacatggagaatatgcacgatagatatgattaaggttgt

SEQ ID NO: 1380 - DNA, 931 bp, Glycine max
  Predicted polypeptide sequence is orthologous to G1063, G2143
acgagagctcctcatcaacaaccagcgcttccaccctattcaacaacaatgtaacaaccacaattccaccgacgacaacaccgtcaaataatgttgtccaattttccaacattgatgaccttttccaacaacaaccacctatgtcacagtcccttcaacttcaaccctacccttctgaaaagaagaagaagaacaacaattcggctcctcctcgatggcggcgatgagggagatgatattccgaatagcggttatgcagcccgttcacatcgatcctgaatccataaagccacccaagagaaggaacgtgaagatctccaaggatccgcagagcgtggcggcgcggcacagaagagaaaggataagcgagagaataaggattcttcagagattggtccctggcggcaccaagatggacactgcttctatgttggacgaggccattcactacgtcaagttcttgaagaaacaggtgcagacgctggagcaagcaggggcaaatacgtcaccacacagtaatactaatagtcccaataatcacgttgttggtgctgctggttttccgctagggatgtcttctaactactccaataatagtagtgttaattattcttctttgttgatgaagggtggttgccaaccttgtcaaatgttcggttccacttctaaacaattgctcagctaatagttgttaggggaagtttgagagggaatttgcttgtttttgtgatgagaaagcaatgggttgtgtagtgttgatcaattggtgtatgcatgggtttggtggatcgggaagaacatgtttctccatgttaatgccattgttgcaatgatcttttgcttttacaatggtgggggtgggtgtaatcgaaatttcattaacataatggatgagtatgttctacaaaaaaaaaaaaaaaaaactcgagac

SEQ ID NO: 1381 - DNA, 1137 bp, Glycine max
  Predicted polypeptide sequence is orthologous to G1063, G2143
aattcggcaccagtaatcccgcaggctgcagcactttctgcaatctgtaatccgtgcactagtgtttcatattattcttcttatctctcttctgcaaagtgcaaaccctacttactactttcacagctccttcctctgatcctcttccttcccatactctctgctcctaactttttctctcttctcccctttcttccattcctccttgtctctcgcaacgcaaaattcatggacgtggataaactgaaaacttccactagtgacagcagcatggacatgatgatgatgatgatgcaaatggaaaagttccctgaattttgtgaacctttttataacaacaacactactactactactactactactcttctctacccagaaaacgagtacttcttaaactccaccaccaccactctacccgtgttccccaacgtcaacaacccaaacgttataacgccaccacccaccactttgattaatccaccaccaccttcctccaatttcgttctacaacaacccatgacacctcatcttgaacccaacccggagaagaagaattctgtggcggctatgagggagatgattgtccgtgtagcagtgatgcaacctggtcatatagacccggaatccatcaagccaccgaagagaaggaacgtgaagatttcaaaagatccccagagtgtggcggcgaggcacagaagagaaaggataagcgagagaataaggatacttcagagattagttcctggtgggaccaaaatggacacggcttctatgttggatgaagccattcactacgtgaagttcttgaagaagcaagtgcagacgctggaacaagcaggggcaagtagacccttgaatgttgttggcttccctactactgcgtccaacgccaataataataatagttattctggttttgtgaagagttgtcagccttatccaatgctgggttctgcagcttctaaacaattgcttagttgagaagtgtttgtttgatacatgcatgaaaaatgaaaatcaatgaattatatatgtggtttttattttattttttatcttcatagtattgtgatcgatcgtgcatggattataaagacagtgtttgtcagtgtaattgtcattgtttcgagaatt

SEQ ID NO: 1382 - DNA, 742 bp, Glycine max
  Predicted polypeptide sequence is orthologous to G1063, G2143
cccatactctctgctcctaactttttctctcttctcccctttcttccattcctccttgtctctcgcaacgcgaaattcatggacgtggacatactgaaaacttccacgagtgacaacatcagcatggacatgatgatgacgatgatgcaaatggaaaagttccctgaattttgtgaacctttttataacaacaacaacccatgacaccccatcttgaacccaacttggagaagaggaattctgtggcggctatgagggagatgattctccgcgtagcagtgatgcaacctattcatatagacccggaatccatcaagccacccaagagaaggaacgtgaagatctcgaaggatccgcagagcgtggcggcgcggcaccggagagagaggataagcgagaggataaggattcttcagagactggtccctggcggcaccaaaatggacacggcttcgatgctggacgaggccattcactacgtcaagttcttgaagaagcaggtgcacacgctgggacaagcaggggcaaataggtcaccacacagtagtaataataataataatattctcaatactactcacgttgttggtgctgttggttttccgctagggatgtcttctaattactccaataatataattagtaatgttgttaattattctttgttgatgaagggtggttgccaaccttgtcaggtgttcggttccacttctaaacaattgctcagctaattatagttgag

SEQ ID NO: 1383 - DNA, 544 bp, Glycine max
  Predicted polypeptide sequence is orthologous to G1063, G2143
acgagagctcctcatcaacaaccagcgcttccaccctattcaacaacaatgtaacaaccacaattccaccgacgacaacaccgtcaaataatgttgtccaattttccaacattgatgaccttttccaacaacaaccacctatgtcacagtcccttcaacttcaaccctacccttctgaaaagaagaagaagaacaacaactcgatggcggcgatgagggagatgatattccggatagcggtgatgcaaccggttcacatcgacccggaatccataaagccacccaaaagaagaaacgtgaagatctcgaaggatccacagagcgtggcggcgcggcaccggagagagaggataagcgagaggataaggattctacagagactggtccctggcggcacaaaaatggacactgcttcgatgctggacgaggctattcactacgtcaagttcttgaagaaacaggtgcagacgctggaacaagcaggggcaaataggtcaccacacagtagtaataataataataatattctcaatactactcacgt

SEQ ID NO: 1384 - DNA, 622 bp, Lycopersicon esculentum
  Predicted polypeptide sequence is orthologous to G1063, G2143
tgtggtatcccttttagcccatctttcattctaatatttctatatatcctcttgtttttttatttttaccttacaaaaacaaatcatggatttacaaaatattgctcactcactagaacttggattctccaatagcaatattgaaatgatacctttacaatcaccactccataactccaattacttaatgaattctcctccatctaatttctcattcatgggcaatccaattgaagagccagccgcgatgccaatactctcatcgatcgatgaaattatagcatcgactcatggtaatggaaatgattactcatgtttgcagaggaggaattctatggaggctatgagggagatgatttttcgtatcgcgatgatgcaaccaattcacattgatccagaatcagttaaacctcccaagaggaaaaatgttaagatatcgaaggatccacagagtgtggcagccaggcatcggagggaacgaataagcgaaaggataaggattttgcaaagactagtccctggaggaactaaaatggatactgcttcaatgttagatgaggctgtccattatgttaagtttttaaagaagcaacttcaatcactagagcaagccgcggttaat

SEQ ID NO: 1385 - DNA, 2015 bp, Glycine max
  Predicted polypeptide sequence is orthologous to G1064
aatccggctcgcgctctctctctctctctctctccacacagagaaaacaacccagctgcaataagctcccatctgaaaggaattccatgctccacaaaacacacaaacagagaaaagagagacccactagcccactaagcgatacaaattgagggtcacctcatcacacctccttagctactacacacaaacacaacaacatacatagcaaaaaaataatatagaaaaagaaatctagtggcagtactactacttactacttccactatagctgctagctaccagataggaggaccagagtaagggtgagactttttttttttaataccccaccaattcatttatttttcttcttttttttcattaaaaaaaaaaagtgcttatagagaagcttggttatatgagataacaagatcatggaaattggaggctgatcatcaaaatgggatccgaagcaggcccaatttccctctgcagctgttagagaaaaaggacgttgatgacgtcaccgaacaaccttgttccaccaccagcgtggtaactactgctgctgctactattacttctggtaacaacgacctccacgtggcggagcagtcgaagaagcctccgccaaagcggagttccacgaaagaccgccacacgaaggtcgatgggcgaggccgccggattcgcatgccagcggcctgcgccgcaagagtgttccaactcacgcgtgagctgggacataagtctgatggtgagaccatcgagtggctcctccagcaggcggagccggcggtcatcgctgccacaggcaccggcaccattcccgccaacttcacctcccttaacatctccctccgcagctccggctccaccatgtcggcgccttctcactacttccgcggaaactacttcaaccctagcacgttctccacctcagccgccgctgcttccgcggcggcggtggcacagctaaggagccgcgcggagtgggaccggaacatgagcatggtgatggaggattctcgtaggagcatgctggagaacacttcttccatctccgcaattttgaatttcaaccctatgggtaacgtcaatgtaattcaacaagcgaaacaagagcttcgagaagaatccgccgccgccggtggcggcggcagtcttgattcggtggcttcggattccgatggaagcttagggagaaagagaaggccagagcaagagctatcacaaatgggaagctacttgatacaatcaagcacagggtcgcttccgtcgagccacgcttccaatacggcggcgttttggatggtggccggtcacggcaaccaagccatgagtggtggtggtggcagcgatggtagcagcgataatcccatttgggcaattccctctgttgggaatagcggtgtgtatagaggagctatgtctgccccaggtggcattcatttcatgaattttgcttctccgatgaaccttatccccggagctcaactaggttccgccatggttgggggcggaagtggtggcggcaacagtggttctcaacttctaagtgaaagtaacttaggcatgcttgcagcccttaatgcctacaggcagattccggctaacggcgtctcggagtctccggccagcgccgggcaacctcacggcggagacgatggacgtgattcctccggtcaacattcctgagggtaaaaataatcacaagtgtatgatctgatgctagcttcttaatttttcttttaattactagtatattattactagtgctactattactactattagttctacaactaattagtggtttctataatatatatatatatatatatatatatatatatatatatatatatatatatatatatatatatattaaatacgtacttatatatgttatgtccatttgcaaaaacatgcaagaagcgcaagtttgattgcttattgagttcagtttgtggtgtgatttttgggcggccgctgatcatgttagggttcaatacgtatactttaccaatggt

SEQ ID NO: 1386 - DNA, 1637 bp, Glycine max
  Predicted polypeptide sequence is orthologous to G1064
ggctcgagaaaagtgcttatagagaagcttggttatatgagataacaagatcatggaattgggcgctgatcatcaaaatgggattcgaagcagactcaatttccctctgcagctgttagagaaaaaggacattgatgacgtcacggaacaaccttgttccaccaccagcgtggtaactgctactactactgctattactactactactacttcagataacaacgacctccacttggcggagcagtccaagaagcctccgccgaaacggagttccaccaaggaccgccacacgaaggtcgatgggcgaggccgccggatccgcatgccggcggcctgcgctgccagagtgttccagctcacgcgtgagctgggacataagtctgacggcgagaccatcgagtggctcctccagcaggcggagcccgccgtcatcgccgccactgggacaggcaccattcccgccaacttcacctccctcaacatctccctccgcagctctggctccaccatgtcggccccgtcgcactacttccgcggaaactacttcaaccctagcacgttctccacgtccgccgccgcggcggcggcggctcatctgagaagccgcgcagagtgggaccggagcatgagcatggtgatggaggattctcgaaggagcatgctggagaacacttcttcaatctccgcaattttgaatttcaaccctatgggtaacgttaatgtaattcaacaagcgaaacaagagcttcgggaagaatccggcgggggcggcggtcttgaatcggtggcttctgattccgatggaagcttagggagaaagagaaggccagagcaagaactatcacaaatgggaagctatttgatacaatcaagcacagggtcgcttccggcgagccacgcttccaatacggcggcgttttggatggtggcgggtcacggcaaccaagccatgagtggtggtggcagcggcggcggtggcaacaatggtagcagcgataataatcccatttgggcaattccctctgttgggaatagtggtgtgtatagaggagctatgtctgctccaggtggcattcatttcatgaatttcgcttctccgatgaaccttatgcccggaggtcaactaggttccggtatcgttggtggcggtggcggcggtggtggcaacggcggtgctcaacttctaagtgaaagtaacttaggcatgcttgcagcccttaatgcctacaggcagattccggcgaacggcgtctcggagcctccgggcagtgccgggcaacatcacggcggagacgatggacgtgattccaccagtcaacattcctgagggtcaaaataatcacaagtgtatgatctgatgctagcttcttaatttttcttttaattactatattattcctagtgctattattactactattagctctactactaattagtgatttgcataatatatattaaatacgtaattatatatgttatgtccatttgcaaaaatatgcaagaagcgcaagtttgattgctttggtatattgagttcagtttgcggttttggttggacctttggtgtgattttgctgaggttgatcatggtagggtttaattcgagaagaaatttatacccgtatatttttacc

SEQ ID NO: 1387 - DNA, 563 bp, Glycine max
  Predicted polypeptide sequence is orthologous to G1064
ggctcgagctcctccccacaccctcctccgaaccttcccccaaaaaaccaccccccaaaagaacctccaccaaagaccggcacacgaaggtcgacggtcgcggtcgtcgaattcgaatgccggctctctgcgccgctagggtgttccagctcacgcgtgagctgggacacaagtctgacggcgagaccatcgagtggctcctccaacaggcggagccatccgtcattgctgccaccggcaccggcactatccccgctaacttcacctccctcaacatctccctccgcagctccggctcatccatgtccgttccctcccaactacgatccagctacttccacaactcaaacttctccctccaacctagaagaagcctattcctagaaaacaccaacactccttccacaacaacaacactccttcatttccaatccaacaacaacaacgccatcttccaacccaagcacgaattgcgcgaatcttcatcactagacttgtcctcagagaacaacaacgaagagggttattttggaagaataagaagacccttggagcaagaccta

SEQ ID NO: 1388 - DNA, 633 bp, Zea mays
  Predicted polypeptide sequence is orthologous to G1064
  misc_feature (615)..(615): n is a, c, g, or t
ccgtactgccttgccccctactttgcctcgcttagcttaggcggcgctgatacccactctcgccgtccttgttgccgcggcgctctgctcacgatggagttccgcgatgcatgtgctgctcgcggctcggggcgcgcgtgctggtcgacgcgccgcaagcgcacgagatggacatgggtgagacgaccgcgccgacgcccgagacgagcaccacaacctgggccgcgcagtatgatctggtcgaggctaaggtcgaccagtagttcatgctccacgaccaggagcaggagcagtaccagcttcagccgaacctgcggatacatattgaccaggcgtcagcggcagcccaggacgatcgcggtggacttaaggagcagcagaagcatgatgcatgtggtggggcagatcgggggattggatgcagcaggcgctcgcccccaagcggagctacaacaaggaccgtcacaccaaggacgacgggaggggccgacggatccggatgccggcgctctgcgccgagcggatcttacagctcacgcgggagctcggccacaagtccgacggcgagactgtgcagtggctgctgcagcaggccgagccggccatcgtcgccgncaccggcacgggcaccat

SEQ ID NO: 1389 - DNA, 1835 bp, Zea mays
  Predicted polypeptide sequence is orthologous to G1064
atcttctccttcccccggcaatcgtcctagctgcaacgcactcggcccgtcgacaaacccagccagaactccataaaatagtgtcgatcaccacaggcaaacctccctccccgtttctctctctttcactctttttctctctccaagaaataattgactccaacgccaagcgccacaagcacaagcccttgcttgcttgatgtcactctttcgctctcgctagctctaacgccaccgctgacggcgctgccgagcctccagtccaccgcccaacgtcatacaccaagtcaggtcagcagccccacaagaacacttcgtaggtcagcaaatccattattagtaccgatatttctccaggtccctgaagagaaagcatcgtcttgtgtatttatatataccatggcctgatcggctatggacgtcaccggagatgccggcggaggtcgccgccccaacttccctttgcagctgctggaaaagaaagaggaacagccctgctctacgtccccagcggttgctgtgggtgctggggctaatgggtcgggagagatgcagatgaagaaggtggcggcgccgaagcgcacatcctccaaggacaggcacacgaaggtggacgggcgcgggaggcgcatccggatgcctgcaatttgcgcggctcgggtgttccagctgacaagggagctggggcacaagacggacggcgagacgatcgagtggctgctgcagcaggcgaagcccgcggtggtggcggccacgggcacgggcaccatcccggccaacttcacctcgctcaacatctctctccgctcctcgggctcttccttctccatcccagcgcacctccgtgcggccggcccacgcttcggcggcgcgcggggggacccgtgggagcgcgtcgtgggagtgggactcgggttcggcgccgccgccgaggaccctccgtccgctacgtcctcggcgtcgtctcctctgctgctgagtttccactccggcagcgtcggtcttgacgtgtcgccgtcgccgtcgtctgccgccgccggctccgacctgtcgaagaaacggaggtgggagcaggaaatgcagcagcagcatcagcagcaataccaccagcagcagcagatggccgggtacacgacgcagagccaaatgccaggcgccgtgtggatggtgccgagcgcgagcagcaacgctcaagccgccgcagcggctggcggtggcggtggcggcagcaacgccaacgagtcgatctggacgttcccgcagccagcaagcggcggcggcggcggcgcggcgaccgtgtaccgcggcgtgccgagtgggctacatttcatgaacttccccgcggcgcccatggcgctggtccccggtggtgggcagcagctcgggctcggcggccccgtgcccgtgggcggcgccggcaacgacagtagtggcagtgccagcggcggcggcggcggcgagggccacatggggatcctcgccgcgctgaacgcgtaccgagcacatagtgccgtctcggacgctgcgccggagcagaacggagcggaaggcggctctcgtcagcaccagcagcacggcggcggcggtgagcgacaggagagcgtgagtcctcccagcgacggctcgtagcgtcttcggagttcggaggcgtgtgcgtgcactggtctgctatggcgtctctctctctttctctctctctcctgtgttaattagtctgtgcttctcgacttatcgtttgcggtttttgttaattggttgcactgttgtggcctcctctggctccttcacattcttgcaaggatcatacagagtttggtttaaaaaaaaaaaaaaag

SEQ ID NO: 1390 - DNA, 671 bp, Lycopersicon esculentum
  Predicted polypeptide sequence is orthologous to G1064
gtgaaaatttagttattaagagtgatcatggaaggaggaggaggtgacgatcatctccaccatcaccatcacaatcaccagcaccaccaacatcaccagcaatatcgtcctaacaacttccctttccaattactcgaaaaaaaagaagacgaaccttgctccagctcctccgcagctaataatattaattatccttcgctagccatttccccatccgatacaaatacgaatataaaccctaatagtaacgaccttcaaattacagttgcctctactgagactgctaaaaagccagctcccaagagaacttccactaaagaccgccacactaaggttgatggccgtggcagacgtatacgtatgccggccctttgtgctgctagggtttttcagctcactcgagaactcggtcacaaatccgatggtgaaaccatcgaatggcttcttcaacaagctgaacctgcagttatagctgctacgggaacaggtacaattccggcgaatttcacgtcactcaacatttcattacgtagttcaggatccagcatgtccgtaccatctcaacttcgatcttcgtatttcaatccgaatttttcactgtcccaaaggcgcagtttgtttcagggtatcggtttatcatcagacagatctgcaactacaacgttgctgaa

SEQ ID NO: 1391 - protein, 381 aa, Oryza sativa
  Orthologous to G1064
MDHGGGGGGGGAAPSSSNIGGGSGGGGGGGGRENHPHHPFYYSGPAAAAAAAAAAQQQQQTFMGALAITPVVAEQPQGSSGGGEKKVVAPTTPAAAGAAATTTLAKRPSKDRHTKVDGRGRRIRMPALCAARVFQLTRELGHKSDGETIEWLLQQAEPAIIAATGTGTIPANFSSLNISIRSGAASASSASNPNRASPFPALALHPHHQQHDGGPLQEDDDRQDPSAPKAREQQPTTPQAAAAAAAAAAMWAVAPNTAAPGGAFWMLPVSASSAAAARPTEQPMWSFAGGGGGAATVQAPLQFMSTRVNYPGSAGAGMSDTNLGMLAALNAYNRGGAGDQQPQQQPEMDQQGRNDDDDDDGDDSGDEDNGGANNNNNNSSQ

SEQ ID NO: 1392 - protein, 314 aa, Gossypium hirsutum
  Orthologous to G1064
MEGGGSDDHHHHHHSHHHHHQQPLHHHHHHHHRPTFPFQLLEKKEEDNQPCSSSSSLPFPSLPVSSSSADQHTSTRSISTHQISPETSKTPPPKRTSTKDRHTKVDGRGRRIRMPALCAARVFQLTRELGHKYNGETIEWLLQQAEPAVIAATGTGTIPANFTSLNISLRSSGSSMSVPSQLRSSGFSSNFSMQQRRSLFPGIGLETTPTPTTFLNFQSSSTSLGISEEAEESSLGRKRRPEQDLSSQHHQNGELLVASSTVHSGESPRSSSGNFWMVTNSNNQAMSGGDPIWTFLQLITVVCIGELCLVGCIS

SEQ ID NO: 1393 - DNA, 1325 bp, Glycine max
  Predicted polypeptide sequence is orthologous to G1069
  misc_feature (831)..(831): n is a, c, g, or t
  misc_feature (842)..(842): n is a, c, g, or t
cacaatcacatatataaatattatatatataacacacaaagttacaaaccaaaccctaatcaccttatttccaacccttctcattatttttttcttctctgttgactcaaaaacaatactatatctatcactcttaccattaatcaatcatctccctccgatcttaatttcttccatataacgagagagagagagagagagttaattagttttcctgcaacttcaacttttgttatggccaaccggtggtggaccgggtcggtgggtctagagaactctggccactcgatgaaaaaaccggatctggggttttccatgaacgagagtacggtgacggggaaccatataggagaagaagatgaggacagagaaaacagcgacgagccaagagagggagctattgacgtcgccaccacgcgccgccctaggggacgtccaccgggctccagaaacaagccgaaaccgccgatattcgtcacccgagacagccctaacgcgctgcggagccacgtcatggagattgccgtcggagccgacatcgccgactgcgtggcgcagttcgctcggaggcgccagcgcggggtttccattctcagcggcagcgggaccgtcgtcaacgtcaatctccggcaacccacggcacccggcgccgtcatggcgctccacggccgcttcgacatcctctccctcaccggctcctttctccctgggccgtcccctcccggcgccaccgggctcacaatctacctcgccggaggccaggggcagatcgtcggcggcggggtggtgggcccgctcgtgggcggcggccccccgttttgggtaatggcnggctacgtttntccaaatgctacgtacgaaaagattgcctctagagggatgatgatcaggaacacggcggcggcggaggctctccgccgggaattaccggcggtcccggcgaggcctcgtcgtcgatttcggtttataacaataacgttcctcctaatttaggtctttcgaatgggcaacatctgaaccatgaagcttattcttcttctccttgggttcattctcctcatgccagacctcctttctaattcaacgtgctagctagctagagaggaacgtgttacatatattattattacatagaaggatgataatattatgatatgatataatgatatagtgtgtttgtatatttaatttacttgcgatctcgtctcacctggacagtgaccatgccgttgcttctttctgtaatttcttcagttttaccccagtgatcactttttagttttcactcttgccatctctgcttctatatatttccttcctttcta

SEQ ID NO: 1394 - DNA, 734 bp, Glycine max
  Predicted polypeptide sequence is orthologous to G1069
cccacgcgtccggaaaatatctagctaagccctttgtttcttataagctatgtgggtttgacttcttttttttttttttgctctcttgcaatttcaacaagtgaaagaaaactcggaagacaaaaaccaaaaatccaaaactaaaccactatcagctacatagtcttcgaagaagcaactgtggcaaatccttggtggacgggtcagggagggttatctggggttgaccacccaggaacccattcacctggcctaggcaaacgcccctcagaccttggaatcagcgaaaacagtggtgggcacaatagagaagaagatgaagacaatagagatgaaccaaaagagggtgcagttgaggttggaacccgcagaccaagaggaagacctcctggatccaaaaacaagccaaaaccacccattttcgtgacaagggacagcccaaataccctgaggagccacgtgatggaggtaactggaggagctgatgttgcagaaagtgttgcccaattcgcaaggaggcgtcagcgtggggtttgtgtgctcagcgggagtggctcagtggccaatgttactcttagacagccttctgctcctggtgctgtggtggcacttcatggaaggttcgagattctgtccctaaccgggactttcctacctggccctgctcctccaggatccacaggactcaccgtgtatctggccggaggacagggccaggtagtgggagggagtgt

SEQ ID NO: 1395 - protein, 266 aa, Oryza sativa
  Orthologous to G1069, G1073
MGLPEQPSGSSGPKAELPVAKEPEASPTGGAAADHADENNESGGGEPREGAVVAAPNRRPRGRPPGSKNKPKPPIFVTRDSPNALRSHVMEVAGGADVADAIAQFSRRRQRGVCVLSGAGTVANVALRQPSAPGAVVALHGRFEILSLTGTFLPGPAPPGSTGLTVYLAGGQGQVVGGSVVGSLIAAGPVMVIASTFANATYERLPLEEEEEGSGPPMPGGAEPLMAGGHGIADPSALPMFNLPPSNGLGGGGDGFPWAAHPRPPY

SEQ ID NO: 1396 - DNA, 1409 bp, Zea mays
  Predicted polypeptide sequence is orthologous to G1069
ctgagcccccctgcttattagagttggagtccgaggtgtgctgtgcatcctctccgtatgcaggtaatcgcccgcccaagaaggtttctgagcggaaaggaataggaaagtcccgacgagaagtgcactctatctctttttatatagggactagggagagaggctggctcggtagctcagagacatcctccagtccagctgattttctcgccgcgccgtgttcaatacggctacgaaaatagtagggctggcaaaccggtggccggccggcagcgcggcggccgaggagatggggagcctcgacggcggccactcgctgcagcagggccgccaccacggctacgcccactcccagtcccacgtcggcgcgggtcccgacagcagcaacaacaacaaccgacgaggacgacgcgtcgcccccgccgccttccggggcgggaggaggtcctcgccggccgcgcgggaggcccccggggtccaagaacaagccgaagccgcccgtggtggtgacgcgggagagccccaacgcgatgcgctcccacgtgctggagatcgccagcggcgccgacatcgtcgacgccatcgcgggcttctcccgccgccgccagcgcggagtctccgtcctcagcggcacgggcgcggtcaccaacgtcacgctgcgggagcccgcgcggcccacggctacgaaaatagtagcgctgcgcggccggttcgagatactgtccatgtccggggctttcctcccggcgccggcgccgccgggggccacggggctcaccgtgtacctggcgggggggcaggggcaggtggtgggcgggagcgtcatgggggagctcatcgcttcgggccccgtcatggtgatcgccgccacgttcggcaacgccacctacgagaggctgccgctggaccaggcagacgccgaggagggcgccgtgctgtccggctcgtccgagggcgccaccgcgcagcagctggagcagcagcagagcagcgggggtcccgtcgtgccgccgtccatgtacgccgtcccgcagacgccgccgcacccgcacgacatgttcgggcagtgggggcacgcggctgtgacgcgcccaccgccgacgtcgttctagctagcgctagatgcacatgcaccagctgcgacctgcaccggccgcccgcccgccgtataccctctccacctttctagttagatttccacttcttcactagctactactatagctactactctagtttgttacgttagctctaccatggcatgcatgtgtgatcgttttcccatttcttctagctctcttccatctggagcgtgtggaatcaatgtacaattcctatttgcgaataccggaatccatcaatgtttacttaaaaaaacccaaaaagcgcggccgctcgcgatctagaac

SEQ ID NO: 1397 - DNA, 628 bp, Lotus japonicus
  Predicted polypeptide sequence is orthologous to G1069
gattctctctagaaaaagaagaggaagaaaaagaagaaacattatctttcagcaaccctggctaatccttggtggactggtcatcaggttgggttgcctggggtagacccttcaggcaactcaccaaaactttccatcaacggaagcggcagccgaagcatcggtggtgatggcgaagggggaaatagcaacatcagggatgatgaagatgaagagagagacgccggcgatgaaccgagagaaggtgcagttgagattggaaaccgtcgtcaaagagggagaccgccaggatcaaagaacaagccaaaaccgcccatctttgtcacccgggacagcccgaattctcttcggagccatgtgatggaggtggccggaggagctgatgttgctgagagcgtggcgcagttcgcgaggcggcgccagcgcggggtttgcgttcttagcgggagtggcgctgtggccaatgttaccctacgtcagcctgcggcgccgggagctgtggtggcgcttcatggaaggtttgagatcttgtccttaactggggcttttcttcctggacctgctcctccaggctccacaggactcacagtgtaccttgctggaggacagggacaggttgtgggaggga

SEQ ID NO: 1398 - DNA, 534 bp, Lycopersicon esculentum
  Predicted polypeptide sequence is orthologous to G1073
ggtgaatctgacagtgatgctggtgcaagttctggaggcggagctcccaatcgccgtcctcgaggccgtccgcctggatctaaaaataagcccaagcctccaatcatcgtgacgagagatacgcctaacgcactccgatctcacgtgcttgaagtttcgaccgatgttgatatcatggaaagtatctccaattacgcaaggcggagagggagaggtgtttgtattcttagtggtagcggcacagttaccaacgtcaaccttcgtcagcctgctgcaagtgtagtcacactccacggacgtttcgaaatacttagcctctcaggtacggtgcttcctccgcctgcaccgcccgcctccagtgggatctctatatttttatcaggtggacaaggacaagtggttggaggatccgttgtagggcctttgatcgcatcaggtccagtcgtcttaatggctgcctcttttgctaatgctgtatttgaacgacttcccttggaggaagatgatgaggctcctgctaatgttcctactaca

SEQ ID NO: 1399 - protein, 336 aa, Oryza sativa
  G3399  Orthologous to G1073
MAGMDPGGGGAGAGSSRYFHHLLRPQQPSPLSPLSPTSHVKMEHSKMSPDKSPVGEGDHAGGSGSGGVGGDHQPSSSAMVPVEGGSGSAGGSGSGGPTRRPRGRPPGSKNKPKPPIIVTRDSPNALHSHVLEVAGGADVVDCVAEYARRRGRGVCVLSGGGAVVNVALRQPGASPPGSMVATLRGRFEILSLTGTVLPPPAPPGASGLTVFLSGGQGQVIGGSVVGPLVAAGPVVLMAASFANAVYERLPLEGEEEEVAAPAAGGEAQDQVAQSAGPPGQQPAASQSSGVTGGDGTGGAGGMSLYNLAGNVGGYQLPGDNFGGWSGAGAGGVRPPF

SEQ ID NO: 1400 - protein, 323 aa, Oryza sativa
  Orthologous to G1073
CGGDGEERVVEEEGHRSTGKLAAGKWWERPDDTAMAGMDPGGGGAGAGSSRYFHHLLRPQQPSPLSPLSPTSHVKMEHSKMSPDKSPVGEGDHAGGSGSGGVGGDHQPSSSAMVPVEGGSGSAGGSGSGGPTRRPRGRPPGSKNKPKPPIIVTRDSPNALHSHVLEVAGGADVVDCVAEYARRRGRGVCVLSGGGAVVNVALRQPGASPPGSMVATLRGRFEILSLTGTVLPPPAPPGASGLTVFLSGGQGQVIGGSVVGPLVAAGPVVLMAASFANAVYERLPLEGEEEEVAAPAAGGEAQDQVAQSAGPQGSNRRRHSPPA

SEQ ID NO: 1401 - protein, 322 aa, Oryza sativa
  G3400 Orthologous to G1073
MAGMDPTGGGGGGGVAAHYLHMLRAQQHQPLSPAGDVKAERSMLSPDESPGADADLGSDHPTSSAMVAAEDSGGGSGSGGPMRRPRGRPLGSKNKPKPPIIVTRDSPNAFHSHVLEVAAGTDIVECVCEFARRRGRGVSVLSGGGAVANVALRQPGASPPGSLVATMRGQFEILSLTGTVLPPPAPPSASGLTVFLSGGQGQVVGGSVAGQLIAAGPVFLMAASFANAVYERLPLDGEDPEAEAAAATPPGDAAQPTGPPPPQQQPTASQSSEVTAGDGGGGGGLGMYLGGHVGSYQQQQQQLPGPGDNFGSWSGSIRPPPF

SEQ ID NO: 1402 - protein, 235 aa, Oryza sativa
  Orthologous to G1073
MASKEPSGDHDHEMNGTSAGGGEPKDGAVVTGRNRRPRGRPPGSKNKPKPPIFVTRDSPNALRSHVMEVAGGADVAESIAHFARRRQRGVCVLSGAGTVTDVALRQPAAPSAVVALRGRFEILSLTGTFLPGPAPPGSTGLTVYLAGGQGQVVGGSVVGTLTAAGPVMVIASTFANATYERLPLDQEEEEAAAGGMMAPPPLMAGAADPLLFGGGMHDAGLAAWHHARPPPPPPY

SEQ ID NO: 1403 - protein, 328 aa, Oryza sativa
  Orthologous to G1073
MDPVTAAAAHGGGHHHHHHFGAPPVAAFHHHPFHHGGGAHYPAAFQQFQEEQQQLVAAAAAAGGMAKQELVDESNNTINSGGSNGSGGEEQRQQSGEEQHQQGAAAPVVIRRPRGRPAGSKNKPKPPVIITRDSASALRAHVLEVASGCDLVDSVATFARRRQVGVCVLSATGAVTNVSVRQPGAGPGAVVNLTGRFDILSLSGSFLPPPAPPSATGLTVYVSGGQGQVVGGTVAGPLIAVGPVVIMAASFGNAAYERLPLEDDEPPQHMAGGGQSSPPPPPLPLPPHQQPILQDHLPHNLMNGIHLPGDAAYGWTSGGGGGGRAAPY

SEQ ID NO: 1404 - protein, 328 aa, Oryza sativa
  Orthologous to G1073
MDPVTAAAAHGGGHHHHHHFGAPPVAAFHHHPFHHGGGAHYPAAFQQFQEEQQQLVAAAAAAGGMAKQELVDESNNTINSGGSNGSGGEEQRQQSGEEQHQQGAAAPVVIRRPRGRPAGSKNKPKPPVIITRDSASALRAHVLEVASGCDLVDSVATFARRRQVGVCVLSATGAVTNVSVRQPGAGPGAVVNLTGRFDILSLSGSFLPPPAPPSATGLTVYVSGGQGQVVGGTVAGPLIAVGPVVIMAASFGNAAYERLPLEDDEPPQHMAGGGQSSPPPPPLPLPPHQQPILQDHLPHNLMNGIHLPGDAAYGWTNGGGGGGRAAPY

SEQ ID NO: 1405 - protein, 289 aa, Oryza sativa
  Orthologous to G1073
MAGLDLGTSYLHHHQSLHLRHDDGGAGSDDGGHDDLSPGSGGGGGPSSTAGGAGIGGGEVVARRPRGRPPGSKNKPKPPVIITRESANALRAHILEVAAGCDVFEALTAYARRRQRGVCVLSAAGTVANVTLRQPQSAQPGPASPAVATLHGRFEILSLAGSFLPPPAPPGATSLAAFLAGGQGQVVGGSVAGALIAAGPVVVVAASFSNVAYERLPLEDGDEVVPPAPAGSDQGGGGSGGMPPLGVDPSGGAATGGLPFFNMPFGMPPMPVDGHAGWPGAGVGRPPFS

SEQ ID NO: 1406 - protein, 305 aa, Oryza sativa
  Orthologous to G1073
MAGLDLGTAATRYVHQLHHLHPDLQLQHSYAKQHEPSDDDPNGSGGGGNSNGGPYGDHDGGSSSSGPATDGAVGGPGDVVARRPRGRPPGSKNKPKPPVIITRESANTLRAHILEVGSGCDVFECVSTYARRRQRGVCVLSGSGVVTNVTLRQPSAPAGAVVSLHGRFEILSLSGSFLPPPAPPGATSLTIFLAGGQGQVVGGNVVGALYAAGPVIVIAASFANVAYERLPLEEEEAPPPQAGLQMQQPGGGADAGGMGGAFPPDPSAAGLPFFNLPLNNMPGGGGSQLPPGADGHGWAGARPPF

SEQ ID NO: 1407 - protein, 334 aa, Oryza sativa
  Orthologous to G1073
MSFCERDMNKESMYQERDDMAGIRFATPPLPQQQQQQQLVECFSDEVDSRGSGGEMKDAVGSGSGQLVVVGGGDGASIEVAKKRRGRPPGSKNKPKPPVVITREAEPAAAMRPHVIEIPGGRDVAEALARFSSRRNLGICVLAGTGAVANVSLRHPSPGVPGSAPAAIVFHGRYEILSLSATFLPPAMSSVAPQAAVAAAGLSISLAGPHGQIVGGAVAGPLYAATTVVVVAAAFTNPTFHRLPADDDASVSVSVSLSGSGDADEHRGHQHKPEPQEPRQLRRPPPHLSAAAAVSAAQPVEPCGAPMYACHPQPQEVMWPPPARTPHPPPPPPY

SEQ ID NO: 1408 - protein, 316 aa, Oryza sativa
  Orthologous to G1073
MDPVTASIHGHHLPPPFNTRDFHHHLQQQQHQLHLKTEDDQGGGTPGVFGSRGTKRDHDDDENSGNGHGSGGDGGDLALVPPSGGGPDGAGSESATRRPRGRPAGSKNKPKPPIIITRDSANTLRTHVMEVAGGCDISESITTFARRRQRGVCVLSGAGTVTNVTLRQPASQGAVVALHGRFEILSLSGSFLPPPAPPEATGLTVYLAGGQGQVVGGSVVGALTAAGPVVIMAASFANAVYERLPLEDDELLAAQGQADSAGLLAAGQQAAQLAGGAVDPSLFQGLPPNLLGNVQLPPEAAYGWNPGAGGGRPAPF

SEQ ID NO: 1409 - protein, 258 aa, Oryza sativa
  Orthologous to G1073
MGSIDGHSLQQHQGYSHGGGAGGSNEEEEASPPPGGGSATGSAGRRPRGRPPGSKNKPKPPVVVTRESPNAMRSHVLEIASGADIVEAIAGFSRRRQRGVSVLSGSGAVTNVTLRQPAGTGAAAVALRGRFEILSMSGAFLPAPAPPGATGLAVYLAGGQGQVVGGSVMGELIASGPVMVIAATFGNATYERLPLDQEGEEGAVLSGSEGAAAQMEQQSSGGAVVPPPMYAAVQQTPPHDMFGQWGHAAVARPPPTSF

SEQ ID NO: 1410 - protein, 238 aa, Oryza sativa
  Orthologous to G1073
MASKEPSGDHDHDHELNGTSGGGGEPKDGAVVTGRNRRPRGRPPGSKNKPKPPIFVTRDSPNALRSHVMEVAGGADVAESIAHFARRRQRGVCVLSGAGTVTDVALRQPAAPSAVVALRGRFEILSLTGTFLPGPAPPGSTGLTVYLAGGQGQVVGGSVVGTLTAAGPVMVIASTFANATYERLPLDQEDQEEAAAGGMMAPPPLMAGAADPLLFSGGMHDAGLAAWHHARPPPPPPY

SEQ ID NO: 1411 - protein, 265 aa, Glycine max
  Orthologous to G1073
TRSNSNTNANTNTNTTEEEVSRDNGEDQNQNLGSHEGSEPGSSGRRPRGRPAGSKNKPKPPIVIIFLSPNALRSHVLEIASGRDVAESIAAFANRRHRGVSVLSGSGIVANVTLRQPAAPAGVITLHGRFEILSLSGAFLPSPSPSGATGLTVYLAGGQGQVVGGNVAGSLVASGPVMVIAATFANATYERLPLEDDQGEEEMQVQQQQQQQQQQQQQQQQQQSQGLGEQVSMPMYNLPPNLLHNGQNMPHDVFWGAPPRPPPSF

SEQ ID NO: 1412 - protein, 310 aa, Glycine max
  Orthologous to G1073
MDPVAAQGRPLPPPFLTRDLHLHPHHQFQPHHNHQNTEDEAGNGRGQKRDRDENAGGGGGATTPPQGGGEGKESGSGDGGGSDMGRRPRGRPAGSKNKPKPPIIITRDSANALRSHVMEIANGCDIMESITAFARRRQRGVCVLSGSGTVTNVTLRQPASPGAVVTLHGRFEILSLSGSFLPPPAPPAASGLAIYLAGGQGQVVGGSVVGPLVASGPVVIMAASFGNAAYERLPLEEEETPVPYHGTEGLGSPGIPGTQQQSQSQPQQQQQQLVGDPNSSSLFHGVPQNLLNSIQLPAEGYWGGSARPPF

SEQ ID NO: 1413 - protein, 247 aa, Glycine max
  Orthologous to G1073
MANRWWTGSVGLENSGHSMKKPDLGFSMNESTVTGNHIGEEDEDRENSDEPREGAIDVATTRRPRGRPPGSRNKPKPPIFVTRDSPNALRSHVMEIAVGADIADCVAQFARRRQRGVSILSGSGTVVNVNLRQPTAPGAVMALHGRFDILSLTGSFLPGPSPPGATGLTIYLAGGQGQIVGGEVVGPLVAAGPVLVMAATFSNATYERLPLEDDDQEQHGGGGGGGSPQEKNGGPGEASSSISVYTI

SEQ ID NO: 1414 - protein, 186 aa, Glycine max
  Orthologous to G1073
MAGIDLGSASHFVHHRLQRPDLEDDENQQDQDNTVTNVTLRQPAAAGAVVTLHGRFEILSLSGSFLPPPAPPGATSLTVFLGGGQGQVVGGNVVGPLVASGPVIVIASSFTNVAYERLPLDEEESMQMQQGQSSAGGGGSGDHGGGVSNNSFPDPSSGLPFFNLPLNMPQLPVDGWAGNSGGRQSY

SEQ ID NO: 1415 - protein, 270 aa, Glycine max
  Orthologous to G1073
MAGIDLGSASHFVHHRLERPDLEDDENQQDQDNNLNNHEGLDLVTPNSGPGDVVGRRPRGRPPGSKNKPKPPVIITRESANTLRAHILEVSSGCDVFESVATYARKRQRGICVLSGSGTVTNVTLRQPAAAGAVVTLHGRFEILSLSGSFLPPPAPPGATSLTVFLGGGQGQVVGGNVVGPLVASGPVIVIASSFTNVAYERLPLDEDESMQMQQGQSSAGDGSGDHGGGVSNNSFPDPSSGLPFFNLPLNMPQLPVDGWAGNSGGRQSY

SEQ ID NO: 1416 - protein, 295 aa, Glycine max
  Orthologous to G1073
MAGLDLGSASRFVQNLHRPDLHLQQNFQQHQDQQHQRDLEEQKTPPNHRMGAPFDDDSDDRSPGLELTSGPGDIVGRRPRGRPPGSKNKPKPPVIITRESANTLRAHILEVGSGSDVFDCVTAYARRRQRGICVLSGSGTVTNVSLRQPAAAGAVVTLHGRFEILSLSGSFLPPPAPPGATSLTIYLAGGQGQVVGGNVIGELTAAGPVIVIAASFTNVAYERLPLEEDEQQQQQQQLQIQPPATTSSQGNNNNNNPFPDPSSGLPFFNLPLNMQNVQLPVEGWAVNPASRPQPF

SEQ ID NO: 1417 - protein, 276 aa, Glycine max
  Orthologous to G1073
MAGLDLGSASRFVQNLHLPDLHLQQNYQQPRHKRDSEEQETPPNPGTALAPFDNDDDKSQGLELASGPGDIVGRRPRGRPSGSKNKPKPPVIITRESANTLRAHILEVGSGSDVFDCVTAYARRRQRGICVLSGSGTVTNVSLRQPAAAGAVVRLHGRFEILSLSGSFLPPPAPPGATSLTIYLAGGQGQVVGGNVVGELTAAGPVIVIAASFTNVAYERLPLEEDEQQHQQLQIQSPAATSSQGNNNNNPFPDPSSGLPFFNLPLNMQNVQLPPF

SEQ ID NO: 1418 - protein, 191 aa, Zea mays
  Orthologous to G1073
MGSLDGGHSLQQGRHHGYAHSQSHVGAGPDSSNNNNDEDDASPPPPSGAGGGPRRPRGRPPGSKNKPKPPVVVTRESPNAMRSHVLEIASGADIVDAIAGFSRRRQRGVSVLSGTGAVTNVTLREPAGAGGAAAVALRGRFEILSMSGAFLPAPAPPGATGLTVYLAGGQGQVVGGSVMGELIASGPVMVI

SEQ ID NO: 1419 - DNA, 939 bp, Glycine max
  Predicted polypeptide sequence is orthologous to G1075
ttcccttctaacctcccattccgttttctctgcagtactcaattgatccctttgtttttctattcgttctgagagctttgtgtgtatggccggcatagacttgggttcagcatcacattttgttcatcatcgccttcaacgccctgaccttgaagacgatgagaaccaacaagaccaagacaacaccgtgaccaacgtgacgttgagacagccagctgcggctggtgccgtcgtcacgctgcacggaaggtttgagatcctctctttgtcaggatcgttcctcccacctcccgctccaccaggtgctacaagtttgaccgtgttccttggtggaggacagggtcaagtggtgggaggaaatgttgttggtcctttggtggcttctgggcctgttattgttattgcttcatcttttactaatgtagcatatgagaggttgcccttggatgaagaggaatctatgcagatgcaacaagggcaatcatctgctggcggtggtggtagcggtgaccatggtggtggagtcagtaataactcttttccggacccgtcttctgggcttccattcttcaatttgccactaaacatgcctcagttacctgttgatggttgggctggcaactctggtggaaggcaatcttactgatccagagtctttgggggcacaaaggtgagaagttgaattgatctcatatatattggtcttctctaatctttcctctgaatattgcttgtgaagaagtactgatttttctattgaagaatcgttttgtttggctaggtttgttgtaaggacgatcagtttctaggaacaactgtaaaacgttttctcttggttgctggagttattagactagactgttgtgcattaaccttgagttgaataaatcataggctcaaatcaataacaaaaatatatattttggatttttaaaaaaa

SEQ ID NO: 1420 - DNA, 659 bp, Glycine max
  Predicted polypeptide sequence is orthologous to G1075
tcgcccacgcgtccgtacggctgcgagaagacgacagaaggggccactttatttgtctctctctttcccttccaacctcatcccattccgttttctctgcagtactcaattgatccctttgtttttctattcgttctgagagctttgtgtgtatggccggcatagacttgggttcagcatcacattttgttcatcatcgccttgaacgccctgaccttgaagacgatgagaaccaacaagaccaagacaacaaccttaacaatcacgaagggcttgacctagttacaccaaattcaggtcctggtgatgttgttggtcgcaggccaagaggaagacctccaggttcaaagaacaagccaaaaccaccagttatcatcacaagagagagtgcaaacacccttagggctcacatccttgaagttagtagtggttgtgacgtctttgaatcggtcgctacctatgcaaggaagcgacaaagagggatctgtgtccttagtgggagtggcaccgtgaccaacgtgacgttgaggcagccggccgcggctggtgccgtcgtcacgctgcacggaaggtttgagatcctctctctgtcaggatcattccttgcacccccagctgcaccaggcgctacaagtttgactgtgttccttggaggagga

SEQ ID NO: 1421 - DNA, 1596 bp, Glycine max
  Predicted polypeptide sequence is orthologous to G1075
ctgtcgcgtgggaaacaaatggctgcattgtgagttctttgtccccttcaacctcatttcaattctctctctcccccattcttacttcacccgcgccccctcccccgcccgctcccgtcccttttctttctctgcactccatctttctttccaaaacccacccttttctattcctcttcctcttcctccttttcccttctttttatttccttacactcacaacatttcccttaaaataaacataaacaaaccagcactgttcttgacccccaaaaaaaaaaaatctctactatttattaactatattaattcctccataatataatcatttgttttccttgttttctgttttctcttataatatataaccttcttttatctattttttctgttttgcaccttgtgattgtgagttatatctatttatatttatatatcattctctctcttttttttggatgtgtctatggctggtttggatttaggaagcgcctcacgctttgttcaaaaccttcacagaccagacttgcacttgcaacaaaatttccagcagcaccaggaccagcagcaccagcgtgatttggaggagcagaaaactcctccgaatcacagaatgggggcgccgttcgacgatgatagcgatgatagaagcccgggcctggagctcacttcaggtcctggcgacatcgtcggacggcgcccgcgtggcaggcctcctgggtcgaagaacaagcctaagccgcccgtcataatcacccgggagagcgccaacacgctgagggcgcacatcctcgaggtcggaagcggctccgacgtcttcgactgtgtcaccgcgtatgcccggcggcgccagcgtgggatctgcgtcctcagtggcagcggcaccgtcaccaatgtcagtctccggcagcctgcagctgccggtgccgtcgtcacgctgcacggcaggttcgagattctctccctctctggctcgttcctcccgccgccggctccgccgggagccaccagcctcacaatctacctggccggcgggcaggggcaggttgtcggaggaaacgtcatcggagaattaaccgcagcagggccagtaatcgtcatcgcagcgtcgttcaccaacgtggcttacgagaggttacccttagaagaagatgaacaacagcagcaacaacagcagcttcagattcagccacctgcaacgacgtcgtctcaaggaaacaacaacaacaataaccctttccccgacccttcttcaggacttcccttcttcaatttaccactcaatatgcagaatgttcagttaccagttgagggttgggctgtaaaccctgcttcacgtccacaacctttttgagagttcatgaagatgttgacggaggatttatatcacaaaaggctttatattattttaaggtcagcaaattaatattcatggactacaacatatatataaactatatgttttttcttcttcttcatgttattttgtttttttcttatgttgttaatggatataatatgacatgataattattatgtagtctgattttcatctccttggaattttatatacttatttcccctgttaaaaaaaaa

SEQ ID NO: 1422 - DNA, 1129 bp, Glycine max
  Predicted polypeptide sequence is orthologous to G1075
tttggatttaggaagcgcgtcacgctttgttcagaatcttcacttaccggacttgcacttgcaacaaaattaccagcaaccccggcacaagcgcgattcggaggagcaagagactcctccgaacccgggaacagcgctggcgccgttcgacaacgatgatgacaaaagccagggcttggagctggcttcaggccctggggacatcgttggacggcgcccacgcggcagaccttccgggtccaagaacaagccgaagccaccggtgataatcacccgggagagcgccaacacgctgagggcgcacattctcgaggtaggaagcggctccgacgtcttcgactgtgtcaccgcttatgcgcggcggcgccagcgcgggatctgcgtcctcagcggcagtggcaccgtcaccaatgtcagtctccggcagcctgcggctgccggagccgtcgtcaggctgcacggaaggttcgagattctctctctctccggctcgttcctcccgccgccggctccgccgggagccaccagtctcacaatctacctcgccggcgggcagggccaggtcgtcggaggaaacgtcgtgggagaattaaccgcggcagggccagtaatcgtcatcgcagcatcgttcaccaacgtggcttacgagaggctccccttagaagaagatgaacagcagcatcaacagcttcagattcagtcacccgcagcgacgtcatctcaaggaaacaacaacaataaccctttccctgacccttcttcaggacttcccttcttcaacttaccactcaatatgcagaatgttcagttaccacctttttgagggttcatgaatctgataatatgagactgatgaagatcatgttgatggaggatttatcaccaaagggtttatattattataaggtcagcaaatattcatggactagaacatatatataaactatatgttcttcttcttcttgttagtatgttttttttttcttctgttgttaatgggtatcgttatgataggacatgattattattattatgtagcgagtttcagtctgactctcatgtctttgggattttatttacttatttcccttgtccattattagaatatggaaccctgtattatttaatt

SEQ ID NO: 1423 - DNA, 657 bp, Glycine max
  Predicted polypeptide sequence is orthologous to G1075
  misc_feature (477)..(477): n is a, c, g, or t
cccggagaagacgccaaacaatcagcagaagatgggccacatcaccagggcgatgtggtggggcggcgcccgcgggggcgtccggcggggtccaagaacaagccgaagccgccggtcatcataacgcgggagagcgccaacacgctccgcgcccacatcctcgaagtcgccaacggctgcgacgtcttcgaaagcgtagccagctacgcacgccgccgccagcgcgggatctgtattctcagcggcagcggaacggttacgaatgtgagcctccggcagccggcgtcggcgggggcggtggtcacgcttcacggcaggttcgagatactgtccctgacgggatcgttccttcctccgccggcgccgccgggggcgacgagtctcagcatatacctcgccggaggacaggggcaggtggtgggtgggagttgtggtcggagagtttgatcgctgcgggaccggtgattgtgatggcgngcgtcgttcacgaacgtggcctatgaaaaggttaccgttggaggaagaagagaacaggttgagatatcttggtgttgctggtaataatagtaacccctttcctgatccttcttcgggacttcctttcttcaatttgccaatgaatgttcagttgccctgtggatgcctgggccgggaaac

SEQ ID NO: 1424 - DNA, 233 bp, Oryza sativa
  Predicted polypeptide sequence is orthologous to G1075
  misc_feature (185)..(185): n is a, c, g, or t
  misc_feature (224)..(224): n is a, c, g, or t
gccggactagatatataaaccttgtggcgatccgatcgtgttcgtccatggccgacgaggggtcgtcgcgcgccgagctgatcgaggcttcgccggcgccggcgctggaccttccgtcgccgccgcggaagccgcggggccggccgctggggtccaagaacaagcccaagccgccggtggtcgtnacgcgggagagcgaggcggcgatgcggcccgtcgtgctngagctcggc

SEQ ID NO: 1425 - DNA, 1190 bp, Oryza sativa
  Predicted polypeptide sequence is orthologous to G1075
  misc_feature (1181)..(1181): n is a, c, g, or t
tttttttttgtttttttttttgagcaaccactgccgatcttgatacgcacagtaattttacattcttcaaactctgaagaaaatggaacgataagatcacacgagtacttatgcattacatagcacattaattaacatggtaaatgattaattaacctactcaaacaactagggaaagaagtggaaggctaactagctaggtagagagacattgattaaccggtgccagtgctagaacgatgtcggcggcggccgagccaccgctgcatgcccccactgcccgaacatgtcgtgcggcggcgtctgctggacggcggcgtacatcggcgggggcacgacggcgcctccgctgctctgctgctccatctgcgcggcggcgccctccgacccggacagcacggcgccctcctcgccttcctggtccagcggcagcctctcgtacgtggcgttgccgaacgtggccgcgatcaccatgacggggcccgacgcgatcagctcccccatgacgctcccacccaccacctgcccctgcccgccggcgaggtacacggcgagccccgtggcccctggcggcgccggcgccgggaggaaggcgccagacatggacaatatctcgaacctcccccgcagcgcgacggcggcggccccagtccccgcgggctgccggagcgtgacgttggtgacggcgccgctcccgctgagcacggagacgccgcgctgcctgcggcgggagaagcccgcgatggcctcgacgatgtcggcgccgctggcgatctccagcacgtgggaacgcatcgcgttggggctctcccgcgtcaccacgacgggcggcttcggcttgttcttggagcccggcggcctccccctcggccggcggcccgccgaccccgtagccgagccaccgccgggcggcggcgacgcctcctcctcctcgttgctccctcccgcgccgccgccgtgggagtacccctgatgctgctgcagcgagtggccgtcgatgctccccatcccctcggccggatcgccggccggccaccggtttgccagccctactattttcgcggtcggaaagtcgcaccaacaatctagcttctccacgccaatcgctgaagccagcgtcgctcccgtctccaagcaaaagcaaagcaagcaagcgaacccacccacttaattagccgcanacacgtccg

SEQ ID NO: 1426 - DNA, 246 bp, Oryza sativa
  Predicted polypeptide sequence is orthologous to G1075
ttttccgcccgctctacgtctccacgggctccgccgtgtcgtcgccgcgcggggcgttggagatggcggcggcggcggcggcgatggggatggggctgtcgtcgctccgggtcgtagtggttcacgccgcgattgagctctcccgccggttcactcacctgcgggggcggcggggggggcggctcgtggcctgagccggctagcgtgccgcttgtatggctgcccagtggggccgggaacgtacac

SEQ ID NO: 1427 - DNA, 433 bp, Oryza sativa
  Predicted polypeptide sequence is orthologous to G1089
cagcctacaggaggcctacagcggcagcacccaccagggcaggcggggaggcaggcagtcgttcatccacatccaccgccgccgtctcccccgccgcttctcacccattcctctccaatccggccgcgccggcgccgcatctggtccaccaagaaccccttcaaagaatccccacaaccctctagggaaagatcgcgagaattcctctcaatcgccgcttggatggggtgcgggcagtccaagatcgaccaggaggaggcggtgtgccggtgccgggaccggaggaagctgatggccgacgccgtccaggcgcgcaacgccttcgccgccgcccactccgcctacaccgttctcctcaaaagcaccggcggcgcgctctctgacttcgcccaaggcgagacgcccgacctggtggcctctcacgcccacctcg

SEQ ID NO: 1428 - DNA, 423 bp, Zea mays
  Predicted polypeptide sequence is orthologous to G1089
  misc_feature (8)..(8): n is a, c, g, or t
agcgcctncacgatctcgacgagaggatgcccaatcgcgaaaccgccgccctattgcaatggcgcccaaggccgagaagaagcccgccgtcgagaagcctgcggaggaggagccggcggcggagaaggccacggctgggaagaagcccaaggctgagaagcggctccccgccggcaagtacgcaggcaaggagggtggctagaagaaggggaagaagaaggcaaacaagtcggtggagacgtacaagatctacatcttgcaggtgctgaatcaagtgcacccagacattggcatctcgtccaaggccatgtccatcatgaactccttcatcaacgacatcttcgagaagctggcggcggaggcggccaatctggcacggtacaacaagaagcctaccattacgtccagcgagatccagacctg

SEQ ID NO: 1429 - DNA, 975 bp, Zea mays
  Predicted polypeptide sequence is orthologous to G1089
  misc_feature (4)..(4): n is a, c, g, or t
cggncgcgtgggctcaaaattagtattttagtaatgttcttacggtgggtccctcgcgacccgccggcagacacgaagtccaacccaaatctcaatatcccaaccctccgatccccatttccatccactccgacaccaatcctccgctccgaccaccgccggagaaatggggcggcgccgccggttcgcgcagctggacgatgacgacgacgacgacgaagacgtgcccatcaatttcaagccctcgggtggcgcctcctcctcggacgccaaacccaggaagccccagccgccgccgcagcagcgccgcggagtctccgatgacgacgacgaggacgtggaggaagtggaacttgaggaggaggaggacgacgagaaggatctcgaggcaatgcgacgggccgaggaggaggagcgccgcgagcaggaggccgagacgaagactcgccgccgccggggacggcccaagcgccgccgcgacccggggagcgaggatgaggagcccgaggagctagagctgcaaacggaggatccccgtgaggaggagatcacggaggcggtgcccgtagctgtaggggacccggtcaagatcactggcaaggggaagaagcagaagaagcactatgcttccttcgagtacgagggcaacagcttcgagctggaggaccccgtgcttctcacgcctgaggacagcaatcagaagccctatgtcgccatcctcaaggatataacagaaactgatgggagcctatatgtaactggccaatggttttatagaccagaagaggctgacaaaaaggagggtggattctgggtagcacgagatacacgagagctattttacagttttcatactgatgatgtgcctgcagaatcagtatgcacaaatgtgtgggtcatttcattcctcagcaaaacagattccagtcgaagcagcatccggggattattgtcagaaggtctatgatgcagttg

SEQ ID NO: 1430 - DNA, 1733 bp, Zea mays
  Predicted polypeptide sequence is orthologous to G1089
  misc_feature (1659)..(1659): n is a, c, g, or t
accggccagtgataccgcactcctccccttaaagccctagccatggggtcctccaggccgggcggggatctggctgcctcggtcgatttctaattctcctcgcgagcccaaaccctaaacctaaacctttcacccgccgccgccgccaccaccagcactgccactccgccaccaccgtcccgaagccccctcccagcgccatcgacttcatctcggattgaagcaatgtcgtcggacgatgaggtcagggaggagaaggagctcgacctctcctccaacgacgttgtcaccaagtacaaggctgccgccgaaatcctcaacaacgctctgaagattgttgtgtctcagtgcaagccaaaagtcaagattgttgacctttgcgagaagggcgactctttcataagagagcaaactgggaatgtttacaagaacgcaaagaggaagattgaaaggggtattgctttcccaacctgtgtatccgtcaatgacacagtttgccacttctcaccgcttgcaaccgatgatgccgttctggaagaaaatgacatggttaaaattgatatgggctgtcatattgatggctttattgctgtggtggcacatacacatgtaattacaaatgggcctgtcacaggaagggctggtgatgtgcttgctgctgccaacacagcagcagaagtcgcaatgcggcttgtgagacctgggaagaaaaataaggatgttactgaagcaattcagaaagttgctgctgcttatgattgcaaaattgtggaaggtgttcttagccatcaactgaaacaatttgtgattgatggtaacaaagttgtgctcagtgtctccaatgctgatacaaaggttgatgatgctgaatttgaagaaaatgaagtatatgcaatcgatattgtcaccagcactggggaggggaagcccaagttattggatgagaaacagaccaccatctacaaaagggccgtagacaagaattatcacttgaagatgaaagcgtcaaggtttattttcagtgagatcagccagaagttcccaatcatgccttttactgctagggcattagaagagaagcgtgcgcgtttaggcttggtggaatgcatgaaccatgaactattgcagccgtaccctgtacttcatgagaagccaggcgatcttgttgcacacataaagttcactgtgctgctgatgcccaatggatcagataagataacatcacatcctctacaggagttaaagcccaccaaatccattgaagacaatgcagagataaaggcatggcttgctttggggacgaaatcaaagaagaagggtggtgggaagaagaagaaaggcaagaaaggagatgcagcagaagcagatcccatggaggaggcgacaaacggtgctacaagccaagaataattctgatttttggaattactgccaccagcttttttcttgtttcttcgctgcatctgatggtgttatattacattcagttgtggaaaaattgagtactatttctagcttctaagaaatgaagcatcctattatcgcatcaaaaagaaaaaaaataatcgacaaggcatgcccagtgttcgttctctgcgccccgtgacgacgctcgtcacttggatttttcggagttcctcccagcccggaaatttcttncctggacattgccaactgctgagatgtagcatccggatacaaatgttcgaattacgtatacaatgttactgtgt

SEQ ID NO: 1431 - DNA, 2773 bp, Zea mays
  Predicted polypeptide sequence is orthologous to G1089
agacgccgcccctccgaacagctgaaggcctgaagcaccctcactttccccactccggagctgcacgggcacgcacgcagtttatccaacgccactgggcctcaacaacaacaatctcccaacgccgccgcttccgccgcatcaagcgctagaactaggaacccctcccaaaggatctcaagaagacaaggacaccgtcgagtcgccgccagtcgctcgatggggtgcgggcagtcaaagatcgatcaagaggaggcggtgtttcgatgccgggagcggaagcggctgatggctgacgccgtggcctcgcggaacggttttgccgccgcccacactggctacactgtccgcctgaagagcaccggcggcgcgctatccgatttcgcccaaggcgaggcgccggaccctagcctggtgtcctcccatacccaccacgctccggctgtggcgacgtcatctgtctcgactccgccaggcccctccgcagcttccgtcaacagcccctccccgccgccgccgccattcgccgacttctctcattctagcctccaaagatcctcatccacccccaacattcctatgccggagccgagggccgcagccaaaaaccgccctcctgccgatgcttctatccgagaggaggatgaggatgaggatgaggaggaacaggatggacatatcaagatcgatagcgatgacgacagtgacgacgacagtgacgaagacgacgatcaccatgagcatgacgatgttagtgggggtgacatggggcatggaccacaatcaagccggattttgatgagtagtgtgggatcttctccagtaacaccacctccgcctccaaggttgaaccacaccccaccaacgcttgccacagcaacgccaccgcccccggtgctggagtcacagatggctacctgggactacatctttggcccaactcccaccccaccacccaccctagagcagcctgctgctgatactttgtggatggaaaggcgtgataaggagccagtggctgaggtgaaggcacctgtggcaaaaacagttgttagtaagccagctgctactgaggaaaggccaccagagacggccgtagagaaggataaagcaattgaggagatgatggctaatctaccgccatcaaaacctattgtgaggaagccacccaaagcacctggcccatcacaagaagcagcacactaccagcatgcctcttcgatgggtgcagttgaaattcggaaggggaaggtaatggtggcatcaggaactgccagcttgctacagattgttacacggcttgatgataactttcttagagcttcagagagtgcgcatgatgtgtcaaaaaaactggaggccacccggatgcattatcactccaaccatgctgacagccgaggacatatcgaccactctacaaaaattatgcacgttatcacatggaaccgctccttcaagaacttacctgaccatgaggacctgaacgataattttgagattgatgatagatttgaaactcatgctgcagttctagatagaatgcttgcttgggagaaaaaactgtatgacgaagtgaaggctggggagcttatgaaaaccgattatcagaagaaggtgtctctattgcagaagcaaaagaaacggggtgttaaacttgaaaccttggagaagacaaaagctgctgttagccaattgcacacaaggtacattgtagacatgcaatccatggattcaacagtttcagaaataaatcggcttcgggatagacagttattcccaaagttaatggaccttgttgatggaatggccaagatgtggagttctatgtaccgccatcatagaagtcagttcctgatcatttctggaataagaggtttcgagattcctcctattccaagggagacaactgattctcattacatccagacttgtgagctacgtgacattgttagggagtggcatacgcagtttgagaaattgatggacaatcagaaagcatacatcagagcactcaatgcatggctgaagctcaatctcatcccaattgagagcaacataaaggagaaggtctcctcccctccaaggctggtggatccacccatcaagcacctgctgcatgcctggcatgacgagctcgaaaggcttccgattgagcttgcaaaaactgccatcaaaacctttgctgaagtcataagcactatcgtgcatcttcaggaagaggaagtaaacctaaggaggcggtgtgatgaaactcgtagggatctgaaccgaaagaaggcacagtttgaggactggcatcaaaagtacttggagagacagacagcagaaactcaaaacatagatcctgtcgaggataggaaacgcaccatcgaggaactagagattcggctgagagaggaggaggggcaccatcttaggcatgccaggcaggtgcgggagaaatcacttgcaaacctccggacacacctgccagaacttttcaggaacatgtccgattttgcttacttttgcaaagacatgtacaacaatcttagaaaaactgctgcgctgtccaaagatgaagtctaaggctgatgatatttgtgcgtgtgtatgtatactcgacaagcagtagaatgtttgctggtaacttgtcctgatgccgtctagaatacataatagtcggcattaattatgtttgtaaattggaatggacattccggactccccattgtttatttccatgctatgtactgcattggtgcgtggataaaaatctttgaattgctct

SEQ ID NO: 1432 - DNA, 452 bp, Zea mays
  Predicted polypeptide sequence is orthologous to G1089
tttgtcgccgcttccgccgcatcaagcgctagaactaggaacccctcccaaaggatctcaagaagacaaggacaccgtcgagtcgccgtcagtcgctcgatggggtgcgggcagtcaaagatcgatcaagaggaggcggtgtttcgatgccgggagcggaagcggctgatggctgacgccgtggcctcgcggaacgggtttgccgccgcccacactggctacactgtccgcctgaagagcaccggcggcgcgctatccgattttgtccaaggcgaggcgccggaccctagcctggtgttcttccatacccaccacggttcggatgtggcgaactaatttgttttgaattcccccgggcccttccaagctttcgtttacaagccctttctcgcggccggtgtcatttggcggactttttttattttatgcctccaaagattctctattccccc

SEQ ID NO: 1433 - protein, 2623 aa, Oryza sativa
  Orthologous to G1089
MSNEKVPSNAPIAPQEGNAPQNSGSNKHPGASSEETWRTPSDPFPMEITQVAPRDDDPDYIPIEQAMVVRRRSKRKAGRNRTEQEVEMDTATSAPERTETSTSAGGSGKKRRGERSKNKLPKETYNVIALDQDGKPIEPPIVRSKFSNACGTLVRTRCPINVKLWETVDDNIKTLLWNELQKYFVFPPGSEVRGRDYALKKMGDRWRQWKSDLNRDYVQKNLPPFTDYGHISQADWDTFVADRTTAEALALRKKMSELAKKNKYPHRLGSSGYAGHVDQWREIEQRFAAAGKPLLVDPMVERSKNWVWARSTGQVSDEGDILFETPDIEEVTTNLQQIVEKERSGQFVPRRERDQLTAALGTAEHSGRVRGLSSKTSWKVGFPQDAPSYKKRDKYKEQLSDKIYAQVKEHFYSLAAENPTAFPRLFPDSQQPTQSAQQTTNVPSSVGSVQTSTFPVDSITGPTPCSLVVPIGRAGKTKEVATGLAIPGRQFHNTAIPEDYARVQVAKVHSDHVSLELDIPAPEGIELLGDAVNQFILWHRRDIILSAAVLAAGSSTPSSSQAMTAAAPAPPSPPEPPSPRHPPSPPPLRSPARQPTPPPSPSQQPPLPTPQPVQASPTSPTKQHAPPAPPSVQTSPPTPQSALVEEVHIPDGTTSEPKSNTLEPRRIIPKLISTYDPKEIDKDKEKFMFSAFRNSEKRKELAHVLSDSQKSVLAAQDEVQSWLSADVPETYEYGKPFLPTYLMNKLPWEMRVMHEWYMKASRKGLGFISVAVPEGAFMSGPNGIFFISFQDLYALYKLDKMDVNLVAAFCLMQFHEADRTGAKVGYVDPTRICKTQHTIELRQDCEQLVGKTPEEKEEYVKTLHKRKKLEVATYLAIAMLAHADKDVLMVPYQFTDHYILFLVYPKDQLIISLDPAHYDKETFMEFLTILNLAHKYYRKRGGPVHIPSQKKLSVRTGWPCYKQPPGTNLCGYYVCEMLRVNGRYKTTSNRIPEIPYIAQRFNHTTILNVAADLCRFIRRDVCNARGVTPESASFADTGYDPPPKKWKGICQVGPSFEAISCNRKFIGARWYIDDEILSSISDNEVLSPRDVEGHGTHTASTAGGNIIHNVSFLGLAAGTVRGGAPRARLAIYKACWSGYGCSGATVLKAMDDAVYDGVDVLSLSIGGTKEDVGTLHVVANGISVVYAGGNDGPIAQTVENQSPWLVTVAATTIDRSLPVVITLGNGEKLVAQSFVLLETASQFSEIQKYTDEECNANNIMNSTVKGKIAFCFMGEMLNNKQQTSYPDVTTAVAAKGGRAPDIAAPGVSILAAAQIPYYKGVSYHFDSGTSMACPHVAGIIAVLKSIHPKWSPAALKSAIMTTDYSIPLAGVHQRSGEQVSGTSAFDVLHREKAAIRHCDFTMADFADALRPDKFTGVHFKRWQIRVTLWLTAMKCFWVSTGKPEGVLTAEQQKQFEEATTLFVGCILSVLGDRLVEVYMHMTDAKELWDALNTKFGATDASNDLYIMEQFHDYKMADNRSVVEQAHEIQTMAKSFGTALKHKRQEYSVEGLIASLDVEEKAREKDAASKGDGGQSSANVVHKAQNKSKGKYKAQQTTNFKKQKKNNNNPNQDERTCFVCGQVGHLARKCPQRKGMKAPAGQTSKSANVTIGNTGDGSGYGNLPTVFSVNQSTNWWVDTGANVARGSTVLMGNGSHASVHGVGTVDLKFTSGKIVQLKNVQHVPSIDRNLVSGSRLTRDGFKLVFESNKVVVSKHGYFIGKGYECGGLFRFSLSDFCNKSVNHICGSVDDEANVWHSRLCHINFGLMSRLSSMCLIPKFSIVKGSKCHSCVQSKQPRKPHKAAEERNLAPLELLHSDLCEMNGVLTKGGKRYFMTFIDDATRFCYVYLLKKKDEALDYFKIYKAEVENQLDRKIKRLRSDRGGEFFSNEFDLFCEEHGIIHERTPPYSPESNGIAERKNCTLTDLVNAMLDTAGLPKAWWGEVLLTSNHVLNRVPNRNKDKTPYEIWIGRKPSLSYLRTWGCLAKVNVPITKKRKLGPKTVDCVFLGYAHHSIAYRFLIVKSEVLDMHVGIIMESRDATFFESFFPMKDTHSGSNQPSEIIPSSIIPPEQTEHTHELVSEEDVSEAPRRSKRQRTAKSFGDDFTVYLVDDTPKSISEAYASPDADYWKEAVRSEMDSIIANGTWEVTEQPYGCKPVGCKWVFKKKLRPDGTIEKYKARLVAKGYTQKEGEDFFDTYSPVARLTTIRVLLSLAASHGLLVHQMDVKTAFLNGELDEEIYMDQPDGFVVEGFGVNYAYPCVYYRHGGGQGVILCLYVDDILIFGTNLEVINEVKSFLSQNFDMKDLGVADVILNIKLIRGENGITLLQSHYVEKILNRFGYIDSKPFPTPYDPSLLLRKNKRIARNQLEYSQIIGSLMYLASATRPDISFAVSKLSRFTSNPGDDHWRALERVMRYLKGTVELGLHYTGYPAVLEGYSDSNWISDVDEIKATSGYVFTLGGGAVSWRSCKQTILTRSTMEAELTALDTATVEAEWLRDLLMDLPVVEKPVPAILMNCDNQTTCEKTIEVCQEIKKLRSYNVGLHPNSEKPGRSLHEGTITKCDRQCIEGDGFETHVSYTMVVTQSM

SEQ ID NO: 1434 - DNA, 990 bp, Glycine max
  Predicted polypeptide sequence is orthologous to G1134, G2555
atcaattaaaaaggctcgagacagaggagaggagaggagaaggcgatgcaacccacatccggcggcggcgggctggcaaggttccgttcagctccggcgagctggttagaatcagttctgttgaaggaagaggaagaagaagaagaccccttaagcttcactcaactgctttccactatcgatgatgctccctctcattctcaacaccaactctatggtgccgctctctcaaacaaggataaaacacctgaaatcttcatgttagaagattccgttccttgcagagtgagggctaagcgtggctgtgctactcatcccaggagtattgctgaaagggtaactcactcactcttttctctctacttaactaactcctttactttctgttatcttttctcttttcgccttaggttcgcaggactcgtatcagtgaccgcatcagaaagctgcaagaacttgtgccaaacatggataagcaaacaaatactgcagatatgttagatgaggctgtagcgtatgtcaagtttctacaaaagcaaattgaggaactgtcagagcaccaacggaggtgtaaatgcgtggttcaagagtaaattgctgattgttccatgcagtgcttggctttttacgatttacttatgaattattatcagaatttttttatgttctgatgaagatcaaccataccacactctggatgctaattaaatttaatatctcctgataacttaaaagatgcatatattatacatgttaggggtgacattgccaagttcgagacgaataaattacaaatagaattttaccctagagtgttataattgtgttgtagtgttgtacaactcttaagatacacaaatctgccaagttaatagctacttggacttaagatatatacataaccatatgtgttattttattaaaaaaaaaaaaaaaaaaaaaaaaaaaaaaaaaaaaaaaaaaaaaaaaaaaaaaaaaaaaaaaaaaaaa

SEQ ID NO: 1435 - DNA, 745 bp, Glycine max
  Predicted polypeptide sequence is orthologous to G1134, G2555
atcaattaaaaaagataaacagaggagaggagaggagaaggcgatgcaacccacatccggcggcggcgggctggcaaggttccgttcagctccggcgagctggttagaatcagttctgttgaaggaagaggaagaagaagaagaccccttaagcttcactcaactgctttccactatcgatgatgctccctctcattctcaacaccaactctatggtgccgctctctcaaacaaggataaaacacctgaaatcttcatgttagaagattccgttccttgcagagtgagggctaagcgtggctgtgctactcatcccaggagtattgctgaaagggttcgcaggactcgtatcagtgaccgcatcagaaagctgcaagaacttgtgccaaacatggataagcaaacaaatactgcagatatgttagatgaggctgtagcgtatgtcaagtttctacaaaagcaaattgaggaactgtcagagcaccaacggaggtgtaaatgcgtggttcaagagtaaattgctgattgttccatgcagtgcttggctttttacgatttacttatgaattattatcagaatttttttatgttctgatgaagatcaaccataccacactctggatgctaattaaatttaatatctcctgataacttaaaagatgcatatattatacatgtaaaaaaaattaaaaaaataaataaaaaaaaaaaaaaaaaaaaaaaaaaaaaaaacccaaataaaaaa

SEQ ID NO: 1436 - DNA, 706 bp, Oryza sativa
  Predicted polypeptide sequence is orthologous to G1134, G2555
  misc_feature (28)..(28): n is a, c, g, or t
  misc_feature (30)..(30): n is a, c, g, or t
  misc_feature (92)..(93): n is a, c, g, or t
  misc_feature (132)..(132): n is a, c, g, or t
  misc_feature (186)..(186): n is a, c, g, or t
  misc_feature (206)..(206): n is a, c, g, or t
tctgaacctcccggtgcagccgccggcnantgagctcgtcgggcttgctgcggtacagatcggcgccgagcacgctgctcgccgagttctgnnacgacttcctctccgggtacccgatgagctccgggtggnaggagtcgtcgctcatgtcggacacgaacatctccggcgtgaagcgcagcgcgnactcgtcggagccgtcccanaacggcggcggcggcggcggcctggcgcaccagtggatcccccggccgaggacactcgtcggagatggcggccatcgagaagttcctccagttccaggacgcggtgccctgcaagatccgcgccaagcgcggctgcgccacgcacccgcgcagcatcgccgagcgggtgaggaggacaaggatcagcgagcgaatcaggaagctgcaagaactcgtgccaaacatggacaaggtactgatgagtactacacctctctctctctctctctctctctctctcttccccaataggcaatagaacagtgtttggttagcaaatagtagcagtagtagcagcaaatctgcaaatgtgcagtacaaggaccactccaaaattaacctgtccgaaacctgaaacgtatccgttttcctgcagcaaaccaacactgctgacatgctggatttggctgttgactacatcaaggatcttcagaagcaggtcaagggattaaacgacagcc

SEQ ID NO: 1437 - DNA, 548 bp, Glycine max
  Predicted polypeptide sequence is orthologous to G1140
ggttccaatcaagtaatcgagatagtgctccaactagctaataaagtgaaatatatcaacaaattaaaatcgaaccccaccaatccaaagctatcatacccttgcatgttcacgagcttccttttgattggtttgtgcagctgctaattattaaaatgacgagaacgaggataaagataaagaaaatcgacaacataacggcgaggcaggtaacattttctaagaggaggcgagggctattcaagaaagctgaagagctttctgtgctatgcgatgctgaggttggtctcattgttttctcatctaccgggaagctctttgattatagcagctccagtatgaatgacatagttacaaagtacagtacgcattcccatggcatcaacaaattggataagccatcactagaactgcagctagaagctagcaatagcgccaaattgagtaaggaaattgcagatagaacccaagaattaagttggttgaaaggcgacgatcttcaaggactaggtctaaatgagttgcagcaactggagaaaacacttgaa

SEQ ID NO: 1438 - DNA, 1208 bp, Glycine max
  Predicted polypeptide sequence is orthologous to G1140
ttggtcgtttttttttttttttttttttttccgaaggaaaactaaaatcattttcctcacaaatatggagataatatcatacctaaaccatatccattaagaaggttctactaattaacaaacacgaattactagaaaataaatattcagttggggcaatcgtagaatgtcattgttctaaacttagagatgacccaccatatatatacgtgaaccattttatccttggtgattcactcttccttttcacactaactaaaacgcagtatcatggtcccctcattgctcagaaactctgtactttgagccagcaggaaaagatagccccaacgtgagggaggtgtcaaaggaccggccttgttcatgctcgtgtctctggaccgaacatatttcattcctcggttttatcctctgcttcatcagcctgttatcttccatgaggtttgtttcccttttgcttaagaatatcgatctctcttgtaaaattttcaaccttcgctttataaactcggttcaaggatgagtccagtcgttcttctaatttctgaagctcccttagggccaatccttgcagttcttctccattcagttgtctcatttcacgaatcctgtctccaaattccttgtttaaatcagcataattacatctaagctgctccgtaggacatgattggtctaatttttcaaggttcagctctgaccataaaatatgcctttcaattaccttctgcatacttgaactagcatagtcgaagagcttgccaccaggtgaaaagactatgagtgctatctcagaatcacagagaagagagagctcgcgtgccttcttgaaaagaccactcttcctctttgagaatgtcacctgcctcgcagttacgttgtcgatcttcttgatcggtatcttccttctcaccattttcttgttaagatggaagcgcagaagaatccttgattggcggtcgagaatgcagcagaagcaaccctagctagctagccaggtagatcatgggtgatcgataaagaagaaattaagaagcgtaattaagtacaaacctaaccccccagtccttgactccaaagaaagaatggtgaggggaagacatgaatatgccacatttatctttctcccactcccattcccaatcttaatctccccttctgtcgtttctcgcagccgtactcgagccgattcggctcgagctcgagcc

SEQ ID NO: 1439 - DNA, 1015 bp, Glycine max
  Predicted polypeptide sequence is orthologous to G1140
  misc_feature (16)..(18): n is a, c, g, or t
tgcaacaatgatgcannnctagtgcaaatcatgacttcctaaatgtcaatggtgttcaattgggttatcatgtacataattaactcttaaacctataaatgatacaaagcaatcagtctaaacatatgcttttgaaataatatcatagctaaaccatatccattacggtcccactaataacaaacatgaattactagaatctattatacttgaacatacgtgaaccattttatccttggtgattcactcttccttttcagttttcacactaattaaaacgcagcatcatggtcccctcattgctcagaaactctactttgagccagcaggaaaaggtagccccaacgtgagggaggtgtcaaagagctggccttgttcatgctcatgtctctggaccgaacatatttcattcctcggtaattttatcatctgttttatcagcatgttatcttccatgagtttttttcccttttccttaagaataccgatctcttttataaaattttcaaccttcgctttataaacacggttcaaggatgagtcaagtcgttcttctaatttctgaagttcccttagggtcaatccttgcagttcttctccattcagttgtctcatttcacgagtcctgtctgcaaattccttgttcaaatcagcataattacatctcacctgctccgtaggacacgactggtctaatttttcaaggttaagctctgaccgtaaaatatgcctttcaattaccttctgcatacttgaactaccatagtcgaagagcttgccaccaggtgaaaagactatgagtgctatctcagcatcacagagaagagagagctcacgtgccttcttgaaaagaccactcttcctctttgagaatgtcacctgcctcgcagttacgtcgtcgatcttcttgatcggtatcttccttctcaccattttcttgttacgatggaaggcagaagattccttggcgatcgagaatgcagaagcgaaagcaacccccagtcctttgattcca

SEQ ID NO: 1440 - DNA, 1021 bp, Glycine max
  Predicted polypeptide sequence is orthologous to G1140
ccacgcgtccgcggacgcgtgggcccaggcattggtgggttcttaccctttattattattattattggagatgactagaaagaggatacagatcaagaaaatcgacaacatcagttccaggcaagtgactttctccaagagaaggaaagggcttttcaagaaggctcaggaattgtcaaccctttgtgatgcagacatagctctcattgttttttctgcaactagcaagctctttgagtatgccagttcaagtatgcatcaagtaattgaaaggcgcgatagccattcagcaatgaatagactggatcgcccctcaattgagctgcagattgagaatgactccaatgaaatcctgcgcaagaaagtagaagataagaaccgtgagctgaggcagatgaatggggaagatctgcaaggattgacattacaagaactgcataaactagaggaacaccttaaaagaggtttgatcaatgtttcaaaagtaaaggatgaaaaacttatgcaagagatcagcacgcttaagagaaagggagtggaactaatggaggaaaaccaaagactgaaacaggtggtaccgagccttatccatgtacataggcaatcatcggaatccattcttagcaattcatctaaccttcctgaagatggtggtagcgacacatctctcaagttggggttaccttaagtattcaacaaaatgtagattattagaagtgaccgggttcgcttcctttatatatgttttaagtgtttcactcaaaaccagttgagtccagtgatgtttgctgtttaaaaacaactcctgcaaagtaagtaaatcctagggatgaggttctgcaggcagaattgcatgtacttgaattcgtattctattttcttttcgtagattgattcataggaagtgttatatatgcccgagttaatggtcaatgctttggccgtttcttactttctatactttgtcatcataaaaaaattattcttacctaaaaaaaaaaaaaaaaaaaggctaaaaaag

SEQ ID NO: 1441 - DNA, 905 bp, Glycine max
  Predicted polypeptide sequence is orthologous to G1140
acgaagctcggaattcggctcgagctaactggcaactaattaacgtgtttgggactcgcgagttgtgcattcctaacacccatttcaggaagcccaagcattgggagatgactagaaagaggatacagatcaagaaaatcgacaacatcagttcgaggcaagtgactttctccaagagaaggaaagggcttttcaagaaggctcaggagttgtcaaccctttgtgatgcagacatagctctcatagtcttttctgcaactagcaagctctttgagtatgccagttcaagcatgcatcaagtaattgaaaggcacgatcgctattcagcaatccatagattggatcgcccctctattgagctgcagattgagagtgactccaacaacattctgcgcaagaaagtagaagataagactcgtgaactgaggcagatgaatggggaagatctgcaaggattgacattacaagaactgcagaaactagaggaacatcttaaaagaagtttgaccaatgtttcaaaagtaaaggatgcaaaatttatgcaagagatcagctcctttaagagaaagggagtggaactaatggaggaaaaccaaagactgaaacaggtgccgagccttatccatgcacatagctataggcaatcatcggaatccattcttagcaattcatctaaccttcctgaagatggtggtagcaacacatctctcaagttggggttaccttaaataatgaacacaatgtagattatttagaagtgatcggtttcgcttcctttatatgtcagtcaaaaccaattgaatatcctgtgttgtttgctgtttaaaaacaactcgtgtaaagtaagtaaatccaaaggatgaggtcctgcatgtagaattgtgcttgaaaaaaaaaaaaaaagg

SEQ ID NO: 1442 - DNA, 1237 bp, Glycine max
  Predicted polypeptide sequence is orthologous to G1140
  misc_feature (47)..(47): n is a, c, g, or t
aaatatatcataatcttgtgatttttgcctgggttaattttatcgcnccacacacttttctcatcagccggagtatggtagccccaatttgagcgaagtatctgagctttcatagtcttgggggggtcccagtggaattgcaaaccgtacggtgacagactccgaagactgacccttcatccataacaaagttctcagattcggcaccacccatgcctttggccattaattatccccgccacgtgacgtttgagtcgctcgttctcttccatcaatagcatcccctttctttggagatcagcgatctcactcataatcttctctcccttcttttctattacacggcccaatccagtttcaagtgacctctccaattgttgcaattcttctatgtttaagccttgaagatcctctcctctcagctgccttagttgatggctcttttcggccacttccttgctcaatctggagcagttgctgttttcaactagctgcaactcgagagatggttgttccatccttgctaggttctttgagtgcaaatgatgcctttcaagtatttccttcatgcttgagcttgagtactcaaagagcttcccagtggaagagaagattatgagggcaacatcagcatcacacataaccgaaagctcctcagctttcttgaagagccctctgcgacgcttggagaacgtgacctgcctcgccgtggcgttgtcgatcttcttaatctgaatcttctccctcaccatgtaccttaacctaaaaaaagcaaagaaattaaggctgagccgttgactacttatagaaaagcaaaagcaaagggtggtggtgtttttcttttgtttagtgtgagggacatgtgatgcatgtatagagcagaaaaatttaatatgcaggtgtttatctaaatttagcttttgtgaaatcaaagctttgttcggagatcctgcgatcagggtaaattttctttctttttttagtgattgttgttagtggtgttagttaggggaagacttggagttggagttggagttggtgttagtgtgtggtgggatgttgttgaaagagagagctgagtaaggatgtacttgttgatttttactttccttattgggggaaggcgttgatattaggaatgttggtttttggttcggtttggtttgccatgtttagatgatttcagctttgggttgaaagccaccaatgaaggaaagagagagaggatgagcgccaa

SEQ ID NO: 1443 - DNA, 1307 bp, Oryza sativa
  Predicted polypeptide sequence is orthologous to G1140
cgcggtggcggcgtctaaactagtggatccccggcctgcgggtccccgggctgcagggcctcgcctcgcctcacctcacctcaccctccgcctcgtctccttcccccctttcctcaacccacgcacgccctctctcccatcccagccgtagccgcgccgtgacttgtctcgatcggcggcgaggaggagggcttccgttccctggccggtaggggaggatcaggcgggggggcggcggggagggggaggagatcggtctcggtcgatccgcgcgcggcggcgatggcgcgggagaggcgggagataaagaggatagagagcgcggcggcgcggcaggtcaccttctccaagcgccggcgcggcctgttcaagaaggccgaggagctctccgtgctctgcgacgccgacgtcgcgctcatcgtcttctcctccacggggaagctatcccacttcgcaagctccagtatgaatgaaatcatcgacaagtacaacacacattctaataatctggggaaagcagaacagccttcgctcgacttgaatttagaacatagcaagtatgcacatttgaatgagcaacttgcggaagctagtctccggcttagacaaatgagaggtgaggagcttgagggattgagcattgatgaactccagcagctagagaagaacctggaagctggtctgcacagggtgatgctgacaaaggatcaacaatttatggagcagatcagtgaactccagcggaagagttcacagctggcagaggagaacatgcaactcagaaaccaggtatcccagatatcaccagctgagaagcaagttgttgatactgaaaattttgttaccgaaggacagtcctctgaatctgtgatgactgcattgcattctggaagttcacagtcgcaggataatgatgatggctcggatgtatccctgaaattagggctgccttgtggtgcatggaagtaactgaaaggaaaaaaaaagcatccttgcagatctggttggagtcgttgcggcatccaggggagaaacgcttgtgttattcccaaacccagactgcaataatataatcttgcgttggaagcgagatcagttaacctgatttatcatccttgtggctgcatgatgcgatgttccgcttgtactgttcgctaggatcttgactaaactttgagatctatgtgccgtttaattatcccatcgctattggcactccttatgcgatacatcatatatgcactttgttgctatcttaattatgatgcgtcttttgcagcgttctaaaaaaaaaaaaaaaaaaaaaa

SEQ ID NO: 1444 - DNA, 481 bp, Zea mays
  Predicted polypeptide sequence is orthologous to G1140
ccggtccgaaattaccggggccacccacgcgtccggagtctgcgtcgtccacggagatcagggatcggcggcggggtatggcgagggagcgacgggagataaagaggatagagagcgcggcggcgcggcaggtcacgttctccaagcgccgccgcggcctcttcaagaaggctgaggagctctccgtgctgtgcgatgccgacgtcgcgctcatcgtcttctcctccacgggaaagctctcccagttcgccagctccagtatgaatgagatcattgacaagtacagcacacattctaaaaacctggggaaagcagaacagccttcacttgacttgaacttagaacatagcaaatatgcaaatttgaatgagcaacttgtggaagcaagccttcgactcaggcagatgagaggtgaagaacttgagggattgagtgttgaagaactccagcaattggggaagaatctggaatctggtctgca

SEQ ID NO: 1445 - DNA, 756 bp, Zea mays
  Predicted polypeptide sequence is orthologous to G1140
aattcggcacgagggatccactggccgccggttttctccagctggagagccattcgtgggcgtaggacgagagagaggatcggcggcggcggcgtgtgggagatggcgcgcgagaggcgggagatacggcggatagagagcgcggcggcgcggcaggtgaccttctccaagcgccggcgcgggctgttcaagaaggcggaggagctcgccgtgctgtgcgacgccgacgtcgcgctcgtcgtgttctccgccaccggcaggctctcgcagttcgcgagctccagtgtgaatgacatcgttgacaagtacagtacacattctaagaatctggggaaatcacatcagcagccttctattgatttgaatgtagagcagagcaaatacagcggcttgaacgagcaacttgctgaagaaactaatggacttagacagatgagaggtgaagaccttgagggattgagtgtagaggaattgcaccgaatggaaaggaaacttgaagcaggactgcatagagtgattagtacaaaggaccagctattcatgcaacaaatcggcgaattactgcaaaagggcacacagctagaagatgagaacagggcgtctaaaagaacaaaaaatatcctcactgaagacgggcagtcgtctgaatctgtaatgactgcattgcattcaggaagctcgctcgactgtgatgatggttccgatatttcctttgaagttgtcgttgccttgaaaggaagaccatcgcatcgcatg

SEQ ID NO: 1446 - DNA, 1186 bp, Zea mays
  Predicted polypeptide sequence is orthologous to G1140
ccttttttttttttttttttttttttggtagcatcatgtgtctatattatgctcttcctctttttttgataacaactaagtgcatatatataatacaccaacaatatagcgccagcaacgaaacaatacagatttttagaacgaagataacgcagcgcatacactattatatatacaaatttcgcgttagccactttgaagtacagacatgcacaaggatagcacatctggttaaaccaatataatgccgcgaatgggactatcccagtctttatcttcttagaagcactgatgtcagccccactcatgcagataacatgcgatgcgatggtccttcctttcaaggcaacgacaacttcaaggatatatctgaaccatcatcacagtcgagcgagcttcctgaatgcaatgcagtcattacagattcagacgactgcccgtcttcagtaaggatattttctgcagcagcagcaaccaccattgtgccagccgttagcacctgaggcatttgttcttttagacgcctgttctcatcttctagctgtgtgcccttttgcagtaattcgccgatttgttgcatgaatagctggtcctttgtactaatcactctatgcagtcctgcttcaagtttcctttccattcggtgcaattcctctacactcaatccctcaaggtcttcacctctcatctgtctaagtccattagtttcttcagcaagttgctcgttcaagccgctgtatttgctctgctctacattcaaatcaatagaaggctgctgatgtgatttccccagattcttagaatgtgtactgtacttgtcaacgatgtcattcacactggagctcgcgaactgcgagagcctgccggtggcggagaacacgacgagcgcgacgtcggcgtcgcacagcacggcgagctcctccgccttcttgaacagcccgcgccggcgcttggagaaggtcacctgccgcgccgccgcgctctctatccgccgtatctcccgcctctcgcgcgccatctcccacacgccgccgccgccgcgtactgctccgatcctctctctctcgtcctacgcccacgaatggctctccagctggagaaaaccggcggccagtggatccaccatcagcggacgcggggatcgggcagagaagttaaggccggcgcgtggaggggcagcatcctt

SEQ ID NO: 1447 - DNA, 1077 bp, Zea mays
  Predicted polypeptide sequence is orthologous to G1140
gggggggttttttttttttttttttttttttttttttttttttttttttttttttttttttaaacaatacagatttttagaacgaagataacgcagcgcatacactattatatatacaaatttcgcgttagccactttgaagtacagacatgcgcgggggcggcacatctggttaaaccaatataatgccgcgaatgggactatcccagtctttgtcttcttagaagcactggtgtcagccccactcatgcagataacatgcgatgcgatggtccttcctttcaaggcaacgacaacttcaaggatatatcggaaccatcatcacagtcgagcgagcttcctgaatgcaatgcagtcattacagattcagacgactgcccgtcttcagggaggatattttctgcagcagcagcaaccaccattgggccagccgttagcacctgaggcatttgttcttttagacgcctggtctcatcttctagctgggggcccttttgcagtaattcgccgatttgttgcatgaatagctggtcctttgtactaatcactctatgcagtcctgcttcaagtttcctttccattcggtgcaattcctctccacccaatccctcaaggtcttcccctctcatctgtctaagtccattagtttcttcagcaagttgctcgttcaagccgctgtatttgctctgctctccattcaaatcaatagaaggctgctgatgtgatttccccagattcttagaatgtgtactgtacttgtcaacgatgtcattcacactggagctcgcgaactgcgagagcctgccggtggcggagaacacgacgagcgcgacgtcggcgtcgcacagcacggcgagctcctccgccttcttgaacagcccgcgccggcgcttggagaaggtcacctgccgcgccgccgcgctctctatccgccgtatctcccgcctctcgcgcgccatctcccacgcgccgccgccgccgcgtactgctccgatcctctctctctcgtcctacgcccacgaatggctctccagccgaagcgacggcaaatgaaagcgaggcgaggcgaggcgaggc

SEQ ID NO: 1448 - DNA, 1335 bp, Zea mays
  Predicted polypeptide sequence is orthologous to G1140
ttgggaccctcccgcccggccggccccctggccctctccttggcttttcctctcgctctcctcctctctcgcatcccaccgcatcacaaccacgacttcctcccgccgccggttggcttcgctgctcgtccacctccgcccggcccgtgggacgagtggggactggagagggtcgcctctgggcttcgcctctcggcggccgagtgtctgcgtcgtccacggagctgagagcctgagactgagactgagagcgaccggcggcggggatggcgagggagaggcgggagataaagaggatagagagcgcggcagcgaggcaggtcacgttctccaagcgccgccgcggcctcttcaagaaggcccaggagctctccgtgctgtgcgatgccgacgtcgcgctcatagtcttctcctccacggggaagctctcccagttcgccagctccagtatgaatgagataattgacaagtacaacacgcattctaaaaacctggggaaaacagaacagccttcgctggacttgaacttagagcatagcaaatatgcaaatttgaatgagcaacttgcggaagcaagccttcgactcaggcagatgagaggtgaagaacttgagggattgaatgttgaagaactccagcaattggagaagaacctggaatctggtctgcatagggtgcttcaaacaaaggatcaacaattcttggaacagatcaatgacctcgaacgtaagagtacgcagctggcagaggagaacatgcaactgaggaatcaagtatcccagatacccccagctggcaagcaagcagttgctgatactgaaaatgttattgctgaagaagggcaatcctctgaatcagtgatgactgcgttgcactctgggagttcacaggataatgatgatggttcggatgtatctctaaagttagggctgccttgcgttgcatggaagtaaacaggaaatgaggctccttgtcgattctgggtgtggatgtgggtgtgggtggagctgcggcctcagcggataggcacttgtgtatggttttatggacgaccggcccccgactacgtactgcaataatcttgcattggaagcgagatcggttaacctgatttgtcatccttgtggcttcatgatgcgatgttccgcttgtaccgtttgctagcatgttaactgaatttttagaatcgcatatacttttgttcttatatatcactgtcgtactgctcgtaagatgtatctactttattctatccaatgttgtaacctatcacctgccaacttccctactgttttggcgcgccgcaagctgtgctcaagcatgcttcatgtttgt

SEQ ID NO: 1449 - DNA, 1457 bp, Zea mays
  Predicted polypeptide sequence is orthologous to G1140
cccacgcgtccggtctgcctttccctctcccagtttccgtttttttaatgctttgtttactcgcggggatcatggggtaatcgcgtgggccgtgcctggctgggtttatttccttgggtcccccgaggccggccgggcccctttcctgcccctccccctccgcctttcctctctctcgctctcctcctctcctctcctctcctctcctctccttccgcatcacacaccacgactcccaaccgccggttggctttgctgctccgagctcttcctcttccacacccgccctctctcttgggtcggcggccgagtgtctgcgtcgtccacggagatcagggatcggcggcggggtatggcgagggagcgacgggagataaagaggatagagagcgcggcggcgcggcaggtcacgttctccaagcgccgccgcggcctcttcaagaaggctgaggagctctccgtgctgtgcgatgccgacgtcgcgctcatcgtcttctcctccacgggaaagctctcccagttcgccagctccagtatgaatgagatcattgacaagtacagcacacattctaaaaacctggggaaagcagaacagccttcacttgacttgaacttagaacatagcaaatatgcaaatttgaatgagcaacttgtggaagcaagccttcgactcaggcagatgagaggtgaagaacttgagggattgagtgttgaagaactccagcaattggagaagaatctggaatctggtctgcatagggtgcttcaaacaaaggatcaacaattcttggaacagatcagcgacctcgaacaaaagagtacacaactggcagaggagaacaggcaactgaggaatcaagtatcccacatacccccagttggcaagcaatcagttgctgatactgaaaatgttatcgctgaagatgggcaatcctctgaatcagtcatgactgcgttgcattctgggagttcacaggataatgatgatggttcggatgtctctctaaaattagggctgccttgtgttgcatggaagtgaaaaaacaagatggtctgtgttgatctgggtggagctgcggcttcagcagataggcacttgtgttattgtcttatggacgacccccgactactgcaataatcttgcatcggaagcgagatcagttaacctgatttgtcatccttgtggcttcatgatgcgatgttgcgcttgtaccgtttgctaggatgttaactggactagaatcgtgtctacttttgtactgctcgtgaatcctatctactttgtgctatccaaagttatgacctaccacttgcatcggcatggcgcgccggccgtaagctgtgctcaagcatgcatgcttcgtgttatacgtgtgtacttattgggaagttgagtctgcatacaacctgaccgccggtgcggtcttgctgtcttacagagagaccgtttagttttc

SEQ ID NO: 1450 - DNA, 1300 bp, Zea mays
  Predicted polypeptide sequence is orthologous to G1140
gccgggaaaacatagctagggttctccttctcccctccctccgccccctcgagattttcgcgggcccgcttgctcttggacggtgcttcctcttctttaccagctagtcaaagtaaccacgcgtgctgcttcatctctcccttccttcctgccgtgtggttgttggcagccgcagcggcggcgcccgcgggtggaggagcaggagaggcggcgccatggtcgggaccgggaagagggagcggatagcgatacggaggatcgacaacctggcggccaggcaggtgaccttctccaagaggcggcggggcctgttcaagaaggccgaggagctctccatcctctgcgacgccgaggtcggccttgtcgtcttctccgccaccggcaaactcttccacttcgccagctccagcatgaagcaggtaatcgatcggtacgactctcattccaagactctccagaggtccgaaccgcagtcgtctcaactgcagtcacatatggatgacggcacttgtgcaaggctaaaggaggaacttgctgaaacaagccttaagctcaggcagatgagaggagaggagctccagaggctgagcgtcgaacagctgcaggagctcgagaagaccctcgaatccggcctcggctctgtactcaaaaccaagagccaaaaaatccttgacgagatcagcggtctggaaagaaagagaacgcagctgatcgaggagaactcaaggctgaaggagcaagtgacacggatgtcgaggatggagacgcagcttggcgccgatccagagttcgtgtacgaggaagggcagtcgtctgaatccgtgacgaacacgtcctatccgcgcccgtccaccgacaccgacgactgctccgacacatcgctcaggctcgggctaccactcttcagctccaagtgacggagatttgacatgtccggtagcggagcggtgccgattgcttgcccttctccactctagataggtctggattgggggagagcaagcactgctggatcgggaagacccaagtgaccaacgcgtcgcatcagaataaggcattttgagtgctgtatgatgtgtgtattctggctctgaaagtgagacctgcttttgttataatacatacatacaggcagcatggcaatacgtgacggggtatccgctgcctgcagtccgtgacctgtctgtcgtctctgtttctagtacccgtataatcaccctgcaattacctgcagctggtcatcgttaggagaaactccagtccatgcaaatgaactcccaaaaaaaaaaaaaaaaaaaaa

SEQ ID NO: 1451 - DNA, 1426 bp, Zea mays
  Predicted polypeptide sequence is orthologous to G1140
  misc_feature (1118)..(1118): n is a, c, g, or t
  misc_feature (1129)..(1129): n is a, c, g, or t
  misc_feature (1136)..(1136): n is a, c, g, or t
  misc_feature (1171)..(1171): n is a, c, g, or t
  misc_feature (1204)..(1204): n is a, c, g, or t
  misc_feature (1259)..(1259): n is a, c, g, or t
  misc_feature (1272)..(1272): n is a, c, g, or t
  misc_feature (1285)..(1286): n is a, c, g, or t
  misc_feature (1292)..(1292): n is a, c, g, or t
  misc_feature (1331)..(1331): n is a, c, g, or t
  misc_feature (1342)..(1342): n is a, c, g, or t
  misc_feature (1389)..(1389): n is a, c, g, or t
  misc_feature (1392)..(1392): n is a, c, g, or t
cctcgcggccggccgggcctttgcgcaaaagagtactctctccctcctaccacacacagcctccggactgctccggacgcgcgcctcagatctactccaacacctccgcagcggcggcgcccgcgggtggaggagcaggagcaggagcggcggcgccatggtcgggaccgggaagagggagcggatagcgatacggaggatcgacaacctggcggccaggcaggtgaccttctccaagaggcggcggggcctgttcaagaaggccgaggagctctccatcctctgcgacgccgaggtcggccttgtcgtcttctccgccaccggcaaactcttccacttcgccagctccagcatgaagcaggtaatcgatcggtacgactctcattccaagactctccagaggtccgaaccgcagtcgtctcaactgcagtcacatatggatgacggcacttgtgcaaggctaaaggaggaacttgctgaaacaagccttaagctcaggcagatgagaggagaggagctccagaggctgagcgtccaacagctacaggagctcgagaagaccctcgaatccggcctcggctctgtactcaaaaccaagagccaaaaaatccttgacgagatcagcggtctggaaagaaagagaacgcagctgatcgaggagaactcaaggctgaaggagcaagtgacacggatgtcgaggatggagacgcagcttggcgccgacccagagttcgtgtacgaggaagggcagtcgtctgaatccgtgacgaacacgtcctatccgcgcccgtccaccgacaccgacgactgctccgacacatcgctcaggctcgggctaccattcttcagctccaagtgacggagatttgacatgtccggtagcggagcggtgccgattgcttgcccttctccactctagataggtctggattgggggagagcaagcactgctggatcgggaagacccaagtgaccaacgcgtcgcatcagaataaggcattttgagtgctgtatgatgtgtgtattctggctctgaaagtgagacctgcttttgttataatacatacatacaggcagcatggcaatacgtaacggggtaccgctgcctgcagtccgtnacctgtctgtngtctctntttctagtactcgctataatcaccctgcaattacntgtagctggtcatcgttaggagaaattccagtncatgcaaattaactcccagcacttgttctcttcgcggtatcagatatgctacgtngttctttgcagtnggaacttcgatgnnaatttngcaatagcatacggagcaggtgcagagccttcagcaatngagggtaaaantgaagaagcccaaagaaaaaaaaggggttctttggcgtcacaggggntanactttaatgatgaagtaggtcaagcaaaaggtgg

SEQ ID NO: 1452 - DNA, 1120 bp, Zea mays
  Predicted polypeptide sequence is orthologous to G1140
ggccggccgggcctttcgtgcaaaagagactctctccctcctaccactcccagcctccggactgctccggacgcgcgcctcagatctactccaacacctgtatggattcctctggccgtgtggcctttccggcaactatagctagcggcggcgcccgcgggtggaggagcaggagcacgacgcggccgcgccatggtcggcaccgggaagagggagcggatagcgatccggaggatcgacaacctggcgcccaggcaggtgaccttctccaagaggcggcggggcctgctcaagaaggccgaggcgctctccatcctctgcgacgccgaggtcggccttgtcggcttctccgccaccggcaaactctgccacttcgccagctccagcatgaagcaggtaatcgatcgggacgactctcattccaagactctccagaggcccgaaccgcagtcgtctcaactgcagtcacatatggatgacggcacttgtgcaaggctaaaggaggaacttgctgaaacaagccttaagctcaggcagatgagaggagaggagctccagaggctgagcgtcgaacagctgcaggagctcgagaagaccctcgaatccggcctcggctctgtactcaaaaccaagagccaaaaaaatccttgacgagatcagcggtctggaaagaagagaacgcagctgatcgaggagaactctatggctgaaggagcggggtttcaagcatttctcgtgatggagcggcaccttggagtccacccatagtttgtgtatgaggaaggacaatcgtctgaatcggttcggaacacgtcttatccgcgtccgtccactgacacagagggttgctcctacacatcgctcaggcttgggctcccattcttcagctccaagtggcgcagatttggcatgtccggtaacggagcggtaccgatcgcttgcccttttcccctctagataggtctggattgggggagagcagcagtgttggatcgggaagacccaagtgaccaacgcgtcgcatcagaataaggcattttgagtgctgtatgatgtgtgtattctggctctgaaagtgagacctgcttttgttataatacatacatacaggcagcatggc

SEQ ID NO: 1453 - protein, 229 aa, Oryza sativa
  Orthologous to G1140
MARERREIKRIESAAARQVTFSKRRRGLFKKAEELSVLCDADVALIVFSSTGKLSHFASSSMNEIIDKYNTHSNNLGKAEQPSLDLNLEHSKYAHLNEQLAEASLRLRQMRGEELEGLSIDELQQLEKNLEAGLHRVMLTKDQQFMEQISELQRKSSQLAEENMQLRNQVSQISPAEKQVVDTENFVTEGQSSESVMTALHSGSSQSQDNDDGSDVSLKLGCTATQQKR

SEQ ID NO: 1454 - protein, 229 aa, Ipomoea batatas
  Orthologous to G1140
MAREKIKIKKIDNITARQVTFSKRRRGLFKKAEELAVLCDADVALIVFSATGKLFEFASSNMKDILGKYELHSSNLDQATQPSRELQLENSLHVRLSKEVADKTRELRQMKGEELQGLSLEELQKLEKRLENGLTRVLETKGERVVTEIATLQRKGAELMKENKQLKEKMARVNGEKFPVIADVEAAGLIPEEGQSSESITTNVCSCNSGPPPEDDCSDTSLKLGLPIN

SEQ ID NO: 1455 - DNA, 430 bp, Zea mays
  Predicted polypeptide sequence is orthologous to G1146
atccaccaccatccatggccatggcgtcctccccggcctgccacttccgccacccgccccgcctccgcctcctcctcccgctgtccacctcggccccccacccgtggctctactcctggtcgcacccgcgccagcgcggccgactccgcgcgccgcccgccgcgctcgacctccgtccggagccgtccccgtcgtccgactccgacgatgaggacgccgtcggtgccagccgctcctccggccgctccaccatgtccctcatcctcagccgcctccgccgcgccggctacttcggcgaggacccgcgtgccgccgccccaccgcacccgccgcgggggtcggtcgaggacgtctttcgcgccgacgatggcgtgcttcccaacgcgcgcggcgggttctacgccgactacgaggagcgggcgctcgggga

SEQ ID NO: 1456 - DNA, 557 bp, Zea mays
  Predicted polypeptide sequence is orthologous to G1146
cccgccgccggctccacgctcacctctcgcgtcccctcgccattctctcgaacgccttctcggcgtccgccgcctcgtctcggccgcgcccgccgccgctcccgccactctctccgctgctcccagcgcgccccgaggacgcgcgcctcgtagcagcgtcctcgtccgccatcgccggcggcttccacgactggttccacgagtcccgcaactccgcttctgcgccgacaccgcccaaggcgctcgacgcgatctacgaggcgctcgcgtgcgatgagacggccccattagaggcgctgccgctctcggagacgcaaagtcatgccgagcgcgggagcggatacgaggggtttcaacaatacattgttgctccttgggggtggtggatataccataagagaagttgcacgctatcggtgttatgagactggagttgctcttgaccaagagcctcaacacaagatgcctggttaatgaggactatgaatacttcggaccagattacactcttcatgttgcaccaattgacatgggagaacaaaaatacacgacaacaa

SEQ ID NO: 1457 - protein, 1504 aa, Oryza sativa
  Orthologous to G1146
MASRPRRAARAPARFGFEDGRVEAEANHESANEQSHRSNRSHRTVSRNAEVEQPRRSSRSHRTVSRDAEMEQSHLSHCTVSHNSGEERLPSPPHVENNMQHIMAVQTQILQGLTTAIASFQHNVHGHPHVGNNRSKLTDFLRSRPPEFSQTVEPVEADDWLKDVDRKLNLVQCTPVEKTLYASHQLRGPAADWWENYCNAHPEPNNIAWDEFATAFRAAHVPESTIDMKKEEFNRLKQGNNSVNEYLSQFNKLARYAPEEVDTDKKKIRKFLKGIAVGMRLQLLAHDFPTFQHMINKALLLEDARKEATEEYKKRKSNHQGNSSRGAPRPRYGQPMQYHQSITQTNRQPGYAPRPQINRPAPPPQQRAPSGNTAPNSVTSFKSPQGPSAVQCFRCNQMGHYARQCPQNPANTNSGHANGSTARTPTPAAAQSRPSSQASGQGSRASNHFGRGRVNHIQAETAQDAPDVVMGMFSVNSVPAIVLFDSGASHSFISQAFVKRNGWKTQNLRVPMIVHSPGRNIRAIQICPEVNLRIEEVDFLAKPIVLDSQSLDIILGMDWLAKHKGQIDCAEKSITLQGPGGKQVRFTPNTPTASRSILTCLQVTSLESVPIVSEYPDVFPEELTTNELAEVKRQIEELESKGYVRPSSSPWGAPVLLVKKKDGSERMVIDYRALNEVTIKNKYPLPRIDDLFDQLKGARVFSKIDLRSGYHQLKIRSEDIPKTAFSTRYGLYEFTVMSFGLTNAPAFFMNLMNKIFMEYLDQFVVKCEFWLDRVAFLGHVISSNGVEVDPSKVEAVLAWNPPKNVSEIRSFLGLAGYYRRFIEGFSKLARPMTELLKKEKKFQWSAACEDSFQEMKKRLTTAPVLTLPDIRKDFEIFCDASRQGLGCVLMQERKVVAYASRQLRPHEVNYPTHDLELAAMVHALKIWRHYLIGNRCEVYTDHKSLKYIFTQTELNMRQRRWLELIKDYDLGIHYHPGKANVVADALSRKAYCNVAQTRPNQDHLCRELEKLRLTVVQSGVPASLTVQPTLESQIREAQKDDEGIKELIKRIREKKDTNFSIDEQGTVWCGPRICVPAKKELRDLILKEAHESAYSIHPGSTKMYQDIKAYFWWAGMKRDVAEYVALCDICQRVKAEHQRPAGLLQPLPIPEWKWEEIGMDFITGLPRTPCGYDSIWVIVDRLTKSAHFVPVKTTYDGKKLAELYMTHVVCRFGCPKKIVSDRGTQFTSRFWKQLHETLGTDLNFSTAYHPQTDGQTERVNQILEDMLRACALDFEGTWDRCLPYAEFSYNNSYQASIQMSPNEAMFGRKCRTPLCWNEVGEALVFGPDILKSAEEQVKLIRERLKTAQNRQKNYADNRRRDLEFKKGDHVYLRVSPLRGMRRFGMSGKLAPRYIGPYLIAARRGEVAYQLELPEGLADVHNVFHVSQLKKCLRVPEEQVPLGSIELEKNLTYKERPIKVLEEAERQTRRKTIKFYKVQWSNHSEDEATREREDLLRAEFPELLP

SEQ ID NO: 1458 - protein, 1562 aa, Oryza sativa
  Orthologous to G1146
MAVNASFSSHGFGEGHHVAQLRDLARFLGFSCPEYTGYSVDRVPPHCELSVYLYPRGDARYPCPYSESQPVLTRMVELSEAQATQHDLLLEAYRSLARRYAALEACLAEEGVTSVDTISWDSGRLCHASHLSSHSSRGSARTPSGPRSPSSRAPYSPVYSPYPHPVSPSYTPGHTPVASSRRGPRFIRTARKRVVGSSTVFRFHYPAPPPLAMASRPRRTARAPARFGFEDGRVEPEANHESANEQSHHSNRSHRTVSRNAEVEQPRRSSRSHRTVSRDAEMEQSHRSHHTASHNSGEERLPSPPHVENNMQHLMAVQTQILQGLTTAIASFQHNAHGNGHPHMGNNRSKLTDFLRSRPPEFSQTVEPVEADDWLKDVDRKLNLVQCTPVEKTLYASHQLRGPAADWWENYCNAHLEPTNIAWDEFATAFRAAHVPESTIDMKKEEFNRLKQGNSSVNEYLSQFNKLARYAPEEVDTDKKKIRKFLKGIAVGMRLQLLAHDFPTFQHMINKALLLEDARKEATEEYKKRKSNHQGNSSRGAPRPRYGQPMQYHQSVTQANRQPGYAPRPQMNRPAPPPQQRAPSGNTAPNSVTSFKSPQGPSAVQCFRCNQMGHYARQCPQNPTNTNSGHANGSTARTPTPAAAQSRPSSQASGQGSRASNNFGRGRVNHIQAETAQDAPDVVMGPGGKQIRFTPNTPTASRSILTCLQVTSLESVPIVCAYPDVFPEELTRMPPDREIEFAIELALGTAPIAKRPYRMAANELAEVKRQIEELESKGYVRPSSSPWGAPVLLVKKKDGSERMVIDYRALNEVTIKNKYPLPRIDDLFDQLKGARVFSKIDLRSGYHQLKIRSEDIPKTAFSTRYGLYEFTFVVVFIDDILIYPKNVSEIRSFLGLAGYYRRFIKGFSKLARPMTELLKKEKKFQWSAACEDSFQEMKKRLTTAPVLTLPDIRKDFEIFCDASRQGLGCVLMQERKVVAYASRQLRPHEVNYPTHDLELAAVVHALKIWRHYLIGNRCEVYTDHKSLKYIFTQTELNMRQRRWLELIKDYDLGIHYHPGKANVVADALSRKAYCNVAQIRPDQDHLCRELEKLRLTMVQSGVPASLTVQPTLESQIREAQKDDEGIKELIKRIQEKKDTNFSIDDQGTVWCGPRIYVPAKKELRDLILKEAHESAYSIHPGSTKMYQDIKAYFWWAGMKRDVAEYVALCDICQRVKAEHQRPAGLLQPLPIPEWKWEEIGMDFITGLPRTPSGYDSIWVIVDRLTKSAHFVLVKTTYDGKKLAELYMTHVVCRFGCPKKIVSDRGTQFTSRFWKQLHEALGTDLNFSTAYHPQTDGQTERVNQILEDMLRACALDFEGTWDRCLPYAEFSYNNSYQASIQMSPNEAMFGRKCRTPLCWNEVGEALVFGPDILKSAEEQVKLIRERLKTAQNRQKNYADNRRRDLEFEKGDHVYLRVSPLHGMRRFGMSGKLAPRYIGPYLITARRGEVAYQLELPEGLADVHNVFHVSQLKKCLRIPEEQVPLVSEPEDPQCEDFEDQAPDLEQGKPPLNILNLYLKFNYVA

SEQ ID NO: 1459 - protein, 1562 aa, Oryza sativa
  Orthologous to G1146
MAVNASFSSHGFGEGHHVAQLRDLARFLGFSCPEYTGYSVDRVPPHCELSVYLYPRGDARYPCPYSESQPVLTRMVELSEAQATQHDLLLEAYRSLARRYAALEACLAEEGVTSVDTISWDSGRLCHASHLSSHSSRGSARTPSGPRSPSSRAPYSPVYSPYPHPVSPSYTPGHTPVASSRRGPRFIRTARKRVVGSSTVFRFHYPAPPPLAMASRPRRTARAPARFGFEDGRVEPEANHESANEQSHHSNRSHRTVSRNAEVEQPRRSSRSHRTVSRDAEMEQSHRSHHTASHNSGEERLPSPPHVENNMQHLMAVQTQILQGLTTAIASFQHNAHGNGHPHMGNNRSKLTDFLRSRPPEFSQTVEPVEADDWLKDVDRKLNLVQCTPVEKTLYASHQLRGPAADWWENYCNAHLEPTNIAWDEFATAFRAAHVPESTIDMKKEEFNRLKQGNSSVNEYLSQFNKLARYAPEEVDTDKKKIRKFLKGIAVGMRLQLLAHDFPTFQHMINKALLLEDARKEATEEYKKRKSNHQGNSSRGAPRPRYGQPMQYHQSVTQANRQPGYAPRPQMNRPAPPPQQRAPSGNTAPNSVTSFKSPQGPSAVQCFRCNQMGHYARQCPQNPTNTNSGHANGSTARTPTPAAAQSRPSSQASGQGSRASNNFGRGRVNHIQAETAQDAPDVVMGPGGKQIRFTPNTPTASRSILTCLQVTSLESVPIVCAYPDVFPEELTRMPPDREIEFAIELALGTAPIAKRPYRMAANELAEVKRQIEELESKGYVRPSSSPWGAPVLLVKKKDGSERMVIDYRALNEVTIKNKYPLPRIDDLFDQLKGARVFSKIDLRSGYHQLKIRSEDIPKTAFSTRYGLYEFTFVVVFIDDILIYPKNVSEIRSFLGLAGYYRRFIKGFSKLARPMTELLKKEKKFQWSAACEDSFQEMKKRLTTAPVLTLPDIRKDFEIFCDASRQGLGCVLMQERKVVAYASRQLRPHEVNYPTHDLELAAVVHALKIWRHYLIGNRCEVYTDHKSLKYIFTQTELNMRQRRWLELIKDYDLGIHYHPGKANVVADALSRKAYCNVAQIRPDQDHLCRELEKLRLTMVQSGVPASLTVQPTLESQIREAQKDDEGIKELIKRIQEKKDTNFSIDDQGTVWCGPRIYVPAKKELRDLILKEAHESAYSIHPGSTKMYQDIKAYFWWAGMKRDVAEYVALCDICQRVKAEHQRPAGLLQPLPIPEWKWEEIGMDFITGLPRTPSGYDSIWVIADRLTKSAHFVLVKTTYDGKKLAELYMTHVVCRFGCPKKIVSDRGTQFTSRFWKQLHEALGTDLNFSTAYHPQTDGQTERVNQILEDMLRACALDFEGTWDRCLPYAEFSYNNSYQASIQMSPNEAMFGRKCRTPLCWNEVGEALVFGPDILKSAEEQVKLIRERLKTAQNRQKNYADNRRRDLEFEKGDHVYLRVSPLHGMRRFGMSGKLAPRYIGPYLITARRGEVAYQLELPEGLADVHNVFHVSQLKKCLRIPEEQVPLVSEPEDPQCEDFEDQAPDLEQGKPPLNILNLYLKFNYVA

SEQ ID NO: 1460 - DNA, 1842 bp, Glycine max
  Predicted polypeptide sequence is orthologous to G1196
ggctcgagacctgattgcgattatagtgatgctgaccttgttgtcgagggaattccggttagtgttcatcgatgtattctggcctctaggagtaagtttttccatgaattattcaagagggagaaggggtcatcagaaaaagaagggaaattgaagtataacatgaatgatttgttgccttatggcaaggttggatatgaagccttcctcatattccttggctatgtatatactggtaaactcaagccctctccaatggaggtgtctacttgtgttgacaatgtttgtgctcatgatgcgtgtagacctgccattaactttgctgttgagttaatgtatgcctcttccatttttcaaataccagagttggtatcacttttccagagacgtctacttaactttataggaaaggcccttgtggaagatgtcatcccaatcctcactgttgctttccattgtcaatcaaatcaacttgtcaatcaatgtattgatagggtggccagatcagaccttgaccagatttcaattgaccaagagcttccgcatgaactctcacaaaaagttaaattgctccgccgcaaacctcagcaagatgttgaaaatgatgcttctgtagtggatgctttgtctctaaaaagaatcactagaatacacaaggcgttggactcagatgatgttgagcttgttaaacttcttttgaatgaatcagacattactttggatgaagccaatgctctccattatgctgcagcctactgtgaccccaaggttgtttctgaggtacttggtttgggactggctaatgtcaatcttcgaaattctagggggtacacagtgcttcacattgctgccatgcgtaaagagccttccattatagtatccctacttacgaaaggggcttgtgcatcagatttgacttttgatggtcagagtgctgttagtatttgtaggaggttgacaaggccaaaggattatcatgcaaaaacagagcaggggaaagaaacaaacaaagatcggatatgcatcgatgttcttgaaagagaaatgaggaggaatccaatggctggggatgcctgtatgtcttcccataccatggctgatgatctccacatgaaactactgtaccttgagaacagagtggcatttgcaagacttttcttcccttcagaagccaaactagccatggacattgcgcatgctgagacaacatctgagtttgctggtctttctgcgtcaaactcaaaaggttcaaatggaaacttaagggaggttgatctcaatgagactcctatagtgcaaaataaaagacttctttctagaatggaagcccttacgaaaacagtggagatggggcggcgctacttcccacattgctcggaagtgctggacaagttcatggaggatgacctgcctgacttgttttaccttgaaaagggtactcatgaagagcagagaatcaaaaggacgcgtttcatggagcttaaagatgacgtccacaaggctttcaacaaggacaaggccgagtttagccgctctgggatttcatcttcatcatcctcatcatccctcagagattctgttgtacattacaaggctaggaaagtgtaattttaaaaccatacatagtgtttttgattttgacatacatattatatatagtgcaaattttaaaggtgaagcccaccaactcatctgtaaaattctcgaagcaggaaagttgatgtaaacaacctgcgcatatatttttgaaaatgttttcatatgctttttggtggagaaaaaaaaaaaaaaaaaaaaaaaaaaaaaaaaaaaaaaaaaaaaaaaaaaaaaaaaaaaaaaagg

SEQ ID NO: 1461 - DNA, 2793 bp, Glycine max
  Predicted polypeptide sequence is orthologous to G1196
cacaggtctcggttcccgagcatcatctctctctctctctctgttttcccatatcttctgtttcccgtcgttggtcaacctttgttcattggttctctttctctttccatttcaagtcttcgcttctttggttcaaaggacttgagcattcttgatgttaaactagccatcttcttcttcttctttttctgcagcgttttgaagcctcttccaagagtctcttacttaagatctgctgtcgagttcatcttccctcttaagtcttaacgggtaacaccctgtatgtaatatttattcttcttttgctcttaacgtctttcccatgtcagttaagttctgaaagttcaaattttttgttctcacgcctcaatttatttgatggatcatccccagatgaaaaatcatctcagtttttgcttctgggaatctgagttttgttgcttgacttgcaagtgactttggtcttgtggtaggggaaacagtgacctttctcaattttgcttatttaatttgagcttagtttgtttagttatagattatgttagctagcttttcagtttagatgggtacttaaaggggtttaatttcttcttttgcttctaaatttggtcaaacagtgctttgactcaattggaatctcgtatatttggaatcatggataactcatatgattcatcctcatccttgagtttcgtatcatctcacctgtcacatggttctagtaatcacaacgtgtcttccaccaccagcaatgagcatggggaaaatattgaaattttgagtctgaataagctcagtggaagccttgagaagctattgattgaggctgagtatgattatagtgatgctgagattcttgttgaggacatccctgtgggtattcatcgctgtatattggcgtcgcgtagtctgtttttccatgagctttttaagaaagggactgatggatcaggcaaggaaggaaagccaaggtatctcatgtcagatttgatgccttatggcacagttggatatcaagctttccaagtgttcttgtactatctgtatactggaaggctaaaggcttcaccaacagaagagacaacatgtgttgatgaaacatgtatccatgtagcatgccgccctgctatcaatcatgccctagagctgatgtatgcttctgccacttttcagatgaaagagctagttttactttttcagcggcatctcctaaattttgttgagaaggctcttgtggaagatgtcattcctattcttatggctgctttcaactgccaactagaccagcttctctctcggtgcattcggagagtagcaaggtctgactttgacaacacatctttggaaaaagagctccctcgtgaagttgtgactgaaatcaaattgctccgactcccatttcagccagaatccacacctaatgcaatggaagtggagtccttgaatgaaaagagtataaggagaatccacaaggcattggactctgatgatgttgagctactgaagcttcttctaaatgagtctagtgtcactctagatgatgcacatgccctgcactatgcttgtgcctatagcgattctaaggttattcaagaagttcttagtctaggcatggctgatattcttcgtagaaattcccgaggatacacagttcttcatgtggctgcaaggcgaaaggatccatccattttggtagcactactgaataaaggggcgtgtgcatcagataccactccagatggacaaactgctcttgcaatttgtcagaggttgacgagatacaaggattatcaagagcaaacagtccagtgtaaggaatctaacaaggacaggctctgtgttgatgtcctggagagggagatgagaagaaattctatgactgtgaatatgtctgtttcatcacagctaacagccaatgatttgcacatgagactggattaccttgaagatagagttgcatttgctcggctgttttttcctgctgaggctagggtagccattgagaatgctgaagcagattcatcgtcgatgtacgcaaactcatcggctttgaagggcacaaatggcaacccgaaacaagtagatctaaatgaatctccctcggctcgtaccagaaaactccagttaagattgcatgcccttatgaaaacagttgagaatggtaggcgcttctttccccattgctctgaagtgcttgataagtttctggaagatgacgatatgccagatgttttcttcctagagaagggcagtgaagacgagcagagaatcaagaaagcacgcttcatggagcttaaagatgatgtgcaaaaggcatttcacaaggatatggctgaaaataaccattctggtttttcatctacggtgtcttcctcatcttcctcaactcgtagggaaggtcttaaccatagagtgaggagaaaatgaagcccatgttcttctagagtagagtgttgcaacttgcaagtagaagccgtggcatatttagaaaaaataagatggaatgttaaattagggggttttgctaatgaacttgggagatttttactagcttgatttagtttcttatagttgttggaccaagagaagaagaaaaataaaagaagacgaattggcttatagtaatatctttgttccttttcgaagaccctaaagtgtgtattttttactttgttatctgatcctagattgttatataattgaaaatctcacctcctgtaataattactttaaagatgacatgcaagactatttaaaagtcatttctaaaaaaaaaaaaaaaaaaaaaaaaaa

SEQ ID NO: 1462 - DNA, 832 bp, Glycine max
  Predicted polypeptide sequence is orthologous to G1196
  misc_feature (34)..(34): n is a, c, g, or t
cttgcatgcctgcagtggcatttgcaagactttntcttcccttcagaagccaaactagccatggacattgcgcatgctgagacaacatctgagtttgctggtctttctgcgtcaaactcaaaaggttcaaatggaaacttaagggaggttgatctcaatgagactcctatagtgcaaaataaaagacttctttctagaatggaagcccttacgaaaacaggtaattgcagtctttattttattttcctataaccatttgttgtaatgatgcttttaacatgtttgtttatcattcaaattcgtagccagttgggtagtgaggtcaattttgtttcaggcatgctctatttcttgtttgtggtacaggctttgtaagcttcattcatgtatctcaatactcagattttgttaaaaaagttgttcatatttgataatatatttttatgattaaaaaaaaatctaatggatatgaactagggtacacgttaaaattggttttgggttcaggggatgtaaaattcttatcgaacctgacccactggcatcagtacttgactaatttcaacctatgtggtgatggaccagaaattttttaaattagtaaattagtttggcttcaattttaataacacaaatccatagaatacccctcttttttgtatacaatggcagaaataaagtttgagcttaggatttcatgcatactacccaaatcccctacaactaagccacctctagtggattaatctataaaatatctgttatcatggaaagttgcgtctcactgtcttcgtaacatgcaaacttgtcagacacaaattaatgcgagtag

SEQ ID NO: 1463 - DNA, 900 bp, Oryza sativa
  Predicted polypeptide sequence is orthologous to G1196
gcagatgattaggtgacactatagaagagctatgacgtcgcatgcacgcgtacgtaagcttggatctctagagcggccgcggcggcgatggggctgccggcggcggcggcggcggcggtggtgggggaggggagaggactggggggaggccgcggtacaagagggaggagctcgtgccgggaggccgcgtggggcgcgacgccttcctgtcgctgctgggttacctgtacacgggcaagctccggccggcgccggatgacgtggtgtcctgcgccgaccccatgtgcccgcacgactcgtgcccgccggcgatcaggttcaacgtcgagcaaatgtacgcggcgtgggcgttcaagatcaccgagctcatctcgctgttccagcgacggcttcttaacttcgtcgataagactctagtagaagatgttcttccaattctgcaagttgcttttcattcagagctgactccagtgcttgaaaaatgtattcggagaattgcaagatcaaatcttgataatgtatcgttggataaggaacttcctccagaagttgctgttcagataaaagagattcgccaaaaatctcagccaaatgagggtgacactgtcatttcagaccctgtacatgagaaaagggtcagaagaatccacagggcactggattctgatgatgttgagcttgtgaagttgcttcttaacgagtctgagatcaccttggatgatgccaatgcattgcactatgctgctgcttactgtgattcgaaagttgtttcggagttgttagacttgagacttgccaacttgaatttgaagaattcgcgtggatacacggcactccatctggctgctatgaggagagagccagctattatcatgtgtctcctaaacaaaggagcagctg

SEQ ID NO: 1464 - DNA, 2165 bp, Zea mays
  Predicted polypeptide sequence is orthologous to G1196
cacgattcgtgcccgccggccatcaggtccgcggtcgagctcatgtacgcggcgtgtaccttcaagatcctcgagctcacctcgctcttccaggcgaacctggtggcttgaagtctatgaattgaaatggaatcattattcattaggctgctcaacatttgaatattacatttatggctgtatagtttatcaatcagtttaacatcaattgagctttgctttgtctttacggaaggcaaatggttaacatggtcttcttctacagcggcggcttcttaattttgtagacaagactctagtggaggatgttattcctattctggaagttgcttcccactcagggctgactcaagtgatcgacaaatgtattcaaaggattgctagatcagatctcgacgatatatctttggataaggagctccctccagaagcagttgatgagataaaaaatttgcgcaagaagtcacaaactgctgatggtgatacgttcatttcggaccctgtgcatgagaaaagagtcagaagaatccacagggcacttgactctgatgatgttgagcttgtgaagttgcttcttaatgagtccgacatcacattagatgatgccaacgcattacactatgctgcttcttactgtgatcctaaagttgtctcagagctgttagatttggcaatggctaacttaaatttgaagaatagccgtgggtacacagcactccacttggctgctatgaggagagaaccagctataatcatgtgtctccttaacaaaggggcaaatgtgtcacaactgacagctgatggcaggagcgcaattggtatttgtcggaggttaacaagagcaaaagactacaatacaaagatggagcagggtcaagaatcaaataaagataggctgtgtatagatattctagagagggagatgatgcggaatcctatggcggtggaagatgccgtcacctcgcctttgttggcagatgatcttcacatgaagcttctctacctggaaaacagagttgcatttgctagattgttctttcctgctgaagccaaggtcgccatgcaaatcgcacaagcagacaccacagaagaattcggcggtatagttgcagttgcagcaagcacttccggtaaactgagggaggtggaccttaatgagacgccagtgacacaaaacaaaaggctccgttcaagggtagatgcactgatgaaaacagtggagctgggccgtcggtacttcccgaactgctcgcaggtgctggacaagttcctggaggacgatctgccggaaggtctggaccagttctacctccagaggggcacagccgatgagcagaaggtgaagaggatgcgcttctgcgagctgaaagaggacgtgctgaaggcgtttagcaaggacaaggcggaggggcagcgtgttctcgggcctgtcctcgtcgtcgtcgtgctcgccgccccagaagtatgcccagaggtgatcaaggcaccagtttttgccgtatagtttgttatcatggtcttcgagacttggacccggacagcatatagggacatgtacacctgtgtatgtatagtgcttacaattggcgtaagtagaactatatgtatggaacataaggaaacatggcaggaacaccgtgcaaaaagatgaaaagatggccgaagtgctctatgcgagtgcccacctgattcgatggccctattcaacggcgccctgtcagcatgctgcatgcccactgagaccttcggttgcatagggataggaggagatttctgttcaattttggctagcaagtgatataggggtgtttaggactgtttcactttatgaaaatcaacttagctcataaacacttttaacttcaataacttaggtcctgtttggagtggctgtatttttctagtcccaagaaaataatgtggtatctgagaataccatggtctagaaaccaaaatgtgtttggcagactcttttaaaccatggtatttaaaatcttggttttgacaagaccacattatttctgggtatagaatactgtcagccgagttcggctcggctcggtgcggctcgttgactgaacgagctcgactcggctcgtccattccacgagctggtgaaagaggctcggctcggctcgaccttagctcgcgagccatattcttgt

SEQ ID NO: 1465 - DNA, 1635 bp, Zea mays
  Predicted polypeptide sequence is orthologous to G1196
  misc_feature (1631)..(1634): n is a, c, g, or t
acatcggccgcgacgccctcgtgcccgtcctcggctatctctacaccggccgcctcaagcccccggcgcaggacgccaccgtctgcatggacgacgcgtgcggccacgggacttgccgcccggccatagatttcgtcgtcgagtccatgtacgcggcgtctggcttccagatctcggagcttgcctccctcttccagcgtcgcctctctgacttcgtttgcgaagcgctggacgaggacgtggtgccgattattcatgtcgcttccacctgcgatctccaggacctgctcaatctgtgtattcagagggtcgcagtctccgctctcgatagccgctacctggacaaggagcttccggctgacatatacaacaagatcaaggagatccgccgccaaccagagaacgccattattctggaccctgagcatgacaagagggtcaggaacatcctcaaggccttggattccgacgacgtcgatctcgtcggcttgctgttgaaggaatcgacggtgaccttggacgatgcattcgcgatacactatgctgcagcctactgggagcccaaggtgtttgcagagctgctcaaactggactctgcgggcgggaacctgaagaacagcggtgggtatacgccgctgcacatagcttgcatgaggagagagccggacatcattctttcgctggtggagaggggagcctgtgtgctggagaggaccctggatgggcgcgatgctcttactatctgcaagagactgacaagagagaaagactgcaataggaagttggacaaggacgaggagaaaagtaaggcttacttggggatcgacattttggagcaagaactcaagaggaaatccttcggtttggaccccatctctatctctatagaggagtcgactgccacgcctttgctggtcgataattttcacatgaggctcataaacttggaaaacagagttgcgtttgctcggatattcttcccttctgaagccaagcttgtcatgcgcatcgcacaagccgattcaacccaagagtttgccggcatcaccaacttcagcagactcaaggaagttgatctaaacgaaaccccaacgatgcagaataggaggcttcgcgaacgccttgatgccttaacaaagacagttgagctagggagacgatacttcccacactgttcggacgttctggataagttcctcaacgaagaatccactgatccgatcttccttgagactgggaccccggaggatcagcaagtcaagaggatgcgtttctctgagctcagagaggacgtgcgcaaggcgttcacgaaagataaggcagcagtggctgcaatagcttcctcggcgtcctcgtcttcgtctccgaggtgcagacgacccaataggaaatcacggtgatgtcagtctgttcaggacacctgcactgggttgtgtgtgttttgacatgtaacactgtttcagtagataatgctgattgtcagatttgctgccgctctacagaagattaagcgaccgtctgtttcaagaattattcagacagttacttgtgattctttcaagcagcagttacaaaaaaaaaaaaaaaaaaaaaaaaaaaaaaaaaaaaaaaaaaaaaaaaaaaaaaaaagnnnna

SEQ ID NO: 1466 - protein, 624 aa, Oryza sativa
  Orthologous to G1196
MEPSSSITIASSSSYLSNGSSPCSVSLAPPGAGAVAAQAAPVAAGEGGGGGGGGGGGGSSSVEVVSLNRLSANLERLLLDSDLDCSDADVDVADGGPPVPVHRCILAARSTFFYNLFAARGRGGDGAAGGGGGGGGGGGERTGGRPRYKMEELVPGGRVGRDAFLSLLGYLYTGKLRPAPDDVVSCADPMCPHDSCPPAIRFNVEQMYAAWAFKITELISLFQRRLLNFVDKTLVEDVLPILQVAFHSELTPVLEKCIRRIARSNLDNVSLDKELPPEVAVQIKEIRQKSQPNEGDTVISDPVHEKRVRRIHRALDSDDVELVKLLLNESEITLDDANALHYAAAYCDSKVVSELLDLRLANLNLKNSRGYTALHLAAMRREPAIIMCLLNKGAAVSQLTADGQSAMSICRRLTRMKDYNTKMEQGQESNKDRLCIDILDREMIRKPMAVEDSVTSPLLADDLHMKLLYLENRVAFARLFFPAEAKVAMQIAQADTTPEFGIVPAASTSGKLKEVDLNETPVTQNKRLRSRVDALMKTVELGRRYFPNCSQVLDKFLEDDLPDSPDALDLQNGTSDEQNVKRMRFCELKEDVRKAFSKDRADNSMFSILSSSSSSSPPPKVAKK

SEQ ID NO: 1467 - protein, 89 aa, Oryza sativa
  Orthologous to G1196
HCEIVELFLSRGVDVDLDSITGTPLLTAAMNGQYSTMKILLEHHADVGADVNFRDPNGVTCVMVAANHGSPVIMKCLLDAGANSNIPDE

SEQ ID NO: 1468 - DNA, 1090 bp, Glycine max
  Predicted polypeptide sequence is orthologous to G1198
aaactcaaacttttttttttctatttctcttcagctaaagtaggagcttcctcatcatgcacataaaaactagatttacatttacaataaaacataaagacacaagggagcatagaagattgaaaagaaaaaataaataaatatttttcttttaggaagacgctgacattcatttgtaaagcagcccaacgaaatccccttaattatggcgagcaaacttctttcaggctaatgggttttaattacatctctcagaaacttgagaaataattctgagaatgttggactatttgcatttccgtagttgtttggcatgagttatcgtcgttgatcaaggtctctcgtggtcttgatgcccaaagagaactaagggcacgaagacgtccatagtactctccaataacaataaagcatcgtgctgcttgacgaactgtgagtaatcgacatagctgatgaagagtttgctgcctcaaattatcagcctggcgaacaaaaccttcaagattggcaagcttgctcatggcaacgaccatttgttgaacaccatcaaccactgggcctccagctatggtgtccacaagtgactgctgcaactgctcaagtccctgagagagtgcttcttctgcttgctgtgaggaatgcctcaagccatacatccccattatttgttgctcagctagtggctccaactgttgaatcaacatcgtgatgagatcagagggtctaaaaccaccaatccagaggaagcaacgttcagcttgggaagtccacatgccattgataaggtggaacacatctgatttagcagccacaaccttgagcctgaaaatttcatcatagtgagaaagatatccatccaccatcactctcatatcactatctgataacggtgcttgcaacccgttcctcagctcccccattagcctgtgatcttcttctaaccatcttgcatattccatgtcaaacattgcggctccagagcttacagtacttccaacacctccataatccacgaacaagccctgagagcgtgctctttgaagttcttgttctatctgggtaagctttaatctacttgactctagctgct

SEQ ID NO: 1469 - DNA, 1861 bp, Glycine max
  Predicted polypeptide sequence is orthologous to G1198
  misc_feature (5)..(5): n is a, c, g, or t
cggtnccgattcccgggtcgatatgggacatatgcacacacttcaagttttgatattctacaactttgtgatgaattgagtttcttctactttgtgagaaacttttagtttcaacttcagagaaggtgagaatggtctaagaagaagccttgcatggcgagccaaagaataggagaaacgggtttgtctgagtcaggaccttcaagtcaccatatcccttatggagttcttcatgggattaatacttcatcatcagccctaatcaatcaagggtcagcttttgattttggagagctggaagaggctattgttctgcaaggaattaagataagaaatgatgaagccaaagcatctttattcacaggcaggccttcagccacactggaaatgttcccttcatggccaatgagattccagcaaacctcaagaggaggttcaaagtcaggagaggaaagcagtgattcaggatcaggagtgaacactctttcaagcaaaaatgagctccaatttgaaacagaatctccaataagcataaaagcatctccttcagatcatcatcaggcttttgatcagcaccttcaacaacagcagcagcagcagcaacaacaacaacaggagacagcaacagcaggcacatcatcacagaatcaatcagcagccaaatcacctcaagaaaagaggaaaggagctggttccacatcagagaagccacttgatgcaaagacactgagacgtttagctcaaaacagagaagctgccaggaaaagccgtctcaggaaaaaggcttatgtgcagcaactagagtcaagtagattaaagctcacccaccttgaacaagaccttcaaagagctcgctctcagggtgtgtttatgggatgtggtggtgctggtggcagtttaagttctggagctgcaatgtttgacatggagtatgcaaaatggttagaggatgaccagcggcacatagcggagctccggtcggggctgcagacgccgctgtcggacggcgaactaagagtgattgtggatggatttctgtctcattatgatgaagttttcaggctgaaaggggtggctgctaaaacagatgtgtttcatcttattaatggcacatggacttcaccagctgagagatgcttcctctggataggtggttttaaaccatcagagctcatcacaatgttgataccacagttagagcccctggcggagcagcaaattatggtcatatgtgaactcgggcattcgtcactgcaaacagaagaagctctcagtcaaggtcttgaacagcttcagcagtctcttgttgacaccattgccggcgggcccatcgccgacggtgttcaacagatggtggcagccatgaccaagcttggccaccttgaagaatttgttgctcaggctgataatttgaggcaacaaacccttcaccaattatgtcgattgctgacagttcgtcaagcagcaaggtgttttcttgtgattggagagtattatggccgtcttagagcccttagttctctttgggcatcaagaccacgagagtcattgatcagtgatgataactcatgccaaacaaccactgaattgcaaatggttcaatcttctcagaatcatttctcaagtttctgaaatacattgtaattgaaacctggtgcaagtggatttctttgggctgctttagaaagaatggaaaagagtgtcagcatcatcaaagaattaatatcttttttttttcttctttcaatcttcctctcgtgtctcttatgttttgtaataattaaatggaattcgagttttatgtgaatgacgaggaagctcttctactttagctaaaaggagtagaggaatttaatgatat

SEQ ID NO: 1470 - DNA, 2064 bp, Glycine max
  Predicted polypeptide sequence is orthologous to G1198
ccggaattcccgcctcgccccccccgtcgcttgcgatcggtttcttcttctgggtgtgttgcttaaatctgtggaaagttcatttttttttccgattttcatgtgaccagggtcttttggggctaataaggtttgtggagagagaagatgatcgttgtgctgagcatgattattgatgggtagcagaagtagaacggtaaacgttaacactaaggacactaacaaggttctgaacgggatgccaagctacgctcctccattgccttcttctaattccatagccatggaagcaactaatgttcatccttcccgcatttctgaatttggaaccctggagcaatctcttggatttcgcgttgaagataccattaatcttagcagaaatccgatgtttaatcaaatgaaatcaaatagccaagctctaggtgctgatattcaatttggtgctttaaataagtcaattgcaacatcagatataaacctctctgctgctattgctgggtctcaagcattggtattccaaaaagattcgcaaccaactctggcttcaacatctgctggtcgtgagaactggggagagaccaacttggctgatgctagccctaggactgatacttcaacagatgatacagaagacaaaaatcaaaggcctgaaaggggtgaatccagtggatcaaaagataaatcagatcaaaagacattaagacggcttgctcaaaatcgtgaggctgccaggaaaagccgactgaggaaaaaggcatatgtgcaacaattagagagcagtaggttgaaactgacccaacttgagcaggagctccagcgagcacgccagcagggaatatttatttcaagtactggagatcaggcacagtcaatgagtggaaatggcgctatggcatttgatgtagagtacgcacgatggttagaagagcataatagacaaaccaatgagctaagggctgcaataaattctcatgctggagatattgaacttcgaaccattgttgacaatttcatgacacaatttgatgatatcttcaggctgaaaggtattgcagcaaaagctgatgttttccacattctgtcaggaatgtggaagactccagctgagaggtgtttcatgtggattggaggctttcgctcatccgaactactcaagcttcttgaaagtcagttggagcctttaaccgagcaacaattgatgggcatctacaacttgcagcagtcatcccagcaggctgaagatgctctttcccaagggatggatgcattgcagcaatcactgtctgagacattggctaatggttcacccagcacatcaggctcctcgggaaatgtggcaagttacatggggcaaatggctatggccatgggaaagcttggtactcttgatgggtttcttcgccaggctgacaatctgcggcagcagacattacaacaaatgcttcgaatattaacgaccaggcaatcagctcgagctcttctcgccatcagtgattatttctcacggctgcgagctctgagttctttgtggcttgctaggccaagggagtgaagcatttcacagccccattagtggacttctttcatgcctgactcccttaaacaccgatgatcattgaatcttgtgctctgaatgagttcaatggaagctggtgtcttttgacaatgaattcctcttgaagcctagttgtgatgctataaacattaaatgctatgatttttctactctgccaactgctggtgtggtgcaacatttttctttaagcttttgtggttttaaaatagtctcaataatttgattatataggtgtatgatagatagaagctgttgaagggaaaaatgtagaaatagtgtatctgtatttttaggttatagctgttcattgtatttcagaaatcagcttttatttgagggggtatttacctctctttagtttcatttcctgcttaatggtttgtggttggttgcacataaggctccatggtgtatgtatttatacgttctcttttggtatattagaaagacattactaactaaaaaaaaaaaaaaaaggcggccgc

SEQ ID NO: 1471 - DNA, 1824 bp, Glycine max
  Predicted polypeptide sequence is orthologous to G1198
cggacgcgtgggcaaataatgaccaatcataatcttccaggctgagagctatacagaggagagcacaattgattcttttcatgtttctgactttggagcatttgatcagtcatatcgaataggggatgctgttgacctcagtggaaacccagtttacaattcactaaaagtaaacagccaaacaatttctccaggttctgttcacattagtagtcttggtcaggtgagtttttctagttcttttcatccaatgaactccctgctttggtgaataaggcgaagttttagctggttacagtatgtcatattttctagttttctttattttctctttaatatagttgccaacttcacttgaaaaaagcccattgacgaatcaaatagagccgcataggttacgattacagaaggttcaatcatcaaatcctggcacaatattagttggtaatacagataaccaggaggagtctgccatggctgatgccagtcctaggactgatatttctacagatggtgacactgatgacaagaatcagccgtatgatagaaatgaagcccttgctgctgtttccgactctagtgacagatcgaaagacaaatcagatcagaagactctccgcaggcttgctcagaaccgtgaagctgccagaaaaagccgcttgcgaaagaaagcgtatgtccaacagttggaaagtagtcgtttgaagctgacccaactagagcaagagcttcagcgagctaggcagcatgggattttcatatcaagctcgggtgatcaagcacatacattgagtggaaatggggcaatgcaatttgatgcagaatatgcaaggtggctggaagagcagaatcgacaaattaatgagctgaaagctgctgtaaactctcatgcaagtgacactgaacttcgcatgatcgttgatggtatattggcacattatgatgagatttttaggctgaaaggtgttgcagctaaggctgatgttttccatttgttgtctggtatgtggaaaacacctgctgagaggtgttttttgtggcttggtggttttcggtcatctgaactcctcaagatatatcaatatcgatacaagaataagaatctgcttgggtggtggtagcgaagtgccaaaagaacaattaaattgtgctctatctaaagccctgagtctgctggttagtcaattggagcctctcacagagcagcagctgatgggtattaccaacttgcagcaatcctcccaacaagcagaagatgcattatctcagggcatggaagcattgcaacagtcccttgcagagacattgtccaccggagcacctgcctcatctggttcatcagggaatgtggcaaattacatgggtcaaatggccatggccatgggtaagctagggacacttgaagggttcattcaacaggctgacaatcttcgccaacaaactcttcaacaaatgcaccgtatactgacaactcgccaatcagctcgtgcactccttgctatacatgactacttttcgcgtctgcgtgctctcagttcactctggcttgctcgccctagagattgatgggcgcggtaaatagtatggcaaattaattttcatggatccatcactagcaatacttggtcatcataactcttgacaagttttcttgttgttttgttgtactctttgtatcactgatgttagtgcttcattgagtcagtctagaaacgaaattggtgacaagaagtatgaatattactaataatattgtccattgtaattgttgaagggctttgttttttccatacaaaaaaaaaaaaaaaaaaaaaaaaaaaaaaa

SEQ ID NO: 1472 - DNA, 1716 bp, Glycine max
  Predicted polypeptide sequence is orthologous to G1198
ccacgcgtccgcggaaattggactgatcctttctctctctctctctctctttctcctcaacgcctcttcctttcaatttaatccaacaataataattattcgcaaaaaaacgttgaacagataccatcatcatcacccacatcatcagaatttcaagctatacagagggaagcgcaattgattctttttgtgtgtttgactttgatcaatcagttggatatcgcatagaggattgtgttgccttgaggggaaactcagtttttgactcactaaaagtaagtagccaaacaatttctcggggtcctgttgaagttgattcctttgataagttagttaccaacttcactcaataaaaacccattaacaagccaaacagagcgacaaagattgcaattacaaaaggttcaattatcaaatctggtcagtggggatacggaacaccaggaagagtctgccatggctgacgccagtcctagaactgatatttctacagatgttgacactgatgataagaatccacggtttgatagaagtcagtcccttgttgctgtggtttctgactccagtgacagatcaaaggataaatcagatcagaagactctccgaaggcttgctcagaatcgtgaggcagcaagaaaaagtcggttgagaaagaaagcttatgttcaacagcttgaaagtagtcgcttaaagttaacccaactggagcaagagcttcagcgagctaggcagcagggaatcattatatcaaactcaggtgatcaagcacattcaatgagtggaaatggggctatggcatttgatgtagagtatgcaagatggctggaagagcagaatcgacaagttaatgagctaagagcagctgtaaattcccatgcaggtgatacagaacttcgcatgattatcgatggtataatggcacattatgatgagatatttaggctgaaggccgatgcagctaaggctgatgtcttccatttgttgtctggaatgtggaagacaccagcagagaggtgttttctatggcttggtggttttcggtcatctgaactcctcaagctcctggtaaatcagttggaacctctgacagagcaacagttagtgggtattaccaacttgcagcaatcttcccaacaggccgaagatgcattgtctcagggcatggaagcattgcaacagtccctttctgagacattatccactggatcacttggctcctctggttcatcaggcaatgtggcaaattacatgggtcaaatggctatggccatgggtaaactagggacacttgaggggttcattaagcaggctgacaatttgcgccagcagactttgcaacaaattcaccgcatattgacaactcggcaatcggctcgtgcactacttgcaatacatgactacttttctaggttgcgtgcccttagctctctttggcttgcccgcccaagagactgatgggtggtaaatagtgtcattaattttcatggatctggcaccagaatcatttgtcgtaggtttttcactcttgcaattttactgtgttgtagttttcatattactgatattagtgtttcagtaagttataattcagaaactgaattggtgacatgacaagggtatgtattttgtttattactactaatgtgataatattgtccattgtaacacagttgaagggatttagattatttttttacaaaatagctgcgatgcgat

SEQ ID NO: 1473 - DNA, 1722 bp, Glycine max
  Predicted polypeptide sequence is orthologous to G1198
gcgcgcgtcgccgcctcgtaagctcggcgtgaggcacgaggcctagaaattggactgatcctttctctctctctttcttcccaactcaactcaagtcctcttcctttcactttaatccaacaataataattattcgcaaaaaaaaaaaaaaaaaacacgttgaacagataccatcatcattcatcttcatcacccacatcatcagaatttcaagactcagtttttgactcactaagtaagtagccaaacaatttctcgggttcctgttcaagttgattcctttgataagttaccaacttcactcgataaaaacccattaacaaaccaaacagagtgacaaagtttgcaattacaaaaggttcaattatcaaatctggtcagtggtgatacggaacaccaggaagagtctgccatggctgacgccagtcctagaactgatatttctacagatgttgacacggatgataagaatccacggtttgatagaagtcagtcccttgttgctgtggcttctgactccagtgacagatcaaaggataaatcagatcagaagagtctccggaggcttgctcagaatcgcgaggctgcaagaaaaagtcggttgagaaagaaagcttatgttcaacagctcgaaagtagtcgcttaaagttgacccaactggagcaagagcttcagagagctaggcagcagggaatctttatatcaaactcaggtgatcaagcacattcaatgagtggaaatggggctatggcatttgatgtagaatatgcaaggtggctggaagagcagaatcgacaaattaatgagctaagagcaggtgtaaattctcatgcaggtgatacagaacttcgcatgattatcgatggtataatggcacattatgatgagatatttaggctgaaggccaatgcagctaaggctgatgtcttccatttgctgtctggaatgtggaagacaccagcagagaggtgttttctatggcttggtggttttcggtcatctgaactcctcaagctcctggtaaatcagttggaacctctgacggagcaacagttagtgggtatcaccaacttgcagcaatcttcccaacaagcagaagatgctttgtctcagggcatggaagcattgcaacagtccctttctgagacattatccactggatcacttggctcctctggttcatcaggcaatgtggcaaattacatgggtcaaatggctatggccatgggtaaactagggacacttgagggattcattaagcaggctgacaacttgcgccagcagacgttgcatcaaattcaccgcatattgacaactcggctgtcggctcgtgcactacttgcaatacatgactacttttctaggttgcgtgcccttagctctctttggcttgcccgcccaagagactgatgggggtaaatagtgtgtcattaattttcatggatctggcaccagaatcctttggcataggttttttactcttgcaattttactgtgttgtagttctcacattactgatattagtttcagtaagttattatctagaaactgaattggtgacatgacaagggtatgtattttgtttattactactaacgtaataatattgtctattgtaacacagttgaaggaatttagatgattttatacaaaaaaatggttgggatgtgaaaaaaaaaaaaaaaaaaaaaaaaaaaaaagcggccgctctacaggatcca

SEQ ID NO: 1474 - DNA, 1893 bp, Glycine max
  Predicted polypeptide sequence is orthologous to G1198
ggtggaagatttgagcagaagaagacatgtagagattggaatcatccgtgtccctctctctcatctctctttctctctcttcccttggtttccttactaattactttaacccaataatccaataactacatacaaagttgaacaataccaccatcatagcgcatcatcatcagaattccaaggggaattgttgatgtggtggtgagaatgatgtatggggagtagaactacctggagggttgttggtgttgaagatgacaagggagctgaaagaggaatgccgagcttcaattctgagttacccaattccaattcatgctatacagaggggaacacaattgattcttttcgtgtttctgactttggagcatttgatcagtcatatcacatagaggatgctgttgacctcagtggaaacccagtttacaattcactaaaggtaaatagccaaacaatttctccgggttctgttcacattagtagccttggtcagttgccaatttcactcgaaaaaagcccattgacaaatcaaacagagccaccgcataggttgcgattacagaaggttcaatcatcaaatcctggcacaatattagttggtaatacagataactgggaggagtctaccatggctgatgccagtcccaggactgatatttctacagatggtgacactgatgacaagaatcatccgtttgatagaaatcaagcccttactgctgtttccgactctagtgacagatcgaaagataaatcagatcagaagactctccgcaggcttgctcagaaccgtgaagctgccagaaaaagccgcttgcgaaagaaagcgtatgtccaacagttggaaagtagtcgtttgaagctgacccaactagagcaagagcttcagcgagctaggcagcaggggattttcatatcaagctcgggtgatcaagcacatacattgagtggaaatggggcaatgcaatttgatgcagaatatgctaggtggctggaagagcagaatcgacaaattaatgagctaagagcagctgtaaactctcatgcaagtgacactgaacttcgcatgattgttgatggtatattggcacattatgatgagatttttaggctgaaaggtgttgcagctaaggctgatgttttccatttgctgtctggcatgtggaaaacacctgctgagaggtgttttttgtggcttggtggttttcggtcatctgaacttctcaagctgctggtaagtcaattggagcctctcacagagcagcagctgatgggtatcaccaacttgcagcaatcctctcaacaagcagaagatgcgttgtctcagggcatggaagcattgcaacagtcccttgcagagactttgtccaccggagcacctgcctcatctggttcatcagggaatgtggcaagttacatgggtcaaatggccatggccatgggcaagctagggacactagaagggttcattcaacaggctgacaatcttcgccagcaaactcttcaacaaatgcaccgtatactgacaactcgccaatcagctcgcgcactccttgctatacatgactacatttcgcgtctgcgtgctctcagttcgctttggcttgctcgccctagagattgatgggtgcagtaaatatgtcaaattagttttcatggatccatcaccaggaatacttggtcatcataggttttactcttgacaagttttcttgtgttgattgttgtagtctctgtatcactgatgttagtgcttcattgagtcacatagtctagaaacgaaattggtgacaagaagtatggatgtgtctactaataatattcaccattgtaattgaagggctttgtttttttccatataaatatagttgggcccatatgatatattttttg

SEQ ID NO: 1475 - DNA, 2172 bp, Glycine max
  Predicted polypeptide sequence is orthologous to G1198
gatttgagcagaacaagacatttagagattggaatcatccgtgttcctctctctcatctctctttctctctgttccctcggtttccttactttgaagtttaatccaatccaataatccaataactacatacaaagttgaacaataccaccatcatagcgtatcatcatcagaattccaaggtggatttgcttcatcttttactccggcttcatgctgcatgagtaaaggccgttatgttatgctcatggtggatttttgtgcaactgggactaggggaattgatgatgtggtggtggtgagaatgatgtatggggagtagaactacccaggagggttgttggtgttgaagatgacaagggagctgaaagaggaatgccgagctccaattctgagttacccatttccaattcatgctatacagaggagagcacaattgattcttttcatgtttctgactttggagcatttggatcagtcatatcgaataggggatgctgttgacctcagtggaaacccagtttacaattcactaaaagtaaacagccaaacaatttctccaggttctgttcacattagtagtcttggtcaggtgagtttttctagttcttttcatccaatgaactccctgctttggtgaataaggcgaagatctagctggtatacaggatgccatatttcctagttttctctatttcctctttaatataggggccaacttcacttgaaaaaagcccattgacgaatcaaatagagccgcataggttacgattacagaaggttcaatcatcaaatcctggcacaatattagttggtaatacagattaccaggaggagtctgccatggctgatgccagccctaggactgatatttctacagatggtgacactgatgacaagaatcagccgtatgatagaaatgaagcccttgctgctgtttccgactctagtgacagatcgaaagacaaatcagatcagaagactctccgcaggcttgctcagaaccgtgaagctgccagaaaaagccgcttgcgaaagaaagcgtatgtccaacagttggaaagtagtcgtttgaagctgacccaactagagcaagagcttcagcgagctaggcagcatgtgaggggattttcatatctagctcgggtgatcaagcacatacattgagtggaaatggggcaatgcaatttgatgcagaatatgcaaggtggctggaagagcagaatcgacaaattaatgagctgaaagctgctgtaaactctcatgcaagtgacactgaacttcgcatgatcgttgatggtatattggcacattatgatgagatttttaggctgaaaggtgttgcagctaaggctgatgttttccatttgttgtctggtatgtggaaaacacctgctgagaggtgttttttgtggcttggtggttttcggtcatctgaactcctcaagctgctggttagtcaattggagcctctcacagagcagcagctgatgggtattaccaacttgcagcaatcctcccaacaagcagaagatgcattatctcagggcatggaagcattgcaacagtcccttgcagagacattgtccaccggagcacctgcctcatctggttcatcagggaatgtggcaaattacatgggtcaaatggccatggccatgggtaagctagggacacttgaagggttcattcaacaggctgacaatcttcgccaacaaactcttcaacaaatgcaccgtatactgacaactcgccaatcagctcgtgcaactccttgctatacatgactacttttcgcgtctgcgtgctctcagttcactctggcttgctcgccctagagattgatgggcgcggtaaatagtatggcaaattaattttcatggatccatcactagcaatacttggtcatcataactcttgacaagttttcttgtgttgttttgttgtactctttgtatcactgatgttagtgcttcattgagtcagtctagaaacgaaattggtgacaagaagtatgaatattactaataatattgtccattgtaattgttgaagggctttgttttttccatacaaatatagttgggccatatgatatattttaagggttgtttcagtcgccatagtttacccttggatctgagttcatacaaaattgttgagtttattctttt

SEQ ID NO: 1476 - DNA, 401 bp, Oryza sativa
  Predicted polypeptide sequence is orthologous to G1198
  misc_feature (352)..(352): n is a, c, g, or t
  misc_feature (367)..(367): n is a, c, g, or t
cggacgcgtgggcggacgcgtgggcggacgcgtgggcggacgcgtgggctagagaccagcagggtcaggcttcagcagatcgagcaagaactccaaagagcacggtcacagggcctgtttcttggggggtgcagagcagcaggcgacatgagttctgtaaaatcgtttgcaggcgcggccatgttcgacatggagtacgcgcgctggctggacgacgacagcaagcggctgaccgacctccgtggcggcctgcaggcgcacctgctggacaccaaccttggcctcatcgtggaggagtgcatgcagcactacgacgagctgttccagcttcaaggcggcgctcgcgcgcctncgcgtcttccacctncttaccgggacgtgggctacccccgccgagcgct

SEQ ID NO: 1477 - DNA, 495 bp, Oryza sativa
  Predicted polypeptide sequence is orthologous to G1198
  misc_feature (453)..(454): n is a, c, g, or t
cggacgcgtgggggaaaactgttagatgccaagactgaaaggcgattggctcagaacagagaagctgcaagaaagagcaggctgaggaaaaaggcttatgtgcagcaacttgagactagccgcataaggcttcagcaaatcgagcaagagcttcagagagcacgctcacagggcttgtttcctggaggatgcagtgcacctggagatatgagctcgggtgctgtaatgtttgacatggattacacccgatggatagacgacgacagcaaatgcatggcagagctccagggcgcgctacaggcccagctccccgacggaaaccttggtgccattgtggaagaatgcatgcgccactacgacgagctcttccaccttagggccgtgctcgccagcttccgcgtgttccacctgatgactggcatgtgggcggcgccggcccgacggtgcttcctnncttttggggcgttcggccatcagaaattctcaaaatgctga

SEQ ID NO: 1478 - DNA, 654 bp, Oryza sativa
  Predicted polypeptide sequence is orthologous to G1198
  misc_feature (618)..(618): n is a, c, g, or t
ggaacaagggagccagtgaccagcattgcattgcacctcaacaaatttttgcctcttccttttcctagtgatgttgctttctcaatactttaataatagaacattacaacccctctccctctcccaccctctctttctaacatcacttttggccggagtttacatcctccaggagaagctctcaaaatcctgagtactgattctgctgaggctgattatgcatcggttgcagctcggttcctgtgggactgacgctctcggtgccaatgaagttctcgcgaggacgtgaagaccagaggttgctgagagcacggaggcggcggtaatactccccaatggagaggaaacaccgagccgcctgccgggttgttagaatccgccgcagctgatgcaacgtttgttgcctcagattgtcagcctgctggtagaagctctcgaggctggcgagcttgtccagggcgatggccatgaggctcatgtagttgggcacgccggggccgtcgttgagcgtgccggcggcgacggtgtcggcgagcgactggtgcagctgctgcagcccctgcgcgagcgcctcctccgcctgctccgacgactgctgcaggctgtagatccccagcntctgctgctccgtcagcggggccagctgctgtatca

SEQ ID NO: 1479 - DNA, 1985 bp, Oryza sativa
  Predicted polypeptide sequence is orthologous to G1198
tcgagcggccgcccgggcaggtcgcctcgcctctctctcttccttctgaccaacccgacctcggcgcccccccccatttctctctctctctcttcgcgttgccgtctcgaccccgcctccaccgccgaagccgcccgaggcggcggccgccggcagctgggctcctccgaatccgaacacggcgggggctctcccctcgctccccacggcggttggcacctgctggctctcgatccaacgtgtacagctaatttgatctgttggcgccttagctagaaaggtggcgactctggcatctcagtgatcatagggcatttgaaggtggcctgcatccctgttacaagtaagggacaacaaagcaatttgttgtctctttatttggagctgggaagaacccggcatggcagatgctagttcgaggactgacacatcaacagtcctggataccgacgataagaatcagatggtagacgggcaaagtggagctattgtgccttctaattcatctgatcggtctgacagatctgacaagcccatggaccaaaaggtgttacgccggcttgctcaaaatcgtgaggctgcaagaaaaagtcggctgagaaaaaaggcatatgtacaacaattagagagcagtaagctgaaacttgcaagcttggagcaagagatcaataaagctcgcccacaaggaatttacatttcgagctcaggagaccaaactcatgctatgagtggaaatggagctatgacttttgatttagaatatgcccgttggttggaggaacaaaacaagcagataaatgagctgaggactgcagtaaatgctcatgcaagtgacagcgacctccgtctcattgtagatgggataatggcgcattacgatgagatattcaggctgaagggtgttgccgcaaaggctgatgtgtttcatatactttcaggcatgtggaaaacacctgctgaaaggtgcttcttgtggcttgggggttttcgttcctctgagcttctaaagcttcttgtgaatcagctcgagccattaactgagcagcagttgttgggactatcgaacctccaacagtcctctcagcaggctgaagatgctctatcacagggaatggaagcgttgcaacaatccttggcagatacgttggccgggtcccttggtccatcaggatcttcagggaacgtggcaaactacatgggtcaaatggctatggccatgggcaaacttgggacccttgagaatttcctccgtcaggctgacaatttgcggcagcagactttacatcaaatgcagcgaattctgacaatccgacaagctgcccgtgctctacttgcaatacatgattacttctcacgtttgcgtgccctgagttctctctggcttgctaggccacgggagtaacaacacatagggtgcatcaccgttaatgcttcatgaactgatctgggaggaacggcggagcgggactgattgcggatgcatttgcagaagattggtggctcagttccctcggcacaagttgtattgacaccttttggtttcatgttgtacctgatgttgtacaagtagggtaaagcttgtaacttgtaagttatggtgaatttatgattggcagattgtacaattgtattagcaataaaataaaaggtagataaaggctggaagaatacccagcgatcttacagtggtcggaaacgaaaagcaaaggggacatctcgcacgggatggtcgattgttctaactgaatagataagcacttaagcagggcctttcttttatgacaaccgaaatataggtgaaatggaaactatgggtagaacatgttctgctgattgtttggtcatcctatactcattatcttggtgtctatattatgtacatgcacacaagtgggcgctagtaccactgttttgagctttgtagatttatacctgtcctaatcagagtatactgtatttataaaacaactgccttttttttttca

SEQ ID NO: 1480 - DNA, 1092 bp, Oryza sativa
  Predicted polypeptide sequence is orthologous to G1198
  misc_feature (19)..(19): n is a, c, g, or t
cagcagtttgaaaagcagnaagttgaagtttgttcagatggaacaggattatccacagagttcgttcccagggcttactgcttggagctccaggtggaaacaccagctcaggtgccgcaatgttcgacgtcgactacgcccggtggctggaggaagacagccagcgcatggctgaactgcacggagggctgcacgcacatctgccggacagcgacctcagagccatcgtcgacgacacgctaacccactacgaccacctcttcaacctcaagggcatggcggccaaggccgacgtgttccacctcatcaccgggatgtgggcgaccccagctgagcggtgcttcctctggatgggcggattccggccctccgagctgctcaagacattgacaccccagctggatcccctgactgagcagcaagtggttggtatctgcaatcttcaacagtcatcgcaacaggcagaggaagctctctcccagggcttggatcagctgcatcagtcattagcagaaaccgtggctggagggtccccgttggatgaccccaacgtcgggagtttcatgggtcacatggctattgccctcggccagctatcaaatcggggaggttttggcatacgggctggtaatttgaggcagcagactatccatcagatgcacaggattctgacagtcaggcaggcagctcgatgtttcttggccattggagagtaccataatcgcctccgtgccctgagctcactttgggcttctcgccctcgagagtaaaccccatgcctgatactggtggcagatgaaggcaattgtggggagctaagcattgcagcacatccatctgagagccaatattcagccttctgaaatcctgtttcaaatgtattttgcaactaaccttcaaagtagggagcaaaagcttgttttttaaatgaaatctagcactctagcagatatgtgagaaactcagaagagagttgggaaacaatggaaggctccagctgcactagcaaaattttcagatggaatgaatgggattgcatgattttcagttactgatcataaagcaagtagttcacgtcctttcctggatgat

SEQ ID NO: 1481 - DNA, 1571 bp, Zea mays
  Predicted polypeptide sequence is orthologous to G1198
aattcggcacgaggcacacagccgccgtttcttttacttgcgctcggcacgcaggcgacggctgcggcgctcaggttggggttctcatcgacggcgtcagcggcttcccctcccgcctctcgccagtcgcttcgcgccctcgcctccggtcctccgcacactggccggtgaccctgcatagtattatctgattttcctggaggccacattttaaggactgaggttacaatggcagatgccagccctagaacagaaacatcaacagatgatactgacgacaataacgggcttgaaccaggcagaggtggtcttgttgcttctgactccagtgacagatccaaagacaaacatggagatcaaaagacattgcgtcgccttgctcaaaatcgtgaggctgcaaggaagagccgactaaggaagaaggcatatgttcaacagttggagaatagcaggctaaaacttacccaactagagcaagagctgcaaagagctcgtcagcagggcatttttatatctagttcagttgatcagtcacactccatgagtggaaatggggcattggcctttgatatggagtatgcgaggtggttggaagagcacaatcggcaaattagtgaactaagggctggtgtcagtgctcatgcaagtgatactgatcttcgaagtgttgttgataagatcatgtcacactatgatgagatttttaggctcaaaggcaatgcagccaaggcagatgtttttcacgtcttatctggcatgtggaagacaccggcggagaggtgttttttgtggctaggaggtttccgaccatctgaggttttaaagcttctttcgacacaacttgaacctctcaccgaacagcagctgtcagggataagcaaccttcagcaatcttcacagcaggctgaggatgctctttcacaaggaatggaggcccttcagcaatcattggccgaaaccttggctgggtctctttcgtcttctggatcaacaggaaatgtggcaaactacatgggtcaaatggccatggctatgggaaaacttggaacgcttgagaatttccttcgtcaggctgacaacctgcggctgcagactctacaacagatgcaaaggatcctgaccactagacagtcagctcgggcgctacttgtgataagtgattactcttcacgtctccgtgccctaagctctctctggcttgctcggcccaaggaatagcaagaacatgctatttgactgcaatacttttcacaatttggttttcaatggtcaggagatttgacaaggctgcgacagacttgattcggacatatctgcacatactatgacccaaatggaaggggatgttcatgtagcttaggctgcttagctttgtagttaagtgttgttgatgtatcattaccaactgctgtaaaattctcactctgtatgcccctgatttgcagcgaaccattagaatgcacattgatgttcacctgtcgacttttttgttcactcttaggaacactagcgtaaacataatgttctgcccagtatcatctaaccagggtatatggctgatcccccgcact

SEQ ID NO: 1482 - DNA, 1633 bp, Zea mays
  Predicted polypeptide sequence is orthologous to G1198
atggccagtgaattgaatttaggtgacactatagaagagctatgacctgctacttacctttttttacagcagtgcatgttcgtctcatggtgctgcattcagtttacaatgtgtctgaaggatttgaagaccccacccccagatagtggatgggcttttttttacatattgtatgtgtcaacaggtaatcagaaggctggctcagaatcgtgaggctgcacgcaaaagccggctgcggaagaaggcgtacattcagcagctcgagagctgtaagctgaagctttctcagatggaacaggacatgcagcgagcccgtacccagggcctctttcttggaggagatccgggtgcaagcaccagttcaggtgccgccatgtttgacgtggagtacgcccggtggctggacaaccacagccggcgcctggccgagctgaacggagccctacacgcgcacctggcagacggtgacctcagagccatcgtcgacgacgccctcacccaccacgacgagctgttccagctcaaggccatggcggccaaatccgacgtgttccacctcatcactggggtgtggacgacccccgccgagcgctgcttcctctggatgggtggattcaggccctccgatctgctcaagacactgctgccccagctagatccactgacagagcagcaagtggtcggcatatgcagccttcagcagtcatcacagcaggcagaggaagctctctcgcagggcttggagcagctgcatcagtcgcttgctgacaccatggccggtgggtctctgactgacgacgccaacatgagcttcatgagccaaatggctcttgccctcggcaaactggccaaccttgaaggctttgtgatacaggccgataacttgaggcaacagactcttcatcagatgcaccggattctgacagttcggcaggcagctcgatgtctcttggcaattggcgagtaccacaaccgccttcgtgccttaagttccctctgggcttctagacctcgagagatactggtgaccgatgaaggcaattgtgagataagcatcgcagcacaaccatcccaaaaccaattttcaaccttctgactgacacatgttgtggaactaaccctcagcataggagcaagagaaaaatgactgggaagagaatgactgggaagagagattgtttggatgcacgtagcagatatctgagagctacagaggaaagctgggaaatagaagaagctctaaaacaaggagtgtttctggaaattctttagttttcaaaaaacactttctgaaaatgtgtgtacaagaaaattccaggaaggtgaaattgcttcattgactgcagtgggaaggggaaagagagaagctagaatctcatgtcgagtactccagtacaatgtgttcttttgtctggtctaaattcttgtaacagctcttcctatgatggaagaatccattcaacaattccacctatgattactggattgagtatgttgaataggttggttgaggctatctagtaatttttatgactatgtttatccattatctaggactatttggttactatattatataatctttatcatatatacatccatttagttcaccaaaaaaaaaaaaaaaaaaaaa

SEQ ID NO: 1483 - DNA, 1531 bp, Zea mays
  Predicted polypeptide sequence is orthologous to G1198
ggctcgagggaggccctcatccacggtggtggcgccgccagcgccggcggcggcgtcgatccgggcgtgatcatcaagaacgacgtcgcgcaggcaaagtgggaattcgcagtcagtagggagcaccggcactgactcgagctcagctcagaacacaatgtctcagatggagttggtgtccccagcctcctctgcgccgcggcaggaggtcatgatggtgaccactgatgattacagctacaagccaggcctcgccgctgcgcccgctgctgccgccccgccgagctttcagcagcaccacccgctcccgctgcagctgcacggaggagagggagggggagaccatgacaagacggaacggcggctggcgcagaacagagaggctgcgaggaagagcaggctgaggaagaaggcttacgtgcagcagctcgagactagcaggatcaggcttcagcaggtcgagcatgagctccagagagcacggtcacagggcctgttcgttggagggtgcagcgccgccggggacatgagctctggcgccgccatgttcgacatggagtacgcgcggtggcttgacgacgacaccaagcggctggcggagctccgaggcgggctgcaggcgcacctgctggacggcaacctgggactcatcgtggaggagtgcatgcagcactacgacgagctgttccagctcaaggcggcgctcgcgcgctccgacgtcttccacctcctcaccggctcctgggccacccccgccgagcgctgcttcttctggatgggcggcttccgcccgtccgagctgctcaagatcctgataccgcagctggacccgctgacggagcagcagctgctggggatctgcaatctgcagcagtcgtcggagcaagcggaggaagctctcgcccagggcctgcaccagctgcaccagtccctggccgacacagtcgccgcgggcacgctcaacgacggcgccgccgcccccaactacatgaacatcatggccgtcgcacttgagaagctcgccagcctcgaaaatttctatcaacaggccgacaatctaaggcaccagacgttgcatcagatgcgccggatcctgaccactcggcaggctgcgcggtgcttcctctccattggggagtactacagccgcctcagagctctcagcaacctctgggcttcccgtccccgcgagtaagattcagacttgatcaactgcaaaaactggagtttattgttgatcaactgcactgtagttgttcccaactcccaagcatgccttaatcacatgtattccttcgggtttttttttgaaagatagaaccacttgttttcagatttcattaggccttgttcgtttgtgccggattggtgggtcggaacgattcctagccggattgcttctctaatttatataaactttgattagctggaacaattccgggtgcaatccgatagaaacgaacaagaccttatatgaaaagtcagaaatggacatggctgacactggcaaaaaaaaaaaaaaaaaaaaagg

SEQ ID NO: 1484 - DNA, 1991 bp, Zea mays
  Predicted polypeptide sequence is orthologous to G1198
caattttgctcttttatatagtccatcgccaccgcccacagcgacttcctgctggtctcttgttggtcgtagaactagcagtggccatggtgcaaggcgaggagagttcttggaggatggagagggcagcgctgcctctcaaccagctggcgctcgcgtacggagtccaagcccacgccgccgccgccgccgccgcggctgcaccgccgacctgcttcctggacttccagcctgcggccgcatccgctgcctacttcgggttcggtgagctggaggaggccctcatccacggtggtggcgccgccagcgccggcggcggcgtcgatccgggcgtgatcatcaagaacgacgtcgcgcaggcaaagtcagcggcaggatatctcgcgggcgctggcaccggcaggccccccacgctggagatcttcccttcgtggccaatgaggcaccaacagcagctgcacagtgggaattcgcagtcagtagggagcaccggcactgactcgagctcagctcagaacacaatgtctcagatggagttggtgtccccagcctcctctgcgccgcggcaggagatcatgatggtgaccactgatgattacagctacaagccaggcctcgccgctgcgcccgctgctgccgccccgccgagctttcagcagcaccacccgctcccgctgcagctgcacggaggagagggagggggagaccatgacaagaggaagcatggatccacaagaaaagatggcaagttggtagatgccaagacggaacggcggctggcgcagaacagagaggctgcgaggaagagcaggctgaggaagaaggcttacgtgcagcagctcgagactagcaggatcaggcttcagcaggtcgagcatgagctccagagagcacggtcacagggcctgttcgttggagggtgcagcgccgccggggacatgagctctggcgccgccatgttcgacatggagtacgcgcggtggcttgacgacgacaccaagcggctggcggagctccgaggcgggctgcaggcgcacctgctggacggcaacctgggactcatcgtggaggagtgcatgcagcactacgacgagctgttccagctcaaggcggcgctcgcgcgctccgacgtcttccacctcctcaccggctcctgggccacccccgccgagcgctgcttcttctggatgggcggcttccgcccgtccgagctgctcaagatcctgataccgcagctggacccgctgacggagcagcagctgctggggatctgcaatctgcagcagtcgtcggagcaagcggaggaagctctcgcccagggcctgcaccagctgcaccagtccctggccgacacagtcgccgcgggcacgctcaacgacggcgccgccgcccccaactacatgaacatcatggccgtcgcacttgagaagctcgccagcctcgaaaatttctatcaacaggccgacaatctaaggcaccagacgttgcatcagatgcgccggatcctgaccactcggcaggctgcgcggtgcttcctctccattggggagtactacagccgcctcagagctctcagcaacctctgggcttcccgtccccgcgacaacttcatcgggacagagagcctcagccccacagcaacggaactgcaagccctgcaccaccagcagcagaaccagttcgccggattttgaggcctcacctggtgagggagggtgtaaaactttggccgcgagggtggtgttacaaagattagaggttttgagagggagatgcattgtaatgttctatcattaaagtactgagaaagcaacatcactaggcgaaaagggcggggagaaggaattgctgtagtgcgatgttgggtggctcacctgttcatatggctcttgaactgattgaagggttagcaccgcagaattttttgcgggtagcagcagaaaacaaagcagtggcagaagattctggctgctcacttgccagagagcact

SEQ ID NO: 1485 - DNA, 965 bp, Zea mays
  Predicted polypeptide sequence is orthologous to G1198
gcagatcgcttgcgcagaaccgagaagctgcgcgcaaaagccggctgcgaaagaaggcttacatccagcagcttgagagcagcaagctgaagcttgcccaaatggaacgggacatgcagagagcacactcccagccccagggcgtctttcttggaggagctccaggtgcaaacgccagctcaggcgcggcaatgatcgacgcggagtacgcccgttggctggatgaccacggccagcgcaaggccgagctacaaggagctctgcaagcgcacttgcccgacggtgatctccaagcgatcgtggatgacaccctgacccaccacgacgagctgttcaggctgaaggcttcagcagccaagtccgacgtgttccacgtcatcaccggggcgtggacgacccctgccgagcggtgcttcctctggatgggtggattcaggccatcggatctggtcaagacgctgctgccccagctagaccccctgaccgagcagcaactggtaggcatatgcaaccttaagcagtcgtcacagcaggcagaggaagctctctcccagggcctggaccagctgcatcagtcactagctgacaccatggccaacggatcgctgatcgacgacaccagcatgagcttcatgggtcaaatggcccttgcccttggcaagctgtccagccttgaagtttttgtgatacaggctgataacttgaggcagcagactcttcatcagatgcgccggattctgacagttcggcaggcagctcgctgtttccttgccatcgccgggtaccagaaccgcctgcgcgccctaagctccctctgggtttctcggcctcgagagatactggttgcagatgaaggcgactgtggggagatgagcgctgcagcatatgcaggcatcccaaagccaatttccgtccttctgattcaggcatgactcggagctctaaccaaccttctgactcaggag

SEQ ID NO: 1486 - DNA, 1359 bp, Zea mays
  Predicted polypeptide sequence is orthologous to G1198
ggctcgaggcttggcccagggagttgcaacctgcagcagctgctccttattactttggtgagttggaggaggcccttatccatggcacccgtacatctgttgatcacggcatgatcggaagtgatgtggacacagagcgtaagacagctggataccttgcagctaggccccccacactggagatcttcccttcatggccaatgagtcatctacagcagccatacagtggtaactcgcactcagtagggagcaccactgagttcgagctcaggtcagaacagtatgccacagaccgagctggtgtccccagggagcatgagggccgactctggacagcgtcaggagcttttgatggtgactgttgatgattacaactacgagcaaggactcggagccgcagcaaccacagctccaatctttcagcagcatgcagcaggccaagacaagggaaagcatggatccacaaggaaagacggcaggctgttagacgccaagaccgagaggcgattggcccagaacagagaagctgcgaggaagagcaggctgagaaaaaaggcctacgtacagcagctagagacgagtcggatcaggcttcagcaaatcgagcaggagctgcatggagcacgctcacagggtctgttcccgggaggaggtggtgcggctggagacttgagttcaggcgctgtgattttcgacatggagtacgcccggtggctagaagacgacgcctcgcgcatgacggagctccaggccgtgctgcagccccagatcatcgacgcgaacctgggggccatcgtcgaggactgcatgcggcactacgacgagctgttccacctgagggccatgctcgcaagatccgacgtgttccacctgatgaccggcctgtgggcgaccacggccgagcgatgcttcctctggatgggagggttccgtccttctgaaatcctcaagatgctgataccgcagctcgaccctctcgcggagccgcagctgctagggatgtacaatctgcaacggtcgtcggagcagaccgaggaggcgctcgtgcaggggcttcagcagctgcaccagtcgctggcggacgccgtgggcgctagtcctctcagcgacggcgcgaatgtcgccaactacaccgctctcatggccctggcacttgacaggctcgacaccctcgagagcttttaccgccaggcggacagcctgaggcagcagaccttgcaccagatgcggcggatcctgacgacccgccagacggctcggtgcttcgtctccatcagcgagtaccaccgccgcctccgcgccctcagctccgtctgggcatcgtcccgccctccaactcctccaagcgagggcgtcgtt

SEQ ID NO: 1487 - DNA, 1786 bp, Zea mays
  Predicted polypeptide sequence is orthologous to G1198
ggctttgcttttaccccccaaccttttcgacaggaccctgcttgctctacagggttctcccggaggcagaaactctttgcttccgcctggctcgcgatgcttgtttgggtgcgcgggcctgcggcgaggtgaggcgacggcggcgccgggcggttgcatggtggccgatggagagtagacggggagggtcgtcggcggcggcggcggaagatgcgggcggggcgatgccgagctttgggccaacgcagcacgccattcgcgcaggcgcagatgtgaacagcatgcaaccttctcgagttactgactttggggcactggcacagtctgctggattccgaatagaagatcttgctaaccttaatgcaaatgctttgttcaatctgaagccaaattctcatacgattgacaacagtcctctccagtttggaaattacggaaagtctatttcttctcatataaatactacagaagcaacaacagctgcaacaagaattgaccctcagctgtcagcacagcaaacaggagcacaaccaattctggtggcgttaccaactggtaacatggagaattggggagagtcagctatggctgatagccctatgactgacacatctacagatccagacactgatgagaggaaccagatgtttgaacaaggacttgttgctgtccccacagcatctgattctagtgacaaatcaagggacaaactagatcagaagacacttcggcgtcttgcccaaaatcgtgaagctgccaggtaaagccgtttacgaaaaaaggcatacatccaaaaccttgagagtagcagactgaaacttactcagttagagcaagagcttcagcgggctcgtcaacagggtatttttatttcgacatcaggcttttatgttcatgttgtctgatctgtaggagctttggcatttgacatggagtatgcacgctggttggaagagcacaacaaacatgtaaatgagttgaggcttgcagtcaatgcacatgccggtgataatgatctccgtggtattgttggtagtgttatggcacactacgatgaatttttcaggctcaagggtgtggcagctagatcagatgtttttcatgtgctgtctgggatgtggaagacccctgctgagagatgtttcatgtggttaggtggcttccgatcatctgaggttcttaagttactggcaggtcacctagagcctcttactgatcagcagcttgttggtatatccaacctgcagcagtcctcccaacaagctgaagatgctctttctcaagggatggaagcattacaacagtcgcttgcagaaactctagcatctggatccctgggccctgctggaccttctggcaatgttgcaaattacatgggacaaatggcgatggctatgggaaaacttggcacccttgagaactttctacgacaggctgataatctacggctgcaaacacttcaacaaatgcaacgcatcttaaccacccgacaatccgcacgagccctacttgcaataagcgactacttctctcggctgcgtgctttgagttctctttggcttgcccgtccaagggaataaattcaattaactcataactaggataatttttttgtactgtttctagtatggccattagtttcttcagaacgctcatgtgtcagtgagatatttggatcatattgtaggccatcatggtttactggacaactttgtaacaattttggagagaaaaaactgagttgtaaatacatctggaataatctaagatcttatgaaggggaaaa

SEQ ID NO: 1488 - DNA, 2252 bp, Zea mays
  Predicted polypeptide sequence is orthologous to G1198
cattgggaccctcgaggccggccggaccccggggccggccgcgccgggacgtgctgcagagcctgcagaggcttttcttccccccaccccacccatcgcgtgtgagtccacggtgtgatgtcacggagcggtggcggctttcccgattcactgtgcgggagaaatccccgtgcagccttcttccacctcctcctactctccgctattcgtcttcgctgatttctgccgctccaattccatcgcttccctgctttagaaccttctctgctagcttctccccgtcacagcttttggtgcctcgtcatcggcgaccaaaccgccggcgaccggataaactaagccagctccttcgctccgaaagtcgtctctcgtagagagcacttgctcacctgctccccgccccccctctactggcgctggacttgctcggagtggagatccatccggacctggttcgatttcttcatttcgggttcgattcggtttttctatcccagagcgaaagatcaatatcacctgacacaacataacgatttcgtggaagccgaggttgcttctctgctcagtgggtggataactggattgtggattttgctaactacatgctgggttatcagcctatcataaggaaagcaaagaagagacaacaaagcaatttgttgtctctttcttaggagctggcgagtactcggcatggcagatgctagttcgaggactgacacctcgactgttttagacatggatgataagaatcaaaggttagaaaatggacagagtggagctatggccctggcttcgaattcatctgatcggtctgacagatctgacaaacctatggaccaaaaggttttacgacggcttgcccaaaatcgtgaggcagcaaggaaaagtcggctgaggaaaaaggcatatgtgcaacaactagagagcagcaagctaaaacttgcaagcctggagcaagaactccagaaagctcgacaacagggaatcttcatatccagttctggagatcaaactcatgctatgagtggaaatggagctatgaccttcgatttagaatattctcgatggcaagaggaacaaaataagcagataaatgagctgaggactgcagtaaatgctcatgcaagtgatagtgacctccgtcttatcgtcgatgggataatggcacattatgacgagatattcaggctgaagggcattgctgcaaaggctgatgtgttccatatactttcaggcatgtggaaaacacctgctgaaaggtgcttcttgtggcttgggggtttccgttcgtctgagcttctaaagctccttgtgaatcagcttgagcctctaactgagcagcaattgatggggctatccaatctgcagcaatcttctcagcaggctgaggatgcattgtcacaaggcatggaagcattgcagcagtccttggcagaaacgctggctgggtcccttggtccatcaggatcttctggaaacgtggcaaactatatgggtcaaatggctatggccatgggaaaacttggcacactcgagaatttccttcgccaggctgacaatctacgacagcagaccttacatcagatgcaacgtatcctgacaatccgacaagctgctcgtgcgcttcttgcaatccatgactacttttcacgtttgcgcgcactgagttctctttggcttgctaggccacgagagtaacatcacccccgttggggtcactcgatgaactgatctgtgaatgtgggactgctggctgcaaactcgcaaagcatttgcagatgactggaggatcagtcctctctgtacaagttgtattaacatcttctggtctcatattgtgctccagtgttgtacaatttagggaaaagcttggattaacttgtaagttatcatgaatttgttattggcatattgtacaattgtattagcaataaaaatagaagtacataagtgctggaaggactatccagcgtctatattggttggaaacgagcagcagaagcttgtcatgtcgattgttttccttgaatagtcggttgaagtgttcttttgggggtctatagagaacaaagaaagcttcaggagaaatgtataggtattcaccagtctaccatagagtgtgtgcttcggggagctccttgtgatggtaaaatttgataacgaggatgagttctgtgacattaaaaaaaaaaaaaaaaaaaaaaaaaaaaaaaaaaaaaaaaaaaaaaaaaaaaaaaaagggcggccgc

SEQ ID NO: 1489 - DNA, 1821 bp, Zea mays
  Predicted polypeptide sequence is orthologous to G1198
ctcgaggccggccggggtccgtctcataccatcccatcccatcccatcccatccccgtgcgccgagttcacggccgccaccaccaccaccacaaccgattgcacaaggccacgcggcttctggaagcttcccttcccttgccttgccttgcctctcaacccaaatcgccacggctccctccgcccgcagcgccctcggcacgaccgccggattcgcctctgggtggggttggttttgtctcccccaccaccctacccacccctctcctctcctccaaggcttggcttgcctcgtgtcgtgtgtccctccaccgcccgccatgccgacgaggcttgccccccaccgccgatcgcacacggtcatatgattgcaatgaatcctgacatggtactactgtcttggaaacaaatggagaatggaagtggtgcggttgtaccttctaattcttcagataggtccgacaggtctgataaacctttggaccaaaagacaatgcgacggcttgcccaaaatcgtgaggcagcaagaaaaagtcggctgaggaaaaaggcatatgtgcagcagctggagagcagtaagctgaaacttgcacaactggaacaggaactccagaaagctcgccagcagggaatcttcatttctagctctggagaccaaacccatgccatgagtggaaatggagctttgacttttgacatagaatatgctagatggctagaggaccaaaataagcagataaatgagttgaggactgcagtgaatgctcatgcaagtgacagtgatctacgacttattgtagatggcataatggcacactatgatgaaatattcaaggtcaaaggtgttgctgcaaaggctgatgtgtttcatatactttcaggcatgtggaagacacctgctgaaaggtgcttcctatggcttgggggttttcgtccatctgagcttttaaagctcctagcgaatcacctcgagcctctaactgagcagcaaatgctgggtttgaccaacctccagcaatcttcccaacaagcagaggatgcgttgtcacagggcatggaagcactgcagcaatctttggcagagactttggctggatctctcggtccagcaggttcttcaggaaatgtggcaaactacatgggtcagatggccatggccatgggcaaactcgggacgctagagaattttcttcgccaagccgacaacctgcgacagcagacgttgcatcaaatgcaacgtatcctaacgatccgacaggcttctcgtgctcttcttgcaatccacgactatttttcacgattgcgcgctttaagttctctgtggcttgctaggccacgtgaataacgaagggccgtcagtattttgagttccctctgccttacggtgctgctgcgtcgttcgcagcgatgcatcacagatctttggtggtactgtttttgttgtacaattacttttggccgctgcttggtccaaattgtactcaggtgggtgtacaagtaggtcaatataatcctgtaagttatggtgatttatgggtgtgttagcaatgcaataataattagagagggcaggatcagggtttctgttgtttgtactggttagagatttagtcctaatgtaacttcctgggacatggggggcggaatgggaagagagtaacaagaatcttcctttggttactgtagtatatgttggtattgttgcatcccatttgctcattttgctgttaggagaatgattattctgtccctttggggactttttgagcggccttgtttgtaacccccacatgattatggatatgactgctagttccttccc

SEQ ID NO: 1490 - DNA, 2154 bp, Zea mays
  Predicted polypeptide sequence is orthologous to G1198
cattctttttttcgtgtgttttttttgtgtgatgtcactgatcgttgtttttttttttgttttttgtgttttagaaatccccgtgcagccttcttccagctttttctactctttgctactcgtcttcgctgatttctgccttaattccatcccttccctgcctagaacttgctttgcttcaccccatcacagcttttggtgcctcgtcatcggcgacctaaccgccggcgaccagataaactaagccaggcccttcgctccgaaagtcgtctctcgtagagagcacttgctcacctgctcctcgccctcctctgctggcagtggacttgcgcggagtggagatccatccggacctggttcgatttcttcatctcggttgcttctctgtccagtgggtggatcactggattgtgggttgtgctaactgcaggctggcttgtcagcctatcataaggaaagtgaaaaagagacaacaaagcaatttgttgtctcattcttaggagctggcgagcactcggcatggcagatgctagttcgaggactgacacctcgactgttgtagacatggatgataagaatcaaaggattattttacgaaatttcaacttctctctgtgggacatctaatggtacaggtcttggagagatgcatgtaaagtgttagaaaacggacagagtggagccatggtcccggcttctaattcatctgaccggtctgacagatctgacaaacctatggaccagaaggttttacgacggcttgcccaaaatcgtgaggcagcaagaaaaagccggctgaggaaaaaggcatatgtgcaacagctagagagcagtaagctaaaacttgcaagcctggagcaagaactccagaaagctcgacagcagggaatcttcatttctagttctggagatcaaactcatactatgagtggaaatggagctatgaccttcgatttagaatattctcgatggcaagaggaacaaaataagcagataaatgagctgaggactgcagtaaatgctcatgcaagtgatagtgacctccgtcttatagtcgatgggataatggcacattatgacgagatattcaggctgaagggcattgctgcaaaggctgatgtgttccatatactttcaggcatgtggaaaacatctgctgaaaggtgcttcttgtggcttgggggtttccgttcgtctgagcttctaaagctccttgtgaatcagcttgagcctctaactgagcagcaattgatggggctgtccaatctgcagcaatcttctcagcaggctgaggatgcattgtcacaaggaatggaagcattgcagcagtccttggcagaaacgctggctgggtcccttggtccatcaggatcttctggaaacgtggcaaactatatgggtcaaatggctatggccatgggaaaacttggcacactcgagaatttccttcgccaggctgacaatctacgacagcagaccttacatcagatgcaacgtatcctgacaatccgacaagctgctcgtgcgcttcttgcaatccatgactacttttcacgtttgcgcgcactgagttctctttggcttgctaggccacgagagtaacatcacccccgttggggtcactcgatgaactgatctgtgaatgtgggactgctggctgcaaactcgcaaagcatttgcagatgactggaggatcagtcctctctgtacaagttgtattaacatcttctggtctcatattgtgctccagtgttgtacaatttagggaaaagcttggattaacttgtaagttatcatgaatttgttattggcatattgtacaattgtattagcaataaaaatagaagtacataagtgctggaagcctggaaggatatccagaatctatattggttggaaacgagcagcagaagattgttatagattgttatgttgctttgaatattcggttgtaagtgccttttttggggtatatagaacaaagaaagattcaggagagatgtagggattcaccagaggctatcggggattgtgcttctaggagctccctggactatctctagcaagtctcatattaagctctactctgtaaacagtgatacattgaattgaacgtgctacggttatgatggtaacatgtaaaaaaaaaaaaaa

SEQ ID NO: 1491 - DNA, 978 bp, nicotiana tabacum
  Predicted polypeptide sequence is orthologous to G1198
atggctgatatcagtcctagtacatcaacagatgccgatacggaagataagaacaggttcctaaattctcaacaactgggtgcggtagcttctgatggaagtgacaggacaagagatcagaagacacttcgtagacttgcccaaaatcgtgaagcagctcgaaaaagtcgtctaaggaaaaaggcatatgttcaacagttagagagcagccggatgaagctgacacaactagagcaggaacttcaacgagctcgacaacagggcatatttatttcaggttcaggagatcaatcacagtcgatgagcggaaatggagctttggcatttgatgtagaatatgcccggtggttggaggagcagaaccgacgaattaatgagctaaggggagctgtaaattctcatgctggtgatggtgaacttcgcataattgtcgacggtatcttagcacactatgatgacatattcaggataaaaggggatgctgcaaagtccgacgtttttcacatattgtcgggcatgtggaaaactccagcagagagatgcttcttgtggcttggtggattccgttcgtctgaactcctcaagctcctcattaaccagttggagcctttaaccgaacaacaattattggcaatcaacaacttgcaacagtcatcccaacaggctgaagatgctttatcccaaggaatggaggcactgcagcagtctttggctgagactctggcggggtcccttggaccttcaagttcctcagggaatgttgccaattatatgggtcaaatggccatggcaatggggaagctcggaactctcgagggcttcatacgacaggctgataaccttcggcaacaaacattgcagcaaatgcatcgtatattgacaactcgccaatcagctcgtgctcttcttgcgatcagtgattatttctctcggcttcgagcactgagctctctctggcttgctcgcccccgggaataa

SEQ ID NO: 1492 - protein, 423 aa, Oryza sativa
  Orthologous to G1198
MPFAAEFDMLAFNNPIELLSNAYVLCMGPTHRSIKLGTTRKQYKQLGFPIKKAGKVCLWHVFLEPGQLALAAASDSDRSKDKHEDQKTLRRLAQNREAARKSRLRKKIHGKWKSFAKILWGITCKNRLGMGIGCWSGHGRELQGYIGMQDLQSRTVPSNSGQLQAYVQQLENSRLKLTQLEQELQRARQQGIFISSSVDQTHSMSGNGALAFDMEYARWLEEHNRQINELRSAVNAHAGDNELRGVVDKIMSHYEEIFKQKGNAAKADVFHVLSGMWKTPAERCFLWLGGFRPSELLKLEPLTEQQLSGIANLQQSSQQAEDALSQGMEALQQSLAETLAGSLGSSGSTGNVANYMGQMAMAMGKLGTLENFLRQADNLRQQTLQQMQRILTTRQSARALLVISDYSSRLRALSSLWLARPKE

SEQ ID NO: 1493 - protein, 357 aa, Oryza sativa
  Orthologous to G1198
MGAYDRPPPVGMWSHEQFKVDNGQATSASTIMEAEMKFENRLEEIPQVVLEEGRNVDQEASKPPDKVLRRLAQNREAARKSRLRKKAYIQQLETSRLKLAQLEQELQRARQQAVYANGSLREPNLGFTGPIDPGALGFEIKYSHWVDEQNRNTGELRNALLQGQTTDQDLELKLLVEAGLDNYNRLFEMKEEAANSDVFYIMSGMWKTPTERFFLWIGGFRPSEVLKNLRPQLEPLTDKQVVEVGGLQQTSMQVEDALSQGMDKLKQTIADSLTAADPFDSPEAYMVHMANAVEQLRSLVQFVTQADHLRQQTLQEMHRILTTRQAARGLLALGDYFQRFRALSSLWAARPRDSGIS

SEQ ID NO: 1494 - protein, 292 aa, Oryza sativa
  Orthologous to G1198
MADASSRTDTSIVVDNDDKNHQLENGHSGAVMASNSSDRSDRSDKLMDQKTIRRLAQNREAARKSRLRKKAYVQQLESSKLKLAQLEQELQKARQQGIFISSSGDQTHAMSGNGALTFDLEYTRWLEEQNKQINELRTAVNAHASDSDLRLIVDGIMAHYDEVFKVKGVAAKADVFHILSGMWKTPAERCFLWLGGFRPSELLKLLANHLEPLTEQQLLGLNNLQESSQQAEDALSQGMEALQQSLADTLAGSLGSSGSSGNVANYMGQMAMAMGKLGTLENFLCQASIFTF

SEQ ID NO: 1495 - protein, 366 aa, Oryza sativa
  Orthologous to G1198
MAPSSLLIIFFLLPTSRSSALQQHGVAVVGMAAHQGMAAATAADRFCLPRMAAAAAAASQVENWGDSGVIVSSPFTDDTSTDLDDSADKHHLHALVGGGDGGDDAGEQRGADSSAVSKERRGDQKMQRRLAQNREAARKSRMRKKAYIQQLESSRSKLMHLEQELQRARQQMSDDELCELVDAVMMHYDQVFRLKSFATKSDVFHVLSGMWMSPAERFFMWLGGFRSSELLKVLASHLEPLTDQQLMGICNLQQSSQQAEDALSQGMEALQQTLGDTLVSAAATVVSGGGGADNVTNYMGQMAIAMAKLTTLENFLRQADLLRHQTLQQMHRILTTRQAARALLVISDYFSRLRALSSLWLARPRD

SEQ ID NO: 1496 - protein, 519 aa, Oryza sativa
  Orthologous to G1198
MEGGRLGGAAASASAAAAADARGGMSGFAAPQHAIVKHGPGSVTHCGGKWTFAELCQSEQIWVLDCYCMQWACKFATNATECHTNLNNVQPTQVTDFGALAQSAGFRIEDLANLSTNGLFNLKSNAHTIINDPLQFENYVKSISPSNITTTATVTVVDPQTLVPQKGAQLNLVTIRTGNVENWGESTIADTSPRTDTSTDPDTDERNQMFEQGQLAAPTASDSSDRSKDKLDHKTLRRLAQNREAARKSRLRKKAYIQNLESSRLKLTQIEQELQRARQQGIFISTSSDQSHSASGNGALAFDMEYARWLEEHNKHINELRAAVNAHAGDNDLKSTVDSIMAHYNEIFKLKGVAAKADVFHVLSGMWKTPAERCFMWLGGFRSSELLKLLAGQLEPLTEQQLAGIANLQQSSQQAEDALSQGMEALQQSLAETLASGSLGPAGSSGNVANYMGQMAMAMGKLGTLENFLRQADNLRLQTLQQMQRILTTRQSARALLAISDYFSRLRALSSLWLARPRE

SEQ ID NO: 1497 - protein, 399 aa, Oryza sativa
  Orthologous to G1198
MGIYDRRHHPLAAGVWGDHPFIRPDTTASTSNAAAAAMVVAPPPLTEPKFESQLALPLQHGDDQDNAAALQESPRHASDSFEQEASKPRDKIQRRLAQNREAARKSRLRKKAYIQNLETSRMKLAHLEQEITRARQQSAYINRSSNPATLPAPIDSGVVTFEVEYAQWVEEQGRQTAELRASLQAAAEGPELRAVVEAALAHYDRLFAAKREAARRDVFFVMSGVWRTGAERFFLWIAGFRPSEVIRVLAPQLEPMTERQAADVQGLQQKARHLEDALSQGMDKLKQTLADSLLAEAVVVSTSCDASPPPPPPEEEEPSSSAAGDGGCYMAQMGSAMGRLSNLVAFVDHADHLRQETLQNMYKILTLPQAARGLLALGDYCQRLRALSSLWAARPREPA

SEQ ID NO: 1498 - protein, 480 aa, Oryza sativa
  Orthologous to G1198
MASMAPPCPTPWLLQTSYHSGQQIYSQQVVDLMLHVLISLLNLHWPDTDSEQGGGGGGGAAYFGELEEALVHQVATLRRRAQQTATTTTSHHGHTTPFSTAAAAATATATARPPATLDIFPSWPMRRSSLPTPKDGCSNVTADTTDSESSSKNNGDQGAAAADMASQFDQIPQQQQKQHKKMAASSTHSDHRMTKTLDPKIMRRLAQNREAARKSRLRKKAYIQQLESSKLRLAQMEQDLERARSQGLLLGGSPGGNTSAGAAMFDAEYGRWLEDGGRRMAELHGGLHAHLPDGDLRAIVDDALAHYDELFRLRAAAAKADVFHLITGTWATPAERCFLWMGGFQPSDLLKTVAPQLDPLTEQQVVGICSLQQSSQQAEEALSQGLEQLHQSLAETVANGGSVVNEASLGSFMGYMALALGKLSNLEGFVIQADNLRQQTLHQMHRILTIRQAARCFLAIGEYHNRLRALSSLWASRPRE

SEQ ID NO: 1499 - DNA, 463 bp, Zea mays
  Predicted polypeptide sequence is orthologous to G1225
tttctcgccgtctgatagtgcagcaggagacaggccgacaaccaccgctgccagaatcactacctagagagagacacgcggggagctgctagtaggcaggaccaactcaagatgccccagacaatgacctgccgcagatggcactctggaaggaggaaccgtcaggacgatgttttttagaggagagggaggaggaagcggagagccagcagatgacccacattgctgtggaccgcaaccgacgcaagcacattaacgagcacctcagcgcgctacgatcactcatgccgtcagaccacacgcatcggggcgatcaggcattcatcgagatgcggctcgatcaactgcggcaaggagctggatcagctgctgcagacgctggaagcccggaggccacacccgcagggcagtgcctacgcacgaaatcccgacgacacggccgccgaagcggactaactcacct

SEQ ID NO: 1500 - protein, 362 aa, Oryza sativa
  Orthologous to G1225
MALDTLCSAGGDVLIYDTFNASAAAAAAVVPPASFLFGNNNAGGAAGTETRVQVAAGAVPEVDQLLKQAQQPGRRKRRRRARSCKSREDAESQRMTHIAVERNRRRQMNEYLAVLRSLMPESYVHRGDQASIVGGAIDFVKELEQLLQSLEAQKRTLLMQPPPPPQQQREPKCDAADSTSAADQETPAAAAAAAAADGPPFARFFTYPQYVWCHNPAQDGGGGGGAAAENRAGVADIEVSLVETHASIRVMAARRPGQLLKMVAGLQALRLTVLHLNVTALGSLALYSISVKRFHGGKAIASLGPLGVFFLCALYLWYSTTVVEEGCGMATVDDIAAAVHHVLCIIDAEAASQMLLAGEASG

SEQ ID NO: 1501 - protein, 218 aa, Oryza sativa
  Orthologous to G1226
AAAPPVTAPATRAERRRKRPRPRPRAAPPPEKRKKPEEAENQRMTHIAVERNRRRLMNDHLASLRSLIPSNYIPRGDQATVVGGAIDYVKQLEQQLVALQAAAAERSGVGVVAAAATAASDGVFVSPQYTSYSEARGGSGVDVEATAAVGGHVRVRVAGRRWTGRLVRAVAAMEDLRLTVLHLAVTSVGHDAVVYCFNLKVKTTTTLHHLLLHVPSFF

SEQ ID NO: 1502 - DNA, 431 bp, Glycine max
  Predicted polypeptide sequence is orthologous to G1229
atcgttcatgtcaacattaactgtgctgcggatgataccatgctaaactcattcactatcaagattggaattgaatgccaactcagtgccgaagaactcgctcaacaaatccagcaaacattctgctaattataaaagatgggttatgtttttccagagtccagaccaaacatcagcttgcatgcatccctctctctctctctctcttctcttattgtgttgtacgtaccttgctgtacaaataacatagaacatgggaagagccatatttaatttttcaaccatttatcatttttctttctttttaattattacagcaattgctagtgtaattcctcatgatgacaagtattagctagtttattagtatagagtgacaccactctcttgtaattgaccaccgtacgtcaagctgtgatttgtgtatgaat

SEQ ID NO: 1503 - protein, 401 aa, Oryza sativa
  Orthologous to G1229
MGDALCDQLLLVDSDGGEFIPHHADADADDLFTILETWEGCANVVAGGAPATTTTLGSPIAAAACISGVVGGQNHQQLPEPAAAKTVPATNNKRREEEVADRDGDGDDDDGSPQKRRKCCSPESSTTDVAAATTPKTAHIAVERNRRKQMNENLAVLRSLMPCFYVKRGDQASIIGGVVDYIKELQQVLHSLEAKKQRKVYTDQVLSPRPPATVAASCCSPRPPQLSPRLPPQLLKSTPPLSPRLAVPISPRTPPTPGSPYRLLRLPPPPPPASGSNYASPAMTPTHHETAAPSLDAIAAELSAYASRQALGGGLLLPDVKVEFAGANLVLKTVSQRSPGQAVKIIAALEGRSLEILHAKISTVDDTAVNSFTVKYIFGQIGIECELSAEELVQVIQQTFT

SEQ ID NO: 1504 - protein, 415 aa, Oryza sativa
  Orthologous to G1229
MADGGGGGLCELFSDDHRDIRHVADADLFRILETWEECINGGAGGGGGGVSLAGVADQGAAAASTGAGGGARTTTTTTAANGRRREGRDEEKGGGGGGGPPAQKKQKGSSSSSSSPPALAAAVGDGDGAAKMSHITVERNRRKQMNEHLAVLRSLMPCFYVKRGDQASIIGGVVDYIKELQQVLRSLEAKKNRKAYADQVLSPRPSPAAAALMVKPTPPISPRFAAAAAAGVPISPRTPTPGSPYNKHAAAAATARPPHPAAATSSCSVAYSMSPAMTPTSSSSTTTTTTHELSPAPAFLPILDSLVTELAARGGASCRPLVIPSSAAAIAGIVGVPDVRVEFAGPNLVLKTVSHRAPGQALKIIAALESLSLEILHVSICTVDDATVLSFTIKIGIECELSAEELVQEIQQTFL

SEQ ID NO: 1505 - DNA, 1834 bp, Glycine max
  Predicted polypeptide sequence is orthologous to G1255
attcggctcgaggcataaccaataattgaatttgaatcatttgggtctctagacacaaacactaccccctctttccccctcctcaacattgttatgatcccttgttggtaaccattccatttgcacttgtctttgcaaccaaaaaacaagctctatgaccaacgaaatgaaagaagcaagtgccttaggagctagaacagcacgagcatgcgagagctgcctaaaagtaagagcacggtggtattgtgcagctgatgatgcattcctttgccatggctgtgacaacatggttcactcagcaaaccaattagcaagtagacacgaaagggttaagcttcaaactgcatcctctaaggtcaactactcagtgacccctaaggtagcatggcacagtggattcacacgcaaggcaagaacgccacgccacaacaacaacagacactcatcattgaaacaacaacaacaaaaaaaaccattacatgaagaacgaggagaggaagaagtgtttttcaataacactattagtcttcttccccttgtgcctgagcttggaagtgaagagccattgcttaatgatgagactgaggagcaactactgtgtcgcgtgccggtgtttgatgctgagctttgtagcatatacaatgaagtgaaggacgaggttgtagctgctggtgaagaagccttggacttggaaaacttttcttccgagtttcttccatcagatacggaccttgctgagtttactgctgatgtgaaaagctttcttggaaacggggctgatgaggattcacctgatgatgatgagcacgtgaaagaatcagaactactgattcttgattgcaaagaagaagaaggagatgaggaaatggatgaatgttttgatggagtactaattggagccaaagatgctatggtgggtgaaggtcaaagatgaagaagaacttgatgctgatgatgacacagcttgccatttggattcgattcttgatatgaacggcgaggcatttaattggaatattgttgaatcagaatcacctgcacaggcacaagaagatgaagtgagtaaagtgggaactaagaaggacatatttttgagattaaactatgaagaagtcattactgcttgggcaagtcaaggttctccatggactaatgggaccccacctaagttcttcaactctgatgattgctggctagacttcttgggttcgaatggtgggaatgttcaatgctgttatggggcagtgggaagcttaagggtgcatgcagatgggggaagggaagcaagagtgtcaaggtaccgagagaagagaagaacgcgtttatttgcaaagaagataaggtatgaagtgaggaagttgaacgcggagaaaagacctagaatgaaaggtcgatttgtgaagaggacaccctttgttggagccactgcgttgccagcttaatcatcaatcaccactgacatgattgatcatcaaagtgatcaaattaatggttaacttctccaagttaatttgattttatggaaaagttaatttttagattaattattagttacttggttttgccatatatgtacaatatcatcactaggtcaggtttctcttgcttgggatatttatttctttctctaacaggtctagctagtactaatggaaatgtggtagcccctctcagcattttgaaggctttggtaatcaatttcgggagccctttttcaatgttgcttaattatgatatatataagaatctgtaattaatctatgctgatgttatgtttacctttaactctgagggtactgattaacagtgtttaacatcaggtacttatatgtcc

SEQ ID NO: 1506 - DNA, 1494 bp, Glycine max
  Predicted polypeptide sequence is orthologous to G1255
tacggctgcgagaagacgacagaagggggttaaggtcaaagatgaagaagaacttgatgctgatgatgacacagcttgccatttggattcgattcttgacatgaatagcgaggcctttaattggaatattgctgagtcagagtcacctgcacaggcacaagaagatgaagtgagtaaagtgagaaccaataagaaggacatatttttgaggctaaactatgaagaagtcattactgcttgggcaagtcaaggttctccatggactacaggaaccccacctaagttcttcaactccgatgattgctggctagacttggtaacttctcttcaaccctctttgcttatgcagcagtatcttcttgtgtgtttggtttgacttatttttatgagaataaatttttcagttttcttatagtatcatagccgatctcatatatatctggctaaaggaggaaggttgtgttgcgtcttcagtaaccgatgtaaaattcgtcgatatacctgaaatcattcgtagggcggagatgtgttatgccttcggtaaccaatgcaaagttcgtcgatatacctaacatgaatcgctcacagtgagataaaattttgttgttgtggatacatgagagctctcaaaagaaaactattatatattttttattttttttaaaaaagaaaaagtctctcaacaagcatgcagctactcaattatgcacaattgtattgtataggtggccgtagctccttatgagttgtttaattacatagctgtgtttttagtttttgaagttgcaaaccaaaatactgagtttttaaaaaaaatttagaaatgaccatttaaattgttttgaagctcaaacttgatcatcactgtttctatagttgaaatgaaactttctaatttttattttattttgttaagggttcgaatggtgggggtgttcaatgctattatggggaagtgagaagcttaagagtgcatgcagatgggggaagagaagcaagagtgtcaaggtaccgagagaagagaagaacgcgtttatttgcaaagaagataaggtatgaagtgaggaagttaaacgcggagaaaagacctagaatgaaaggtcgatttgtgaagagtgttcctttgttggagccactgctttgccagcttaattatcaatcatcaccactgacatgattgatcatcaaagtgatcaaattaatggttaacttctccaagttaatttgattttatggaaaagttaatttttagattaattattagttacttggttttgccatatatgtacaatatcatcactaggtcaggtttctcttgcttgggatatttatttctttctctaacaggtctagctagtactaatggaaatgtggtagcccctctcagcattttgaaggctttggtaatcaatttcagaagccctttttcaatgttgcttgattgtcatcatatgaataaaaatctgtaactaatccaaaaaaaaaaaaaaaaaa

SEQ ID NO: 1507 - DNA, 1540 bp, Glycine max
  Predicted polypeptide sequence is orthologous to G1255
attcggctcgagaaacgaaaagccattgttacaagcatttcacacttaacatatcaaaaaaacaaaggtttctactttctacgatgagagacatgaaagacgcaggtgccttgggaggcaagacagcaagagcctgcgacagctgcgtaagcagaagagcaaggtggttctgtgcagctgatgatgctttcctctgccatggctgcgacactttggttcattccgcgaaccagttagcaagcaggcacgaaagggttcggcttcaaactgcttcctcaaaagtaaccaccacgcacgcatggcacagtggattcacacgcaaggcaagaaccccgcgtcacaacagcaagcactttgcgctgcaacagcgtctcaaagacgaagttctcttcaacaacaccagtgttcttcccctcgtgccggagctcggaggggaagaacaagaaccggtggttgtggataacgatgagacggaggagcagatgctgtgtcgggtgcccgtgttcgacccttttgatgtgagaaccgatgacttggatagtttttctgacatggatttcgctgagtttgctgctgatgttgaaagcctacttgataaagaagacgatgaaataagtgcgtgtgtgggagggggagagggagagggagagggagttcaagcgtgcattggccaaggttaaggatgaagaagaaattgatggtgatgtagcgtgttatctggaatcggtttttgatgatgcctttcattggaataacattgagtctgtgctgtcagatgcacgggaagagaaggagggtgtggtggcgtgtgatgtaggtgtcggtgatgaagaaggaggaacaaagagagacatatttttgagactaaactatgatgaggttattactgcttggtctagccaaggttcttctccatggacaacttcaaacccacctaagttcaactctgattatgacttctccttgggtttgagtggtgtaggtggggaagtaagaagcttaagagggcacctagatggtggaagagaagcaagagtgtcaaggtatagagagaagagaaggactcgtttgtttgcaaagaagataagatatgaagtaaggaagttgaacgcagagaaaaggcctagaatgaaaggtcgttttgtgaagaggacatgctttgttggagccaatgcttttcctgcttaccactgacatcaatcaattaacggatccatctttgctttttctgcaaatttgggttaatacttggtttggctatatatatgtacgtatatatagcctgtattatataaatactagtaaataatattactgggccaggttaattttactagaattgttgcttgggatatttctgtctatatatatctctagacaggtttagtaattagtactaattaatgatcatctttattggcaggtttaagccttttggaatccaattttggaagccttttcattgtttctcattagaaattcaattgttcaatgctgatgctgttatttgctagccagttgctatttcacgctgctgatt

SEQ ID NO: 1508 - DNA, 949 bp, Glycine max
  Predicted polypeptide sequence is orthologous to G1255
  misc_feature (409)..(410): n is a, c, g, or t
ccacgcgtccgacttaacaatggtttgtaagatatgagagacatgaaagacgcaggtgccctgggaggcaagacagcacgagcctgcgatagctgcgtaagcagaagggcaaggtggttctgtgcagcagatgatgctttcctctgccatgcttgcgacactttggttcattccgcgaaccagttagcaagcagacacgaaagggttcggcttcaaactgcatcctctaaggcaaccacaaccactacgcacgcatggcacagtggattcacacgcaaggcaagaaccccgcgtcacaacaacagcaagcactttgcgctgcaacagcgtctcaagaacgaagttctcttcaacaacactagtgttcttcccctcgtgccggagctcggaggggaagaacaagagccgnnggttgtggacaacgatgaaacggaggaacagatgctgtgtcgcgtgcccgtgttcgacccttttgatgtgagaaccgatgacttggatagcttttctgacatggatttttctgaatttgctgctgatgttgaaggccggcttgacaaagaagacgatgaaataagtgcgtatgtgggaggaggagagggagttcaaggtgtattggccaaggttaagggcgaagaagaaattgatggtgatgtagcgtgttatctggagtcagtttttgacatgatcagtgatgatgcctttcattggaataatattgagtctgtggtgtcagatgcccgggaagagaaggggtgtgtggtgccatgtgatggtggggttagtgaacaaggaggaataaagagagacatatttttgagactaaactatgatgaggttattactgcttggtctagccaaggttcttccccatggacaacttcaaacccaccttaagttcaactctgattatgacttctccttggtactactactacttaactttcctttt

SEQ ID NO: 1509 - DNA, 1465 bp, Glycine max
  Predicted polypeptide sequence is orthologous to G1255
cttgtttttttcccatcaaaacaatcattcccctgttaccaaaaccacactgtaacccccctttttttggtattggcttcaaatgagttcggctactaagaacgcggcaaacgcggttggggccaaaacggcaagagcatgtgacagctgcataaccaaacgtgcacgttggtactgtgctgccgatgatgcttttctctgccaggcctgcgactcttctgttcactcggcgaatcctttggctcgaagacacgaacgagtccgcttgaaaacggcgtcctacaagtccactgatgaacaacaacaacaacaacaacaacaacctcccacgtggcacactaagaaacctcgaacgccgaggcacgggaaacattctcgtaacaacaaccctttccatttggtccctgaagagggttcggaggaggcgaattcccatgatgagaacgaggagcagcttctttatagggtccccatattcgacccttttgttgctgagctatgtgggactaatagttctccttctcctgttacttcaactgatcaaggagtagttgctgctgctgaggttgaatacaaagggtttcaaagcaatggtttttgtagcaatagcagtgagatggaaaacttgcatgggatgcttccttctgatgcagaacttgctgagttcgctgctgatgtggagagcttgttgggtagggggcttgaaaacgagtgcgtggggatggaagaattgggactggttgatgcgaaagaggaggagtgttcggtaggtagtgggaaggtgaagatggaagatcaggaagagagccctctggtggagatggagatggatatggtcgtgggcagagatgatcaatcgtttgagttgagctttgattatgaaacgtgtgaagaggtgaaggtttgtgatttgggattggggaatgaattaggagcgaagaaagagaatgatgatgaggtgaaaaagaccaagatttcgttgcagctagactatgaggcggtaatcatcgcctgggctagccaaaaatctccgtggaccaccgctgacaaaccaaacttggaccctgatgagtgctggaaacaatgcatgggaagttgcgaaacggcatatcatcatccttgcggtgaaatgggtggatttgggattcatccagtgataatagacgggggcagagaggcgagggtgtcaagatacagagagaagcgccgaacgaggttgttctcgaagaaaataaggtacgaagttaggaaattgaatgctgagaagagacccagaatgaaggggaggtttgtcaagagggcttcctttgcaccaccaacatttcctttgctaaataaataagagctacatttgtatgttctgccactaaagttttgttagtatttgctaagtatagttttgcgacgtgatatcgcttttcatttcattttcttatttctttgtatataaaaattttgctaagtt

SEQ ID NO: 1510 - DNA, 1462 bp, Glycine max
  Predicted polypeptide sequence is orthologous to G1255
acgagcactccctcttttttccatcaaaaataatcattcccctgttaccaaaaccacactgtagcctaacccctcccttttggtgtcatgagttcggctactaagaacgcagcaaacgcggttgggggaaaaactgcaagagcatgtgacggctgcataacgaaacgtgcacgttggtactgtgctgccgatgatgcttttctctgccaggcttgtgactcttcggttcacttggcgaatcctttggctcgaagacacgaacgagtccgcttgaaaaccgcgtcgtacaagtccaccgatgaacgacgacaacctcccacgtggcacaccaagaaacctcgaacgcccagacatgggaaacattctcgtaacaacaaccctttccacttggtccctgaagagggttccgaagaggcgaattcccatgatgagaatgaggagcagctcgtttatagggtccccatagtcgacccttttgttgctgagctatgtgggactaatagttctccttcttctgttacttcaacgctccagggggtagtagctgctgctgctgctgcttctgctgtggttgaatacaaagggattcaaagcaatgatttttgtagcaatagcaatgagatcgaaaacttgcatgggatgcttccttcggatgcagaacttgctgagtctgctgctgatgttgagagctttttgggtaagggggcttgaaaacaagtgcgtggggatggaagaattgggactcgttgataccaaagaagaggagtgttcggtgggtactgggacggcgaaggtggaagatgaagagagccctctgatggagatggatatgggaagagatgatcaatcatttgagttgagctctgattatgagacgtgcgaagaggtcaaggagatgaaggttagtgatttggaattggggaatgagttaggagagatgaaagagaatgatgatgatgaggtgaaaaggaagaaggtatcgttgcagcttgattatgaggcgataatcatcgcctgggctagccaaaagtctccgtggaccactgctgacaaacaaaacttggaccctgatgagtgctggcaccaatgcatgggaagttgcggaacggcatttcatcacccttacggtgaactgggtggatttgggattcattcagtgatagtagacgggggcagagaggcaagggtgtcaagatacagagagaagcgccgaactaggttgttctcgaagaaaataaggtacgaggttaggaaattgaatgcagagaagagacccagaatgaaggggaggtttgtcaagagggcttcctttgcaccaccaacatttcctttgctaaataaataagaccactaatgttttgttagtatttagtatttgcgacgtcatatggcttttcatttcattttcttatttctttgtatataacaattttttaagctaataaatcgtccaaatttataa

SEQ ID NO: 1511 - DNA, 539 bp, Glycine max
  Predicted polypeptide sequence is orthologous to G1255
aaaaaactaaggtttctacctttctacgatgagagacatgaaagacgcaggtgccttgggaggcaagacagcaagagcctgcgacagctgcgtaagcagaagagcaaggtggttctgtgcagctgatgatgctttcctctgccatggctgcgacactttggttcattccgcgaaccagttagcaagcaggcacgaaagggttcggcttcaaactgcttcctcaaaagtaaccaccacgcacgcatggcacagtggattcacacgcaaggcaagaaccccgcgtcacaacagcaagcactttgcgctgcaacagcgtctcaaagacgaagttctcttcaacaagaaccggtggttgtggataacgatgagacggaggagcagatgctgtgtcgggtgcccgtgttcgacccttttgatgtgagaaccgatgacttggatagtttttctgacatggatttcgctgagtttgctgctgatgttgaaagcctacttgataaagaagacgatgaaataagtgcgtgtgtggagggggagagaga

SEQ ID NO: 1512 - DNA, 1381 bp, Oryza sativa
  Predicted polypeptide sequence is orthologous to G1255
ccctcacttagggaataagcttgggccgccgtgtcctgctgcagggaggccgcccccggcgagaacccgacgaagccgtccatgacgacgacgacggctacaacgccaccgctccagttctgccccgacggccacgccaatttcggcccgaccgacgccgagctgagggagttcgccgccgacatggaggccctcctcgggcgtggcctggacgacggcaacgacgaggactccttctgcatggagacgctggggctcatcgagccggtggacgacgacgccgggcgggtcaaggtggaggccgacggcgacgccgggatgaccctagcgtggtgccacgagctggacacggagacgtcgtccggcgagatgctggacatcgacttcgactacggctcacctcaggcggcgacgacacccgacgagaaggtcgggagcagcgggcccgccgccgccgccgacgacgacgcccagttccagcagagcagcctcgccctcagcctcaactacgaggccatcatcgagagctgggggacctcgccgtggaccgacggcgagcggccgcgcgtcaagctcgacgactcctggccccgcgactactcgggggtgtggatggcggcggcaggggtgttcgggcacggcggcgaggagcaggcgctgacgccgaggctggggatggacggcggcagggaggcgcgggtgtcgcggtacagggagaagcggcggacgcggctcttctccaagaagatccggtacgaggtgcgcaagctcaacgccgagaagcggccgcggatgaagggccgcttcgtcaagcgcgccgccgccgccgccgccgtcgccacggcgtgcgtcgcgtaagcgctgcatggcggaagtttgatctgccggccgcgcgctcgccatgaaatcacacaagaacaaaacaactcgtcgaaactgcattagttttagctggtttctttcacggtcacaaatgcgtcttctttttccatcagttcgccattgatggttgctaaggatccaaggacttttaataataattattactataataataatgataatactaataagtgaattgtactatttgttgagaggtatacagtacccctgcgctcaattgctgaaagttttgaaagtttttttccccccttcagattcagggggttggttgacagtagtagcctgtagctgtgctatatgtatgcatatatgtccattggttgtcatgcacgggtacagttcgaggccaggagatatacatgtaaatcaatcaatcaatatatacaactaattgattcagtgatgaaaaaaaacctgcagcccggggatccaaaaaaaaaaaaaaaaaaaaaaaaaaagggggaggcctgcagcccgg

SEQ ID NO: 1513 - DNA, 641 bp, Oryza sativa
  Predicted polypeptide sequence is orthologous to G1255
cccgggctgcaggaattcggcacgaggcctcgtgccgaattcggcacgagggaggccctcctcgggcgtggcctggacgacggcgacgacgaggactccttctgcatggagacgctggggctcatcgagccggtggacgacgacgccgggcgggtcaaggtggaggccgacggcgacgccgggatgaccctagcgtggtgccacgagctggacacggagacgtcgtccggcgagatgctggacatcgacttcgactacggctcacctcaggcggcgacgacacccgacgagaaggtcgggagcagcgggcccgccgccgccgccgacgacgacgcccagttccagcagagcagcctcgccctcagcctcaactacgaggccatcatcgagagctgggggacctcgccgtggaccgacggcgagcggccgcgcgtcaagctcgacgactcctggccccgcgactactcgggggtgtggatggcggcggcaggggtgttcgggcacggcggcgaggagcaggcgctgacgccgaggctggggatggacggcggcagggaggcgcgggtgtcgcggtacagggagaagcggcggacgcggctcttctcccagaagatccggtacgaggtgcgcaagctcaacgc

SEQ ID NO: 1514 - DNA, 455 bp, Oryza sativa
  Predicted polypeptide sequence is orthologous to G1255
gcacggaggattttttttttgttaaccgcgaaaagtgttgtgttgtttgggtaggcagtgtgtgcgacggaatggcgagcgccgccgcggcgacgggcgcggcgctgggggcgcgcacggcgcgggcgtgcgacgggtgcatgcggcggcgggcgcggtggcactgccccgcggacgacgcgttcctgtgccaggcgtgcgacgcgtccgtggactcggcgaacccgctggcgcggcggcaccaccgcgtgcgcctcccgtcggcgtcctcctcgccggcatcctcccctcgctcggcggtcgctccacgtgccggatcagacgaccccgacgcgccggcgtggctgcatgggctcaagcggcggccgcgcacgccccggaccaagcccgggggaggcggcaagcacgacgcctccgccgcgacggtggccgcggcggcggcgtcggcggtcccg

SEQ ID NO: 1515 - DNA, 543 bp, Oryza sativa
  Predicted polypeptide sequence is orthologous to G1255
gctgcagctcggagaaggcggccggggccgtgggcggcaaggcggcgcgcgcgtgcgacagctgcctgcggcggcgggcgcggtggtactgcgcggcggatgacgccttcctgtgccaggggtgcgacacgtcggtgcactcggccaacccgctcgccaggcggcacgagcgcctgcgcctgcgcgtctcgtcgcccccgccggtgacggcgcgggcgtcggtggaggaggaggcggcggcggcggtggggacgacgacgacgacgacgtcgaagagagagggcggcgtctcgccggcatggtcgaagcgcaaggcgcgcacccggcgcccgcaggtcaagagcgtcgggcagctgctctcgaggcggctcgtcgtgccggagatggcggtggagtcgtcggacgaacggaaggccgacgaagacggagctcacgaggagctcgaggggcagttgctgtaccgcgttccggtctttgacccctccctcaccgagttctgctcgccgcccgcgatcgatgacgcggcggccgcatcctcatcgt

SEQ ID NO: 1516 - DNA, 543 bp, Zea mays
  Predicted polypeptide sequence is orthologous to G1255
  misc_feature (188)..(188): n is a, c, g, or t
cgcttctcggcgttgagcttgcgcacctcgtaccggatcttcttggcgaacagtcgcgtccgccgcttctccctgtatcgcgacacccgcgcctcacgctcgccaccggtcaccggtgtcacggctccgccgaggagttcccggtctcccgtctgcatgcatgcgatccatggcaaaaggaaagccgntcagttatttatcccaagacagtgccagagcatgtgtagatctcatgctcgaaccgtagtgcttaccgtgaagtcgtccgaccatagctcgtgacagtcgaggtgaggacgctcgccgtggaaccacggcgagccgccgtcacggacccatgaggcgatgacgccttcgttgttgagcttgagtatcatctccggccgcttccgtttcttgtcctctggttcaggcgccggcgctactatggcgtccaagtccgcgttcacctgaggtttctcttcgtcccagaaacccaaacagtcaaacccgtcgtcgtcgactcccatgaggaggctctccatgtccgcggtgaagctagcg

SEQ ID NO: 1517 - DNA, 649 bp, Zea mays
  Predicted polypeptide sequence is orthologous to G1255
  misc_feature (640)..(640): n is a, c, g, or t
ctccgcgttgagcttccggacctcgtaccttatcttcttggcgaacagcctcgtccgccgcttctcccggtaccgtgtcacccgcgcctctcgcccgccgcccatccccagccgtggagtcaccgccgcctccccacccaaccgtcctcctcccgccatccagccctgcacgcaaaccttgcatgaacccgattgtactttgcaagtcgaagcataattaagcacgcgtcgacactcgacagcgctcgcgatcgatcgatcgaggacgaggagcagcgtgaatttgaaaataaacgtaccgtgaggtgggcgtggggccagaaatcatcgagctggacgcttggccgttggccatcggtccacggcgagcttccccagctctcgatgatggcctcgtagttgagactgagatccaggctcctcttcaagaattgcgtacccgcggcggcggcggcgttgctcgccgacgccttctgttcggaactgtcctcatcctcgttatccatcatcaccgtgggcgagcagcagttgaagtctgtgtccagcacctcagcagcagctgacgacgcctctggcttcatctccgtagggccaaatccgggagcgccctcgccgcgggagcgggagcgtacgatgccgntgggctcca

SEQ ID NO: 1518 - DNA, 786 bp, Zea mays
  Predicted polypeptide sequence is orthologous to G1255
  misc_feature (699)..(699): n is a, c, g, or t
cattgggtacctcgaggccggccggggtagcaagatcgttgcacaccgctcggaagagaaatgattgccacgaccggcggcagctcggcgaaggcggcggcggtgggcggcaaggcggcgcgcgcctgtgacgggtgcctgcggcggcgggcgaggtggtactgcgcggcggacgacgcgttcctgtgccaagggtgcgacacgtcggtgcactcggcgaacccgctcgcgcggcggcacgagcggctgcgcctgtgcccggcgtctccgctgcagacgccgccagctcgctcggcggcggcagcgacggcgactaataagcgcgagcgccacgacgaggtggcggtgcccgcgtggttcgggcgcaaggcgcgaaccccgcgcggcgggcacgccaaaagcgtcggccaggtggcgttgtcgcggcgcctcgtcgtaccgcatgcggctggcggggactcagactcacccgatgagcgaaacggcggcgaggaggagcagctgctctaccgcgtgcccatccttgaccccgccctagccgagttctgctcgcccccgcctctcgaggaccccgcgaagccggatcctgcggcgccgctggcccagttctgccccgtcggcggccatttcaacttcggcccgaccgacgccgagctcagggagttcgccgcggacatggaagccctcctcgggcacggnctggacgacggaaacgaggaggaatcgtcgttttacatggagacgctgggcctcctcgaccaatggaagtgggcgacgatgccacgc

SEQ ID NO: 1519 - DNA, 810 bp, Zea mays
  Predicted polypeptide sequence is orthologous to G1255
  misc_feature (766)..(766): n is a, c, g, or t
aaagtacacttgggcacttggcatcgcggccgaggtccccgaaaaagagccgtgctgggccctaatccagacgtgatattttctcgcgattttgtcacgttagcggccagctacatcctgacgatcctgtcacccgctcgatcggcgggcgctggagcgcgcgcatctagctttgtgcaagtttcacgggatctctagctttgtcggcggcacatgagcagctccaagcacgccgcgggcgccgtaggcggcaaggccgcgcgcgcctgcgacagctgcctgcggcggcgcgcgcggtggtactgcgctgccgacgacgccttcctgtgccagggctgcgacgcctcggtgcactcggcgaacccgctcgccaggcggcacgagcgcctgcgcctgcgcccgacggacccgcactcgacgacgctcgaggccggcgtggcgacgacgacgtggaagaagcgccagcagcaggtcgcgccggcgtggtccaagcgcaaggcgcgcactcggaggccgcacgtcaagagcgtcggggagctcctgtcgaggaagctcgtcgtcgtgcctgaggtgtcccccatcgaatcgtcggaggagcggaaggccgaggaggagggggaagaggaggaggggcagctgctgtactgcgtgccgacctttgaccgcgccctggccgagctctgctcgccaccgcctccggtcgatgacccgacggcctcatcctgctgcagggatgacgtcgacggcgccgtggagaacaacacanaggcaccaccggtcgtggttgcgggatcgcccgtgcagcagctt

SEQ ID NO: 1520 - DNA, 1494 bp, Zea mays
  Predicted polypeptide sequence is orthologous to G1255
ccggccggccacctgttcccgttttttttgttaagctctcgcttaacctaaacgccgggagcacaagtgctcggcgaaatgacgagcgccggggcggcgacaggcgccgcgctaggcgcgcggacggcgcggtcctgcgacggctgcatgaggcggcgggcgcggtggcactgccccgccgacgacgccttcttgtgccagacctgcgacgtctccgtgcactcggcgaacccgctcgcgcgccgccaccaccgcgtccgcctcccctctgcgtcctgctcctccccaccgcgcgacccggacgcgccaacgtggctccacggcctcaagcgacggccacgcacgccgcggtccaagccaggggggagcaagagcaacaagcatgaggcgactcccagctttatcgccgcggctgcgtcgtcggcagcggtccccgacctcgaggcggaggagtccggctccggtatcctgggcggtaacgacgaccaccacgggttcctgcaggatgacgacgaagaccttctgtaccgcgtgccggtgttcgaccctatgctcgccgagttctacaaccccgtggccgacgagggggagcagaagccggcctgcagcctgctgatgccgtctctcgcggaaacatcgccggagttcgcctccggcggctcggcggaggcggacgggctctccgtgtcgttccacgtcccggacatggagctcgctagcttcgccgcggacatggagagcctcctcatgggagtcgacgacgacgggtttgactgtttgggtttcttggacgaagagaaacctcaggtgaacgcggacttggacgccatagtagcgccggcgcctgaaccagaggacaagaaacggaagcggccggagatgatactcaagctcaactacgaaggcgtcatcgcctcatgggtccgtgacggcggctcgccgtggttccacggcgagcgtcctcacctcgactgtcacgagctatggtcggacgacttcacgacgggtagccgggaactcctcggcggagccgtgacaccggtgaccggtggcgagcgtgaggcgcgggtgtcgcgatacagggagaagcggcggacgcgactgttcgccaagaagatccggtacgaggtgcgcaagctcaacgccgagaaacggccgcggatgaagggccggttcgtgaagcgcaccacgctcccgccgctgccgaggccgcccccgccgtcacagcagcaacagaagaagaagcaactgccacgctcattgccacacgtgggcatggtgctcgcgccacctccaggagcggacgggcgcttccggttttgagtctttgagatcacgcacgcaagcacggaaggctcggtatcaggacatcaggtgcacaacggagggatagtgcacaaatgcacaaacttgatcctgcccttccatctcccaatgaacggtcaccgccaaaattgcaagatggcccctccgcacctcctcctcctttaaaaa

SEQ ID NO: 1521 - DNA, 1140 bp, Zea mays
  Predicted polypeptide sequence is orthologous to G1255
ccacgcgtccgcggacgcgtgggcgacgacgaggaccttctgtactgcgtgccggtgttcgaccctatgctcgccgagttctacaaccccgtggccgacgagggggagcagaagccggcctgcctgatgctgcctctcgtggaaacatcgccggagttcgcctccggcggcttggcagaggcggacgggctctccggcttcgacgtcccggacatggatctcgcgggcgcgtgggcggacatggagagcctcctcatgggagtcgacgacgggtttgacgatctgggtttcttggacgaacagaagcctcaggtgaacgcggacgtggacttggaggccatggcggcgccggagcctgaacgagaggacaagaaaaggaagcgggacggctttgattatctgggtttcttggacgaagagaagccacaggtgaacgcggacgtagacttggaggccatggtggcgccggagcctgaacgagaggacaagaaaaggaagcgaacagatatgatactcaagctgaactacgagggcgtcatcgcctcgtgggttcgtgacggcggatcaccgtggtaccacggcgagcgtcctcacctcgacgatccttacgagctatggttggagttcccggcaacggggagccggggacttttcggcggcaccatgacagcggtgaccggcggcgagcgtgaggcacgggtgtcccggtacagggagaagcggcggaggcggctgttcgccaagaagatccggtacgaggtgcgcaagctcaacgccgagaaacggccgcggatgaagggccggttcgtgaagcgcaccacgctcccgccgctgccgaggccgccgccgccgtcacagcagcaacagaagaagaaacaactgccacgcgcattgccacacgtgggcatggtgctcgcgccacctccaggagcggacgggcgcttccggttttgaatctttgagatcacgcacggaagcatggaaggctcggtatcaggtgcacaacggagggatagtgcacaaatgcacaaacttgatcctggccttccatctcccaatgaacggtcaccgtcaaaattgcaagaaggcccctccgcacctcctcctcctttaaaaaaaaaaaaaaaaaaaaaaaaaaag

SEQ ID NO: 1522 - protein, 421 aa, Oryza sativa
  Orthologous to G1255
MASAAAATGAALGARTARACDGCMRRRARWHCPADDAFLCQACDASVHSANPLARRHHRVRLPSASSSPASSPRSAAAPRAGSDDPDAPAWLHGLKRRPRTPRTKPGGGGKHDASAATVAAAAASAVPDLEAEESGIVGDTDHDVGEEDDEDLLYRVPVFDPMLAELYNPVAADDEEQQIEQKPAARVVPFSEPSPEFASGSVEADGLSGFDVPDMELASFAADMESLLMGVDEGFDDLGFLDDEKPHVKLDLDMDMDFASISPAPAPEREERKRKRPEMILKLDYEGVIDSWARDGASPWFHGERPRFDPSESWPDFPAGSRGGLGAAVTAVTGGEREARVSRYREKRRTRLFAKKIRYEVRKLNAEKRPRMKGRFVKRAAALPPLPLPRHQHPPPPPPRALPPVPMMLAPRGAHGRYRF

SEQ ID NO: 1523 - DNA, 527 bp, Glycine max
  Predicted polypeptide sequence is orthologous to G1266
caacttcctcggtgtctcatggttcaggtagtgttgtggaagcagaggtttcggtttcgtacagaggggttcgaaggaggccctgggggaagtttgcggcggagataagggactctacgaggaacggagtgagggtttggttgggaaccttcgacactgccgaggctgctgcgttggcttacgaccaggccgcgctggtcatgagagggtccatggcagtgttgaacttcccagctgagattgttcgccaatcgcttcggaacatggagcagtacggtagtttccaagaaggctcttctccagttctggagttgaagaagaggcactccatgaagagaaaatcagagaccaagaagcaccaactccacgatgtgatggtgttggaggacttaggggcagagtatttggaacaccttcttactctctcccaggatatggatatggatgcttgttagttaagttacatttacctccttcgtcaaaccttgcctttcccatccccaccactttcttttctctctctatca

SEQ ID NO: 1524 - DNA, 593 bp, Glycine max
  Predicted polypeptide sequence is orthologous to G1266
  misc_feature (6)..(7): n is a, c, g, or t
  misc_feature (15)..(16): n is a, c, g, or t
  misc_feature (33)..(34): n is a, c, g, or t
  misc_feature (41)..(43): n is a, c, g, or t
  misc_feature (46)..(49): n is a, c, g, or t
  misc_feature (90)..(92): n is a, c, g, or t
  misc_feature (457)..(458): n is a, c, g, or t
  misc_feature (464)..(465): n is a, c, g, or t
  misc_feature (493)..(493): n is a, c, g, or t
  misc_feature (590)..(591): n is a, c, g, or t
aaccgnngagagganngcatcatacatacgcanngacgatnnncgnnnnaaatgatctttttttttcacagcaatatactaatcaaagcnnntaaccaatattgagtcccctttctttcagcatgcagattggggcatgttgaaggagcctaattcggatattttgtttgaatcattttcaagcaaaggagttgatcatgaccctttccatgattgtctttcctttgatatgattgataactcaagggatccacaggaagaaagtcatcatcaagtgattgaagaagctatgaaaacaaagaagaagtcttatattggggtaagaagaaggccatggggaagatttgcagcggagatcagagacacaacaaggaagggtataagggtttggcttggaacgtttgatagtgctgaggaagctgcattggcttatgaccaggctgcattttccatgagnngctctnntgcagtgctgaattttccggtcaaaagngtcaaagagtctttacaagagatgaactattctggttgcagccgaaggtgctctcctgcattagaactcaaagagaggcacaacataagaagaaaanngt

SEQ ID NO: 1525 - DNA, 514 bp, Glycine max
  Predicted polypeptide sequence is orthologous to G1266
aactctgtttactcatctggtgttagaatggatagttcctctcatcagctcctccccttcaacgaaaacgacccagaagacatgcttctctatggcatcatcacttcatgccaagaaaaaaaagtgaccatcaaccaagagcaagtgaataagaagaggagcagcttccgcggcgtgcggaggcggccgtgggggaagttcgcggcggagataagagactccacgcggcatggcgtgagggtgtggcttgggacattcgacaacgccgaggccgccgcgctggcgtatgaccaagccgcattctccatgaggggctccggcgcggtgctcaacttccccgtggagaaggtgaaggagtctcttagagacatgaagcttgatggatgctctcccgttgtggccttgaagaggagacactccttggctgctaagaggaagaaggaagatgtccttgttttccatgaccttggggctgattatttggaacacttggtgatgtgctctgatctaccta

SEQ ID NO: 1526 - DNA, 989 bp, Glycine max
  Predicted polypeptide sequence is orthologous to G1266
ccagcgtccgcccccacccgtccgtaaaaaacagagcaactactcaattcttcactctgtttccccttaccttacacactctaacacatggattcaccttcctccttcttcaactcaccctcttccggtttctgctccgaatcttcctctccggaagccttctcgtgggaagggtacctacccttcaacgagaacgacccggaggagatgcttctatacggcatgatcgccggcgcgacaaccgaggagcactccggcgagagggcgagctcggaggagagtgctgcagcacggaaggagaagtcgtaccgcggcgtacggcggcggccgtgggggaagttcgcggcggagataagggactccacgcgccacgggatgagggtgtggctggggacattcgacagcgccgaagccgcggctctggcttacgaccaagccgcgttctccatgcgcggctcggcggcgattctcaacttccccgcggagatcgttagagagtcgcttaaagagatgaactacgctcatgatgattccaacaacgaagaagggtgctcccctgttgtcgctctcaagaggaaacactctttgagaaggaaaattaacgtcaggaagaagaagaacaacaataacaatagcaaactacaaagtagtaccgtagacaatgctgtcgtgtttgaagaccttggtcctgattacttggaacagctgttgatgtcctctgatcatcatattcccaccaccttctgattcatttattcctcaattgcaattcagatctcaaaaaccttataaatatccattgcatagtttctacctagggtttttgtgttagtagtgttaattccttcttcttctttgttcttttgtttttgtaaggctaaaatgcttaggtcatgtttggatgacagatttgaacttcttttcagttcttatctttttttctttgtttttgtttttgttttcctactctgggagaattttcttcttta

SEQ ID NO: 1527 - DNA, 430 bp, Oryza sativa
  Predicted polypeptide sequence is orthologous to G1266
aaaagtcaatccacgccaccatcgatctctctatccaatccaagcgcgcaaatcaatggcagagcatttcagccacgccggcatgtacatcggctacacggcagacgccgccgcgtcctcctcctcctcctcctcgtcttcgtcgtcttcctcctcggagatgcttcggttcgacacgggctggcccgacgagacacctgcgccatcctccgtggcggggaggaggaggagcgcgggcggtgatcatcgtcaaggtcggggacagacggaggcggcggcggcgttcatcggggtgcggaggcggccgtggggcaggttcgcggcggagatccgggactcgacgcggaacggcgcgcgggtgtggatcggcacgttcgacagcgccgaggccgccgcgatggcctacgaccaggccgcgctctcgcgcgtg

SEQ ID NO: 1528 - protein, 277 aa, nicotiana tabacum
  Orthologous to G1266
MDSSSCSSHFFYPMNSDLSSDSSWEWSNLNSTSLPFNVNDSEEMLLFGVLTNTAQETTSETVTSYHVKEEEVSSKSKVIKEIEEKPAKEKSFRGVRRRPWGKFAAEIRDSTRNGVRVWLGTFDSPEAAALAYDQAAFLMRGTSAILNFPVETVQESLRDMKCHVDEECSPVVALKKRHSLRKKSLSSKKSNSSSNSKVVREVKMENVNVVVFEDLGPDYLEQLLSSSSSDHSSCNEAFYHVNQRFTQLCIYLFIYLYYFCLFSFRGREIGEFHLFVL

SEQ ID NO: 1529 - DNA, 825 bp, Oryza sativa
  Predicted polypeptide sequence is orthologous to G1275
agtggatcccccgggctggaggaaaattcaccggtgaaaaggttcagcactgtgcaatggcggcttccgtaggactgaaccctgaagctttcttcttcagcaactcctactcctactcctcatcccctttcatggccagctacacgccggagttctcggccgccgctatcgacgccaacttattctccggcgagctcgatttcgactgctctctcccagctccggcccaggagtacccggaaaatgaaaacactatgatgaggtacgagagcgaggagaagatgagggcgagggtgaacgggaggatcgggttcaggacgaggtcggaggtggagattcttgatgatggcttcaagtggaggaagtacggcaagaaagctgtcaagaacagcccaaatccaagaaactactaccggtgctcgacggaggggtgcaacgtgaagaagcgagtggagagagaccgggaggaccaccgctacgtcatcaccacctacgacggcgtccacaaccacgcgagccccgccgccgccgccgcggcgctgcagtacgccgccgccgccggcgactactacagcccgccgctcagcagcgccggctcgccgccggccgcctatttcggcaggcggcttcgctgctcttctgagggctgatgaagtttgtctaggactagacacgcccgggagctctagctaggatagaaaactagagaaagtttaattatacctgaattttaattaatcacctcacaaaactctgatgtatcatattatatcgtgatagtgactggttgttaatttaattttggcgatcgatgtgatcttcggt

SEQ ID NO: 1530 - DNA, 1696 bp, Zea mays
  Predicted polypeptide sequence is orthologous to G1275
cggacggcacatcaacggacagacacacacaagcaaggcggctagcggtgcaagtagtgcgaagctagctaggtgctggtgcatgcaatggcggcttcgctgggtctgaaccctgaagctgtcttcacttcctacacctcctcgccgccgttcatgtcggactacgtggcggcgagcttcctgccgccggccgtcgtcgactccacggacttctctgcagagctcgatgatcttcaccaccacttggattactcatcgccggcgccgaccttggccggggctcggagcgatcgcagcgagaagcagatgatcaggtggtgtgagggtggtggtggcgagaagagactcggtaggatcgggttcagaacgagatcagaggtggagatcttggacgatggattcaaatggaggaagtatggcaagaaggctgtcaagagtagcccaaatccaaggaactactaccgctgctcgtcggagggctgcggcgtgaagaagcgggtggagagggaccgcgacgacccccgctacgtcatcaccacctacgacggcgtccacaaccacgcaagccccgcagccgccgccatcatccagtacggcggcggcggcggattctatagcccgccgcacagcggctcgccgtcggccgcctcctactcgggctccttcgtcctctgacttctccgggccttgacccagagtgatctgatctacctgctttatcccagtcgtaggatgagaagagtgttcagacttcagagacatcagttcagcggccggctaaattcggacctgattgtagatatttacacctcaattattggttacctcttgtgacgactgacgaggcatcataatcgtcactaggataattgatcacgcatgtttttcgcttaattagtttctgtgtatacatacgaagtttgccgtatagctgataggctgctgatttaacttgacttctctttgttcggtattagaccccaagatcaacatttacgctgaacagatgctttgtaacagtgaaggaatattttatggtttttccagatatatgccattatgaaaataaaaaaaaaaaaaaaaaaagcggccgcttggtttgtctctttgttggcattccttgcaacaaattattaattctccacggtacagaacgggacatcatcacaatgtcagtgcgcaaccataactgaactgcaacaatgaagaacaggtagcaaaccttatttcgagcaaacagtcagctcagcttagaaactaactaaaaagagcacggcactcattggcctcattagccatctcttccatgctcctatctttcctctcaatgtccaggtcaagcttctccttcaattctttctccttcacatcaatcgcatcatatatttcatcatttttctcaaaatcccctttcttccttgggatgaggtggatgtggacatgcgcaactgtttggccagcttgaggaccatcctggatagcaaaggtaagtgacgatgctttgtggtactgctcaagacgtgcaccaacttcctttgcagtaacccataagtcactaatctcatcagaacttagatcggcgaatcttttcacttcacgcttggggcacacaagaacatgtaggtattgtcaaggaaaaaccagtgcatatagaagaacacagtttcctaaaacatgatgtatcaaactttgagtc

SEQ ID NO: 1531 - DNA, 1663 bp, Zea mays
  Predicted polypeptide sequence is orthologous to G1275
cattgggaccctcgaggccggccgggtctaattatatgataggtgtcaagtggaagtgcagtgatgtatgcagctgaggcatcctaacagaccccggccgacgggaaacaagaaagaaaaaatcgagaggacgccagggccgattctctgcgtgacttggggcgtcgtcgccgagttttctccggccgagggcggcgcgaccggacaaccagcgtgagcgcgaccggcgacatgactcgcggcaaccagcgtgaccgcgaccgtgagcgcgcggcggcgcggaagcccaacgccaagaactcccaggacgggctcaccccggagcagcgccgcgagagggacaagaaagctctggaggagaaggcggccaagaaggcgcagcaggcagcggccggcggcaccgggacctccacggacaacaacaagaacaaggcaggtggcaagaagtaggaggcagtggcgcgccgccacctctgtacgattaatcgatgccttgagcttgtaacttgttcgcatccttgtaggtgcgatgcttgttgggtcataaactctgatgatatcgagatttggtgatcagaaataatgcgtggttttcgcgcccaaaattgggaaccccgaggccggccggggttattcaggcaggcgcattgactgatacacatatatacaacaagcaaggcggctagctacagcggctagtgcgcgcgtggtgcaggcgcatctagctactacctggtgcttgttgtgcatacaatggcgacttcgctgggactgaaccctgaagatctcttcacttcgtactcgtcttcctactactcctcgccgccgttcatgtccgactacgcggcgagcttcacgccggcggccggggactccacggccttctcctcggagctcgacgaccttcaccacttcgactactcaccggcgccgatcgtcactgctgccggagccggggctgggggcggcgatcgcaacgagaagatgatgtggtgtgagggtggtggtgacgagagaagactcagaagcaacggaaggatcgggttcagaacgaggtcagaggtggagatcttggacgacggattcaagtggaggaagtacgggaagaaggccgtcaagaacagcccaaatccaaggaactactaccgctgctcgtcggagggctgcggcgtgaagaagcgggtggagagggaccgcgacgacccccgctacgtcatcaccacctacgacggcgtccacaaccacgccagccccggagccgctgctatcatcgtcccgtacggcagcggcggcggcaatagcggcttctacagcccgccgcacagcggctccccgtcggccacctcctactcgggctccctagccttctgacttttccgggccttgacccatagttacctttacactccagtcgtcggataagaagaatgttcagcggctggctaaacagtctcaactgctgcagctattcaaattagtgttggagatgcaatttatagagataaaatactctagaagctatcgctgtagccggattaaattctgacctacttgtatagttttacacttacacagtgcaagtaataatatttaagggaagcagagagcactctaggcggccgctcaaaaaaaaaaaaaaaaaaaaaaaaaaaaaaaaaaaaag

SEQ ID NO: 1532 - DNA, 999 bp, Zea mays
  Predicted polypeptide sequence is orthologous to G1275
agagaaaggcagggtcggagcgctgcaggtgtttgggcgcccaactctttgggtttagctactgttcattcgtcttcctcctctcaccaatctgtgtcctgtgcttgtgagcgttttagagttccaacacattctagctacgtgacccgtacgtgcgtgtaataactgatggatgacggatcggatcagtacgacgactccgaggaatgagcaaccgccgccgcggcgtgcagctgcgcctcccaccacgcgtcacaggcggcgctccagctgggcgctgcagccagaggcgctggcgccgaggccgagcgtggaggcgagaagggcgttgcggtcgcggttgcgccgcgcggcggcggtggttggcacaggtaggaggcggcgcccgggcccggcgcggcgtggttgtggacgccgtcgtaggtggtgacgacgtagcgcgggtcgtcgctgtcccgctccacgcgcttcttcacgccggagccctccgtcgagcaccggtagtagttcctcgggttggggctgctcttgaccgccttcttgccgtacttgcgccacttgaagccatcgtccagcacgtccacctccgaccgcgtccggaacccgatccgtgacgacgacggcggccggccgccgccgttcccaccggtgccatatggtggtccgctcatcggcctcctcccgtcgccgtcgccgtccacgccgtagctcagcaggctcatgccattgccgacggcggcggtgacggcgtctgaagaactgttggcgaacaccggcgccgagcagtcatcggccaccatctcctggccggtgaacccgaactggaagtagtcatcggccatggtggcggcggcgggcggcgggaggtccgccacgaggtcgggtggtggtgggaagtacgaggaggcgggcgcgggcggcgggtagtaggcggcgtagctcgtctcgtgggcgagtcctagcgaggccgcctgagtaagtagacgcacgcgccggcag

SEQ ID NO: 1533 - protein, 194 aa, Oryza sativa
  Orthologous to G1275
MAASVGLNPEAFFFSNSYSYSSSPFMASYTPEFSAAAIDANLFSGELDFDCSLPAPAQEYPENENTMMRYESEEKMRARVNGRIGFRTRSEVEILDDGFKWRKYGKKAVKNSPNPRNYYRCSTEGCNVKKRVERDREDHRYVITTYDGVHNHASPAAAAAALQYAAAAGDYYSPPLSSAGSPPAAYSAGGSLLF

SEQ ID NO: 1534 - protein, 246 aa, Oryza sativa
  Orthologous to G1275
MSSLYPSLLSLSESPAEYRQVGGGRYAGEDVVDDDDDMAAVADAVSSYLSFDMDDVEYYTPEVGFHSKQHNPPPVAAAPLEAGGGREQSRREAAVNLGKMDRGPAPVSGGAATGGVPRSKNGSKIAFKTRSEVDVLDDGYRWRKYGKKMVKNSPNPRNYYRCSSEGCRVKKRVERARDDARFVVTTYDGVHNHPAPLHLRPQLPPPGGYSIAGAPAVVAPHGRLGLEEAEVIALFRGTTATSLLLP

SEQ ID NO: 1535 - protein, 219 aa, Oryza sativa
  Orthologous to G1275
MAASLGLCHETSYAYSYPASNTSSSLCFPPLMADHIVDGGGGGGCSFGEFLELGHSVYSLPLPPPPSQPVVVAGGNNDQYGVSSSSSAAATTSRIGFRTRSEVEVLDDGFKWRKYGKKAVKSSPNPRNYYRCSAAGCGVKKRVERDGDDPRYVVTTYDGVHNHATPGCVGGGGHLPYPTSAAPPWSVPAAAASPPPAHAQAWGAPLHAAAAAHSSESSF

SEQ ID NO: 1536 - DNA, 988 bp, Glycine max
  Predicted polypeptide sequence is orthologous to G1322
cggctcgagcggctcgagctcgagccctcggcccggctcgctttatgcttgcacacaaaataatggacaaaaaaccatgcaactcatctcatgatcctgaagtgagaaagggaccatggaccatggaagaagacttgatcttgataaactatattgcaaatcacggtgaaggtgtttggaactctttagccaaagcttctggtcttaaacgaacgggaaagagttgtcgactccgttggctaaactaccttcgtcctgatgttagaagaggaaacattacacccgaggaacagcttttgatcatagaacttcatgcaaagtggggcaataggtggtccaaaattgcaaagcatcttccaggaagaactgacaatgagattaagaacttctggagaacaaggatccaaaagcacattaagcaagctgagacttcacaacaacatggtaattcagagaataatgatcatcaagcaagcactagtactagcaaagtgtccaccatggcacatccaaatgagactttctctccaccctcataccaaggaacttttgagccattccaacctcaattccctacaatcactgatcaatcaagttgttgtaccaccaccaacgacaacaacaactattggagcatcgaggatatctggtcgtctatgcaattactcaatggagattaaacctagctatatgcatgcctatataaatcatatatatgatgatatataaacctaagctcttgtagagtgtgttcaggcttaataacatcattaggtctgtttatatgagtagtctaagtttggtgtttgtaatgcatgatgtgagttaagaattaatttagttatggattgaaatatatagtaacttatatactacatgtgcattctcctattatcgtaaataatatggttgttgtaccatatattatcagtgacgggcatgctcgtattttagtaaatcggtataaataattgctttgtctcaaaaa

SEQ ID NO: 1537 - DNA, 968 bp, Glycine max
  Predicted polypeptide sequence is orthologous to G1322
aattaggctccagtatctctctctctcccctcttccccacccaaccttctctctatcacacacacaagtcaatggataaaaaacaactgtgcaacacgtctcaagatcctgaagtgagaaaagggccttggacaatggaagaagacttgatcttgatcaactatattgcaaatcatggggaaggtgtttggaactctttggccaaagctgctggtctcaaacgtaccggaaagagttgccggctaaggtggctaaactacctccgtcctgatgttagaagagggaatattacacccgaggaacaacttttgatcatggagcttcacgcaaagtggggaaacaggtggtccaaaattgccaagcatctacctggaaggactgataatgagatcaagaactattggaggacaaggatccagaagcacatcaagcaagctgagaactttcagcaacagagtagtaataattctgagataaatgatccccaagcttgcactagccatgtgtccaccatggcgcagcccatggagacctattctccaccctgttatcaaggaatgttagagccattttcaactcagttccctacaattaatcctgatcaatccagttgttgtaccaatgacaacaacaacattaactattggagcatggaggatagctggtcaatgcaattactgaacggtgattaaatattatcaagataaaacctaagttctgaagttccataaggctggaatgtctctggattaaaacatattattgggtttgtttatataagtagttggatgtttggttttgcgtaccattattagctatgtgctgtaatatatacgagatcttatattaaactatatctgcatgctttatatatattttaaatgaggtgctatgtgcattgtagaagatacagttaagaaccacatagttcaaaacacttaatatattcccagtggcatgcttgctta

SEQ ID NO: 1538 - DNA, 969 bp, Glycine max
  Predicted polypeptide sequence is orthologous to G1322
tggcaagagctgggggcttttttatgatcctgccctgttattcgggccaggacaatggaagaagacttaatcttgatcacctatattgccaatcacggggaaggggtttggaactctttggccaaggctgctggacttaaacgtaccggaaagagttgccggcttcggtagctaaactacctacgtcctgatgttagaagagggaatattacacccgaggaacagcttttgatcatggaacttcatgcaaagtggagcaacaggtggtccaaaattgccaagcatctacccggaaggactgataatgagattaagaactactggaggacaaggatccagaagcacctcaagcaagcttccagcagcttccagcaacagagtagtaattctgagataatttatcatccccaagcttgcactagccaagtgtccaccatggcgcagcccatagaaacctattctccacccagttatcaaggaatgttagatccattttcaattcagttcccaacaaatcctcatcattctagttgttgtaccaatgacgacgacaacaacaactattggagcatggaggatatctggtcaatgcaattagccaattactgaacgggaattaaacctataaacataaatataaataatatatataaacctaagtgtctaagttccataaattaagctgtagtctctggcttaaaacatgttaggtttgtttatacaagtagttggatgtttggagtacttcggtcttttgcgtaccatcaatatttaagaactaagttagttatgttccgtaacttatgggctcttaattaaactatatctgcacaaaattatatatatatcaaatgtgatggtatgtggactataaaaagatatggttgagaaccacaaactttgaaacttcgaataatatattgccagtgacagtcttgttgatttgttatagcagaagcagacacatgg

SEQ ID NO: 1539 - DNA, 418 bp, Oryza sativa
  Predicted polypeptide sequence is orthologous to G1322
agcaaatccaccgccccctcacccgtctctgctctgctctgctctctgttcctcgcggcacgctagctattcgatggccaccaggatgtgcggccgcgccggcgagccggcggtgcgcaagggcccgtggacgctggaggaggacctcatcctcgtcagctacatctcgcaaaacggcgaaggatcctgggacaacctcgcgcgctctgccgggctgaaccggaacgggaagagctgcaggctgcggtggctcaactacctgaggcccggtgtgcggcggggcagcatcacgccggaggaggacatggtcatccgggagctccactcccggtgggggaacaggtggtccaagatcgccaagcacctccccggccgcaccgacaacgcgatcaagaactactggaagaccaagatacac

SEQ ID NO: 1540 - protein, 249 aa, Oryza sativa
  Orthologous to G1322
MQYTVEGSGGGGVQTVEAAVRKGPWTMEEDLSLVNYIAANGEGAWNTLARAAGLNRTGKSCRLRWLNYLRPDVRRGNITPEEHTLIVELQARWGNRWSKIARYLPGRTDNEVKNFWRTKIQKKHRKSTDGIYATTTSESIMPAATVHQNTVAEDQGSSSVSGRTTTATVAVTQEYATEAPPPSGMSSGSYLDQLQPGYASSIHGGQDGGAAAAAAGDVVVSDEFLAASSDNFWALEDLWPTVQSLHGNC

SEQ ID NO: 1541 - protein, 228 aa, Oryza sativa
  Orthologous to G1322
MATRMCGRAGEPAVRKGPWTLEEDLILVSYISQNGEGSWDNLARSAGLNRNGKSCRLRWLNYLRPGVRRGSITPEEDMVIRELHSRWGNRWSKIAKHLPGRTDNEIKNYWRTKIHRKPRGRSQLLQEPCEDAMGMGMSTTTSEAASTSASSGQSQASPGVWDEYMQASSFPHPELVSFAADHHLEMAGVGEVAAAAAAQFVPTEFGFNDGFWNFVDNFWETMPVSDVV

SEQ ID NO: 1542 - DNA, 777 bp, Zea mays
  Predicted polypeptide sequence is orthologous to G1323
  misc_feature (11)..(11): n is a, c, g, or t
  misc_feature (687)..(687): n is a, c, g, or t
  misc_feature (753)..(753): n is a, c, g, or t
ctcggccgggngcagctccgcacagtgcccctggcacaggcgaggagcaggagcttctgaggtgtcgccgcgtagcagcaactgcagcttggggctcggaacgaacgagaagaaacaggcatggggaagggccgggcaccgtgctgcgccaaggtggggctcaacaagggctcctggacgccggaggaggacatgcgcctcatcgcctacattcagaagtacggccacgccaactggcgcgccctgcccaagcaagcaggtctgctgcggtgcgggaagagctgccggctgcggtggatcaactacctgcgcccggacctcaagcgcggcaacttcaccgccgaggaggaggaggccatcatcaagctccacggcttgctcgggaacaagtggtccaagatcgcgtcgtgcctgccgggccggacggacaacgagatcaagaacgtctggaacacgcacttgaagaagcgggtgtcgccggccggggaggagcgcggcgccgccgggtccaagaagaagaagaaaaagaagacgacgaaggcagccgctggcggtggcgcggaggcgccgctgccgctccggttcgcggtcgccgtcctcgtccacgacgacgaccaacttctccagcggcgactccggcgagcagcagagcaacaacatgagcaaggaagcggacgacgagctggnacctggagacttcgagatgatgccgatgctcgacgtcgacgaccccagcttcggctttggcacgcntggtggacaccgcgccagcgccgt

SEQ ID NO: 1543 - DNA, 1302 bp, Zea mays
  Predicted polypeptide sequence is orthologous to G1323
acccgggagcagacagtgacaggcgaaccaagacacgcagggacagggagacatggggcgagggcgagcgccgtgctgcgccaaggtggggctcaacaggggctcctggacgccgcaggaggacatgcgcctcatcgcctacatccagaagcacggccacaccaactggcgcgcgctgcccaagcaagcaggtttgctgcgctgtgggaagagctgcaggctgcgctggatcaactacctgcggccggacctcaagcgcggcaacttcaccgacgaggaggaggaggccatcataaggctgcacgggttgctcgggaataaatggtctaagatcgctgcctgcctgccggggaggacggacaacgagatcaagaacgtgtggaacacgcacctgaagaagaaggtggcgcagcgggagaagaagaaggccggcgcggggagcggcgacgccggcacgcccgccactgcgcccttgtcctcggcgacctcctcgacgacgacccacaacagctccgggggcagcgactccggcgaccagtgcggcacgagcagggagcctgacgcgaccgacgtgtgccccctccagctagaggacatggacgtctcggacatgctggtggacggcgcgcccccggcggcgcagccaatgccgtcgccgtcctcctcgtcctccctgacgacgtgcgtcggcggcgtggaggagctgatcgagctgccggtgatcgacatcgagccggaaatctggagcatcatcgacggcgagagcgctgtggcgcgccatggtggcgatgcagccgcgccatgtacgggcaccggcaccgccgtcagcaccagcgaagcagaggaagcggcggcgaacgattggtggctggagaatttggagaaggagctgggcctgtggggctacgcggaggaggatactcaggcccaccctgacctactggaccactacacaggtttgagcccactctgcgccctggagggggacccagtctccacctacttccagaccgggcccgccgccgcggaacctgagctcctggtggtcgtcgaaccatctgccgttctgctatgactatgagcaacatgacggacggtcacagcaacgaacatcctggttcttggagatgttcggtggatcaaattcgagtagtttgtttgatgcagtggcagattaatatctctacaggccaattagaatgcacattcagaacagaaccgtccaaagaaagcctgtagagtgaaggctagtactctcttattcttaacagtgtttaacgcagataaaaaaaaaaaaaaaag

SEQ ID NO: 1544 - DNA, 1828 bp, Glycine max
  Predicted polypeptide sequence is orthologous to G1330
tcggccaaaccatatctcaaccaaaactattacctctctctcttttctctctaacaaacactccataaacggaaaagaaaagccacacaacaattaattaagttgttaaatttttgtgagatggagaggagtttatcaggaagtagtgaagaggagatgtcaataacgaaaggtccatggacagaggaagaggattctgttctcttcaattacatcactgtccatggggaaggtcactggaactctgtcgctcgctacacaggtctaaaacgaacaggcaaaagctgcagattaagatggttaaactacttgcgtccaaatgttcgacgtgggaacataaccctcgaagaacagctcttgattcttgacctccattcccgttggggcaacaggtattatcatttatgtttattattcattaaattttttaggttaaaatattccttggttcatgtaatttttcttatttttagtctcttgtacaagaaaattgtaaattttaatcccttcacatgcatccatgtttgctaaagttttggttcgcgtcactactaacatatatggaagactttttaggttttagtagtataaagcagccacaaacactttctccaattaatataagccgctaaaaaaatgttgtacatacattaaaactgaaaaatgtttgagaaacactcaatataccatcatatacttaatgagaaaaatatagataggaggtaaataaaatctgattaataattatttttatcaagaagcaaactcaaatattattcaaatgattcaaccttaatttcaacagcacatgaattacttatgctgaatcccctaattaggtggtgatttcctgcacagaactgaaacttaagatgaagcaagcaaatagcagtttgaccaatttttaatctgttagtgatagaacttggtaattgaagtgatgttgtgttatttgttttataaaatgaaggtggtcgaaaatagctgaacatttaccaggaagaactgacaacgagataaagaactattggagaacgagagtggtaaagcaggctaagcaactaaagtgtgaggtgaacagcaagcaattcagggacacgttgcgttttgtgtggatgccacgtatgttagagcggatccaagctcaggcctcatcatcatcatcatcatcatcaggccaagcccaccaaaccacgttaatctccaacgctcaagcacacagtgacccttgcggagtcatgacgaccaacccaagtttgttgtcggaggtgtcatcatcagcccttgatgcccacgcgccttctctctatgactctagtgcgtcttacaatctaatgggtggtggtagttcctcatcgtatagtgcagaatattgctactactcggacatagcaggaaatggttttggtggttcggacttgtggacggatgaaaatatttgctttctgcaacagctgctcgctgatcatgacttgtcgtgaaacatgcatctttgttttaaacttaggtgaaattaatttgcatctatcaagtatcaacgtaactattattatgtatacttcaattaatttcaagagaactgctatttgttgtaaatttaatttagcctgatttctaagagataatgatgagtattttaatttcccagaagacgattttgttcacaacaaatagaattaataatagagtaataaaatgtgattcgaaaaaatcatacaaatgcatgagtgtaagtttttgacagaaataacatgtgatgagttgtatttggctggaaaaaaaaaaaaaaaaaaaaaaaaaaaaaaaaaaaaaaaaaaaaaaaaaaaaa

SEQ ID NO: 1545 - DNA, 922 bp, Glycine max
  Predicted polypeptide sequence is orthologous to G1330
aattcggctctacctctctctgacacaagaattaagttgtgagatggagagaagtagtgaagaggagatgttaataacgaaaggtccatggacagagcaagaggattctcttctcttcaattacatcactgtccacggcgaaggtcactggaactctgtcgctcgctacacaggtctaaaacgaacgggcaaaagctgcagattaagatggttgaactacttgcgtccaaatgttcgacgtgggaacataaccctccaagaacagctcttgattcttgacctccattcccgttggggcaacaggtggtcgaaaatagctgaacatttaccgggaagaacagacaacgagataaagaattattggagaacgagagtggtaaagcaggctaagcaactaaaatgtgatgtgaacagcaagcaattcagggacacgttgcgttttgtgtggatgccacgtatgctagagcggattcgggctcaggcctcatcatcggcccaagcccaccaaagcagcttaatctccaacagtaacactcaagcacacagtggattgttgtcatcagcgcttcatgcccacgcgccttctctctctgactcgagcgcgtcgtacaatcttatgggtgctgatgctggaagttgctcatctcatagctactactcagacatagcaggcaatggttttggtggtgcggacttgtggacggatcaaaacatttgctttctgcaacaccagcttgctcatcatgacttgttctgatcatgcatacttcaacatcttgctccaaaattcactctaaactgcaacatataaagcaattgtaacactagtcgtgaaacatgcatgtttctttttatgttaatttggtgtgaaatttaataatctatacttcaattaatttcaagagaactgccatttgttgtt

SEQ ID NO: 1546 - DNA, 1316 bp, Glycine max
  Predicted polypeptide sequence is orthologous to G1330
ccacgcgtccgcccacgcgtccggttctgcaagactgtatctattggggaatctttcgcagcctcccactaaatcttttgaaaaaatattgaatcctcaaagtgccgatcctcctaaatccaatgtttgctctttttagcccttctctccctatatattttttcacaagcacctctttcaattctctccgtttcactagctcttattccaaagcaaaggaagaagaaagggcaaattagtataatatggagaccatgaatgttcaggtgatgagaagcttatcagatatggtaattaaaaaaggaccatggactgaggaagaagattctgttctgatcaactatgtcaacgtccacggcgaaggccactggaactccctcgctcgctcttcaggtttaaagcgaacgggcaaaagctgcagactaagatgggtcaactacttgcgcccaaatgttcgacgtgggaacatcacccttcaagaacagctcttgattctcgaactccattcccactggggcaatcggtgggccaaaatagcagaacaactgccagggagaacagacaatgagataaagaactattggaggactcgagtggtgaagcaggctaagcaactcaaatgtcatgtaaacagcaaacagttcagggacgccttgcgtttcgtttggatgccgcgccttatggagcagattcaggcttcttcttcttcctatggccttgatcaaaccacgttgtgcaacactcaaacccacagagacaactcaatggtttcatcgtactcatcagaggttgatcttcagcctccttctctttctgatacaagtataacttcatcatcttacaatttaattggtgatggaggcctgtcaacggaaagtgcagaaaaggggtccatatactctctttggcagcattgggactactctgacatacaagcatttgagccatgcaatggttttggtgatgcagacttgtggaccgatgaaaacatgtggttcttgcagcagcatcttgctgatgaattatgatccagttttgcaatttacactaggctttgcaattaacaagttcaacgatatatcgctaattaaactactgaatgtcattatttgagtgatgattgattgtttgtaattgtcctacatgatacattaattttcttatgaaataagatacttgtagttgaatagtacatttctctaagaacatgtaggaactcaatttaagttgaccctctgtttagtgtccgttattgttatatacaatataagaacattcattaaaaaaaaaaaaaaaaaaaaaaaaaaaaaaaaaag

SEQ ID NO: 1547 - DNA, 1513 bp, Glycine max
  Predicted polypeptide sequence is orthologous to G1330
cccacgcgtccgtccacgcgtccgcccacgcgtccgccctcccgcccgccctctcattctctttccctcttcaactcaaccacacacttcttagatcaaaagctatctttgttgctttgagtttgaaccttgaatctatcaatcaatcaaagtgggtggtgactcatggaagtgaaaggaataagggcaagcaactccaccaccaccaccaccacaatccaaagtgaggatgagatggaccttcgaagaggtccttggaccgtcgatgaggaccttgctctcatcaattacattgccaatcacggtgaaggtcgatggaactctcttgctcgttcagctggactcaaacgaactggcaagagctgcagattgagatggttgaattatttgcgtcctgatgttcgacgtggaaacatcacacttgaagaacagcttcttattcttgaactccacggtcgctggggaaaccgttggtctaaaattgctcaatatttgccgggaagaaccgataatgagattaaaaactattggagaacccgtgtccaaaagcatgccaagcaactcaaatgtgacgtgaatagcaagcaattcaaggatgccatgcgctatctttggatgccgaggctggtggagcgcattcaagccgccgcggctgccaccaccaccgtggcggctgcgggttctccaacggcatctgccagtgctaccacaaccatcaccaccaacaacaacaccaccacatacaactactacgacaacaacaaccttaacaacagttttgaggtgcacagtgggaacatgatggtgagaaatccaacaatcatgaacaacaataacttttgtggttcacatagttacactcccgagaatagtagcacgggtgcatcatcggattcgtttggtacacaggtttcacctgtctcggacttgactcaggattattacaataatgtcacggctgggaataataacaacaataaccctaatcctgatcagtattaccaacaagcacatgatcaactgagtttcttagactgcatcacaagcccatcagggttgttcgatttccaacccatggaaccaaacaccccgtggattaatctgagtaatgttggggacacgtccaacggtttctggaatgttgaaaacatgttgctctttcaacaattctctgacaacaacatgtgaaacattcgtaggagaattcatggtgaaaaccgtgacgaaggggggaaatattgttaaatttacagatgataaagttatataagtagaaaattgagcaaatagaataaattcatatgtaggacacacgtaggatccacgacatggacatagattttaagctaaggatattataagagcaaagagaaggaaactgtgaattactttttttaagtttaatttgtacggacttttttttgttctttgattttccttattttaaagggggtgtgggaaatatttgtaatttgagctttctcagtataagatttcattctttgaaattatt

SEQ ID NO: 1548 - DNA, 1514 bp, Glycine max
  Predicted polypeptide sequence is orthologous to G1330
attcggctcgagatccaacgctctttctccctatcccaacaatctcactcatacctcttcaatctaacaaacttaatttcttttgttttgagtttcttagagaatggatgaaaaaggagcaagaagtagcaacacccttttaagttgtgaggacgagatggaccttcgaagaggcccttggaccgtcgatgaagacctcactcttatcaattacattgccactcatggcgaaggtcgctggaacacgctcgccctctctgctgggctgaaacgaacggggaagagttgcagattgaggtggctgaattatctgcgtcctgatgttcgacgtggaaacatcacgcttgaagaacaacttttgattctggagctccattctcgctggggaaaccgttggtcgaaaattgctcaatatttgcctggtagaaccgacaacgagataaagaactattggagaacccgtgtccaaaagcatgccaagcaactcaaatgcgacgtgaatagcaagcaattcaaggacaccatgcgttacatttggatgccaaggctcgtggaacgcattcaagccaccgctgccgcctccgccaccacaaccgttaccgctaccaccgcgaccaacaatgcatacacctacggaagcaaccttaataacaacaaattcgaggttcacgatcacaagggcaaaatggggttaaccgatccttcagttatgaacaatgacttagtgggttcacatgtcacgcaaagttacacccctgagaatagtagcaccggtgcgtcatcatcagactcgtttgggactcaagtctcagcaatttctgatttgactgaatattacactgtcactgttagtggtaacaataacaatactaattctgcggattattatcaaccctctcaaattagttactcggatagttgcatcacaagcccatctgggttgttccctcaagggctagattttcaatccatggatccaaacaccccgtggaacatgcaaagtggggactcctctgacagtttttggaacgttgaaagcatgttgttcttagagcagcaactcatgaatgacaacatgtgaaaacattgggaataggaaaataagacttagatacggttcttcttagtattgtgttttaattaaagttaaagttaacacaagttattgaagtgaaactttaattttaattgaataataatactgaaaacaagagttgtatttaagttttattcttttatgaattatgaattagattgacagaaggggttgtttgtgaaatatacaggtgaaagtatagaaagtagcaacattaataaatcattcatgtgtagcacacacctagatatttaggatctatgatcaacaaatatctgaaacggtggattattataaggataaagagaaggattttttttttccagcttgtagtttttttaatgattaagtttttattaattttttgtcattacttttaatcgatctctctaaaaaaatttgctcatttttaaaaaaa

SEQ ID NO: 1549 - DNA, 1220 bp, Glycine max
  Predicted polypeptide sequence is orthologous to G1330
ttttcccaccccttaataaatttcccccccggattaataaaccatattatttcaactggtatcaacttttaggcacgtgactagtttagtctctaagatttaatatgtacatgaaagtgaggaaaacaatattcattgaacgcatgctcaactttcagcactgtgcattgcagaatgcgtgacggaagggaattgtattttatttcatttggaggtcataagaaagctgttgcaaaaagcacatattgtcgtcatcccacaaactttccaacaagtcaccgccactcccctgttccaacaacatttggttattgaaacctggccacagatccgaccccctttcaatactatggtcggaattcgaaggaagcagtgatgatgaagcgtgtaacacaagtccactttggtttggctccagtgcttgtgatgtgggctgaagccgctccagcaagcgcggcatccaaacgtaacgcaacgtgtctctgaactgtttgctattcacatcgcactttagctgcttcgcttgttttatcactctggtcctccaatagttctttatttcgttgtctgttcttcctggcagctgttgagcaatctttgaccacctatcgaaaaacattcattcattcatactatgttatatatgtgtacatccacccttataaaacaaattaatatatatatagagagagagagagagtggaatatttttataccatacctgttgccccagcgagagtgaaggtcgagaattaatatttgttcttggagtgtgatatttccacgccgcacgtctgggcgcaagtagtttagccaccttaatctgcaactcttcccactcctccttagacctgtaattgataaatctcataattaacatatataccattattacttggcacatgcagaaattaaattataattaagatgcatgcatgcctgcacatcgtgccacggaattccagtggccttcaccgtgtgtggcgatgtaattgaccagaatggtgtcctcctcaaccgcccatggaccttttctcatgcccatctccttttcgttatgcttctgcaacttcacttgtgcttgtactacagacccacctttcttaacatccatgataagtgttttaatttggaggagaggaagagtggttatatatacaggggattgatggtttcacttccccttctgtcgtcttctcgcagccgtacggacgcgtggg

SEQ ID NO: 1550 - DNA, 1009 bp, Glycine max
  Predicted polypeptide sequence is orthologous to G1330
aatcaatatgtagtggagggagtaattcttatgataactacataaacaaaggcatagactatttttttcaattaagattaataaaccatattatttcaactggtatcaacttttaggcacgtgactagtttagtctctaagatttaatatgtacatgaaagtgaggaaaacaatattcattgaacgcatgctcaactttcagcactgtgcattgcagaatgcgtgacggaagggaattgtattttatttcatttggaggtcataagaaagctgttgcaaaaagcacatattgtcgtcatcccacaaactttccaacaagtcaccgccactcccctgttccaacaacatttggttattgaaacctggccacagatccgaccccctttcaatactatggtcggaattcgaaggaagcagtgatgatgaagcgtgtaacacaagtccactttggtttggctccagtgcttgtgatgtgggctgaagccgctccagcaagcgcggcatccaaacgtaacgcaacgtgtctctgaactgtttgctattcacatcgcactttagctgcttcgcttgttttatcactctggtcctccaatagttctttatttcgttgtctgttcttcctggcagctgttgagcaatctttgaccacctgttgccccagcgagagtgaaggtcgagaattaatatttgttcttggagtgtgatatttccacgccgcacgtctgggcgcaagtagtttagccaccttaatctgcaactcttcccactcctccttagacctgcacatcgtgccacggaattccagtggccttcaccgtgtgtggcgatgtaattgaccagaatggtgtcctcctcaaccgcccatggaccttttctcatgcccatctccttttcgttatgcttctgcaacttcacttgtgcttgtactacagacccacctttcttaacatccatgataagtgttttaatttggaggagaggaagagtggttatatatacaggggatcaa

SEQ ID NO: 1551 - DNA, 718 bp, Oryza sativa
  Predicted polypeptide sequence is orthologous to G1330
ccccgggctgcaggaatcggcacgaggcagcacacatccatccatccatccatctatccagagagcacagcaacggctcatatatagtacccctctaccaaagcacaacaaccagaatctcctgagctcgatctagctactagcttgatctatccgatcaatcgactggcccgcgaggatcgatcgagactcgaaagggagggattttgatccggatcggtcgacgatggacatggcgcacgagagggacgcgagcagcgaggaggaggtgatgggcggcgacctgcgtcgcgggccgtggacggtggaggaggacctcctgctcgtcaactacatcgccgcgcacggcgagggccgctggaactcgctcgcccgatcagcagggctgaaacgcacaggcaagagctgccggctccggtggctgaactacctccgccccgacctccggcgaggcaacatcacgccgcaggagcagctgctcatcctggagctgcactcgcggtggggaaaccgctggtccaagatcgcgcagcacctcccgggacgcaccgacaacgagatcaagaactactggcgcacgcgggtgcagaagcacgccaagcagctcaagtgcggacgtcaacagccagcagttcaaggacgtcatgcgctacctctggatgccccgcctcgtcgagcggatccaggccgccgccgcccggcagcagcagcagcaggg

SEQ ID NO: 1552 - DNA, 1479 bp, Oryza sativa
  Predicted polypeptide sequence is orthologous to G1330
taacgcaaaagcctagtcgtctcatactcttcttgttcagttcttctcctcccaaatctttctgctataaaaggcattcgggtctctctttctccgaatcccagctgcacccttgcatcttctctcctctctctctctcttcttcttcttcttcttcttcttcttctccatatctcctactcctcctcgtgaagatcgatcgaccatcggcaatttcattcggtaatagttaagctaagatcaaatcaagatcggcgaaacgatggagatggtgctgcagaggacgagccaccacccggtgcccggggagcagcaggaggcggcggcggagctgtcgtcggctgagctccggcgagggccgtggaccgtcgacgaggacctcaccctcatcaattacatctctgatcacggcgagggccgctggaacgcactcgcacgcgccgccggtctgaagaggactgggaagagctgccggctccggtggctgaactatctccggccggatgtgaagcgcggcaacttcaccgcagaggagcagctgctcatcctcgacctccactcccgatggggcaaccggtggtccaagatagcacagcatctgcctgggaggaccgacaacgagatcaagaactactggaggaccagagtgcaaaagcatgccaagcaactcaattgtgatgtcaacagcaagaggttcaaggatgccatgaagtacctatggatgcctcgccttgccgagcgcatccatgccagggctggcgctgttgatgatagcggagactacagcaacaacgacttatcatgtgtatctggtgtaacaatggccactgttgctaattgttttgatggctctccgagcatggtgactagctcatcttccgattcgttcacgtcggagtcacaagatttgaagaagattaacttacatgtgcatggtgatgatgagaagatgaactctgaagactggatgcaggaggtggaccatgagttttggtctacagagattcagcctaataatgaacagtttcaggaccaacagcttaacggttgggtgcaaggtttttctgagggtttgtccgaaactctatggagtctagaggacatatggaagatgcaataaattttacatttacaaaggacatatttgtaaaatagaatagagagacatcaaggaaggcaaagagaaaaagttctttagtcatatactgtacgttgagacacttaagttctttgccaacttcaatgttttttttcttttatttttgctgcctctttcgatccctgaaggggtttttgccttctagatgtctaggggttcaaagaggaccagcggagatatatatgtgtttggatatgttgatatatgagctgatatatgccttactatatatatactccagaattgcactgaggattacatatccaattcagacatgcaaaccttaccagttgcaatattgtaaaaaaaaaaaaaaaaaa

SEQ ID NO: 1553 - DNA, 1310 bp, Oryza sativa
  Predicted polypeptide sequence is orthologous to G1330
  misc_feature (640)..(640): n is a, c, g, or t
cttctctctctctctctctctctacaacttctccgcttagcacagccaagctagagccatctagctacttttgctgctttctctctcctcctgcaacacacgacctagctgagagctgagctgagttgcgccggccatggcagcatcgcagaggagcaggagcacggcggcgcagctcgacgtcgacgaccaggcggcggccgatcagctgatgacgatgatgcggcggccagcggcggtactacaggatgaggccgccgccgaggaggaggcctccgcggcggcagcggacctgcagctggagctccggcgagggccgtggaccgtcgacgaggacctcaccctcgtcaactacatcgccgaccacggcgagggacgctggaactccctcgcccgcgccgccgggttgaagaggacggggaagagctgcaggctgcggtggctgaactacctccggcccgacgtgaagcgcggcaacttcaccgccgacgagcagctgctcatcctcgacctccactcccgatggggcaacccggtggtcaaagatagcgcagcatttgccagggaggaccgacaacgagatcaagaactactggaggacccgagtgcaaaagcatgccaagcagctgaactgcgatgnccaacagtgctaggttcaaggatgctatgagatatctatggatgcctcgcctcgccgatgcaagccagcttcgggtgatcaccatgggtataatagtaccactgccatgggcgatgctcatgggatgccagtgatgacatcgtcgtcgtcggactcgttcgcgacatcagagtcatacgatgggggcctttatgcaaatgggcaggccaatgagatggtgaagggtggggactactggatgcagggagcaaataaagggttttgtagtaattatgagtcagagcaacttcatcctcatgagcatagccagtttcaggatccagatcttgttggttgggttcagggcttttctgagggcatttccgagaatttttggagcttggaggacatttggaagatgtagtgaattttgcattaatttgtattgtggctatatatacacatacgtacaggagtatacattttataatattgattgataactcgtggaacaaagattagagtcagcttattctaacttcaaaagttactacgagagaaaaaaagtaaatttcttctttgattttcctttttttttgtatggatgtcgattgacacatatgtatatgttgtcccacccatgtaaaacatataagaagacgtgattgtttctacaacttttgggcaaaaa

SEQ ID NO: 1554 - DNA, 325 bp, Oryza sativa
  Predicted polypeptide sequence is orthologous to G1330
ctacatgtgaatattttgatgtgacgtgaagagaaaaattaatcttggtttttggttgttgtcatgcacggctgaaacgcacaggcaagagctgccggctccagcggctgaactacctccgccccgacctacggcgaggcaacatcacgccgcaggagcagctgctcatcctggagctgcactcgcggtggggaaaccgatggtccaagaacgcgcagcacctcccggaacgcaccgacaaccagatcaagaactactggcgcacgcgggtgcagaagcacgccaagctgctcaagtgcgactccaacagccagcagttcaagga

SEQ ID NO: 1555 - DNA, 1507 bp, Zea mays
  Predicted polypeptide sequence is orthologous to G1330
gatcatcggctatacctaccagctcgctgttcttgctgaagccctggagctatatagcttcgatctgcgcagcacaggttgtctgtcgactagtgattagtgaagaagatggcggcgcgtgaccaccgagagctgagcggcgacgaggactccgtggtggcggccggagacctccgccgcgggccgtggacggtggaggaggacatgctcctcgtcaactacgtcgccgcgcacggcgagggccgctggaacgcgctggcacgatgcgcagggctccggcggacggggaagagctgccgcctgcggtggctcaactacctgcggccggacctgcggcggggcaacatcacggcgcaggagcagctgctcatcctggagctgcactcccgctggggcaaccgctggtccaagatcgcgcagcacctcccagggcgcaccgacaacgagatcaagaactactggcgcacgcgggtgcagaagcacgccaggcagctcaactgcgacgtcaacagccagcgcttcaaggacctcatgcgctacatctggatgccgcgcctcctcgagcgcatcggctccgacgactccggggacggcgccttcgttatcgacgccgccacgccgacgccaacgccgacgctcctcacggccgccacgtggtgcgtggacgacgtcgagctgtcctgcaccaccgccgtgtcgtcgtcgtcgtccgtgtccacggacagcatgcaccagcagcagcagcagctcgtcgccgtgtccccgccgccacagcccgccgccttcggcgagagcaacaacgacgcctcccactacggtgtccacaacagcaacgctgccatgtccatgtggggggacacgctgtgccaaccaccgcactcggcgacgccgcacctggcgggcgccgggacctgtagctggtccgacgagtctctgctggtacctgatgccggcctctccggcggtggcggcgtgtacgccgacatggggcttccggacctctgcgacaccgacaccatgtgggccgccggcgccagcgccgacgacgacctgtggtacacgcagataatggggctgtgaaattaaagcaagtccgccggcggccggttggatttggcctcatggatttctagctagcccggtggaggcggcgggcagcgagttaattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagtaaaagaaaaaggggggggcccttttaaaggaaccaaatttacttccccggggggggagaagaaaagtttttttatgagggaacctaaattaaattcaatggccggggttttaaaaacatttgaattggaaaaaccctggggttaccaaattaaatcggtttggaaaaaaatcccttttttcaagttggggtaaaaagaaaaaggcccccccccatcgccttttcaaaaagaggggg

SEQ ID NO: 1556 - DNA, 691 bp, Zea mays
  Predicted polypeptide sequence is orthologous to G1330
aagtgtcttcccagttaactccgttgtacgtctctctccctttactagctccgatcttctgctagctcctccgaaccacttgtcgacacgatcgatcgtcgtcgtacgcctgcttggcgtacatactgctactaatggagacggcgctgcagcagagtgctgctactactgctggcggcggcatgaggcccggcgcggcgacgacggtgaagaaggcgaggcaagagctggagcaggagttgcggtttccgcaggcggcgcccgcggatcagggcggccttgacgaggagctccggcgcgggccgtggacggtggacgaggacctcacgctcatcaactacatcgccgactacggcgagggccgctggaacgcgctcgctcgcgccgccgggctgaagcggacggggaagagctgccgcctgcggtggctcaactacctgcggccggacgtgaagcgcggcgacttcaccgccgacgagcagctcctcatcctcgacctccactcccgctggggcaaccggtggtccaagatcgcggcgcacctgccaggccggacggacaacgagatcaagaactactggcggacgcgggtgcagaagcacgccaagcagctcaactgcgacgtgaacagcaagcgcttcaaggacgccatgcgcttcctctggatgccgcgcctggccgagcgcgccgc

SEQ ID NO: 1557 - DNA, 1530 bp, Zea mays
  Predicted polypeptide sequence is orthologous to G1330
cccacgcgtccgcttctctagatctcctcctcctcttcctctctatctctctctctccccaaccaacaacctgtcgattaagctagctctcagctcatcccggcctcagaaccaaccaattcctgttttagacggttaacaacctacaacaacagttagcatggccacaacacagagcaggggcggcggcggtgttgttcccgttgaggtggacgaggagcacggccgccgccggcagggaggagcagcgccgcaggaggaggaggaggaggaggcggccgagaagccggagctccggcgtggcccgtggaccgtggacgaggaccacaccctcgtcaactacatcgccgacaacggcgagggccgctggaactccctcgcccgcgccgccggtctgaagcgcacgggcaagagctgccggttgcggtggctcaactacctccggcccgacgtgaagcgcggcaacttcaccgccgacgagcagctgctcatcctcgacctccacacccgctggggcaaccggtggtcgaagatagcgcagcacctgccggggaggacggacaacgagatcaagaactactggaggacgcgggtgcagaagcacgccaagcagctcaactgcgacgccagcagcaagcgcttcaaggacgccatgcgctacctctggatgccgcacctcgtcgacgccaccgctaccaccgccgacgacgaataccaccaccaccaacaccaacaccaagccgccgcagcaggcaacatcgacggcctgctcgccggcggcgacgtcgaccacgtccagcacgctctggcggcgggcgtggccgctgctatggcgtcgtcgtcgtccgactcgctcgcgtcggagccgtactcgtacgaggacggtggcctcctcgcgagcctgcgcgccggcgacgacatgcagctggtgatgagcggcggcggctgggcggcggcgcaggcgcaggaggccaacgaccaagggctgtggccgtcgtcgtctggtcatggtctgtcgtcgtcggtgcaggccgctgccggtggtgccggccagtttgaggacccggagctcagtggatgggtgcaaggtttctccgacagcattattactggtaacctttgggccttggaggaaatttggaagatgcaatgagcaattttgcgttttccacacgcatccaacgaagagctagcggaaatgtatacgactagtgatgttgacagtagatagaacatgaggttgtcatatataattctcgatctctccctctctctatcgatctatatatactctctctctctctctctctctctatatatatatatatatatatatatatatatatatatatatatatatatatatatatatatatatatatatatactctaactccaaatatactatacggtatactaaagttgtatagcattttcatttttttcctcgtttttttatttcgcctcttaaggttcattcttatagaggttggaaaaggagggtattgtttatgcaagtcgaaacaaaaa

SEQ ID NO: 1558 - DNA, 1447 bp, Zea mays
  Predicted polypeptide sequence is orthologous to G1330
agactaataaattccctcacatgctttactctctcctcgcatcttagcctataaaaggactggggaattccaggccggctgccgataactgatcatcttctctagatcttctcatcataccgataccggcctcaacgccctctttttcccagcctcacaaccaattcctgtttcagtcgatcgcagttagcatggccacgacacagagctgtcagagcaggagcagcgcctgcagcaaggctgctgcttgcttcccggccgccgtagcggtcgacgaggagcacggccaccacagccaccagctgaagggaggagcgcaggaggaggctgagaacgacaataataagccggagctccggcgtggcccctggacggtagacgaggacctcaccctcgtcaactacatcgccgacaacggcgagggtcgctggaacaacctcgcccgcgccgccgggctgaagcggacgggcaagagctgccggctgcggtggctcaactacctccggcccgacgtgaagcgtggcaacttcagcgccgacgagcagctgctcatcctcgacctccacacccgctggggcaaccgatggtcgaagatagcgcagcacctgcctggaaggacggacaacgagatcaagaactactggaggacccgggtgcagaagcacgccaagcagatcaactgcgacgccaacagcaagcgcttcaaggacgccatgcgctacctctggatgccgcacctcgccgacgacgtcgataccatcgctgcggccaacgacgacgacgaagaccaccaccaccacctacgcctcctcgtcctgcaccaccaccaggcccagcacctgcagcaagctgctgccgcggccggcggcgctgccaacgaccttgctgcgggcgcctacgacgtccgccagctgcacgcgctgccctcgtcaggcatggcggcggtgccgacgacggcgacgacgtcgtcgtccgactcgctcgcgtcggagtcgtacgatgacgggggcctgcttttcgcgaacttgcgcgccggcgagatgctgatggacggcggagattgggcggcgcagcaggaggccgaccaagggctgtggccgccgccgccgccgacgtctgatcttgatcagtcggtggtgcaggctgctggtgccggcgctggccagtttcaggacatggagctcagtggttgggtgcaaggcttctccgagagcattacagataacttttgggccttggaggaaatttggaagatgcaatgagcgagcaattttacatcttacacatccatccaaattaaagacaacatagatacacatatacataccatatattctaacaacaggtgccatatacgatatacatacacaagttgttgtatagttgtattccgcttatatatatataatttttgcctctcgatgaagttcattcttatagcggccgg

SEQ ID NO: 1559 - DNA, 752 bp, Zea mays
  Predicted polypeptide sequence is orthologous to G1330
  misc_feature (429)..(429): n is a, c, g, or t
  misc_feature (436)..(436): n is a, c, g, or t
  misc_feature (440)..(440): n is a, c, g, or t
  misc_feature (484)..(484): n is a, c, g, or t
  misc_feature (498)..(498): n is a, c, g, or t
  misc_feature (572)..(572): n is a, c, g, or t
  misc_feature (606)..(606): n is a, c, g, or t
  misc_feature (654)..(654): n is a, c, g, or t
  misc_feature (692)..(692): n is a, c, g, or t
  misc_feature (710)..(710): n is a, c, g, or t
  misc_feature (747)..(747): n is a, c, g, or t
ggcatccgagtcccactagctccggccccgtgtcttcattccccagttaactccgttgtacgtctctctccctttcactagctccgatctccttggatcgatctcctgctatctcctccgatccgatccacttgtcgacacgatcgatcgtcgtcgtacgcctgcttggcctacatacgactgctactaatggagacggcgctgcagcagagtgctgctgctactgctggcggcggcatgaggccggccggcgcggcgacgacggggaagaaggcgaggcaggagctggagctggagcaggagcgggagttgcggtttccgcaggcggcggcggccgcggatcagggcggccttgacgaggagctccggcgcgggccgtggacggtggacgaggacctcacgctcatcaactacatcgccgaccacggnaggggcngctnggaacgcgctcgctcgcgccgccgggctgatgcggacggggaanaactgccgtctgcngtggctgaactacttgcggccggacgtgaagcgcggcgacttcaccgccgacgagcagctcctcatcctcgacntccactcccgctggggcaaccgatggtccaagancgcggcgcactttccaggcaggacggacaacgagatcaagaactactngcggacgcgggttcagaacacgccaagcagctcaactnccacgtgaacagcaagcncttcaaggacgcatgcgcttcctctggatgccacgcntagcg

SEQ ID NO: 1560 - DNA, 1667 bp, Zea mays
  Predicted polypeptide sequence is orthologous to G1330
  misc_feature (14)..(14): n is a, c, g, or t
gagctcggccgggnacctcatctcacccttcttcctctgccttcctggcttgccttctcttctcccgccttctcctcctcccagcacagcagcagctgtgaccacatcaccacacacacacacatatatacttggtcatcatccagcttccagcagccagctgcccgccgatcaacgtgtaggcggttcaaagggaaatctgctgatggacatggcgcacgagagatcagacgccagcagcgaggaggaggtgatggccggcgagctgcggcgcgggccttggacggtggaggaggacctccagctggtcaactacgtcgacgcgcacggcgagggccgctggaactcgctcgcccgatcagcaggtctgaagcgcactggcaagagctgccgcctccggtggctgaactacctccgccccgacctccggcgcggcaacatcacgccgcaggagcagctgctgatcctggagctgcactcgcgctggggcaaccgctggtccaagatcgcgcagcacctccccgggcgcaccgacaacgagatcaagaactactggcgcacgcgcgtgcagaagcacgccaagcagctcaagtgcgacgtcaacagccagcagttcaaggacgtcatgcgctacctctggatgccccgcctcgtcgagcgcatccaggccgccgccgccgccggcgccccccagcagcacaaggccggcgccgcggacacgccgctctcgtcgccgtcgtcgtggcagcccggcggtggcggcggcctctacgcgtcgccggacctccccgccacggacgcctgctgctggcctcccgcagactgctacccagccgccgccgccgccgtcggtgacggtgaccatcatcatcagctactgatgaacaaccccgccgccgtgccggagctgtcggcgagcactaccacggccgggtcggcctccccgtcatcggattccggcgcgggcgcacagccctgctggcttgcgccggtgggtggcgcggagtggttcaccaccacctgcgacgccaccagcagcaccgccgccgtcctcctggccgggcaccagcaccagcagcagcaacaatggtcgtgcctgctcggggaggcgacgtgggcgtcgtcatccgagctccctgatctgggctgcgtcgcggacttcgagatcggcagcttcgacgtggagagcatctggagcacggacgacagcttgtggttcacgcaggcgcagggcgtgtgaattgaacccacacgcgcggcgacatggaaatccacgaccacggcgtcaaattaaaccggtggtggatcggacaccccgcacgtcggggacgcctagcgaaggtgccgagagagctagctgagacacgggttagaagaaggagagagattatttggaggaaccgaagacgacgcgggacggctactctttgctcggttcaagatgcttgctgttcttgcctccaggacttttcttccgctccagttctactccgtttcctagtcttgattccctagcggcttgtgtagggtatatacgccaagaaaattccagaaaaaagggggaaaacgtagctgttgtagtagtacatatatactagtagcgtcaagtgtttgtacgtagctgttgagtaattaagcgcaatacatatgaacaagtgaagttactg

SEQ ID NO: 1561 - DNA, 851 bp, Zea mays
  Predicted polypeptide sequence is orthologous to G1330
  misc_feature (802)..(802): n is a, c, g, or t
acctcatctcactcttcttcctcttccttcctggcctgccttctcttctcccgccttctcctcctcccagcacagcagcagctgtgaccacatcaccacacacacacacatatatacttggtcatcatccagcttccagcagccagctgcccgccgatcaacgtgtaggcggttcaaagggaaatctgctgatggacatggcgcacgagagatcagacgccagcagcgaggaggaggtgatggccggcgagctgcggcgcgggccttggacggtggaggaggacctccagctggtcaactacgtcgacgcgcacggcgagggccgctggaactcgctcgcccgatcagcaggtctgaagcgcactggcaagagctgccgcctccggtggctgaactacctccggcccgacctccggcgcggcaacatcacgccgcaggagcagctgctgatcctggagctgcactcgcgctggggcaaccgctggtccaagatcgcgcagcacctccccgggcgcaccgacaacgagatcaagaactactggcgcacgcgcgtgcagaagcacgccaagcagctcaagtgcgacgtcaacagccagcagttcaaggacgtgatgcgctacctctggatgccccgcctcgtcgagcgcatccaggccgccgcagccaacaataacgccagcgggcgccggggttccgccagctggcgccgccgcggacgacacgccgctctcgtcgtcgtggcagcacggcggcggcgccgacgacgacggcgccctctacgcgtcgccggagctgcccacgnacgcctgctgggctcccgcagactgctactactacccagccgccgctga

SEQ ID NO: 1562 - DNA, 635 bp, Lycopersicon esculentum
  Predicted polypeptide sequence is orthologous to G1330
gaaaattgaagttgtatcgggacgaggacgagaaggaggacgaggagatagtgaggaagaaattaaggaggaagaaattgttatggatcttcgaaggggtccatggaccgttgaagaagactttacacttatcaattttattgcacatcatggtgaaggtcgttggaattctcttgcacgttgtgctggtttgaagagaacagggaaaagttgtagattacgatggcttaattatcttcgaccagatgttcgacgtggtaatattactgttgaagaacaactcttgattcttgaattgcattctcgatggggcaatcgttggtctaaaatcgctcaacatctccctggaagaacagacaatgagataaaaaattactggcgaactcgggtacaaaagcatgcaaaacaactcaaatgtgacgtgaatagtaagcaattcaaagataccatgaagtatctttggatgcctaggttagccgaaagaatacaagccgccgcggctacttccaacccaacggcggcttcttcctccggccccaccaccacatacattcaaagtcaagagattcaacatccactaccaaacatgaaccatcatgtacccgaatacttacctatccaactgatgaatatcg

SEQ ID NO: 1563 - protein, 298 aa, Oryza sativa
  Orthologous to G1330
MAREVSSEEEAGGGDELRRGPWTVEEDLLLVNYIAAHGEGRWNALARCAGLKRTGKSCRLRWLNYLRPDVRRGNMTAEEQLLILELHGRWGNRWSKIAQHLPGRTDNEIKNYWRTRVQKHAKHLNCDVNSQQFKDLMRYLWMPRLLERIHRSSQSQSHDADDADLSVSAATSCITSDLVVDAHHPPLAMADSNDSAAMWQQHQAPQMSVAGAPPPTTTMAQHVVLPTAAASCHQMQDQFVCARAAETTTCCWSESESLPGLAGLYYDDAAAALPEFDVETMAMWGPEDDPWYTQMLGL

SEQ ID NO: 1564 - protein, 180 aa, Oryza sativa
  Orthologous to G1330
MEMMRMAMSPAMSSATAAAASEDEGDLRRGPWTVEEDMLLVDYIANHGEGRWNSLARCAGLRRTGKSCRLRWLNYLRPDVRRGNITADEQLLILDLHSRWGNRWSKIAQYLPGRTDNEIKNYWRTRVQKHAKQLRCDVNSKEFRDVVRHVWMPRLIERIQADAAAAGEVSAPAPVSAAAT

SEQ ID NO: 1565 - protein, 293 aa, Oryza sativa
  Orthologous to G1330
MDAPCGWTTSAAAAVAEEEDVRRGPWTVEEDAVLAGYVAANGEGRWNELARAAGLRRTGKSCRLRWLNYLRPDVRRGDFTPQEQLLILELHFRWGNRWSRIAQHMPGRTDNEIKNYWRTRVQKHAKQLGCDVNSRQFKDVMRHLWMPRLVERIHAAAASSERAAPPPCAAAPASHSGMCHSPDPSTTTSSMAGSSVTHGEQFPSSTNHHLMTMASVTTAAADWSSEQCGSGSATSTSVGISYDMFEGSWSELLARAYDDDGADSSLLPDFQMADTGDNCWWSNLEDIWSQQPY

SEQ ID NO: 1566 - protein, 329 aa, Oryza sativa
  Orthologous to G1330
MDMAHERDASSEEEVMGGDLRRGPWTVEEDLLLVNYIAAHGEGRWNSLARSAGLKRTGKSCRLRWLNYLRPDLRRGNITPQEQLLILELHSRWGNRWSKIAQHLPGRTDNEIKNYWRTRVQKHAKQLKCDVNSQQFKDVMRYLWMPRLVERIQAAAAGQQQQQEGGTDTPPLSWQHGGSDGLYESPELPAPDASCWPAEYCAAAGGAQSGGTPAPELSSTTAGSSSLSTDSGAGAQPSWPTQADGAEWFTTACDASSATGGVAMRDTELELAQPPCQGGQTWTTSESSLPGLTFPDLAVADFEIGGFDVDSFWTSMEDDQLWCPTQAAV

SEQ ID NO: 1567 - DNA, 1045 bp, Glycine max
  Predicted polypeptide sequence is orthologous to G1331
  misc_feature (1042)..(1042): n is a, c, g, or t
  misc_feature (1044)..(1044): n is a, c, g, or t
cggcattcggctcgagggaagacaaagtttacctaagagccaactttatcactatattgtatgtattacgaagatatggcgggaaacgtggggtggggtgtgatagaagaggagggatggaggaagggaccttggacttctgaggaggacagattgctcattctgtatgtcaagttcccatggtgagggcagatggaactctgctgctaggcttgcaggactgaaaagaaatggcaagagctgcaaattgagatgggtgaattacctgaggccacacctcaagaagggtcaaattacacattcggctcgaggcataattcaagagctgcatgctaggtggggaaacaggtggtcaacaattgcaagaagcttgccaggaagaactgacaatgagataaagaattattggaggactcacttcaagaaaaagatgaaaactccatctgatgctgctgagaaggcgagaatccactcctcgaggagacagcattttcagcagcaacaacagcagttgaagcagcagcagcaacaattccaattcaacttggacatgaaagggatcataaacttgcttgaggaaaatgaccatagagtgccttctatatctcaagaggcacaagaaatggccagcatgtacccaaacacttcagaacaccagggctacttctactcaatattcaatgtcaatgacaatgacaataatgtctctgcacctgagtcctcaaatgaagaaattctatgggatggactgtggaacttggacgatgttctttgcaatttcaatgcagctagtgccacaagcaaagccagtttacacaatttagtttctcctttctgttaaaaggttttatttagccttgaaaacagttaggaagaatagtagtgtactaatgtcagtcacggcttgataaggctccaaaatcctgcagcttagagttaggattaattgtttcttaaaagtgtggagtctgggtagtaagtaatttctgaaggcgagttattgtgtaaccctttaataaagtatctcaattttgcttataanana

SEQ ID NO: 1568 - DNA, 1109 bp, Glycine max
  Predicted polypeptide sequence is orthologous to G1331
ggaagacaaagtttacctaattaagagccaaacttaaaaactttttgtatgtattgggaagttatggcaggaaacatggggtggagtgtgataatagaagaggagggatggaggaagggaccttggacttctgaggaggacagattgctcattcagtatgtcaagttccatggtgaaggcagatggaactctgttgctaggcttgcaggactgaaaagaaatgggaaaagctgcagattgagatgggtgaattacctgaggccagacctcaagaagggtcacataacaccacaagaagaaagcataattcaagagctgcatgctaggtggggaaacaggtggtcaacaattgcaagaagcttgccaggaagaactgataatgagataaagaactattggaggactcacttcaagaaaaagactaaaaccccctctgatgctgctgagaaggcgagaatccgttcctcgaggaggcaacaatttcaacagcaccagcagcagttgaagcagcagcaggttcagcagcagcaacaacaacaccaacaattccaattcaacttggacatgaaaggggatcataaaccttgcttgaggaaaaataaccatagaagtgcccttctatatctcaagaggcacaaagaaatggccagcatgtaccctaacacttcagaacatcaggactacttctactctatgttcaatgtcaatgacaataatgtctctgcacctgagtgcttaaacgaagaaattttgtgggatggactgtggaacttggacgatgttctttgcaatttcaatgcagctagtgccacaagcaaagctagtttacataatttagttgctcctttctgttaaaggttttatttagccttcaaaattgttaggaagaatattagtactaatgtgagtcacggcttgataaagctccaaaatcttggagcttagagaaaaaaaatatcattaaatgttccttgttagtttttgttagtgagaaatttaaactcacaacctctccgctcctccttgaagcttagagttagggtagtgaatgatattctgaaggcgtgttattgtgtaacccattaataaagtgtctcgattttgcttat

SEQ ID NO: 1569 - DNA, 758 bp, Oryza sativa
  Predicted polypeptide sequence is orthologous to G1331
ggaaagaaaggtttgtttgcttcgcggccatagatagctatagctgctatcttaatctagctcgcctttaatttggcccccggcctctctctctctgcctgtgtcctaccagctgcacaaaaatctcccagaaaacaggcagaggggagagagacagatacgcatcaattaagctcattttcttcgatctgctggtgaaagaagaactgaagaagagaggtagctggactgaagaggccggcaatggcggcggcggaagtgcagtcggctgccgggtgggggaggcagctgcagcaggacggcggcgggtggaggaaagggccgtggacgagccaggaggacgcgctgctcgtcgagcatgtcaggcagcacggcgaaggccggtggaattctgtctccaagcttacaggtctgaagagaagcggcaagagctgcaggctacgatgggttaactacctgaggcctgatctgaagagaggcaagatcactccccaggaggagagcatcatcgtccagctccatgccttgtggggcaacaggtggtcgacgatcgcgcgtagcctcccgggcaggacggacaacgagatcaagaactactggaggacgcacttcaagaagggcaagccgtccaagaacatcgagcgcgccagggccaggttcctgaagcagcgccgcgagatgcagcagagccagcagctgcagcagccgacgctaatgccgacgccgacgccgcagagcaggacatcatcgttgccgag

SEQ ID NO: 1570 - DNA, 634 bp, Zea mays
  Predicted polypeptide sequence is orthologous to G1331
  misc_feature (574)..(574): n is a, c, g, or t
  misc_feature (587)..(587): n is a, c, g, or t
  misc_feature (590)..(590): n is a, c, g, or t
ggacggcgcaggaagacaagctgctggtcgagtatgtcaggcatcatggagaagggaggtggaattctgtcgccaagttaactggtctgaagcgaagcggcaagagctgccggctccggtgggtgaactacctgaggcccgacctgaagcgaggcaagatcacgccgcaggaggagagcgtcatactccagctccacgccctgtgggggaacagatggtcgacgatcgcgcgcagcctgccggggcggacggacaacgagatcaagaactactggcggacgcacttcaagaaggccaagccgtccaagaacgtcgagcgcgccagggcgcggttcctcaagcagcgacgcgagatgcagagccagctgctgctgctgcaggggcaagatcagcatcggcaggaggaggaacagcccgatcatgacgacgacggcgccagtgaggcaacgccgggtgttccactggaggaggaggaggagcagcagcagcagcagcatgaggacctgcggatgatgctgcagcaggacatggacgacctgctgttccagttctgcccgatggcctcctgcacttnctcctcctgcctnctncccggcggcggcagctgcgccttcgtcgtcagcgcgtcggcgag

SEQ ID NO: 1571 - DNA, 789 bp, Zea mays
  Predicted polypeptide sequence is orthologous to G1331
gcccagcgttccatactcctggagatagaaaatatatagacagagctcgttactagtcgtagctagccagggctagctgtagctgaagtcatcatcagataaatatattcatcagcctgtaattaatagctagttttcagtggattagctagcttggcaatatatatttaactaataaggcggcggtggcatggacgcgatcagcagcctgctgctgcaggagggctggaggaagggcccgtggacggcgctggaggacaggctgctcaccgagtacgtgcagcagcacggcgagggcagctggaactccgtcgccaagctcacagggctgcgccggagcgggaagagctgccggctgcggtgggtgaactacctccggccggacctcaagcggggcaagatcacccccgacgaggagaccgtcatcctccacctgcacgccatgctcggcaacaggtggtcggcgatcgcgcggtgccttgccggggaggacggacaacgagatcaagaactactggcggacgcacttcaagaaggcccggccgacgcggcgcgcccgggcgcagctgctgcaccagtaccagctgcagcagcaggagcagcgccgccagtacctgcagctcctgcagccgcagcagctgcagcagcagcagctgggggtggtgaaacaacagcagctggagcagcagagcccgccggagcctcatcaccaggccatgatggacagcctgcaaagcacggcggcgtgctactgcagcccggtgccggaggaatgctgcccgctcccgg

SEQ ID NO: 1572 - protein, 289 aa, Oryza sativa
  Orthologous to G1331
MEGQQFAWGREEGGWRKGPWTAQEDKLLVEYVRQHGEGRWNSVAKITGLKRSGKSCRLRWVNYLRPDLKRGKITPQEESVILELHALWGNRWSTIARSLPGRTDNEIKNYWRTHFKKGKPSKNIERARARFLKQRREMQQQSQLMQTGQQQQLGQDDDATSAVVDDNLAEVAPPAATSLTHDGELQIMQEMAPDMDDLLYYHPGDMSPYSYDDLLGSGGGECGAVAASAGAAASTSEGSSEELDGGAATWGSLWNLDDVVHDMMIDCAAGAGCCWGSFPPLQDKGLAFY

SEQ ID NO: 1573 - DNA, 782 bp, Glycine max
  Predicted polypeptide sequence is orthologous to G1363
  misc_feature (28)..(29): n is a, c, g, or t
  misc_feature (38)..(39): n is a, c, g, or t
  misc_feature (56)..(57): n is a, c, g, or t
  misc_feature (771)..(772): n is a, c, g, or t
gtacgacctcgcaggtatccggtccggnnaattcccgnnggtcgacccccacgcgnntccggaaaaattagagagtgagaagaggaagaagaacattctagagggagaaacattacacaactgaacccacaattctattactgtttgcttcaaaggatataattgaaggttttgagaactaaggctgcaatactgtatacattctactcaaggaatggtcaatatctggaaatttgctatgtggaaaggttaaatgaagccattcttgtcgaatcatactgattctatgtacaattgttcccaagttggttgtagtcatccaatgaatcaacaaatggtgccccagatgctgggattagcatccaccagaattgcattaccagttgatcttgcagaagatgggcccatttatgtcaatgccaaacaataccatggtatactgagaaggcgacagtcacgagcaaagcttgaagctcaaaacaaactcatcaaaagtcgtaagccatatcttcacgagtctcggcaccgccacgcattgaacaggggtaggggatctgggggacgctttcttagcgccaaacagctgccacagtctaatgcagaactagtcactgatgcctatcaaaagaaagatgcatcagaggcagaaaatcatccctcaagcaccggtgaaaatgcatctatcacattcacagccatctctgccttaactagtatgtccagtaacagtgtcaatttccccaacatggctggatcatcgcaatgcagtgnnggactcacct

SEQ ID NO: 1574 - DNA, 378 bp, Oryza sativa
  Predicted polypeptide sequence is orthologous to G1363
ggctttgcacttgcagaggagagaagcaaggtgagaagtgaggaggcagcaagggaggaggtttgccggagaggggacatgctccctcctcatctcacagaaaatggcacagtaatgattcagtttggtcataaaatgcctgactacgagtcatcagctacccaatcaactagtggatctcctcgtgaagtgtctggaatgagcgaaggaagcctcaatgagcagaatgatcaatctggtaatcttgatggttacacgaagagtgatgaagggcatatcatatccatatgcttgattcgttctatggtggtgctgtagcgacttatggcacacatgctattatgcatccccagattgtgggcgtgatgtcatcctccc

SEQ ID NO: 1575 - DNA, 1209 bp, Oryza sativa
  Predicted polypeptide sequence is orthologous to G1363
  misc_feature (1082)..(1082): n is a, c, g, or t
gaactaggcaccccccgggcgcggctttgcactcgcggaggagagaagcaaggtgagaagtgaggaggcagcaagggaggaggtttgccggagaggggacatgctccctcctcatctcacagaaaatggcacagtaatgattcagtttggtcataaaatgcctgactacgagtcatcagctacccaatcaactagtggatctcctcgtgaagtgtctggaatgagcgaaggaagcctcaatgagcagaatgatcaatctggtaatcttgatggttacacgaagagtgatgaaggtaagatgatgtcagctttatctctgggcaaatcagaaactgtgtatgcacattcggaacctgaccgtagccaaccctttggcatatcatatccatatgctgattcgttctatggtggtgctgtagcgacttatggcacacatgctattatgcatccccagattgtgggcgtgatgtcatcctcccgagtcccgctaccaatagaaccagccaccgaagagcctatttatgtaaatgcaaagcaataccatgcgattctccgaaggagacagctccgtgcaaagttagaggctgaaaacaagctggtgaaaaaccgcaagccgtacctccatgaatcccggcatcaacacgcgatgaaaagagctcggggaacaggggggagattcctcaacacaaagcagcagcctgaagcttcagatggtggcaccccaaggctcgtctctgcaaacggcgttgtgttctcaaagcacgagcacagcttgtcgtccagtgatctccatcatcgtcgtgcgaaagagggcgcttgagatcctcgccgtttctgtcatggcaaatcatccttggcttatgtgtggtgcccagcaaaaaaaaatctgactgaacctgtgtgtaaactgatgggtatgggtgggttttgtgcaactgttacttgggtgcttgacatctgtgtctgtggttcctctgcctccttagtttggagacggtgcagctgcagctggtaccagtaatctgatcatgctagacttgtgacaaggacaaaactagcaccccgttatgtttcctggcttntgaatttggtggtcattcagtaagcaagcactcgacgtcagcgggagggggttgcttcgattgatctagttctttcgcgataaacttatttaattttgaacaaaaaaaaaaaaaaaaaaaaaaaaaa

SEQ ID NO: 1576 - DNA, 503 bp, Oryza sativa
  Predicted polypeptide sequence is orthologous to G1363
  misc_feature (68)..(68): n is a, c, g, or t
gcacaggcttgcatttcatacccatacaacgattctggttcaggagtttgggcatcctacaggtggangctcggtgttccatcctcaaattgtgggaggaggcacatcgccaagagttcccttgccctccctggagatagcagatgatgggcccatatatgtcaatcccaaacaatatcatggaattcttcgcagaaggcaactgcgtgctagggtagaggcccagaataagctcgtcaaaacccgaaagccttaccttcacgaatctcggcatcgccatgcaatgaagagggctaggggcactggtgggcgattcctgaataccaagcagctccagctgcagcaacagtctcacactacctccaccaagaccaccacagacagccaaaattcttcaggttcagtccatctacggctaggtggtggcgcaatcggagatcaaactccatttccgttcaaagcaatggattcacaagctaacatcaagagagctgcagcttctg

SEQ ID NO: 1577 - DNA, 682 bp, Oryza sativa
  Predicted polypeptide sequence is orthologous to G1363
ctgcaggaattcggcacgaggcgaagagccgaagaggggaggcgaggatcagaggaggcagcctcatcgtcatgcttcagcactagtagtagtagtgccaccatttctttgccctcgatctttccccagagagagagagagagagtcttgattgggggaggagagagggagagagagaaagagagaggaggacagaaaatgtttgtggatcttgagtaatgccttctaataatgataatgctgttgcaagaaatggagaatcatcctgtccaatgcatggccaagaccaactatgattttctggccaggaataactatccaatgaaacagttagttcagaggaactctggtggtgactcgtcaccaacaaagtctgggcagtctcaccaagaagcatctgcagtaagtgacagcagtctcaacggacaacacacctcaccacaatcagtgtttgtcccctcagatattaacaacaatgatagttgtggggagcgggaccatggcactaagtcggtattgtctttggggaacacagaagctgcctttcctccttcaaagttcgattacaaccagccttttgttcatcctcaaattactggtgctgcaaactctaggatgccattgcctgttgatccttctgtagaagagcccatatttgtcaatgcaaagcaatacaatgcga

SEQ ID NO: 1578 - DNA, 1232 bp, Zea mays
  Predicted polypeptide sequence is orthologous to G1363
  misc_feature (1211)..(1211): n is a, c, g, or t
aaagtttccatctctctctcccgccatatgactagtgttcctgttggctgttgctgtgtcggtccgccatgtacgcgtccctggattgctccggtaactcctttgggaaaaccgttaacgatcatctgaggtcaactttgagttttgataacaagcaacctccatttgcgagtcaaaactttgactacggtcaaacaatagcttgcatttcatacccgtacaatcgttctagatcaggagatgtttgggcagcctatgagtcaccctccagcccggccgagtgactacggtcaactgtgttccgttcccaaattgctggtgggggttcatccacaagaattcccttgcctttggaattagcagagaatgaacccatatatgtgaatcccaaacaatatcacgggatacttcgcagaagacagttacgtgccaagctagaggctcagaacaagctagtcagagcccgaaagccttaccttcatgagtctaggcatcttcatgcaatgaagagggcacgaggttccggtggacgattcctcaacactaagcagctccagcagtctcacacagccctcaccaggtccaccaccacaagtggcacaagctcctcaggctcaactcatctgcggcttggtggtggcgcagccgcagctggagatcgatctgtgctggcacccaaaacaatggcctcacaagacagtagcaagaaggccgtttcttcagccctcgccttcactgcgactccaatgctgcgcagagatgacggcttcttgcagcacccaagccatcttttcagtttttctggtcattttgggcaggcaagcgcgcaagctggcgtccataatggaagtcagcatagggttccagttatgagatgaccggtttgcgaaccatagctggtgatccaggcgtctagggtcaacttcgctgtggtgtcttagtctctcaggcaattcatccttggcttaatttctggctttttattagaaggtaccaaaatgtgttccataccgttgtggccacagagcccataaaccagggggtttgatggttggcactcctacccaaactattgttgcagtggtgtttgttagaataaaccttgactattattctgtacaaaaaaaaaaaaaaaaaaaaaaaaaaaaaaaaaaaaaaaaaaaaaaaaaaaaaaaaaaaaaaaaaaaaaaaaaaaaaaaaaaggactttgngttgttaccactgtttaaggg

SEQ ID NO: 1579 - DNA, 780 bp, Zea mays
  Predicted polypeptide sequence is orthologous to G1363
  misc_feature (738)..(738): n is a, c, g, or t
attgggtacctcgaggccggccgggacaagatgagggataaaagaacagcgcaagtggagtgatgcagccgagggggccagaccagaggaagggacggcggggaggtggcaaggcgcagagtgcaggttcgcttggcggacgcaccgagggaggcgtgtgggagccatgcttcttccctcttcgtcttcgtcttccgcttccgcttccaaaggtaactcctttgggaaaaccgttaacgatcatctgaggtcaactttgagttttgataacaagcaacctccatttgcgagtcaaaactttgactacggtcaaacaatagcttgcatttcatacccgtacaatcgttctagatcaggagatgtttgggcagcctatgagtcacgcaccagcactgccactgtgttccgttcccaaattgctggtgggggttcatccacaagaattcccttgcctttggaattagcagagaatgaacccatatatgtgaatcccaaacaatatcacgggatacttcgcagaagacagttacgtgccaagctagaggctcagaacaagctagtcagagcccgaaagccttaccttcatgagtctaggcatcttcatgcaatgaagagggcacgaggttccggtggacgattcctcaacactaagcagctccagcagtctcacactgccctcaccaggtccaccaccacaagtggcacaagctcctcaggctcaactcatctgcggcttgntggtggcgcagccgcagctggagatcgatctgtgctggcacc

SEQ ID NO: 1580 - DNA, 1399 bp, Zea mays
  Predicted polypeptide sequence is orthologous to G1363
ccacgcgtccggtgcatgcccaagttacacatctcgcctcgcgtgatcaattgagggcctactagcttactactgctgccttagtttcctttttcatgaatacagttacggtgggaaggtcaaattctgttgtgtattcatgcatcagctgtgctccttaaggcttgcagaccttaatacccagtacgtgtttcgaatctcgtatgtttatttctgggaactgacctgtgtttatatatgtttggacagtacgaactgaaaaacaagagtaaagaatttccgtgagatgagacagaatggcgcggtgatgattcagtttggccatcagatgcctgattacgactccccggctacccagtcaaccagtgagacgagccatcaagaagcgtctggaatgagcgaagggagcctcaacgagcataataatgaccattcaggcaaccttgatgggtactcgaagagtgacgaaaacaagatgatgtcagcgttatccctgggcaatccggaaacagcttacgcacataatccgaagcctgaccgtactcagtccttcgccatatcatacccatatgccgatccatactacggtggcgcggtggcagcagcttatggcccgcatgctatcatgcaccctcagctggttggcatggttccgtcctctcgagtgccactgccgatcgagccagccgctgaagagcccatctatgtcaacgcgaagcagtaccacgctattctccggaggagacagctccgtgcaaagctagaggcggaaaacaagctcgtgaaaagccgcaagccgtacctccacgagtctcggcacctgcacgcgatgaagagagctcggggaacaggcgggcggttcctgaacacgaagcagcagccggagtcccccggcagcggcggctcctcggacgcgcaacgcgtgcccgcgaccgcgagcggcggcctgttcacgaagcatgagcacagcctgccgcccggcggtcgccaccactatcacgcgagagggggcggtgagtagggagccccgacactggcaactcatccttggcttatcagcgattcgactcggctctcgctcgtctgaaactgaactctctgcaactactgtaactgtaactaaactgggtgtgcccggattggcggtcgttctgttctactactactagtaccttagctacgcgtcgttgggttgggtctggactagagagcgtgctggttctttgatgaacttggctggacttgagggtgttgactagcgcgaagctgagttccatgtaaaacttttgcttcaagaccgatgactggcggcataataagtagcagtaataaccaaaaaaaaaaaaaaaaaaaaagaaaaaaaaaaaaaaaaactcgaaaaaaaaacccgggggatcca

SEQ ID NO: 1581 - DNA, 1264 bp, Zea mays
  Predicted polypeptide sequence is orthologous to G1363
gaaagggcccaacagctcaacagaaaagccaagcaaaggctgctgctgcatactggaaggccctctgtccctcgccgcccgcaagagaaagggagtcagagagagagagagagagggaggagaccttgcagaggagcgaagcaagcaaggtgggaaagaggcagcagcaagggcggcgggctgccggaaggggaacatgctccctcctcatctcacagtacgaactgaaaaacaagagtaaagaatttccgtgagatgagacagaatggcgcggtgatgattcagtttggccatcagatgcctgattacgactccccggctacccagtcaaccagtgagacgagccatcaagaagcgtctggaatgagcgaagggagcctcaacgagcataataatgaccattcaggcaaccttgatgggtactcgaagagtgacgaaaacaagatgatgtcagcgttatccctgggcaatccggaaacagcttacgcacataatccgaagcctgaccgtactcagtccttcgccatatcatacccatatgccgatccatactacggtggcgcggtggcagcagcttatggcccgcatgctatcatgcaccctcagctggttggcatggttccgtcctctcgagtgccactgccgatcgagccagccgctgaagagcccatctatgtcaacgcgaagcagtaccacgctattctccggaggagacagctccgtgcaaagctagaggcggaaaacaagctcgtgaaaagccgcaagccgtacctccacgagtctcggcacctgcacgcgatgaagagagctcggggaacaggcgggcggttcctgaacacgaagcagcagccggagtcccccggcagcggcggctcctcggacgcgcaacgcgtgcccgcgaccgcgagcggcggcctgttcacgaagcatgagcacagcctgccgcccggcggtcgccaccactatcacgcgagagggggcggtgagtagggagccccgacactggcaactcatccttggcttatcagcgattcgactcggctctcgctcgtctgaaactgaactctctgcaactactgtaactgtaactaaactgggtgtgcccggattggcggtcgttctgttctactactagtacctgagtacctgctacgcgtcgttgctggttctttgatgaacttggctggacttgaggtgttgactagcgcgaagctgagttccatgtaaacttttgcttcaagaccgatgactggcggcataataa

SEQ ID NO: 1582 - DNA, 772 bp, Zea mays
  Predicted polypeptide sequence is orthologous to G1363
aggccctcctctggctccccccggccgtttgagttcggcacgcggagagagagggaggagaccttgcagaggagcgaagcaagcaaggtgggaaagaggcagcagcaagggcggcgggctgccggaaggggaacatgctccctcctcatctcacagagaatggcgcggtgatgattcagtttggccatcagatgcctgattacgactccccggctacccagtcaaccagtgagacgagccatcaagaagcgtctggaatgagcgaagggagcctcaacgagcataataatgaccattcaggcaaccttgatgggtactcgaagagtgacgaaaacaagatgatgtcagcgttatccctgggcaatccggaaacagcttacgcacataatccgaagcctgaccgtactcagtccttcgccatatcatacccatatgccgatccatactacggtggcgcggtggcagcagcttatggcccgcatgctatcatgcaccctcagctggttggcatggttccgtcctctcgagtgccactgccgatcgagccagccgctgaagagcccatctatgtcaacgcgaagcagtaccacgctattctccggaggagacagctccgtgcaaagctagaggcggaaaacaagctcgtgaaaagccgcaagccgtacctccacgagtctcggcacctgcacgcgatgaagagagctcggggaacaggcgggcggttcctgaacacgaagcagcagccggagtcccccggcagcggcggctcctc

SEQ ID NO: 1583 - protein, 685 aa, Oryza sativa
  Orthologous to G1363
MDLDKSTSTGASLKKLQEEGALPGRGTMEREPGGLNSAIVEHRVSQVMISGPTTASNAPTPLCEKEAAEREAAINALSLTDIIGPLADHQAAASLKEGVAQEASDAAIAAAAATTSGSKVPRKGRKFSSVLGNRRKTPTPSALDASPPPPRRHRLVTLGEKAARARAAQDGSGGNSSASPAVASTDVVVAPRSREVTPSGPASDLVPGRGPPAAVLTWEELQVEMGCILEAGARGISREIVEARAAAASSANERADKLARDLAEVTYTGLHQLTGECGVMILIYIENMEIMKSRQSRNRSDRAVDGLTGHYTAVRPARLPGSTKMYQDLKEGYWWPNMKRDVAEYVALCDVCQKVKAEHQRPAGLLQPLRIPEWKWDEISMDFIVGLPKTATGYDSIWVIVDRLTKTARFIPVKTNYSSAKLAELYMTRITDGQTERTNQVLEDMLRACALDFSKDWERCLPYAEFSYNNSFQASLKMSPNEALFGRRCRTPLMWSKTGERAVFGPDIINEAEEKVRLIRDRLKVAQSRQKSYADTRRRNLEFKEGDYVYLKVSPMRGTKRFKIKGKLAPRYVGPFQITARRGEVAYQLQLPENIADVHPVFHVSQLKKCLRVPEEQAPLEEIHISNDLTYPEHPIRILGKAEKRTRSKVWRMYKVQWSNHTEDEATWESEEFLRTEYPHLFENW

SEQ ID NO: 1584 - protein, 130 aa, Oryza sativa
  Orthologous to G1363
MRGTKRFKVKGKLAPRYVGPFQIIARRGEVAYQLQLAENIADVHPVFHVSQLKKCLQVPEEQAPLEEIHICNDLTYPEHPIRILDEAEKRTRTKVWRMYKVQWSNHTEDEATWESEEFLRTEYPHLFENW

SEQ ID NO: 1585 - protein, 346 aa, Oryza sativa
  Orthologous to G1363
MYQDLKEGYWWPNMKRDVAEYVALCDVGQKVKAEHQRPASLLQPLRIPEWKWDEIGMDFIVGLPKTATGYDSIWVIVDRLTKTARFIPVKTNYNSAKLAELYMTRITDGQTERTNQVLEDMLRACALDFSKDWERCLPYAEFSHNNSFQASLKMSPNEALFGRRCRTPLMWSKTGERAVFGPDIINEAEEKKCYADTRRRNLEFKEGDYVYLKIYPMRGPKRFKVKGKLAPRYVGPFQITARRGEVAYQLQLPENIADVHPVFHVSQLKKCLRVPEEQALLEEIHLSNDLTYPEHPVRILDRAEKRTRSKVWHMYKVQWSNHTEDEATWESEEFLKTEYPHLFENW

SEQ ID NO: 1586 - protein, 302 aa, Oryza sativa
  Orthologous to G1363
MTRIVCLHGVPKRIISDRGTQFTSYFWEKVHEALGSYLAFSTAYHPQTDGQTERTNQVLEDMLRVCAMDFSKDWERCLPYAEFSYNNSFQASLKMSPNEALFGRRCRTPLMWTETGERAIFGLDIIKEAEEKVRLIRDHLKVAQSRQKSYADTRRRNLELKEGDYVYLKVSPMRGTKRFKVKGKLAPRYVRPFQITARRGEVAYQLQLPENIADVHPVFHVSQLKKCLRVPEEQATLEEIHISNDLTYPEHLVRILDEAKKKTRTKVWRMYKVQWSNHTEDEATWESEEFLKTEYPHLFENL

SEQ ID NO: 1587 - DNA, 482 bp, Glycine max
  Predicted polypeptide sequence is orthologous to G1411, G2509
aaacgaggcatggcatcattattagttgcagtgccaccaaacacttgagaatgttgatcactgagtggcgtcgccgaggcgtggaacaatgatggacgattagtgaggtaaccaaattccttagagaaatgaaccctttctggaaaattaagcttagctttggttcctttgaatctgagagctgcttcatcgtaagcgagtgcagctgcctcagcagtttcaaaggttcccagccaaactctcgctgctttctttgggtctcgaatctccgatgcccacttcccccacggtcgttgtctcactcctctatagtgccttcttacgtttccttcacatacacacacacatgtccatacatttcaacaaaacaatttgctcccatctttgttacactattttttatttttttttaacaagttatgatatttagacatccatttttctcaaacatctatctgatactaatcatttctctttaaaaa

SEQ ID NO: 1588 - DNA, 1022 bp, Glycine max
  Predicted polypeptide sequence is orthologous to G1411, G2509
ttttcctccactatgtttttttttttttttttgcaattatctttcttatttaaaagatgaagcaagcaaacagaatcccctcttttgatcttggtttcaatattcatcatcaaatcactggtcctccttttatagaaatcttagatctgcttttaacacaaggttttggtggagaagaagaagacgacaaaaacaacaccttcttccccaccccacatggccaaataagcacttctgaatttgttaatagccaaaatccgccccaggctacaaatcaaggcattgatgatattaggaaaaagcactatagaggagttaggcagagaccatggggcaaatgggcagcagaaataagagaccctaagaaagcagctagagtgtggcttggcacctttgacacggcagaggctgcagctatggcttatgatgctgctgcattgaggttcaaaggaaacaaagccaaactcaattttcctgaacgtgttgttatgccaataccaccacaaacaaataacaataattccacttcttcatcagctcctactacacaatcatcttcttctcttccaccaccacaatctctacataataatagttctctttcagcagaagggtttccaaatcttgaggagtatgcaaggttgctgagttgtagcgatgatgatgattttcaacgtgttgcattggggctctaccagcatcacaataatgaggattttatttgtggttcatcacaaccaccaccagtgccgttttttgtgtcctcttcttcttcttcttctgcaatgacatcgtcatattctgattttttgggccaaggagggagtactggttttgatgaagggaacaagagggggtcgtagttttatgtctctgaattttgagcactgcatgcaggttgcttccacaacaattaaggaagttcaaatctctcatctcttatatgttcttttgtttttattattccaattacaaaataacacctgaggtataaaatctataatactcatctttcgtcttta

SEQ ID NO: 1589 - DNA, 689 bp, Glycine max
  Predicted polypeptide sequence is orthologous to G1411, G2509
gttcttttcctccactatgttttttttttttgcaattatctttcttatttaaaagatgaagcaagcaaacagaatcccctcttttgatcttggtttcaatattcatcatcaaatcactggtcctccttttatagaaatcttagatctgcttttaacacaaggttttggtggagaagaagaagcaaagacgacggtgtataaatacaagagtagaagaagaagaagaagcaattagagggagagttagtgagcaaggtggatcgaaggcaagggaagaggtctctccctcctcatgaggagaaaaaagaagctttcaactttcctattattcatccaacaccatctcaaaatcgaaaggaacaagcttcaccatcacccttttcactcctcatgagtaacaaccaaaacaccaccttcttccccctcccacatggccaaataactacttctgaatttgttaatagccagaacaatccatcccaggctacaaatcaaggcattgatgatattaggaaaaagcactatagaggagttaggcagagaccatggggcaaatgggcagcagaaataagagaccctaagaaagcagctagagtgtggcttggcacctttgacacggcagaggctgcagctatggcttatgatgctgctgcattgaggttcaaaggaaacaaagcaaagctcaattt

SEQ ID NO: 1590 - DNA, 1331 bp, Glycine max
  Predicted polypeptide sequence is orthologous to G1411, G2509
ctcggtagctgctccgacctcgagccgattcggctcgagttcataacataaagagtatagagcagcaaacgtaaaagtggatccaagaaggctacatggcaagcttccactatcttcacaagcatcagaggagaaagaggacacagtagaagagtttgatgcttataataattatgcatcttggtcttcagaaactgacatgtctgaaatggtttctgctcttgctcaagttatgggaactaccaatcggaacccatacatgccacaatcaacctcctttcctttctcaacttccgtggtcaaagatcaacctcaaccgtacccatctcaacctcctccagatcaagaggtggcaaagaagccacactacagaggagtgaggcagagaccatgggggaaatgggcagcagaaatccgtgacccaaaaaaagcagccagagtgtggctaggaacctttgaaacagcagaggatgcagcacttgcatatgacaaagcagcactcaagttcaaaggcacaaaagctaagctcaatttccctgaaagagttcatcaagatgttccctttatgcaacaacaccaacaacgttcatcaaacagaaacgtttttcccatccatgcaacttccaccactagtagtgctactgggtctggttcttctgttgatgctgttgctcctccttcgttgtccactcatgatcaacatggccaccaagttttcccaaatctgtatcaatatgcacagattctttcaagtgatgatgcacagttaccttatttcacatcccatcttttcaatcaacaacaacaacagcaacagcaacaacctttcaattctcaattctctagcactttttcttcaacctcatcctacttctacaaccagcaacaacaatatgatcaacaaggacatgatcactcaaaccactagcatgatactattaatctctgtgatttccaaccgtaacattaaagtttttcaagtcttaattaatttgtaatcacagtgttgtaactgcaatattgacaacatgcatgggcattaattagtcgtccccaattttccttttctcaaaagagtaagattttttaggtatgtaacggtggcggcaatttaggggcaaagcaattttaaagcttgaatagctagttagtatatgcatctgtcaattttgttgtagaatattgagtcagggatcaatgtatgtttctttaagcgtgcccaagacatggatcctacatttaatttcccatttaattatggatgtggataaactttttgttggaaaaaaaaaaaaaaaaaaaaaaggggcggccgatttagaggatccaag

SEQ ID NO: 1591 - DNA, 353 bp, Zea mays
  Predicted polypeptide sequence is orthologous to G1411, G2509
agatttggaaacccttctgctgaaagagaactattattatgtatttattgtggtggtggaagagaagaagagcatgtgtagtaagagctgatgaagaagtggaattattgttatttgtttgtggttgtattggcataacaacacgttcaggaaaattgagtttggctttgtttcctttgaacctcaatgcagcagcatcataagccatagctgcagcctctgccgtgtcaaaggtgccaagccacactctagctgctttcttagggtctcttatttctgctgcccatttgccccatggtctctgcctaactcctctatagtgctttttcctaatatcatcactcgagccgaat

SEQ ID NO: 1592 - DNA, 946 bp, Glycine max
  Predicted polypeptide sequence is orthologous to G1417
  misc_feature (6)..(6): n is a, c, g, or t
gaagcncggaattcggctcgagctcgagccgctcgagccgcaggttcaaagatgtgcagatgacaaagcagtgttgataacaacctacgaaggcaatcacaaccaccctttgccgccggccgccaccgccatggcaaatactacgtcagcagccgcagccatgctgctatcaggttcggcagccccaagcaaggaagcgctaacaaactctgcaggatattactcttcttcttcaattccctatgcttcaatggcaaccctatcagcttcagctccattcccaaccatcactctcgacttgacccaaaaccccaacaacgccatgcagctgcaccgagtaccagcaggccatggcgccacgttccctctgccactgcatgcggcagctgctggtccccacctactaggtcaccccttgttcttccaacagaagcttccaccggcagcattaatgccccttcttcaacgacaaccttcgtcgtcgatggtcgaaacggttagtgcagccattgcttcggatccgaacttcactgcagctttgatggcagcaatctcatcaatcattggagtaccaagaggaggcaatgacggtaacaacaacaacagtggaagtggtgctattccaggttcaccgcagcttcctcagtcatgcactactttctccaccaactagcggaattttgagaaactatatacttaatttctctatgtatatacacaacttaaaagagaagattaggcatgctcgcgcttaatttactgtgtttttattttcttatatgtaaaacagattaagagtcacctctgattctgaatgcatgactctataaacaaatcgtttgaaccttaccttcgacccgcaggagcgtgcatgtaagtaagttgatccttttggtacatgagtctggatataacttatgttatatacgtcacagatttgcaattt

SEQ ID NO: 1593 - protein, 310 aa, Oryza sativa
  Orthologous to G1417
MNTFTLFRDEVQKASEKVHRHHANDDEAGLFLSLGLSLGSSPDACQCHASKKDEADAGNGGGDGYLALALRCAPAAGEPMVHPKRQRATTNSSSSSSICGEYGGGAAAAAVPAGHDDDDRSCMITAASTANRPGRVVLRTRCSAPTVKDGCQWRKYGQKTAKGNPWPRGYYRCTGAPGCPVKKQVQRCNHDTSVLVTTYDGVHNHPITPYAAALPPSSSSSSSAAVAMLASSSSSSTWSELQRAMPAAQSSWSQRNYPIQADVVAKAIWDPKFQATVAAAVASYVRDREQSARVAGGKGAGELFNLAPPC

SEQ ID NO: 1594 - protein, 244 aa, Oryza sativa
  Orthologous to G1417
MNTFTLFRDEVQKASEKVHRHHANDDEAGLFLSLGLSLGSSPDACQCHASKKDEADAGNGGGDGYLALALRCAPAAGEPMVKDGCQWRKYGQKTAKGNPWPRGYYRCTGAPGCPVKKQVQRCNHDTSVLVTTYDGVHNHPITPYAAALPPSSSSSSSAAVAMLASSSSSSTWSELQRAMPAAQSSWSQRNYPIQADVVAKAIWDPKFQATVAAAVASYVRDREQSARVAGGKGAGELFNLAPPC

SEQ ID NO: 1595 - DNA, 1435 bp, Glycine max
  Predicted polypeptide sequence is orthologous to G1419
agcggctcgagcggctcgagctcccaaattctcaactttcctaactttagcaaccatctaagaagttcagtcccttaattatctctcaccttgaattagaaaagcattcaaagctttgaacccaatttcactgtttgcacctcaaacatcttagaagtcccaattgagtctcaattccacaaccaaaaatgcaaagttcaatttcacaatctgatatttttatcactgattaccttgtaccccaagaagttccatttcaatttcaatttcaagatatgagcaagaatgacaacaacatgccaatgaaccataccaataataaccttcaaatgcctcaaatcacatctttctccaagcctccaaggtcctcatcaaatctaagcaaccgcaaaccctccttgaaaaacatcacaatcccttccataacctctggtcttgcaacagctatgtcacaaacaacagcaacaacaacaacaatagctacaaccatgtataacaacaaccaagtttcttcttcttctttttcttcagatgaaaccaacaataccaaagacgacaagcactatagaggggttagaagaaggccatgggggaagtatgctgcagaaatccgtgaccctaatagaaaaggctcaagggtgtggcttggaacctttgacacagccatagaagctgctaaggcttatgacaaagctgctttcaagatgagagggagcaaagccatattgaacttccctttggagattggatcagatcagtctaaagaagagtcatcatcatcatcatcatcagtttcaagcagcagcatcgtcatcaaggttggtgtgaagagagaaagagaggaagagagtgaaaggaagaacaactatgagaaaagtgagtttaacaacaatagtaatagtaataagcatgtgaagaaagaagagtgccctttgactccatcatgttggaaaggcttttgggacactgatgttatgggaacaatctttagtgtgcctcctttgtcaccactatctccactaatggttgtttgagattttgtggaacttttgctctttcaatgatgttttgaggtaaccaaactaaggggagagagagagatgatgctggtgattgtcctctctgatttaggttgctaatttgcctaaatcaaaatggtagtactaattaatctactaatagattaatttgcaagtgaatatatatatggatttgtataatgtaaatataggatagtactatgaagcaagatctttttgtttgttgaaaaaaaaaacaaaaaacccatgcttatcttcttcctttaggtaaaaaaatgtactgtacttgaagcaatattgaaatttgtttattcgtttattggagaaaaaaaaaaaaaaaaaaaaaaaaaggaaaaaaaaaaaaaaaaaaaaaaaaaaaaaaaaaaaaaaaaaaa

SEQ ID NO: 1596 - DNA, 1025 bp, Glycine max
  Predicted polypeptide sequence is orthologous to G1449
ctgcgagaagacgacagaaggggagtctcgatcagtttcattcattggaagatatgggaacattagaacaaattgatgcccctcaaacccggtcatcatcatcttcttcttcttccatcgatagcaacaaccacccttctaggactaggactccaccaccctcttccccttcatcaagtccctgcagaaacagaactgatttgagcactgacctcagacttggtcttagcatctctccttcttctcaatctgaatcacccttcaattcaacaccaagggaggaaagttttgactggccaccaattaagtctatattgaggagcacccttgtggggaaacaaagccatctgaaccaaagaccctctttgtttgtcaaagtctatatggaaggaatccccatcggaagaaaattgaatctgatggcacattatggctatgatggactagtgaaaactcttggccatatgtttaggacgaacattctctgtcctaactctcaaccacttaattctgggaattttcacgtgctaacttatgaggatcaagaaggggactggatgatggttggagatgtgccgtgggagatgttcttgaacagtgtgaggaggctgaagatcacaagagctgaccgatgctagttaatttaatgatgtatacaatctctctcacaacacaagctcctcctgatcaattttcattgttcataaatttttgctgtagatctagttattaattagtgggtgggtgaaaccccttgaagtatttcaccaaaaagaatggatcccgtgattatcatatatctaatagctttatacaccgaaaaacaatatagatgtgtaacttcttacctaattctcaattcagtacatagctgcagtattcctagtctctctgtttgatgatggagtcgtctaattttcctctttgttttggaactagctccattattttgtagtcatttggaacaatgcatgtcccttttgtcttcatacctttaatgcatgatgtttcttggtgtctctttt

SEQ ID NO: 1597 - DNA, 822 bp, Glycine max
  Predicted polypeptide sequence is orthologous to G1449
ccacgcgtccgggcaacaatcacaccacccttttgtgaacatttattcacaagttcctgctgaagtgaatgattgcagcaacgatcatagcagcttctttgtgaaggtgtacatggaagggattccaatcggaaggaagctcaatatactagctcatggaggctactatgagttagtcaggactcttgaacacatgtttgacactaccattctttgtaagtctattgttttatatcctctcattttgttgaatattaacaacacattttttaacatgagcttcctaactcgcaagattttgtaatttataagccagagagtgttgaatcagcaaaataacaatggaatgttgtggtgtgttaacagggggaacagaaatgaatggagtgcaaccagagagatgccatgtgctaacttatgaagatgaagaaggggatttggtcatggttggagatgtcccttgggagtaagttaattgactcttttttgtttttttttcttatctgagaaacaaaagcattatatgttccattttgtgaattgatgtggtatttgttttgatggtgtaggatgttcttatcgccggtgaagaggttgaagatcacaagggtagacacattcgggtgttaagtgaagaacatgacactgcctcttcctccaccggtgattttagattttgtcctctagagtgagactctaatgaggtcgctgatcagaaaatttagaaaaatcttagtgaagtatatgcacagataggtgatgtatatgcatagctcactctgctctttctttcaagataaaaaaccacccggccaacccaag

SEQ ID NO: 1598 - DNA, 597 bp, Oryza sativa
  Predicted polypeptide sequence is orthologous to G1449
atcgaggccgcgtgcggcgccatgacggcgacgttccactgtttcgtgaaggtgtacatggagggcgtccccatcggcaggaactggacctgctgccgctggacggctacaaggtctcgtcgcacggcttgcctccatgttcagagcatccatcacctatcatcattgccatcgacagttcgccgtcgtcgggatgaagacgaacaaggttcatcatgttctgacatacgaagaccaggagggagactggatgatggctggagacgtgccactgggactgttcctgacaagcgtgaagagattgaggattgcaagagcggatgacaagtactgctatagctgttgaataattggttaaccaggatggtcaattaattcttccagagttcttggatttcattcattcttactttgctcattttggtggagcacatttagatttgagatgattgttttcgggagcgaaaatttactagtaaaagcatagtgatattgagcagaggatattgtacaaaatatattgtacacactagtaaaagaaaagaaacatatatatagaaatacccttttacttctcaaaaaaaaaaaaaaaaaaaa

SEQ ID NO: 1599 - DNA, 937 bp, Oryza sativa
  Predicted polypeptide sequence is orthologous to G1449
  misc_feature (118)..(118): n is a, c, g, or t
  misc_feature (133)..(133): n is a, c, g, or t
  misc_feature (693)..(693): n is a, c, g, or t
tgatgctgagtgatcccgtccactagctggtgaattggagagacggatggagctcgagctcggcctcaggctcgcgctgccgtcgccgtcgccgtcgccggcgagcggtcgtcggcgngatgggtgtgagctntgacctttctcaacagcgcgccggggtcctgccgcaagaggggcttcgaggaggcgctcggtgggttcaaaaccgacgacgacaacgacgacggcgatggccgcggcggtgacggcgattccgacggcgaactgggcaacaagaggaggaagctggtggggtggccaccggggaagtgcttgcaccggcggcgcgacggtggctgcggtggcggatatgtgaaggtgaagatggaggggttggccatcgggaggaagctggacttgtccatcctcggctcatacgctgagctgctcgacacgctccaccttatgttcccctccactaaccaagaggatgggcacgatcgtcgtcgacgtcacccatacgctgtcacctacgaggatggggaaggagactggatgcaggtcggagacgtgccatgggaggcctttgccaagtcggtgaaacggctcaagatactggtgtaactgactgcaaattaagctactagtactagtctttactacttcgaataaaattgtacgtgaacgggattattttgttcacgtttctctcanaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggccgttttaaaggacccaattttacttccccgggtttgcaaggtaaaaatttttttatggggcccccaaaattaatttccggggccgcggtttaacaccggggggaggggaaaa

SEQ ID NO: 1600 - DNA, 769 bp, Zea mays
  Predicted polypeptide sequence is orthologous to G1449
  misc_feature (654)..(655): n is a, c, g, or t
  misc_feature (667)..(667): n is a, c, g, or t
  misc_feature (681)..(681): n is a, c, g, or t
  misc_feature (697)..(697): n is a, c, g, or t
  misc_feature (747)..(747): n is a, c, g, or t
  misc_feature (756)..(756): n is a, c, g, or t
ggcgattgggttcctcgaggccggccgggcccttccccccttccgttccgttccgatttgacgagttggtggctgctatagattcactccacccctctccatttctgataagtatccagctagctaccagtgtatgcaccaggcagcagcagcatggcggagtgcaaggacgacgacagcggccggcggtctccgtcgtcgtccatggacagcagcacccaccccccggcgctctccaccgcgtcctcggcctcccgccgcccgccggagaggagggaccagctcagccccgacctgcagctagggctcagcctgtcgccggcgtcctccgccctcctggtagcggagacaaacaacagcatcgtcccttctacgccaaggaaccaagcactcccggattggcccccgatcaaaccgttccttagaagcgccctgactgcctcggcacgccgacggcgaacgctgttcgtcaaggtgtacatggaaggcgtcccgatcggccggaagctggacatgctcttgctggacgggtacagcagcctcctagcgaaactttgccacatgttcaaggcatctatcacttcgggttcctcacgagaaggccgcgcatgttctcacctatgaagaccatgatggagactggatgatggttgnngatgtaccgtgngagctctttctcgnaagcgtaaagagctgnagatgcgagaaccgacaggtgctagatagcaaacttttcatgcgggggancgactctgntcccctctctttt

SEQ ID NO: 1601 - DNA, 1097 bp, Zea mays
  Predicted polypeptide sequence is orthologous to G1449
ggccctaggggccttttttttttttttttttcttcacgcaaatcgcctcttcccttgcatccagccttggtacttgctaggcactcagagaaaacagaaaagggaaacatataaaaataccaaaatttaattttctagggatggtatcaagattgacttttcttccgtatactgtacacggtcagtatatatagcctcggtatcacatgcatgtccactctgtggccagcaaaatctttctgtatgaaccgatataaataaaaagaggaaagaaatagagtccatgcagcgcacgaataataagctttgctaactagcatttatctgttcttgcaaatcctaagtttcttcacacttccaaggaagagctcccacggtacatccccaaccatcatccagtctccatcccggtcttcataggtgagaacatgtgcaggcttctcgtgaggaactcgttggtggtactccatagcatcagcaaaggtgatggaggccttgaacatgtggcggagcttcgctaggaggctgtcgtacccatccagcaagagcaagtccagcttccggccgatcgcaacgccttccatgtacaccttcacgaacagtgtccgccgtcgtcggcgtgccgaggctgtcaaggcgcttctgaggaatggtttgatcgggggccagtcttgggtggtcctgctgccccttggcgtggaaaggacgctcttgctctccgctaccaccaggagggcggaggacgccgccggcgacaggctgcagagccctagctgaaggtcggtgctaaggtcgtccctcctctccgtcgtcgtcggccggaagcccgacgacgacgcggcggatagcgccggcgggtgggtgctgctgctgctgtccatggacgacgacgaaggagaacggccgccggcgtcgtcgtcctgcttgcacccggccatatgctgcctgcaggtgtgcatacactgtgtgatatatgttacgccgcagctggtgcttgttagaaatgggtcggcggagagcggcggagcgaatgatcttgctagcgccgacgactcgtcaaactggagcggaaagggagaagcccggccggcctcgag

SEQ ID NO: 1602 - DNA, 1017 bp, Zea mays
  Predicted polypeptide sequence is orthologous to G1449
  misc_feature (117)..(117): n is a, c, g, or t
aaacaagaaaaaggtctgcgtatactcctgacttgataaccaaataaccatggtatttacaaggcagtcaaagaaccaggggaaaggaaacataaaataccaaaatttaattttgcnaggggtggtagcaaaggctggcgtttcttcagtacactgtacacggttagtatagcctcagcatcacgactccactctttagttcagcaaaatctttcctaatgaacctaatatatattaaaagaagaagaaacagagtcgatccaccgcatgaaaaagtttgctatctagcatctgtctgttttcgcaatcctcagcttctttacgcttccgagaaagagctcccacggtacatccccaaccatcatccagtctccatcatggtcttcataggtgagaacatgcgcggccttctcgtgaggaacccgctgatggtactccacagcgtcagcataagtgatagatgccttgaacatgtggcaaagtttcgctaggaggctgctgtacccgtccagcaagagcatgtccagcttccggccgatcgggacgccttccatgtacaccttgacgaacagcgttcgccgtcggcgtgccgaggcagtcagggcgcttctaaggaacggtttgatcgggggccaatccgggagtgcttggttccttggcgtagaagggacgatgctgttgttggtctccgctaccaggagggcggaggacgccggcgacaggctgagccctagctgcaggtcggcgctgagctggtccctcctctccgccgggcggcgggagcccgaggacgcggtggagagcgccggggggtgggtgctgctgtccatggacgacgacggagaccgccggccgctgtcgtcgtccttgcactccgccatgctgctgctgcctcccgcccgccctcgtggtacccctggatacttatcagaaatggaaaggggtggacacggtggagtgaacctatagcaccaaaacaacagctcgtcaaatcgatacggaacggaaggggggaag

SEQ ID NO: 1603 - DNA, 810 bp, Zea mays
  Predicted polypeptide sequence is orthologous to G1449
aaaaagaagaaccagtcgcgcgatccaccgcatgaaaaaagtttgctatctagcatctgtctgttctcgcaatcctcagcttctttacgcttccgagaaagagcctcccacggtacatcccccacccatcatccagtctccatcatggtcttcataggtgagaacatgcgcggccttctcgtgaggaacccgctgatggtactccacagcgtcagcataagtgatggaggccttgaacatgtggcggagtttcgctaggaggctgctgtacccgtccagcaagagcatgtccagcttccggccgatcgggacgccttccatgtacaccttgacgaacagcgttcgccgtcggcgtgccgaggctgtcagggcgcttctaaggaacggtttgatcgggggccaatccgggagtgcttggttccttggcgtagaagggacgatgctgttgtttgtctccgctaccaggagggcggaggacgccggcgacaggctgagccctagctgcaggtcggggctgagctggtccctcctctccggcgggcggcgggaggccgaggacgcggtggagagcgccggggggtgggtgctgctgtccatggacgacgacggagaccgccggccgctgtcgtcgtccttgcactccgccatgctgctgctgcctggtgcatacactggtagctagctggatacttatcagaaatggagaggggtggagtgaatctatagcagccaccaactcgtcaaatcggaacggaacggaaggggggaagggcccggccgccctcgtggtccccaatcgcccttaggagt

SEQ ID NO: 1604 - DNA, 2414 bp, Glycine max
  Predicted polypeptide sequence is orthologous to G1451
  misc_feature (8)..(8): n is a, c, g, or t
gaccacanactgtcatgccatcctcagttctatctagtgatagtatgcacattgggcttcttgcagctgctgctcatgctgcagcaactaatagctgctttacagtgttctataacccaagggctagtccatctgaatttgtcataccgctttcaaaatatatcaaagctgtgtaccatacgcgtgtttctgttggtatgcggctcgggatgctttttgagactgaagaatcaagtgtccgcaggtatatgggtacaataactggcataagtgatttggattctgttcggtggccaaattctcattggcgctctgtcaaggttggttgggatgaatcaacagctggagagagacaaccacgagtgtctctgtgggaaattgagccattaacaacattcccgatgtatccatcattatttcccctcagactgaaacgtccatggcatcctggcacctcatctttgcatgatgggagagatgaagctactaatgggctaatgtggatgagaggtggacctgtagaccaaggtctcaattccctaaattttcaaggagctggtatgttgccctggatgcagcagagactggatccaactttactaggaaatgatcagaatcaacagtaccaagccatgttggcagctggtttgcagaacttagggagtggagatttaatgagacaacaaatgatgaattttcagcagcctttccactatcttcaacaatctggaaaccccaatcctcctttgcagcttcagcagccgcaaccagttcaacaatctgtgtcttctaacatgctgcagccacaagctcacgtgttgacagagaacttctctcagcacctccttcagaaaccacataacaatcaagaagtccaagcacaacagcagcagcatacttatcaagactcgctcttaattccgagtgatcagctccatcagagacaacactctggcattccttcaccatcatattcaaaaccggatttcttggattcgagcatgaagttccctgcttcagtttcccctgggcaaaacatgcttagttcactttgtcccgaaggaagtggcagtctcttgaatttatccaggagtggtcagtccttgctgaccgaacagttaccccaacagcaatggactcaaaaatatgcacctgtgcaggtcaatgcctatggaagcactgtgtcacatccacaatattccggaaaagattctgtaatggtgctaccacattgtaactcagatgcccaaaattctactctttttggtgtcaatatcgattcatctggccttctcctccccaccaccgtccctggttacaccacctcgtccgctgacactaattcatcaacaatgccattagcggagtctggtttccagggttctctatatggttgcatgcaagattcatcggagttgttgcaaagtgcagggcatgttgacccagaaaaccagactcaaacctttgtcaaggtttacaaatcagggtcagttgggcgctcacttgacatatcccggttcagcagctatcatgaactgcgcgaggagttggctcagatgtttggaattgaggggaagttagaagaccctcttagatcaggctggcagcttgtgttcgtcgacagggagaatgatgttcttctccttggagatgatccgtgggaatcattcgtcaataatgtttggtatatcaaaatactttcacctgaagacattcagaaaatgggggatcaagcggtagaatcccttgctctaggttcaggacaaaggctaaacggcactggtgctgagtctcaggacattgtttctggaccaccatcaatcggctcacttgagtactgagaaaactgaaacatgtattccttcagaccaccatggtcaagagaatttctctacatgttttattacttaagttggaatatgttgtgtatgatctgttccccctttcagccctccttattattactatcagcattgaagaaaagtatacatttatgattaaaaaaaacccttaggacatgcttctgtgccaatttgaacttggagcactgcaagctagagttagtgttaatgctattttagcataatatttgatcaaacttttgcatgaactaatgtactctagataggaaactagagaaggctgtttatgcttgagctgtctttgtattctacaatgccattagttcccagttaaggggtcgaacttttaactcaaaatgtatgagtagtattttactatattgccattgaaaccatcaacccaccatacgacatgtctcttaaatgctactattttgtagctctataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagg

SEQ ID NO: 1605 - DNA, 2021 bp, Glycine max
  Predicted polypeptide sequence is orthologous to G1451
attcggctcgagtattattctgagtgtggtgcaagccacctatgtactatttttcctttacttatgcaaaagctacctttgtactatttttcctttacttctgcacaagccaccttcgttttgcaggtacatgggtacaataactggcataagtgacctggatcctgttcgttggccgaattctcattggcgatctgttaaggttggttgggacgaatcaaccgctggagagagacagccccgggtatcattatgggaaattgagcctttaacaacgtttccaatgtatccatctctatttcccctcagattgaaacgaccctggcatccgggcacctcttcttttcatgatggcagagatgaagcaactaatgggcttatgtggctgaggggtggacctggagaccaagctctcaattccctgaattttcaaggttctggtttgttgccatggatgcagcagagaatggatccaactttacttgcaaatgatcataatcagcactaccaagccatgtttgcatctggtttgcagaacttagggagtggagatttaatgagacaacaaataatgaattttcaacagcctttcaattatcttcaacaatcaggaaaccccaatcctcctttgcagcttcagcaaccgcaagcaattcagcaatccgtatcttctaataatattctacagccacaagcccaagtaatggcagagaacctgtctcagcacctccttcagaaatcacacaacaatcgagaagaccaaacacagcagcagcagcagcagcggcacacttatcaagatacagttttacttcaaagtgatcagctccatcagaggcaacactctggtctaccttcaccgtcatattcaaaaccggatttcttagattcaagcatgaagttccctgcttcagtttcgccaggacaaaacatgcttggttcactttgtcccgaagggagtggcaatctcttgaatttatccagaagtagtcagtccatgttgactgaacagttacctcaacaatcatgggccccaaagttcacaccattgcagattaatgcttttggcaactcaatgcaacatgtgcagtattctggaaaagatactgcaatggtgccaccacattgtaacccagactcccaaaatcctattctatttggggtcaacattgattcatctggccttctgcttcctacgactgttcctcgttatactactgcatcagctgaaattgatgcatcagcaatgccaataggagagtctggattccagtctcctctatatccttgcgggcaagattcatcagagttggtgcaaagtgcagggcaagtcgaccctcaaaaccagacacgaacattcgtcaaggtttacaaatcagggtcagtagggcgctcacttgacatctcccggttcagcagttatcatgagctgcgggaggagttggcacagatgtttggtattgaggggaaattagaagaccctcttagatcaggctggcagcttgtattcgtcgacagggagaacgatgttcttctccttggagacgatccgtgggaatcatttgtcaataatgtatggtatatcaaaatactttcacctgaagatatccataaaatgggagaacaagccctggaatcccttggtccaagtccaggacagaggctgaatagcactggtgcagattctcatgaaattgtttcaggactaccatcaattggctcccttgaatactgagagaattttaacatgtatttttctctcaggtcctacggttaagaagactattacatatccacatgtttagtacttctgtttgaacactacttttcgaccttgcatatctgaatcaatatatactgtattgtctgtttcactttcaaaaacatcgttattatttcgtagaggattgttgagattttcaggacaaaaaatctatattatatatatgatgagaaagaaacctaggacaaacttttgtgcctgtaaccttgtgttgacatagagttaaaactattgtagc

SEQ ID NO: 1606 - DNA, 3152 bp, Oryza sativa
  Predicted polypeptide sequence is orthologous to G1451
  misc_feature (3084)..(3084): n is a, c, g, or t
  misc_feature (3138)..(3139): n is a, c, g, or t
cccgggctgcaggaattcggcacgaggtctctctcgccccccggccccaccctttctccccaccatggtggcgatctccgagctcgggtgagcggaagagaaagaatgcggccgatttgaggagggggatggggttttcgggtggatttgtgaggggatagattaagagtttgtgcttctctggtttggtcggaggaggaggagatgagctcgtcgtcggcggccagcatcgggccgccgcagccgccgccgccccccgcgccgcccgaggaagagaagaagtgcctcaactcggagctatggcacgcctgcgccggcccgctcgtctgcctccccaccgtcggcacgcgcgtcgtctacttcccgcaaggccacagcgagcaggtggcggcgtcgacgaacaaggaggtggagggtcacatcccgaactaccccaacctgccggcgcagctgatctgccagctccacgatgtcacaatgcatgcggatgtggagactgacgaggtgtacgcgcagatgacgctccagccactgaacccacaggagcagaacgatgcgtaccttcccgcggagatggggataatgagcaagcagccgacgaattacttctgcaagacattgacggcgagcgacaccagcacgcacgggggggtttctccgtgccccgccgtgctgctgagcgcgtcttccctcctctggatttcacacagcagcctccagcccaggagctaattgcacgggatattcatgacatcgggtggaagttcaggcccctctttcggaggccaacccaaacgacacctgctaaccactggctggagcgtttttgtcagtgctaagagacttgttgctggagattctgtgcttttcagctggaacgcggcacgccggcttttacttggaataagacgtgccagtcggccacagactgtgatgccttcctctgttctttcaagcgatagcatgcacataggtctccttgcagcagcagctcatgctgctgctacaaacagccgtttcactattttctacaacccccgggcaagtccatcagaatttgtcataccactgtcaaaatacatcaaggctgtttttcacacccggatatcggttgggatgcggttcaggatgttgtttgagactgaggaatcaagcgttcgcaggtatatggggactataactgaagttagtgatgcagacccagtccgttggcctagttcctattggagatctgtgaaggttggttgggatgaatcaactgcaggggaaaggccaccaagagtttctttatgggaaattgaaccattgacaacctttccaatgtatccatctctgttcccactgagagttaagcatccttggtattcaggagttgcttccctgcatgatgacagcaatgctttaatctggctgagaggagttgctggtgagggaggttttcagtctctgaactttcagtcacctggtattggctcctggggacaacagaggctccatccatccttactgagcagcgatcacgatcagtaccaagcagtagttgctgctgctgctgcttcccaatctggtggttacttaaaacagcaattcttgcaccttcagcaacctatgcagtcccctcaagaacactgcaacctcaacccattattgcagcaacaaattctgcagcaagcaagccagcaacagataattaatcctgatgcccaaaatatccaaacgatgttgagcccaagtgctatacaacagcaactccagcaactacagcaaatgcagcaagttcagaatgatcagaagcagaagattcaaccagatcaaagctaccaagttcctacaagtgcagttctcccaagtccaacatcattaccgagtcatttgcgagaaaaatttggcttctctgatcctaatgcgaattcttcaagcttcatcacctctagcagtagtgataacatgttggattcgagcttccttcagggaagttcgaaagctgtggacttatctcgatttaatcagcctgtagctagtgagcagcagcagcaacaggcatggaagcagaagtttatgggttcacagtcagtgtcttttgggggctcggttttgcataactcacccacaagcaaagatggttctgttgaaaacaaaattggtcgtgatgtgcaaaaccagtccctttttagtccacaagttgactcttcatccctcctgtacaacatggttcctaatctgacttcgaatgtttcggatggcaacttatcaacgatcccttctggatcaacttatctgcagaatgcaatgtatggttgcttggacgactcttctggtttattgcaaaatacaggagagaacgatccagcaaccagaacatttgtgaaggtttacaagtcaggttcggttgggaggtcgttggacataacccggttctctaattatgctgaacttcgagaagaactgggtcagatgttcggcattaagggtcaattggacgaccctgatagatcaggctggcagcttgtattcgtcgacagggagaatgatgtgcttctccttggagacgacccttgggagtcctttgtgaatagtgtatggtacatcaagatactttcacctgaggatgtgcataagatgggaaagcaaggaaatgatccacggtatctgtcctgaagtgagagaacatggtgccatttctgggcttccaggaggattctgcagtgcatggtggcactcttgctctcgacaatgcacgtcgtcagaagtcccaaatttgtatcttgcatgtacgccgtacatgtttccagaactctctgttacctattcggtgcaggccaccggaaccacgaaacctgatattttgtaggttccacttaggaatcagtatcggtttaactcttatcctagatgatttgtaactcgcacggcagtccactgttttcatgtttcatcgagtcttcctagacattaaacttagttgatattgtatcaggatttatgtgtattgagattcctctacatgctttcaacccaaaaaaaactgcaataatcgaagcgcacgaggattgtttccaaaaaaaaaaaaaaaaaaaaattttnaccgattgtccggttatgtcagtttcgagaggagctgtcaaaaaaaaaaaaaannaaaaaaaaaaaaa

SEQ ID NO: 1607 - DNA, 2536 bp, Oryza sativa
  Predicted polypeptide sequence is orthologous to G1451
ataagctcaatagttcttgaactgaattttcacagttgcatggaaaaccttacttgctgtcattaacagtacattgcaggaggaaaacatcatcaatatacagaatatggccgaagctagcgcctgcggcactacagcactactcaacatgaacctaataattagatgccctaagttaacatgatcagtattccaggaaacaaagtgtcggcatgtataccaaaatgtaataggtaccactaaaagtcaatgtaatatgacataattaccagacagcgcataacttagagctacacttgacctatgtgcttgggttccaggtcacagaactaagagctacagagacgtacagaactggacgcctaacgccgggtgctatgagctccctatttctcagaactcaactgagcccaccgacgcgattccagtgcttaggcttcttgattcctgcctgctcatgtagttgtcacagctgttgccaagtctccttgcagaagtcgagaagagttcaatgcccggcttgcccatctgctgaacctcctgcggcgaaagtatctttatgcaagacacactgttcacaaattcctgccacggatcatcgccaactagaagaaccgtcgtcctctcggtcaacaaatacaagctgccagccctgatctcaaaggggtcttccaactggcccctcaaggcccaaaaggcgccctacctcactacgaagttcatgataactgctaaatctagtgatgtcgagcaaccttccaacggttccagatttgtaaaccttcacaaaggttgcatgcggtcgcttcacttgatcagcattatctgaacatggaacatatcctgattcatctaagcagcccggagtagttagtgtttgactcaatgcctcgtccccttgcctgcggctaaggaagttggatgtggaatatggaattgtgcttgaactgttttcattgtgaaggcttggaatgccatcttgcatcaaaagtgactgtgagtctatatttacaccaaacaagaagtgattttgaggatcagagctcccatcttgatccaccaggcattcccttccaggcagtggtgctaacgtggagttttgaggaatactagaaggtgtcaagtcgaagttctctatctgtgatgaaatgtcatgtgggcgagaagtgatcgtagattccactgcaactcgcttagatgaccatgggtcagagacaggtacaggggtgattcttgccacacctgggaggtctgaagcagcttctgaagggaatgatctcagtgtatcgtgcatggatgagacattggatggagagagacaactgatatttgtgtcagggaaattatgttgctgtgagaatggtgaaactgtctgcaatgtggagggtgtagactgaggggtggaggaaagctgtgaaaaaaccgacaatgcatttggtacagtctgaaagttggacaagtgtttctgttgtcccatttgttgatgctgaggttgctgctggtgtgattcttgctgctgttgctgcggctgcaactgaggcttctgttcgttaaatgatgggcaatgttgaagcggttgctggaggtactcaggctgactatgcccttggattgagttgccattgatgttttggtggtacatctgctgaaattgaggctgtgcttgctgcagaatctgactggatagaagagaagatctaccgacaatgttttgcggctgctggaactgcagcatggcaggtgatacttgcttagtggtgttctgtaaagccgccgccgccgctatcgtttggtacatgtcaggttgcagaccaagtagggaactatccagccttggctgcatccacggactcataccaagtcctccaaaattcagagattggaaacctgtgttttgactatctcgaagccacataagagaagaagccaagtcatcctcctttccgccatataaagaaggtaagcctgttggccatggacgctttagtctgagaggaaaaggagatggatacatcgggaaagttgtcagaggctcgatctcccaaagagacacccttggctgtctctctccagcagtcgactcatcccatccaaccttgacagagcgccagtgtgagttcatccaacgaacaggatcaagatcacttattcctgttattgtccccatgtatctcctaacactggattcttctgtttcaaaaagcatccggaaacgcatgcccaccgatatgcgggtatggtagacagcctttacatatttagccagtggtataacaaactccgaagggcttgctcttggattatagaaaatagtaaaccggctatttgttgatgcggcgtgagcagctgcagcaagcagaccaatatgcatgctgtcactagacaatactgatgatggcatgaccgtttgtggcctatttgcccgacgaattcccagaagcagctgattactgtcattccagataaaaaggacagagtctccagcaacccctcgcgccgcactcccgcagccccgccaacccgtagtcagaagatg

SEQ ID NO: 1608 - DNA, 650 bp, Oryza sativa
  Predicted polypeptide sequence is orthologous to G1451
ctgcaggaatcggcacgaggattgctgcgacggtccaggtttggttagttgttgagggagaaaaaaatggaagatatttctgggcgcaagagaggaaggcaggtgtttgctgctgctgctgggagcatgatgggaagctgaccagcagcttctccggtatcctggtgcggcggagtttcgtgctctttggcgacgggtgcactggtgattggagatgaagctctctccgccggcgtcagcggatatgccgcaggccttgccggagaacgacggggaacaaagatgtctgaactcggagctgtggcatgcatgcgctgggccccttgtgtctttgccagtggtcaggagcagggtcgtctactttccacagggccatagcgagcaggttgcggcatcaactaataaggaagttgatgctcaaatcccaaattatccaaacttacctcctcagttaatctgccagcttcataatgtcaccatgcatgctgatgcagagacagatgaagtttatgctcagatgacattgcaaccattgagcccggaagagcaaaaggagcctttccttccaatggagttgggtgctgctagcaagcaacccactaattacttctgcaagacattgactgcaagtgacacgagcactcatggtg

SEQ ID NO: 1609 - DNA, 3210 bp, Zea mays
  Predicted polypeptide sequence is orthologous to G1451
aattcggcacgaggcttccttctcctaccccccacaccctcgcccccccccgctcccgcccgccgcgccctcctcctcccagtccgccccacccttccggccctccccctcttttatatccagtaccatggtgatctccgagctcgggtgagctgatgagaatgcggccgatttgaggaaggctgtgggcgcgatggatgcggtttcgggcggattcgcgaggaggctgtagaggttaggttccggtgtcccccggcccggccggtcgtgggagatgagctcctcgtccgcggccagcatcgggcagccgccgccgcccgcgccgccgccggaagaagagaagaagtgcctcaactcggagctgtggcacgcctgcgccggcccgctcgtctgcctccccaccgtcggtacgcgcgtcgtctacttcccgcagggccacagcgagcaggtggcagcgtcgacgaacaaggaggtggacgggcacatccccaactaccccaacctgccgccgcagctgatctgccagctccatgatgtcacaatgcatgcggatgtggagacagacgaagtgtacgcgcagatgacgctgcagccgctcaatccacaagagcagaacgacgcgtacctgcctgccgagatgggaatcatgagcaagcagccgacgaattacttctgcaagacgctgactgcgagcgacaccagcacgcacggcgggttctctgtgccccgtcgtgcggccgagcgcgtcttccccccgctggatttcacacagcagcctccagcacaggagcttattgcacgggatattcatgatgttgagtggaagttcaggcatatcttccgaggccagcccaaaagacacctgctgacgactggctggagtgtgtttgtcagtgctaagagacttgttgctggagattctgtgctattcatatggaatgagaaaaaccagcttttgcttggaatcagacacgctacccggccacagactgtgatgccctcttctgttctttcgagtgacagcatgcacatcggactccttgcagcagcagctcatgctgctgcaacaaacagccgcttcacaattttctataatcctagggcaagtccaacagaatttgttatacccctttcgaaatacatcaaggctgtttttcacacgcggatatcagttgggatgcgattcaggatgttatttgagactgaggaatcaagtgtccgcaggtacatggggacaataacagaagtgagtgatgctgacccagtgcgttggcctagttcctattggagatcagtgaaggttggttgggatgaatcaaccgcaggagaaaggccacctagagtttctctgtgggaaattgagccactgacaacctttcctatgtatccatccctgttcccactgcgagttaagcatccttggtattcaggacttgctgctcttcatgatgacagcaatgctttgatgtggctgagaggagtaaccggtgaagggggctttcattctttgaacttccagtcacctggtataggttcctggggacaacagagactccatccatccttacttagcaatgaccatgatcagtatcaagcagtggttgctgccgcagctgcctcccagtccggtggttatctgaagcagcaattcctacaccttcaacaacctatgcagtccccacaggagcagtgcaatctcaatccgctgttgcagcaacaaatactacagcaagcgagccaacagcagatggttagttctgatgctcaaaatattcagtccgtgctcaacccaggtgctattcagcagcagctccaccaactccagcagatgcagcatactcataatgaccagaagcaaaagattcaaccagatcaacagtaccaagttgctagcagtgcggttctcccgagtccaacatcattaccaagccatttgcgtgaaaaatttggcttctctgatcctaatgtgaactcttccagcttcatcagctctagcagcaacgaaaacatgctggaatcaaacttccttcaggtaagttcaaaatccgtggatttgtctagattcaaccaaccagtagttagcgagcagcagcagccgcaacaacaacaggcatggaagcaaaagtttatgggctcacagtcaatgtcttttgggggctcggtttcgcttaactcgcccactagcaaagatggttctgttgacaacaaagttggtcgtgatgtgcagaaccagtccctttttagccctcaagtcgactcttcctccctactgtacaatatggtacctaatcttacctcaaatgttgctgataataatatatcagcgtttccctctggatcaacatatctgcaaagtccaatgtatggttgtctggatgactcttctggtttattgcaaaatacaggagagaatgatccgacaactagaacttttgttaaggtttacaagtcaggatcagtggggagatccttggacatcacccggttctctaattatgctgaacttcgagaggaactgggtcagatgttcggcattaagggtcagttggacgaccctgatagatcaggctggcagcttgtatttgtcgacagggagaacgatgtgcttctccttggagacgacccgtgggagtcatttgtgaatagtgtatggtacatcaagatactttcacctgaggatgtgcataagatgggaaagccaggaaacgatccacgctacctatcttagctacctatcttaaatcgatacatggagctctttctggctcccatgacgattctgcggcacactgtagcactgttcacgacggcctgctctactgtgctcgcatgttcgcccgtgtcatctgtagcatgcaccaccgtgctcgtcttcagaagacgaactccccgtcgcttgtatccggtgcaggtcaccgctcctggactgatattttgtaggttccacgtaggaatcagtatcagcaactctatcctagtttgtggtaggctcgcgcggcgctcgttcctgtgtcgcatcaggatcttcggactaaaatgcgtagtcgaaaccgttctcgtgattcgtaagctattcatgtatttgaggattcctcgacatgctttcgacgatgaactgcaataatctgaatgcaggaggattgtttgagatttgtaaaaaaaaaacaaaaaaaaaaaaaaaaaaaaaaaaaaaaaaaaactcgagagggg

SEQ ID NO: 1610 - DNA, 3988 bp, Zea mays
  Predicted polypeptide sequence is orthologous to G1451
aattcggcgcggggcgaaagcaagcaaggagcaccgcaccacgccactccagtactccactccactctcgtcccctcctcgatccagccatggcggcctagcccccccccccccctcccctagggttctctgccagcccccacccacccaggcgcctcctgccgctcccacccggtggtcgcgctgcccgcgtcgaatgggaggccacccggcgctcggagtcgggcgtgaccgcgcgctgccggaggttccctgagctcggcggcggcgggagcgtggctggtccggagcgcgccgcgcgtgcaatgggaggttcgagtggggttcctgcgagccgccgcggcggtctcggttctgcgagcgcgtggcccatgcttcgcgaagggtagggttgtctgtctgtctagctagctgctagctgcttggtctgatgagctcagctccggcgccccgcctcggcttccccgcgcgcttgctccgtcggctgcccagaacccagcttgcccgctccggcgcttctcttcgcttcttcggggaaaggttggagctttgaggtggtgcgggtgctcagccgaggactccgggcgatgacgcccgcagtggcgcgcgtttgccgcgacagtcctgggttcgggtagcgagttcctcgagcggatttggctgctgctgcgtcctgcgtgggaaggggaggcggcggcggcggcagcagcagaggaaggggaacggttgctctgaagcggagggggagcgggctgacattgcttctgggagcatggcgagcttctaaggacgcgcagctcccgcagcccagccattctcatcgccgcaccttggtgttcttgcccccaggtcgtactggttggtgggagggaacatgaacctctccccgcccaagatgtcggagccatctccggcacgtggcggggaacaaaggtgtctgaactcagagctatggcatgcatgcgcagggccccttgtgtccctgcctgtggttgggagccgggtcgtctactttcctcagggccatagtgagcaggttgctgcatcaactaataaagaagttgatgctcaaatcccaaactatccaaacctacctccacagttaatatgccagcttcataatgtcacaatgcatgctgatgcagagactgaagaggtgtatgcccaaatgacactgcaaccattgagcccggaagagcaaaaggatccttttcttccaattgaattgggtgctggtagcaagcagccaaccaattacttctgcaagacgttgactgcaagtgatacgagtacccatggtggattctctgttccgcgccgagcagctgagaaagtcttccctccattggatttttcacaacagcctccagtgcaagagctggttgcaagagatctgcatgataatgaatggaaatttcgtcatatttttcgtggtcagccaaaaaggcatctactgacgactggttggagtgtttttgtaagcgcgaaaagactagtagcaggggattctatcatatttatctggaatgataataaccagcttctcttgggaattcgccgtgcaagtcgtccacagactgtaatgccctcttctgtgctatcaagcgatagcatgcacattggtcttcttgctgcagcagctcatgctgcagccacaaacagtcgtttcactattttctacaaccctcgggctagcccttctgagtttgtcattccactggctaagtatgtgaaagctgtttaccacacgcgcgtatctgttggaatgcggtttcggatgctttttgagacagaggaatcaagtgtcagaagatacatgggtacgatcacaggcataagtgatctggactcagagcgctggccaaactcgcactggcgttctgtgaaggttggttgggatgagtctacagctggtgataaacagccaagagtttcactctgggagattgagccactgacaacctttccgatgtacccaactgcttttccattaaggctaaagcgtccgtgggcttcaggactacctatgttcaatggtgggaggagcgacgagttcgctcgttattcttctctcatgtggcttcgagatggaaaccgaggggctcagtcactgaacttccagggacttggagcatcaccatggcttcagccaagaatagattatccattgttgggtctgaagccagatacttaccagcagatggctgctgccgcactggaagaaattagagctggggatcatttgaagcaggcatcttctctcctgccagtgcagcagcctcaaactttgaatggtggattagatcctttgtatggaaatcctgttctgcagcagatgcagttccaatctcagcagtcaacactgcaagctgtgcagcaaggttatggtcagaatgcaaacgactctgggtatgttcaaaatcaactgcagcagctgcagctgcaaaagcagcaggagccaccaccaccacagcagcagcagcagacacaagtccttcagcgacaagcacatcaggaaatgcaacagcacctctcagctagttgtcatgatattgctaatgtagcttctggtgtgtccatgtctggatctgcttgtcaatcacaatcttctctgctttctgggtcatcgttctaccaacagaacatctttgatggaaatggtggtccagatctgcatctgcacaacagtttccacaacttttcaagccaagagtcctccaaccttcttaacctcccaagaagtggccaattaatggcatcagagggatggccttcaaagaggttggctgtggaatctcttgctggtcatgagatccaacctctgcagcacaagcttgagaaagttagtcaccagagtactgtgtctcactgttctggcaccttgccgccactatcagcaagagacggttctagtgcccaggcttgtggtacaaatgttcagagtcacctgcttccatcatcatttgcaatccatgatggattgtcaaccatcaggagtggtggtgttggcagtggaactgatgcgataaccatagcttcgttgagatatagtgatgcgaatttgctacctgaaaactccatagcaacttccagttgtttgggtgaatcaggaaccttcaattctcttgacgatgtttgtggtgtaaacccatcacaaggtggaacctttgtgaaggtttacaaatcagggtccctcgggagatcgctcgacatcaccagattcggcagctactacgagttgcgtgtcgagctcgagcggttatttggtctcgaaggccaactggaggaccctgcaagatcaggctggcagcttgtattcgtcgaccgggaaaacgatgttcttctcctcggcgacgacccgtggcaggagtttgtgaatagcgtagggtgcataaagatcctctcgccgcaagacctgcagcagatggcccgcggcggcggaggtgaccttctgtctgcgcctggagcgaggatgctgcagggcagtgtctgtgacgactattctgcaggccacgacgtgcagaacctcaccggcagcattgcgcctgtggtgcctctggactactgaagaggactgaggcgaaggccgggatctgaagctctgaaccaaaaccggcaatccagcatttgcaggatttgccatccgcaagtcgtttcgttcctgtgttatgatcctctcagtctcaggccctgttgatcgggaataacctagtcgtttaatatagctagatgatgatccatgtatcattatggtaatggacatgctgtacgatagctactgtagctctaaatgcaggcaaggcaagaattgatctatcaaagaacgaatgaatgcaggcactcactgtagaggtgatctagccctgtactcctaagtcctaagatatattctcatagctaaaactgatggttccatgtggcattggcacccaagctattgaaaccagtcacctttgccgattcctcctgcgaaaaaaaaaaaaaaaaa

SEQ ID NO: 1611 - DNA, 2886 bp, Zea mays
  Predicted polypeptide sequence is orthologous to G1451
gtcgacccacgcgtccggtctacctccgcagcttatatgccaactgcataatgtgactatgcatgctgatgctgagacagatgaggtgtatgcacagatgacactgcagccactcagtccacaagagctcaaggacccatttttgcctgctgagttaggcactgccagcaaccagccaacaaattatttttgtaaaacactaactgcaagtgatacgagtacacatggtgggttctctgttccacgccgagcagctgagaaggtgtttcctccactggatttcaatcagcaacctcccgcacaggagttgattgcaaaagatcttcatggcaacgactggaaatttcgccatatttttcgaggtcagccaaagcggcatcttctgacaacaggttggagtgtctttgttagtgcaaagagactggttgctggcgactctgtcctttttatctggaatgacaacaaccagctgcttctgggaattcgacgggcaaacagaccacaaaccgtcatgccatcatcagtactttctagtgatagcatgcatattggcctgctcgctgctgcagctcatgctgcatcaacaaatagtcggtttactatcttctataatccaagagcaagcccttgtgaatttgtcatacccatggctaagtatgtgaaagctgtgtaccatacccgtatatctgtgggcatgcgtttccggatgctttttgagacggaggaatctagtgtaaggcgttatatggggacaattacaggaataagtgatcttgatcctgttcgctggccaaactcgcactggcgctcagtaaaggttggatgggacgagtcaactgctggagagaagcagccaagggtatctctttgggagattgaaccgttgacaacttttccaatgtatccatctccttttgctcttggattaaagcgcccatggcctgcaggcctgccttctttatacggtggaaggggtgatggcttgacctcttctcttatgtggcttcgagacagggcaaacccgggtttccagtcactgaatttcagcgggcttggtatgagtccctggatgcagcctaggctggataattccttacttggtctccaatctgacatgtaccagaccatagcagcagcagcagcattacaaagcactacgaagcaagttccaccttcagcaatgcagttccaacagcctcagaacattgctgatagatctgctcttctatcaagtcagattctgcagcaagtacaacctcggtttcagcaaatttaccctcaaaatctcaacgaaaacaaaattcaaggtcatacacaacctgagtacctccaagtccaacagcagcttcaacgctgccaatcatttaatgagcagaagcctccgatgcatccacagcaacaacagcaggaaccacagcagcagcaatgcgtccaaacaccacaggatcaacaaatgcaagaacagaagcatctgcacaacttccactccttgccagatgcattatcggccttttctcagctttccccagccactcactccccaccttccgcattgcagacagttccagcattctcgcatcaacaaaacttcccagatacaaacattagctctctctcaccatctactggcccttcaatgcatggcatgttggggagattaccttccgaagcagcttcgagcctcccatgtgtggcaatgaacgcccctgtatcggtatctgacccatggtcatccaagagagttgcagtggagtctgttaacccttgtcgacctcatgtttcaccacatatagaacatttggatatggcgacgtgtaacatgccgcagagctctgcactagcaccattacctggacgagaatgcctagtggatgaagatgggtgctctgatcctcaaaatcacctcttgtttggtgttcacatagactcacattcacttctgatgcaagggggcattccagcccttcagaatgataacagttcaggcactattccatactcaacctccaatttcctgagcccttctgataacgatttccccttgaatcaaccgctacgcagcgctggctgcttagatgagtcggattatcttccatgtgcagagaatgccgaacaggcaaatcaacagtttgcaacctttgtgaaggtttacaaatccgggaccgtcggaaggttgctcgacatcactagattcagcagctacgacgagctccgtagcgaggtggggcgtctgtttggcctcgagggccagctggaagaccctttgagatcaggctggcagcttgtatttgttgacagggaggacgatgtccttctggttggcgatgacccatggcaggaattcgtgaacagtgtgtcctgtataaagatactttcaccggaggaggtccagcggatgggaaagccgggcatccagctcctgagctcggctccttcaagaaggctgggcaatggctgcgacagctacgcgagcatgcaggagccgagaggcctggacgctgggatggcgccggtgggttcggtcgagttctgaagacggcggagggaagcccaccatggccctcgggtcgaggattactctccctcctgtatgtttctgcagcacttgctagctctgcgacttggaacaaagcacgtagatcaaatggagctctgtgctgctccccgtctgatgatgtcttatggtatagactcgtagcagtaactactacatgttgtatacatgccggcacttcagttcttatcgagtagcaataccgctagtttagtccatccaatcaactacgttcttgttcctatgatcctgttgttgcgatgcagtaaaactttttttttcgtcataaaaaaaaaaaaaaaaaaaaaaagggaaaaaaaaagggcggccgc

SEQ ID NO: 1612 - DNA, 3033 bp, Zea mays
  Predicted polypeptide sequence is orthologous to G1451
ccgcttgtttccttgcccgcggtgggtagccgagttgtgtacttccctcagggccacagcgagcaggtagcagcatcaacaaacaaggaaatagagtctcagatccccaactatcctaatctgcctgccacagcttatatgccaacttcataatgtgacgatgcatgctgatgcagagacagatgaggtatatgcacagatgacactacaaccactcaacccgcaagaactgaaggacccatatttacctgcagaattaggttcggccaataaacagccaacaaactatttctgcaaaacattaacagcaagtgataccagtacccatggtgggttctccgttccccgtcgagcagctgagaaagtgtttcctccactggatttcacccagcaacccccatgccaggagttgatggcaaaagatcttcatggcaatgagtggaaattccgtcacatctttcgtggccagccaaagcggcatcttctaactacaggttggagtgtctttgtaagtgcaaagagactcgttgctggcgactctgtcctttttatctggaatgacaataaccagcttctgctgggaattcgtcgtgcaaatcggccacaaactgtcatgccatcttcagtcttatcaagcgatagcatgcatatcggtcttcttgctgcagctgctcatgctgcttcgacaaatagccgatttacaattttttacaacccaagggcaagcccttcagagtttgtcataccactcgtaaagtatgttaaggctgtgtatcatacccgcatatctgtggggatgcgattcaggatgctttttgagacagaagagtctagcgttaggagatacatggggacaattaccggaatctgtgatcttgattctgttcggtggccaaattcacactggcgttctgttaaggttggctgggatgagtcaactgctggtgagcgacaaccaagggtgtcactatgggagattgaacccctgacaactttcccaatgtatccatctccttttccgctcaggctcaagcgtccatggccaacaggcttgccttctctgcatggtgggaaggatgatgacctggctaactctctcatgtggcttcgagataccgcaaatcctggttttcagtcgttaaattttggtggacttggtatgagcccttggatgcagccaaggctggatgctaccttacttggtctgcaacctgacatgtatcaggcgatggccacagctgcttttcaggatgcaacaaagcaggcatcgcccacaatgctgcagttccagcagccccagaacatagctggccgggcttccccgcttctttcaagtcagattttgcagcaagcacatcatcaatttcagcagcaaccgtaccttcaaaacatctctgagagcacaatccaagcacagggtcagtctgagttcctcaagcagcagatccaacgcagccagtcattcaatgagcagaagccccagatgcaacaccagcaagaatcacagcagcagcagcaaccacagtgtctgccagtcccccaacatcagcaaatgcaacaacagaatatgaccaactaccagtctatatctaatgcattatcaccgttttctcagctgtcgccagtttctcagtcttcacctatggcgctgcagactatattaccgttctcgcaggcacagagcttcacagacacgaatgtaggttcattgtctccatccaatggtaacaccatgcaaaacacactgaggccgttctcatcagaagcagtttctcacctcagtatgccgaggcccactgcgatacctgtcgcagacccatggtcgtcgaagcgtgtcgcggtggagtctctgcttccttctcggcctcaggtttcatcccagatggaacaattggaccctgcaccagctagtatacctcatagctctgcgttggcaccacttcccggaagagggtgcttggttgaccaagatgtgaactctgatcctcaaaatcatctcttgttcggtgttagtatagactcgcagtcactgctaatgcaagggggcattcctggtctccaaaacgggaatgattcagctgctataccttattccacttccaatttcctcagcccttctcagaatgactttcctctggaccatacactaaattcttcaggctgcttagatgattctgggtacgtcccgccatgttcagataattctgacaaagtgaaccgaccaccagcgaccttcgtgaaggtttacaaatctggaacctacgggaggtcgcttgatatcactaggtttagcagctatcacgagctccgtagggaactggggcgcctatttggccttgagggccagttggaagacccattgagatcaggctggcagcttgtattcgtcgaccgtgaggaggacgtccttctcgtgggcgacgacccttggcaggaattcgtgagcacggtgtcctgcataaagatcctctccccgcaggaggtgcagcagatggggaagcagggcctggagctcctgagctcggcccccgcgcggaggctcggtagcagctgtgacgactacgtcagcaggcaggagtcgagaagcctgagcaccgggatcgcgtccgtcggttcggtcgagttgggatgagcagcaagatagcgcgcacgcagcagcagcagcagcaggttacgcatcctcagcctcagggtaggtaggggactgaagggttggtctgcgacttgatgacccacgagctcctcgttgcgcgcttcgttcgcctccatgcgatggatagaagttcagcgcagaccaagccttagctctgcgagctatgtaccatctaataattctgtccgtgtcgtaccatgtcaactcctaagtagaagaattgaagaaactaccagcagccgctgtctggtatacacgctgaaacattttttttcttgtatggagaaatactaatcatctggatgtagccaggcctatgctctctaatggttgatcgggtaatacagcccctcgcacacaaaaataagtcgacgcggccg

SEQ ID NO: 1613 - DNA, 680 bp, Medicago truncatula
  Predicted polypeptide sequence is orthologous to G1451
  misc_feature (541)..(541): n is a, c, g, or t
ttcggcacgaggcgacaaactacttttgcaagaccttgactgctagtgacacaagcactcacgggggattctctgttcctcgccgggcggctgaaaaagtgtttcctcctttggatttctcccaacagcctcctgctcaagagttaatagcaagggacttgcatggtaacgaatggaaattcagacatatcttccgaggccagcccaaaagacatctacttacaactggatggagtgtttttgtgagtgctaaaagacttgttgctggtgattctgtgctgtttatctggaatgaaaagaaccaattgcttcttggtattcgccgtgctagccgaccacaaactgtgatgccttcctcagtattgtcaagtgatagtatgcacttgggacttcttgctgcagcagctcatgcggctgcaaccaatagccgtttcactattttctataacccacgtgcgtgtccatccgaatttgtcatacccttggcaaagtatgttaaagctgtgtatcatactcgagtttcagttggtatgcgtttcangatgctctttgaaacagaggagtctagtgtgcgacgatacatgggtacaataactggcatttgtgacctaaattctgtccggtggcctaactcacattggcgctcggtaaaggttggttgggatgaatccactgccgga

SEQ ID NO: 1614 - DNA, 705 bp, Solanum tuberosum
  Predicted polypeptide sequence is orthologous to G1451
ggagttgtgtattttcctcaagggcatagtgagcaggttgctgcctcaaccaacaaggaagtagatgctcatatccctaattatcctggtttaccgcctcaactaatttgtcagcttcacaacctgacaatgcatgcagatgttgagactgatgaagtatatgctcaaatgacattgcagccactaagtccacaagagcaaaaggacgtgtgcctgctaccagcagaacttggcatcccgagtaaacaaccaaccaactatttctgcaaaactttgacggcaagtgacaccagtactcatggtggattctctgtccctcgccgagcagcagaaaaagttttccctcctcttgattactctcagcagccaccctgtcaagagttgatagcaaaagatctccatgggaatgaatggaaattccggcatatttttcgcggacaaccgaagaggcatctattgacaaccggatggagtgtgtttgtgagtgcaaagagacttgttgcaggcgatgcagtcatctttatctggaacgaaaacaatcaattgcttttggggattcgacgtgctaatcgtcctcaaactgtcatgccttcttcagtcttgtcaagtgatagcatgcacattgggtctcctagctgcagcggctcatgcagctgcaactaatagccgctttacaatattttataatccagggcccagccatca

SEQ ID NO: 1615 - DNA, 617 bp, Zea mays
  Predicted polypeptide sequence is orthologous to G1451
tccaaagaattcggcacgacactggctggagtgtgtttgtcagtgctaagagacttgttgctggagattctgtgctattcatatggaatgagaaaaaccagcttttgcttggaatcagacacgctacccggccacagactgtgatgccctcttctgttctttcgagtgacagcatgcacatcggactccttgcagcagcagctcatgctgctgcaacaaacagccgcttcacaattttctataatcctagggcaagtccaacagaatttgttatacccctttcgaaatacatcaaggctgtttttcacacgcggatatcagttgggatgcgattcaggatgttatttgagactgaggaatcaagtgtccgcaggtacatggggacaataacagaagtgagtgatgctgacccagtgcgttggcctagttcctattggagatcagtgaaggttggttgggatgaatcaaccgcaggagaaaggccacctagagtttctctgtgggaaattgagccactgacaacctttcctatgtatccatccctgttcccactgcgagttaagcatccttggtattcaggacttgctgctcttcatgatgacagcaatgcttgatgt

SEQ ID NO: 1616 - DNA, 512 bp, Sorghum propinquum
  Predicted polypeptide sequence is orthologous to G1451
gcacgagggttgctggcgactctgtcctttttatctggaatgacaacaaccagctgcttctgggaattcgtcgggcaaacagaccacaaactgtcatgccatcatcagtactttctagtgatagcatgcatattggtctgcttgctgcagcagctcatgctgcatcaacaaatagccggtttactattttctataatccaagagcaagcccttgtgaatttgtcatacccatggctaagtacgtcaaagctgtgtaccatacccgtatatctgtgggcatgcgtttccggatgctttttgagacagaggaatccagtgtaaggcgttacatggggacaattacaggaataagtgatctcgatcctgttcgctggccaaactcgcactggcgctcagtaaaggttggatgggacgagtcaactgctggagagaagcagccaagggtatctctttgggagattgaaccattgacaacttttccaatgtacccatctccttttgctcttggatta

SEQ ID NO: 1617 - DNA, 472 bp, Glycine max
  Predicted polypeptide sequence is orthologous to G1451
ccccaaggtcatagtgagcaggttgctgcatcaaccaacagggaagtagatgcacatattcctaattaccccaacttgccaccacaacttatctgtcagcttcacaatgtgacaatgcatgcagatgctgaaacagatgaagtatatgctcaaatgactctgcaacctctaagtccaagcaaaaggaggtgtatctgctgcctgcagaattgggtactcccagcaagcaaccaaccaactacttttgcaaaacattgactgcaagtgataccagcactcatggaggattttctgttcctcgaagagcagctgaaaaagtcttccctcctcttgattactcacagcagcctcctgctcaagaactaattgccagagatcttcatgataatgaatggaaattcaggcatatatttcgcggtcagcccaaaaggcatcttcttactacagggtggagtgtctttgtcagtgccaa

SEQ ID NO: 1618 - DNA, 484 bp, Sorghum bicolor
  Predicted polypeptide sequence is orthologous to G1451
gcacgaggggccatagtgagcaggttgctgcatcaactaataaagaagttgatgctcagatcccaaactacccaaacctacctccacaattaatctgccagcttcataatgtcacaatgcatgctgatgcggagactgaagaggtgtatgcccaaatgacactgcaaccattgagcccggaagaacaaaaggaaccttttcttccaatcgaattgggtgctggtagcaagcagccaactaattacttctgcaagacgttgactgcaagtgatacgagtacccatggtggattctctgttccgcgccgagcagctgagaaagtcttccccccattggatttttcacaacagcctccagttcaagagctggttgcaagagatctgcatgataatgagtggaaatttcggcacatttttcgtggtcagccaaaaaggcatctactgacgactggttggagtgtttttgtaagcgcaaaaagactagt

SEQ ID NO: 1619 - DNA, 485 bp, Hordeum vulgare
  Predicted polypeptide sequence is orthologous to G1451
cgtgatctgccagctgcacgacgtcacaatgcatgccgatgtggagaccgacgaagtgtacgcgcagatgacgctgcagccgctgaacccacaagagcagaacgacgcctacctgccggccgagatggggatcatgagcaagcagccgaccaactacttctgcaagacgctgacggccagcgacaccagcacgcacggcggcttctccgtgccccgccgtgccgccgagcgcgtcttcccccctctggatttcacgcagcagcctcctgctcaggagctaattgcgcgggatattcatgacgtcgagtggaagttcagacacatcttccgaggccagccaaaacgacacttgctaacaactggctggagtgtctttgttagcgccaaaagactcgttgctggagactcagtgctattcatatggaatgagaaaaaccagctttggctgggaatcaggcgtgccaaccggacacagactgtgatcg

SEQ ID NO: 1620 - DNA, 652 bp, Lycopersicon esculentum
  Predicted polypeptide sequence is orthologous to G1451
agaactatggcatgcttgtgctggtccccttgtttgtctaccaacggtagggagtcgagtggtttactttcctcagggtcacagtgaacaggtctttctcaaattaagctacattaattttgaactaattgttgcatatattagtatttagtcaattgctgatagttaccattggaattgagtgtaggttgcggcgacaactaataaagaagtcgatattcacatacctaattacccgaacttgccaccacagttgatctgtcaactccacaatgtcacaatgcatgtaggttcttttttcatattctatgttttcttatgaattagtgttgtgtaagttgtaatataggcttacgagggaatgacgattcctaggattttaggcagatgttgaaacggatgaagtatatgctcagatgacattgcaacccttgacactggtattttctgaacgatgcaataaagctcatttgcttttactgattaccggatattttgtgtgaattggtgacaaaatatgctgttgcattttcagcaagaacaaaaggacacgtatcttcctgttgaattgggtattcctagcaggcagcctactaattatttttgcaagacactcactgcaagtgataccagtacgcatggcggcttttct

SEQ ID NO: 1621 - protein, 908 aa, Oryza sativa
  Orthologous to G1451
MKLSPSAGGVSDQPPSPPEVAEEQKCLNSELWHACAGPLVSLPAVGSRVVYFPQGHSEQVAASTNKEMESQIPNYPNLPPQLICQLHNVTMHADAETDEVYAQMTLQPLSPQELKDPFLPAELGTASKQPTNYFCKTLTASDTSTHGGFSVPRRAAEKVFPPLDFTQQPPAQELMAKDLHGNEWKFRHIFRGQPKRHLLTTGWSVFVSAKRLVAGDSVLFIWNDSNQLLLGIRRANRPQTVMPSSVLSSDSMHIGLLAAAAHAASTNSRFTIFYNPRASPSEFVIPLAKYVKAVYHTRISVGMRFRMLFETEESSVRRYMGTITGISDLDPVRWMNSHWRSVKVGWDESTAGERQPRVSLWEIEPLTTFPMYPSPFPLRLKRPWPTGLPSLYGGKEDDLASSLMWLRDSQNTGFQSLNFGGLGMSPWMQPRLDSSLLGLQPDMYQTIAAAAALQNTTKQVSPAMLQFQQPQNIVGRSSLLSSQILQQAQPQFQQMYHQNINGNSIQGHSQPEYLQQPLQHCQSFNEQKPQLQPQQQQQESHQQQPQHQQMQQQKHLSNFQTVPNALSVFSQLSSTPQSTPSTLQTVSPFSQQHNFPDTNISCLSPSNVSSMHDTLRSFPSEAASDLPGVPRITPVPVSDPWSSKRVAVESTITSRPHDISSQIENFDLTPSSIPQNSTLAPLPGRECLVDQDGSSDPQNHFLFGVNIDSQSLLMQDGIPSLHNENSSSTIPYSTSNFLSPSQDDYPLSQTLTTPGCLDESGYVPCSDNADQVKRPHATFVKVYKSGTVGRLLDITRFSSYHELRSEVGRLFGLEGQLEDPLRSGWQLVFVDREDDVLLVGDDPWQEFVNSVSCIKILSPQEVQQMGKPGIELFSTSARRLGNSCDNYMSRQESRSLSTGIASVGSVEF

SEQ ID NO: 1622 - protein, 863 aa, Oryza sativa
  Orthologous to G1451
MSSSSAASIGPPQPPPPPAPPEEEKKCLNSELWHACAGPLVCLPTVGTRVVYFPQGHSEQVAASTNKEVEGHIPNYPNLPAQLICQLHDVTMHADVETDEVYAQMTLQPLNPVRRLGFLHDVCSAEVLMQEQNDAYLPAEMGIMSKQPTNYFCKTLTASDTSTHGGFSVPRRAAERVFPPLDFTQQPPAQELIARDIHDIEWKFRHIFRGQPKRHLLTTGWSVFVSAKRLVAGDSVLFIWNEKNQLLLGIRRASRPQTVMPSSVLSSDSMHIGLLAAAAHAAATNSRFTIFYNPRTSPHYLWEFYNWASIKIHNILMRPMHTLMKHRYMGTITEVSDADPVRWPSSYWRSVKVGWDESTAGERPPRVSLWEIEPLTTFPMYPSLFPLRVKHPWYSGVASLHDDSNALMWLRGVAGEGGFQSLNFQSPGIGSWGQQRLHPSLLSSDHDQYQAVVAAAAASQSGGYLKQQFLHLQQPMQSPQEHCNLNPLLQQQILQQASQQQIINPDAQNIQTMLSPSAIQQQLQQLQQMQQVQNDQKQKIQPDQSYQVPTSAVLPSPTSLPSHLREKFGFSDPNANSSSFITSSSSDNMLDSSFLQGSSKAVDLSRFNQPVASEQQQQQQQAWKQKFMGSQSVSFGGSVLHNSPTSKDGSVENKIGRDVQNQSLFSPQVDSSSLLYNMVPNLTSNVSDGNLSTIPSGSTYLQNAMYGCLDDSSGLLQNTGENDPATRTFVKVYKSGSVGRSLDITRFSNYAELREELGQMFGIKGQLDDPDRSGWQLVFVDRENDVLLLGDDPWEFINIYMNVSNAKKSYIMKRREYNTLVSWFPQLIAYRGKTVLPSIICVGQSLYVDAQLPKTLRESKHQT

SEQ ID NO: 1623 - protein, 662 aa, Oryza sativa
  Orthologous to G1451
MKLSPPASADMPQALPENDGEQRCLNSELWHACAGPLVSLPVVRSRVVYFPQGHSEQVAASTNKEVDAQIPNYPNLPPQLICQLHNVTMHADAETDEVYAQMTLQPLSPEEQKEPFLPMELGAASKQPTNYFCKTLTASDTSTHGGFSVPRRAAEKVFPPLDFSQQPPAQELIARDLHDNEWKFRHIFRGQPKRHLLTTGWSVFVSAKRLVAGDSVIFIWNDNNQLLLGIRRANRQQTVMPSSVLSSDSMHIGLLAAAAHAAATNSRFTIFYNPRASPSEFVIPLAKYVKAVYHTRVSVGMRFRMLFETEESSVRRYMGTITSISDLDSVRWPNSHWRSVKVGWDESTTGDKQPRVSLWEIEPLTTFPMYPSAFPLRLKRPWASGLPMHGMFNGGGNDDFARYSSLMWLRDGNRGTQSLNFQGHGVSPWLQPRIDSPLLGLKPDTYQQMAAAALEEIRYGDPSKQHPATLQYQQTHNLNSGLNSLFASHVLGQVQFQPQQSPLQVVQQGHCQNTGDSGFLQGQLPRLQLHNTQQLLKEQELQQQQRQHVLQEQSSQEMQQQLPSSDHHVADVASESGSAPQAQSSLLSGSSFYNQNLLEGNSDPPLHLHNNFHNFSYQEASNLLILPRSSQLMASDGWPSKRLTLESAVHPEAPSMHPKIEK

SEQ ID NO: 1624 - protein, 917 aa, Oryza sativa
  Orthologous to G1451
MRLSSSSGSVLPAQAASPEAVEEQKCLNSELWHACAGPLVSLPAVGSRVVYFPQGHSEQVAASTNKEMESQIPNYPNLPPQLICQLHNVTMHADAETDEVYAQMTLQPLSPQELKDPYLPAELGSANKQPTNYFCKTLTASDTSTHGGFSVPRRAAEKVFPPLDFTQQPPAQELIAKDLHGNEWKFRHIFRGQPKRHLLTTGWSVFVSAKRLVAGDSVLFIWNDNNQLLLGIRRANRPQTVMPSSVLSSDSMHIGLLAAAAHAASTNSRFTIFYNPRASPSEFVIPLSKYVKAVYHTRISVGMRFRMLFETEESSVRRYMGTITGISDLDAARWPNSHWRSVKVGWDESTAGERQPRVSLWEIEPLTTFPMYPSPFPLRLKRPWPTGLPSLHGGKDDDLTSSLMWLRDSANPGFQSLNFGGLGMNPWMQPRFDASLLGLQPDMYQTIAATAFQDPTKQVSPTILQFQQPQNIGGRANTLLPSQILQQVQPQFQQQQYLQNINETTIQGHAQSEFLQQQLQRCQSFTEQKPQLQTQQQQQESQQQQQQQSQCMQVPQHQQMQQQKNMTNYQSVPNALSPFSQLSSPSQSSPMTLQTVLPFSQPQSYPDTSMSSLSPSNTSTMHNALRPFSSEAPSHLSMPRPTAVPVPDPWSSKRVAVESLLPSRPQVTSQMEQLDSTAPSIPQSSALAPLPGRGCLVDQDGNSDPQNHLLFGVNIDSQSLLMQGGIPSLQGENDSTAIPYSTSNFLSPSQNDFPLDQTLSSADCLDESGYVPCSQNSDQVINRPPATFVKVYKSGTYGRSLDITRFSSYHELRRELGRLFGLEGQLENPLRSGWQLVFVDREDDVLLVGDDPWQEFVNSVSCIKILSPQEVQQMGKPFELLSSAPGKRLGSSCDDYVSRQESRSLSTGIASVGSVEF

SEQ ID NO: 1625 - DNA, 1388 bp, Glycine max
  Predicted polypeptide sequence is orthologous to G1452
taaggctaatgcaacatattaataggaaagaagcagtttaacaaattgcctacgctttgtgtagcactaatcatgatttacacccgaaaattccccacaatacttgtcttgtttttgtcctctcactaaggacaaaaaatatagaaccatcaaagtgaaaacgaagaaagctaataccaccaaactgttggttgttctggcaaagaaggtattctttgatgagtgcattgtgcttgggaaacgaactactgcacgagaatgctttgaattcccaacccttaatcttattctccggtgtgctgggccttgtggggcaggttgcatctgtgtaggatcctgtgggcttgtgtgactctctaccaagactgatgattcatctaatttgatgatatcatcctttagtatctctgcataacaatcctcttcatacccctcctttggttgacctgaagattcagtgaaagtagcttcgttaactggtcgctgattcgattcggacacagaatcaatttgctccattgaaggagaaccataactgctactgtccctcttggagctacatccaacctctttgtcttgctcacaagcatccctttgatcaataccacctcctgagatagcacaaccactttcatgtgaattcaccggatgcctttgacttgatgaagctctattcgaagcatcgctcaaacggaactctgtgttcctcttgaggcgacaaatgaccaaagattcctgagatttgtcattaatgcagtactcgtgcataatccattcagtcctttcccctttaggtgcacgccctaagtggaacaccaaagtccgcttcgttcctataatgttggaacctgactttacattacgctctttgccagttgccttccagtatccacattcagttgctcttttactttgtgaaccatttgggtactttcttccgcggggagagaagaagaaccattcgttgtctgactgaatgaatgattgggctggtaaatcccaaggctcgtatttacaaagctcaccctcagaaatgacttgaacactctcctcatgaccctccaacttcttcctcaggtaataagaaatcaactcctcatcggtagggcagaatctgaatccaggaaacatggacgaagcagcaatcgacatctgagcctccctcgaaaccccttccatcatccaccaccctgctttttgcaccctcctctgtgttttttttttcctcaaccgattgccgacacaataatgaaaaaaaaagctagctacccagggtttaaggtggttgatggttataaacgaacagggttgctgtcggaagagttattccttgggggcagggaggggtggctccgcttatgaggttcaagtgtggttgtgctttgctt

SEQ ID NO: 1626 - DNA, 912 bp, Glycine max
  Predicted polypeptide sequence is orthologous to G1478
ggtttttggagacaaaaagtgagtatcagccattataattgctattgatataggttacaatatgagatgccaggaactaccatgacatacacttgtaagacatatcattgtatatctgccaacatagtataacttacttctgccagaaattcgctctcctgctttggaattggcttaaaataaaaataaccgtagaagtcaaatttcaattaaactaactacttctaccagaaattaaagaaataaaaaacattgcaaatgccctccttctattgaacacggttctattaccaaccattttttttaaatcatgacattaaaaacatttagcacttccctatgtacctgagatggtactcactaaccttttctattacaaaagatattctaaggagaaaaaaagaaagatggaagttataacaagagggaaaggttgttatgcattcttgagcactttctgtggattcctctgttgctagggagatttccaatggtccagttaatgttggctggaagaaccacctctattgatgctccaatgagatatcttcgcgtaaggttttgacatgtgttgcacagaaagcacctaatgtgcctaagggccaaaaaattagcttcatgaacccttttatcacattttctacacaagtatgcatcatcagcttgacaatacaatgaagcctgtaacccacatagctcacaacatgtagcacttctggttgcacattctttatgtagatagctgctgcagaaaccatgttgcttttctccttctgcacctttgcacatttttagaagctcaatgggataatgataataataataataataatcaagcttgctacttggtagtttcttgaacaaatgcccggcgcttgcgcgcgcccgcccgggcctcgaagcggccgccac

SEQ ID NO: 1627 - DNA, 497 bp, Glycine max
  Predicted polypeptide sequence is orthologous to G1478
cttttctattacaaaagatcttctacggagaataaagaaagatggaagttataaaaagagggaagggctgttatgcattcttgaacactttctgtagattcctctgttgttaaggagatttctaatggtccagtttatattggccggaagaaccacctctagtgatgctccaatgagatatcttcgcgtaaggttctgacatgtgttgcacagaaagcacctaatgtgcctaagggccaaaaaattagcttcatgaacccgtttatcgcattttttacacaagtaggcatcatcagcttggcaatacaatgaagcctgtaacccacatagctcacaacatatagcacttctggttgcactctctttatgtagaaagctgctgcagaaaccatgttgcttttctccttctgcacctttgcacattttcagaagctctatgtgatgataataataatcaagcttgctacttggtagtttcttgccccggcccgaattcc

SEQ ID NO: 1628 - DNA, 480 bp, Glycine max
  Predicted polypeptide sequence is orthologous to G1478
aaaaaattagcttcatgaacccttttatcacattttctacacaagtatgcatcatcagcttgacaatacaatgaagcctgtaacccacatagctcacaacatgtagcacttctggttgcacattctttatgtagatagctgctgcagaaaccatgttgcttttctccttctgcacctttgcacatttttagaagctcaatgggataatgataataataataataataatcaagcttgctacttggtagtttcttgaacaaatggtgtagcttggtgtagatgaatataagaatataaagcctttttataacaaagtgatcattctatggacgagttctactagacaaggacatggggtgccacttcttcacgtaatcacacgtgtctgtattttagtccatttgtcttttaccaatcttgcctaaaggtcaatttggtcattaaagatggagaaagaaatttgtgattccacttgttttg

SEQ ID NO: 1629 - DNA, 390 bp, Zea mays
  Predicted polypeptide sequence is orthologous to G1478
  misc_feature (325)..(325): n is a, c, g, or t
  misc_feature (337)..(337): n is a, c, g, or t
cggacgcgtgggcggacgcgtgggcggacgcgtgggcctggagggtgcaagggagggaggcggtcgaatccgtcatccactgagcaccgccagccccgcacgcggaggtcggagggctacgctccggagtccgaggggaaggcagaggaggcaagcaggccggatgggtgccgctggtgacgccgcggcagcgggcacgcggtgcgagctctgcgggggcgcggcggccgtgcactgcgccgcggactcggcgttcctctgcccgcgctgcgacgccaaggtgcacggcgccaacttcctggcgtccaggcacgtgaggcgccgnctgccgcgcggnggcgccgactccggggtgtccgcgtccgcgtccagcggctcctgcctgtccac

SEQ ID NO: 1630 - DNA, 1337 bp, Glycine max
  Predicted polypeptide sequence is orthologous to G1482
gaattcggctcgagggatggctcatttatcatagtagtgcttcctcctttaccatttgaccatatttatccatctcaatcacttcccactttttatgagcattggccaacccccacgcttcctttattctccctctcaagcttcaagctactcacaccaatgaagatccagtgcgacgtttgcaacaaacacgaggcctccgtcttctgcaccgccgatgaagccgccctctgcgacggctgcgaccaccgtgtccaccatgccaacaaactcgcctccaaacaccaacgcttctctcttctccgcccttctcctaaacaacaccctctctgcgatatttgccaggagagaagagcctttacattctgtcagcaagacagagcgattctctgcaaagagtgtgacgtgtcaattcactctgccaacgaacacacccttaagcacgataggttccttctcaccggtgttaaactttctgcttctgctatgcttcgttcgtcagaaactacctctgattcaaactcaaacccttctcttcttaacttttcacaccaaacaacattactacctccatcttccaccaccaccaccaccaccagcaacaacaacaacaacaaggttgctgttgaaggaactggttcaactagtgctagcagcatatcggagtatttgatagagactcttcctgggtggcaagttgaagactttcttgattcatattctgttccctttggtttctgtaagaatgatgaagtgttgccacggtttgatggtgaaatggaggggcatctgagttctttctcaaccgagaacatggggatctgggttcctcaagcgccaccaactcttatgtgttcttcacaaatggatcgggtgatagttcacggtgagaccaatatcaaaggtagcagcagatcaaggttgaaggatgataatttcactgttccacagattagtcctccttccaattccaagagagccagatttctgtggtagaaacaaataaacaaacaaacaagcctcagtttccattctcttgaggcagaattaacaaccctctttgttttgttttgtcccttttctctttttcttaccctggcttgtagtttactctgcccatgttttcaatttggttcagtttgactttttttttttccctttttcttgtttctcctccctctttccctactgggctgtgttttgataaatttgtgcacctttctactagtgattgtaaatataaaccttttcaaatgcatgttgttttttgacacatgtttagaagagaaacaacagagtatgagcttaatagatatgttgagtaaaattcccccccc

SEQ ID NO: 1631 - DNA, 1173 bp, Glycine max
  Predicted polypeptide sequence is orthologous to G1482
attcggctcgagccttcctttattctctcctcttaaacctttcacttcaagcttcaagttttcaagctacccacccactgctcatactcacacccaatgaagatccagtgcgacgtgtgcaacaaacacgaggcctccgtcttctgcacagccgacgaagccgccctctgcgacggctgcgaccaccgtgtccaccatgccaacaaactcgcctccaaacaccaacgcttctctcttctccgcccttctcataaacaacaccctctctgcgatatttgccaggagagaagagccttcacgttctgtcagcaagacagagcgattctctgcaaagagtgtgacgtgtcaattcactctgccaacgaacacacccttaagcacgataggttccttctcactggtgttaaactcgcagcttctgccatgcttcgttcatcacaaactacctctgattcaaactcaaccccttctcttcttaacgtttcacatcaaactactccacttccatcttccaccaccaccaccaccaccaacaacaacaacaacaaggttgctgttgaaggaactggttcaacgagtgctagcagcatatcagagtatttgatagagactcttcctgggtggcaagttgaggactttctcgattcatattttgttccctttggtttctgtaagaatgatgaagtgttgccacggttggatgctgacgtggaggggcatatgggttcgttttcaaccgagaacatggggatctgggttcctcaagcgccaccacctcttgtgtgttcttcacaaatggatcgggtgatagttcaaagtgagaccaacatcaaaggtagcagcatatcgaggttgaaggatgatactttcactgttccacagattagtcctccctccaattccaagagagccagatttctatggtagaaacaatcctctttgttttgttttgttttgtgccttctctctttttgttaccctggtttgtagcttactcttgcccttgttttcgatttggttctgtttgactttttttcttcttctttttcttggttctcctccctctttccctaccgggctgtgctttgaagtattgataaatttgtgcacctactagtgattgtaaatataaaccttttcaaatacatgttttttttgacacatgtttagaat

SEQ ID NO: 1632 - DNA, 857 bp, Glycine max
  Predicted polypeptide sequence is orthologous to G1482
attcggcgcgagcaaaagcaaaagatgaagatccagtgtgatgtgtgtgacaaagtggaagcctccgtcttctgtcctgcagatgaagctgctctttgccatagctgtgatcgcaccattcaccgcgccaacaagcttgcaaccaaacacgcccgtttctctctccactaccccacctccaaagacttccctctttgtgatatatgccaagagaggcgtgcatatctattttgccaagaagacagggcgttgttatgcagggaatgcgacgttcctatccacagagccaatgagcatacccaaaagcataacaggtttcttctcacgggtgtgaagctctctggtacttgtttagatcctgcttcgtcctccaccaattacaccaataataatagagtcactggctctgaaggaagaaacgacgctcgatctagaatgaacagacccagatcatcagtttccaatgaagaaaatgcaagtaattcttcttgcaaggttgaagacaacgtggctagtgacactggttcgatttcaactagcagcatttctgagtacttgattgaaacaatacccggttactgttttgaagacctccttgatgcttcgtttgcacctaatggtttctgtaagaagcagaactttgatcatccctgggcgtttcaggaccaaaagcgaacaagtggagacactatggccgtgccgttcctgaaactagtcatccattgatcaaaatatctaaaccctcgcggtcataaactgtttgtaaaaatctgttggaaaatatcttctttatttttgttatttgtaaaaatctgaaactttatgattttattttttattctctattcccaaccaca

SEQ ID NO: 1633 - DNA, 1242 bp, Glycine max
  Predicted polypeptide sequence is orthologous to G1482
acggctgcgagaagacgacagaaggggaatctttttgtaagaacgtgaaacatgacaccctaactcgcgttgcttgcttgagtgatttgactcgtgtcgagtgtattgtatttagtttaagcgtggctgatcgagtgagtatcagaatcaattcaattttgagctagtcatgaagatccactgcgacgtgtgtaacaagcaccaggcctctttcttctgcaccgccgacgaagctgccctatgcgacggctgcgaccaccgcgtccaccacgccaacaagctcgcctccaaacaccaacgcttctccctcacccacccctctgcgaaacattttcccctctgcgatgtttgccaggagagaagagccttcgtgttttgtcagcaagatagagcgattctgtgcaaagagtgtgacgtgcccattcattctgccaacgacctcaccaagaaccatagcaggtttcttctcactgggattaagttctctgcttctgccacgccttatgattattcatcaccaccaccaccaccaccaccaccacccaagagaaaccctgttctcgattctccttcaacaccgtcaccgcctaagcctgggggaaactcgctaacaaacgaagaagaacctggtttcacaggtagcagcatttcagagtacttgataaactctatcccaggcatgaagttcgaagatttcctcgattcacattctcttccctttgcttgctccaagaatagtgatgacatgttgtcgctgtttggtgagggaaacatggtttctttctcacccggtgggttctgggttcctcaagcaccaccatcttcagtacaaatggatcggcagagtgggtacagagagacaagggaaggtagcattagatcaagttttggagatgataatttcatagttccacagatgagtcctcccagcaatgtgtctaataagagatccaggcttctctggtaaaacagatatagctagttacaactagctaacccccttatgtggctttgtgtgacttaaatttcactctcccctcctattttgtattttttatgtggtattgttttaatttttgtttgttcgtttggttttggtccctctcccttcctgaactacactactcttctagctactttctctcttgataagttggtgtatctcttccaaattgtaaatatgaacgttttaagagctctctgggttgagataaaaaaaaaaaaaaaaaaaaaagcggccaa

SEQ ID NO: 1634 - DNA, 1111 bp, Glycine max
  Predicted polypeptide sequence is orthologous to G1482
ggctcgagttcaaatcctcctttctattaatctgaaacaagttattagtcatgaagatccagtgcgacgtgtgtaacaaacagcaggcatcgttgttctgcaccgccgacgaagccgccctatgcgacggctgcgaccaccgcgtccaccacgccaacaagctcgcctccaaacaccaacgcttctccctcagccacccctctgcaaaacattttcctctctgcgatgtttgccaggagagaagagcctttgtgttttgtcagcaagatagagcgattctgtgcaaagagtgtgacgtgcccgttcattctgccaacgacctcaccaagaaccataacaggtttcttctcactgggattaagttttctgccctcgattctccttcaacacctcctaagcctgcaggtggaaactccctaacaaatcaacaaccacaacaacaaactggtttcacaggtagcagcatatcagaatacttgataaacactatcccaggcatggagttcgaagatttcctcgattcacattctcttccctttgcttgctccaagaatagtgatgacatgatgttgtcgatgtttggttgagggaaacatggtttcgttctcagccggagggatctgggttcctcaagcaccatcttcagtacaaatggatcagcagagtgggtacaaagacacatgggaaactagcattagatcaagttttggggatgatagtttattagttccacagatgactcctcccagcaatgtgtttaataataagagatccaggcttctatggtaaaacagttacagctagctatcaagctaaccaccttatgtggcttttaatttcactctattcttaatttggttttctttgtttttttgtccctctcctccttcctgagtactacactactcttctagctacttaattccctcttgcgttctcgataagttgatgtatctcttccaaattgtaaatgtctatgttttaagagctctctgggttcagattaattgtttctgctacatgttaaaagatgactcaagtcttaattaacattgcataaatgaaccggaagaagacttaggcgatatcttcaaaaaaaaaaaaaaaaagg

SEQ ID NO: 1635 - DNA, 1018 bp, Oryza sativa
  Predicted polypeptide sequence is orthologous to G1482
  misc_feature (202)..(202): n is a, c, g, or t
ggcgactcgagcaaccacgcggtcgcagaagaaagagagagagagagatggcggcatgagcacctcctcctgcatcgccacctcccccgatcccccgcaaaccctagcgaccgcgccccccaccgtcatccttctctgcggcggcgccctggtgaggagggaggaggaggatggggaggtggagagggcggtcgctgcgacntgtgcgcggccgaggccggcctcggtcttgtggtgggcggacgaggccgcgctgtgcgacgcgtgcgaccgccgcgtccacagcgcgaacaggctcgccgggacgcgccggcggttctgcctcctccgaccggtggcgtggtggtggtccgcccagaagccaccggcgggcgcctcccgtcaggagaagagggggttcttgttctgcaaggaggacaggggcgatcctgtgccgggagtgcgacgtcacggtgcacaccacgagcgagctgacgaggcggcacggccggttcctcctcaccggcgtgcgcctctcgtcggcgccgatggactcccccgcgccgtcggaggaagaggaggaggaagcaggggaggactacagctgcagccccagcagcgtcgccggcaccgccgcggggagcgcgagcgacgggagcagcatctccgagtacctcaccaagacgctgcccggttggcacgtcgaggacttcctcgtcgacgaggccaccgccgcctcctcctcctcagacgggctatttcaggtcagttcatccactgttaacgatccaaactttccatggcaacgaaaacctgaatacgtattcagtccggttcatgcatgaaaccctgaaaaaccaatccacacacgttcttgtgagcaccatgaacgaagcacaggcaaagcacggcgcgccaaactctgttcaggccctgccggccgtcgtgggcacataagccaatctgttcacaatatcgtgagcggacaaattttaccatgcaggtagtttgtagtcatgctcacacagctagcaataac

SEQ ID NO: 1636 - DNA, 478 bp, Oryza sativa
  Predicted polypeptide sequence is orthologous to G1482
gcacgcctcggacccgtccactctacttctccttgcaacatcgtcgttagtcctctaacccaaggcattgacctgagcttgttgtgcgcttctgccttatctgcatcccctcccggccgagacgcgaccatctttctttcccgcttcgttagctgtctctgccgatcgatcggactggacggggagacatgaaggtgcagtgcgacgtgtgcgcggccgaggccgcctcggtcttctgctgcgccgacgaggccgcgctgtgcgacgcgtgcgaccgccgcgtccacagcgcgaacaagctcgccgggaagcaccgccgattctccctcctccaaccgttggcgtcgtcgtcgtccgcccagaagccaccgctctgcgacatctgtcaggagaagagggggttcttgttctgcaaggaggacagggcgatcctgtgccgggagtgcgacgtcacggtgcacaccacgagcgagctgac

SEQ ID NO: 1637 - DNA, 1393 bp, Oryza sativa
  Predicted polypeptide sequence is orthologous to G1482
  misc_feature (1378)..(1378): n is a, c, g, or t
  misc_feature (1380)..(1380): n is a, c, g, or t
  misc_feature (1387)..(1387): n is a, c, g, or t
  misc_feature (1390)..(1390): n is a, c, g, or t
tttgttccctccacttcggcctcttcttcctcctccatccccatcctccatcggatgcactagtagctggccttgtaccctacctagcttagctacccacccatgtcctcctcctcgtctcctctcgctgtctgcctttgacttggagacctagctcgtcgatcgccggccatgcgggtgcagtgcgacgtctgcgccgccgagccggccgcggtgctctgctgcgccgacgaggccgcgctctgctccgcctgcgaccgccgcgtccaccgcgccaaccgcctcgccagcaagcaccgccgcctcccgctcgtccacccgtcctcctcctcctccggcgacggtggcgccgccgccgcgccgctgtgcgacgtgtgcagggagaagaggggcctcgtgttctgcgtcgaggaccgcgccatcctgtgcgccgactgcgacgagcccatccactccgccaacgacctcaccgccaagcacacccgcttcctcctcgtcggcgccaagctctcccccgccgcgctcgccgaacagccgctcccgtcctccgactgcagctccgacgacgacgccgccgccgccgccaccgaggaggagtaccactcctccgccgcatccaccggcgccgcagtgagcgcgcctcttgacgcctccagcaacggcgccggtggcggaggaggagtagggaggggagcagcatctccgactacctcaccaccatctgccccggctggcgcgtcgaggacctcctccccgacgacgacgccttcgccgccgccgccgcgcaggcggggaaagagaaggacgagcgcgtgccgttcctcgacgccgacctgttcgacgtggtcgcccgccggccggagaagaagggcggcgcgtgggcgccgcacgtgccgcacctgccggcgtggtgcctcgacgaggtgccggtcgtcgtcgccgcgtcggcggcgccagcggcgacacctgtaaaggcgaagcagggacacgtgcgggacagccactggagcgacagcgacgcgttcgccgtgccggagttctcgccgccgccgccgccggccaagagggcgcggcccagctcgcagttctggtgcttctgaacgccgccgccgccgtacaatctggccgccggcgagctcgacgaacacctcgatggatcgatcgaacacctgtgtaatcactcagctggtcactactacaagtagcaatcagcaagcttgatgtgccactgttactagctgctgctgtttaattagtgagtactaagctactactagttaattttggtgaaaactatgctactttgttactatataatgaagtatgtgtatcaaactaaactgagatgttggtaattaattatcgtattttgtaaaantnaaaaaanttnaaa

SEQ ID NO: 1638 - DNA, 427 bp, Oryza sativa
  Predicted polypeptide sequence is orthologous to G1482
ccgggaagcaccgccggttctcgctgctcaacccctcggcgtccggccgctcgccgacatcgacgacggcgccgctctgcgacatctgccaggagaagaggggtttcctgttctgcaaggaggaccgggcgatcctgtgccgcgagtgcgacgtgccggtgcacacggcagagcgagctcaccatgcgccacagccggtacctcctcaccgtgcgtgcggctctcctcggagcctgccgcgtccccggcgccgccgtcggaggaggagaacagcagcagcttctgctgcagcgccgacgacgccgtgccggccccggcggcgcccgccacgagccacggcgggagcagcggcagcagcagcatctccgagtacctcaccacgctgcccgggtggcacgtcgaggacttcctcgtcgacgacgccact

SEQ ID NO: 1639 - DNA, 700 bp, Zea mays
  Predicted polypeptide sequence is orthologous to G1482
  misc_feature (163)..(168): n is a, c, g, or t
  misc_feature (594)..(594): n is a, c, g, or t
  misc_feature (596)..(597): n is a, c, g, or t
  misc_feature (609)..(609): n is a, c, g, or t
  misc_feature (636)..(637): n is a, c, g, or t
  misc_feature (664)..(665): n is a, c, g, or t
  misc_feature (669)..(669): n is a, c, g, or t
  misc_feature (690)..(690): n is a, c, g, or t
gaattgttctctgtttcttttaagcggcaatgaagatccagtgtgatgtgtgtaacaaacacgaagcttctttattttgcaccgccgatgaagctgccttatgtgattcctgtgaccaccgtgtccaccatgctaacaagctcgcctacaaacaccaacgttnnnnnnttaatcacccttctgcagaacatttccctgtctgtgatgtttgcacggagagaaaggcttatgttttttgtcagcaagatagagcgattttgtgcaaagagtgtgacttgcctattcattctgcaaacgaacataccaagaagcataataagtttcttctaactgggattaagctctctgcttctgccaccctttattcatcactaccctcttctaattccaagtctgtgatgaaaaatcctgtgattgattcttcttcacaacaacctttgatggataagacttcttcttcaacagtatcagtgcctcccaccatcagcaaggctaatgaagaagctggtttcacaagtagcatatctgagtacttgataaatactatcccgggttggcaatttgaagatttgctcaattccccttctcttcctntnngtttctctaagnatggtgatgatatggtgtcactggtgnntggtgatgttgggggaaatatgttttnnttcncaccacccgagagcattggtnggatctggga

SEQ ID NO: 1640 - DNA, 1364 bp, Zea mays
  Predicted polypeptide sequence is orthologous to G1482
gaattcccgggtcgacccacgcgtccgcccacgcgtccggtcctctcctctgtctctctctctttgagcctcctttttcaacctaacctttgacgctgtagctcgagagcaagcatagtgcctagtgcctaccagattctctccctgagcggctgagctctgccgatccgcgataggctcgcgccatgcagatgctctgcgacgtctgcgccgccgcgccggccgccgtgatctgctgcgccgacgaggccgcgctctgctccgcctgcgaccgccgcgtccaccgcgccaacaagctcgcccacaagcaccgccgcatccccctcgcccagccctctggcgacgaatccgacgccgacgccaagccgctctgcgacgtgtgtaaggagcggaggggcctcgtgttctgcgtggaggaccgcgccatcctgtgccccgactgcgacgaccccatccacagcgccaacgacctcaccgccaagcacacccgcttcctcctcgtcggggccaagctctcagccgcgctcgtcgacgcccaggcgccccactcccctgacgacgacgacaacgactgcggccgcggcaacggcgccgccgccgagcccgacgctgtccccgccgtctgcgcgcagggctcctgcgcggccaaggcctcgtctcttgagtccggtggcggcggcggcggcggcagcggcagcggcagcagcatctccgagtacctcaccaacatctgcccaggctggcgcgtcgacgacctcctctttgacgactcggcgttctcagcggcatcgaaggccgacagctgcgacgacgggcacgagcaggtgccgtccctggacgccgacctcttcgacgtggtggctggcgccggctggccggggaagcgcggcagcgcgtggtcaggagtcggagctctgggcttcgacaaggtgccggcctccgttgttgtcgtcccgacggcggccaagcaacagcaggggtgcgtgagggagaggacctgggactcggacagcgacagcgacgtgttcgcggtgccggagctcccgcaaccaccgcaggccaagaaggcgcggccggcgccggctccggcgccgactttctggtgcttctgagctgcactgtcccagtccggtccggccggcctgtgtgcactgtgtacttgccgtgacttctgtaaccagtgtgtgtgagcgagcttgctcgtgctttttacccatgtactgttgttactgcatacacacacacacttaccactactattagtagctagcagtgctcaaacccaagttaattaagtttggcgcagtttatattatgacttaatcataaggtgattttgcggcggccggtcgagatcttgaact

SEQ ID NO: 1641 - DNA, 779 bp, Zea mays
  Predicted polypeptide sequence is orthologous to G1482
ctcgaggccggcccggcccgccatgtcctctcctctgttcctctccagcccccttttcaacctttgacgctgtagcttgagagcgagattagtgcctaccatattctcctcctgagcgactgagcgctggtctccgataggctcgccatgcaggtgctctgcgacgtctgcggcggcgcgccggccgccgtgctctgctgcactgacgaggccgcgctctgctccgcctgcgaccgccgcgtctaccgcgccgacaagcgccgccgcatcccgctcgtccagccctgcggcgacgactccgccgccgccgccgccgcgccgctctgcgacgtctgcaaggagcggaggggcctcgtgttctgcgtggaggaccgcgccatcctgtgccccgactgcgacgaccccatccacagcgccaacgacctcaccgccaagcacacccgcttcctcctcgtcggggccaagctctccgccgcgctcgtcgaccaggcgcccccctcccctgacgacgacgacgacgacgtcgccgagcccgacgctgtccccgccgcctgcgcggccaaggcctcgtctcttgagtccggcggcggcagcagcatctccgactacctcaccaacatctgcccgggctggcgcgtcgacgatcttctcttggacgactcgtcgttctcagcgccatctaagaccggctacagcgacggccacgatcaggtgccgtccgtggatgccgacctcttccacgtggtggccagcggccggccaggcaagcgcgtcggcgg

SEQ ID NO: 1642 - DNA, 1627 bp, Zea mays
  Predicted polypeptide sequence is orthologous to G1482
cgggatggtctacaaccgtatgcgtactttatcagttaactgcccatgatctagcagtggtccaatgtttgtcctagactcctagggggaaaaaagatctgcactttgtgctgtgctgtttcttcttcttgttgttgttgtacgtagcgccgagatttcccagcaccgcttgcgatttagaaacccacagtttgttctttttcgtttaggggatggctgtacactgctgctgcttcttactaatgatagaaaggagaggtgaagttcgcagttgctgagatagacagatgatagaaggcaacgctagctaccgcgagggggaggaagatgagcaatcgggaaagcacggcatcaagcaagttgttgccttgtagttgtaggagtgtccttattgcgactttgtcaccctggtgacctgagcgctcccacgcggccatgtctgatgaattacggcggcccattcgctcccatcagcaaacacccacgaatggccaatcgttgcccagcagcagcgggcttcagtattcgtcaaccaaattgtcagagagagtccttttgcgccccccggggcgcatactacagaggaggttgagcggagtaggcggcggccagcaatgaaggtacagtgcgacgtgtgcacggccgaggcggcctccgtcttctgctgcgccgacgaggccgcgctgtgcgacgcatgcgaccgccgtgtccaccgcgccaacaagctcgcggggaagcaccgccgcttctccctcctgcacccgtgttcttcctcttcctcctccgccgcgcacaagccgccgctctgcgacatctgccaggagcggaggggcttcttgttctgcaaggaggacagggcgatcctgtgccgggagtgcgacgcgccggtgcacagcgccagcgacatgacgaggcggcacagccggttcctgctcaccggcgtgcgcctctcgtcagcgccggtggactctgcgggcccatccgaagaggaggagcaggagaacagccgcggcccctgcaacgacgaatcctgcagcagcggcagcggcgccggcggcgcgaccacggcgaccgccagcgacgggagcagcatctccgagtacctgaccaagacgctgcccgggtggcacgtcgaggacttcctcattgacgacgcgtccgctggcgacgtcggcgcctgctcggatggcctctatcagggacaaaatggacagatcagtggggtgctgcaagaagcttacctgccgtggacggagcgggagcaggtgcaaactgacgtcgcagacgagcgggccagctgggagcggtgggtgccacagatgcatgcggagttcggcggcggcggcaagcgacctagagcgtcgccttcgcctccctgttcgtactggtgattggtgaaaagttcgccgtcttcagcaagatgatttgtattgggctaattagtagagctactgtaggaacgaccgaaaaatgagccaaaaaagtaacggcctccatcgagctcgttttaaattattctctgcctaaagccaaactttcagaaaggagaacggtattttcctgttcgattaattaggtcgatttcgatcgaactcgttccaaaaaaaaaaaaaaaaagggcggccgc

SEQ ID NO: 1643 - DNA, 835 bp, Zea mays
  Predicted polypeptide sequence is orthologous to G1482
ggtctagctaggactagtaagtagcataccattaccatcctccgcgcggctagctccggctcgctttcatccatacgattgcccggagctcaagccctgagctgagccgccagagcgcgcgcgatcatcgcttgagggaaaagcagagtggagtggccgagatgaaggtgcagtgcgacgtgtgcgcggccgaggcggccgaggtgttctgctgcgccgacgaggcggcgctgtgcgacgcgtgcgtaccgccgcgtgcaccgcgccaacaagctcgccggcaagcaccgccgcttctcgctgctcagcccggcgccaccgccgccgccgccgctctgcgacatctgccaggttcactcgatcatccatcccccgatccccgtgcaaaataaatctcttcggacggcgttctttccgattgttcagcctgccaggtgtgccctgcctgcctctgatcgatatgcatgcaggacaagcgggggctcctgttctgcaaggaggaccgcgccatcctgtgccgcgactgcgacgtgtcggtgcacacggccagcgacctgaccatgcgccacgcccggttcctgctcacgggcgtccgcctctccgccgagcccgccgccgcgtgcccggcgccggaggatgaggaggaggaggacgacgagaacagcagcggcagcttctgctgcagcgccggcgacgcagccgcacatcctcctcctcttccgtcgtcggcgcccgccaccagccacgggagcgacagcagcagcatctccgagtacctcaccaagacgctgcccgggtggcacgtcgaggacttcctggtggacgaggcggccgc

SEQ ID NO: 1644 - DNA, 727 bp, Zea mays
  Predicted polypeptide sequence is orthologous to G1482
  misc_feature (477)..(477): n is a, c, g, or t
  misc_feature (481)..(481): n is a, c, g, or t
  misc_feature (490)..(490): n is a, c, g, or t
  misc_feature (492)..(492): n is a, c, g, or t
  misc_feature (499)..(499): n is a, c, g, or t
  misc_feature (587)..(587): n is a, c, g, or t
  misc_feature (642)..(642): n is a, c, g, or t
  misc_feature (644)..(644): n is a, c, g, or t
  misc_feature (708)..(708): n is a, c, g, or t
ccggccgggctttcctgctaagccccggctagctaggaagtatcactagtagcatcccccatcatccagcctcgcggtcgctacagttagcttcgctttcctccagcccatccttctatacacgattgacctgagctgagccgcctcccgtctcgagagggagggagagggagagggagagcgagagctagcgcgcgcgatcgcaaagagagcggtgaaagatgaaggtgcagtgcgacgtgtgcgcggccgaggcggcgtctgtcttctgctgcgccgacgaggccgcgctgtgcgaggcgtgcgaccgccgcgtgcaccgcgccaacaagctcgccggcaagcaccgccggctctcgctgctcggcccggcggcgccgtcctcgtcggcgcacagacacccgccgccgcctccgctctgcgacatctgccaggagaagcgcgggctcctgttctgcaaggaggaccgggcgatcntgtnccgcgactncnacgtgcnggtgcacacggccagcgagctggcaatgcgccacacccggttcctgctcacgggcgtgcgcctctccgcagagcccgccgcgcgcccnccgccgtcggaggaggacgagaacgacagcagcagcagcagcatctccgagtacntnaccaagacgctgcccgggtggcatgtcgaggacttcctggtggacgagaccgccgccgcaactnccattggcgtctccgcaga

SEQ ID NO: 1645 - protein, 250 aa, Oryza sativa
  Orthologous to G1482
MKVQCDVCAAEAASVFCCADEAALCDACDRRVHSANKLAGKHRRFSLLQPLASSSSAQKPPLCDICQEKRGFLFCKEDRAILCRECDVTVHTTSELTRRHGRFLLTGVRLSSAPMDSPAPSEEEEEEAGEDYSCSPSSVAGTAAGSASDGSSISEYLTKTLPGWHVEDFLVDEATAASSSSDGLFQGGLLAQIGGVPDGYAAWAGREQLHSGVAVAADERASRERWVPQMNAEWGAGSKRPRASPPCLYW

SEQ ID NO: 1646 - protein, 337 aa, Oryza sativa
  Orthologous to G1482
MRVQCDVCAAEPAAVLCCADEAALCSACDRRVHRANRLASKHRRLPLVHPSSSSSGDGGAAAAPLCDVCREKRGLVFCVEDRAILCADCDEPIHSANDLTAKHTRFLLVGAKLSPAALAEQPLPSSDCSSDDDAAAAATEEEYHSSAASTGAAVSAPLDASSNGAGGGGGVGGSSISDYLTTICPGWRVEDLLPDDDAFAAAAAVSTTNPSLRRVLATSPSMKPRLTYDSLEQQAGKEKDERVPFLDADLFDVVAGRPEKKGGAWAPHVPHLPAWCLDEVPVVVAASAAPAATPVKAKQGHVRDSHWSDSDAFAVPEFSPPPPPAKRARPSSQFWCF

SEQ ID NO: 1647 - DNA, 1129 bp, Glycine max
  Predicted polypeptide sequence is orthologous to G1488
acggctgcgagaagacgacagaagggggagttggaataccaattttggcgctctctctgtatttctcttccttctctttcatttcccctctcttgttggttcaaaattatactctctctaagttttaaccttatgaatatggatatgtgccaaaatgtatcagtttccggtgagtgccaacaagtgcaggtttttgccccttcttgctcaagcagccttgatgacctcttctctgctcagaacacggaagtggatgttgagttggagtggctttcagagtttgttgaagactgtttttcaagccctccaagctgtgtcttggtacctattggtgtcaagactacaagcacaagcaccaacctttcttcaggcacattgaagagaccccaacaacaaaatgagtcacctttgcaaaactttgctgtgccagggaaggcaaggagcaaaaggaagaggctttcagccccaagaaccaacaaagaccctctaaacatatggtcacaccatttgaatcctcaaaatgagtccttgtgttctgaccctcctcttctcaaacaggcttattggttagctgacagtgagctcatcatgccaaagccaaaggatgaggagcaagaagaggtggtgaccaaagaggatgaaaaagtgattaatgtgatgagcaaggaaagctttggggactctgagcttgaggagggtagcaatggtcaacaaccaatgccaacaaggaggtgcagccattgcttggctcagaggaccccgcagtggagggcaggaccattaggtccaaagacactatgcaatgcatgtggagtgaggtacaagtctggtaggttgctaccagagtataggccagccaagagtcctacttttgttagctacttgcactccaattcccacaagaaagtcatggagatgaggatggctgttttctccaccatttctagtgagcagtagtagtggttgttacttattagaggtatatttctatgtaaaaaaaaaaaatcaaacttcaaattttaggaacaaaaaactatttggcaaacagagagatactgttaaggggagagtgcttaatgctatgattgattataggcacatttatttatatgacttattatccagtttc

SEQ ID NO: 1648 - DNA, 1230 bp, Glycine max
  Predicted polypeptide sequence is orthologous to G1488
ggaaaaccacaactttgtcacactttgtgtctccaactccctatactttctcgcttcaccctccccggtaacgttttcgcttcagcccacaacgagccatggaagcacaagagtttttccagaacaccttctgtccccaattcccctcagacagcaacatcactccctccaacgccaacccctccgccgccaccaccgaccacttcctcgtagaagacttcttcgacttctccaacgacgacgacgccaccttcgactccctccccaccgacgtcgactcccccaccgttacccctgtcgacaccaccaccaactccaatttccccgcctccgcagacgcccatttccccggtgacctctccgtcccgtatgatgatcttgcggaattggaatggctgtcgaaatttgcggacgaatcgttttcgagcgaggatttgcagaagctgcagctgataacgggtgtgagagcgcaaaacgatgctgcatcgtctgaaacgcgtgacccaaacccggttatgttcaacccgcaagtgtcggttcggggcaaggctcggagcaagcggacacgtggacccccatgcaactggacctctcgcctcgttgtgctctccccgaacacgaagtcgtcgtcgtcttctcactccggcgcggaaggcggcagcgaggggcggaagtgcctgcattgcgcaacggacaagaccccacagtggcggactgggcccatgggcccaaaaacgctctgcaacgcgtgcggcgtgaggtacaagtctgggcggctggtgccagagtacaggcccgccgcgagcccaacgtttgttctgacgaagcactcgaattcgcaccgcaaggtgctggagctgcggcggcagaaggaaatggtgaaggtccagcaccagcagcatcagtttctccaattgcagcatcagcagaacatgatgttcgatgtcccatcatccaacggtgaggatttcctcatccatcagcacgtgggcccaaatttcacgcacctcatctagagtaggaaacttccgctacttaatttgtagttagctcagttatttcttctcttctcttttcttttcttgcctaattttgttaggaatttgtttaatttctttttcagtttatgctatatgtagactggtctcatgtttctttcttcaagtcattttgaccgacttgaaaacccacaaactctaaattttcctaatgcattattcttttcttttc

SEQ ID NO: 1649 - DNA, 567 bp, Glycine max
  Predicted polypeptide sequence is orthologous to G1488
ccacgcgcctgctccacctggtcgcgccggagaaggagaagccgccgcaggcgaagaaagagagagggaacgaatgtggagtgttccggacgcaaatgccttcactgcggcgcggagaagacgccgcagtggcgaacgggaccgatgggaccgaaaactctatgcaacgcgtgcggcgtgaggttcaagtccgggaggctggtgccggaataccggccggcggcgagtccaacgttcatgtcaacgaagcattcgaattcgcatcggaaggttttggagctcaggcggcagaaggagatgcaacgacagcagcatcatcagcagttgatgagtcaaagttcaattttcggcgtatccaacggtggagatgaattctcgatccatcatcatcatcataatcatcacctccattgtgggccagactttagacacgttatttagactacctagtttttaaattttcattttaattttaatttagggtgcaggtctaagtttaaactatcgtcagcttcagcacttcttttttcttatctgaaaaattttgtcttatgaatttgaattctt

SEQ ID NO: 1650 - DNA, 1022 bp, Oryza sativa
  Predicted polypeptide sequence is orthologous to G1488
  misc_feature (642)..(643): n is a, c, g, or t
  misc_feature (724)..(724): n is a, c, g, or t
  misc_feature (728)..(728): n is a, c, g, or t
  misc_feature (777)..(778): n is a, c, g, or t
  misc_feature (780)..(780): n is a, c, g, or t
  misc_feature (782)..(782): n is a, c, g, or t
  misc_feature (785)..(790): n is a, c, g, or t
  misc_feature (792)..(792): n is a, c, g, or t
  misc_feature (794)..(810): n is a, c, g, or t
gtcgggcaccgcggcgccggcattcccggccaagaaggcggcgaagtccgccaagaagaaggacgggccgtcccccgcgccggcgccgaacgcggccgcgcaggcggcggcggaggggaggaggtgcctccactgcgagacggacaagacgccgcagtggaggacggggcccatgggtcccaagacgctgtgcaacgcgtgcggggtgcggtacaagtccgggcggctcgtgccggagtaccggccggcggcgagcccgacgttcgtggtgtccaagcactccaactcccaccgcaaggtggtggagctgcggcgccagaaggagatgcagctcctgcaccaccaccagcagccgccgccgcacgtgggcgcgggcggcggcggcgccgccggagggctgctccacgtgacgagcccgctgctgttcgacgggccgacgtcgtcggcgccgctcttcgccggcgcggacgaattcctgatccataaccgcataagcccggactaccggcgccaggctacctaggaaactattcattagcccaggaataattcagcgataaaaacagctaatttttttttgtcctgcaaaccgcattttgggtactctttatttctcagcttcttaagtttcttttttctttnnttgagaattttagtgtttttcccccttagaagcagactctgaggagtttctttcgtagcacatttttttttcttttgattnttgnatgcaggactcttagaagaagaggaacaggagcagttttcattgtttcnncnanaannnnnntntnnnnnnnnnnnnnnnnnctcttgaggggggcccggacccaattcgccctttatgagtgtttaccgccctacatggccgtgttttacacgtgggaatggaaaacctgcgttcccactaatggcttgagaaaatcccttttcagatggtaattacaaaggccgaccatgcctttccaaatgccccctaattggatggaacccctttacgcctttaaacgggggggttgtct

SEQ ID NO: 1651 - DNA, 1897 bp, Oryza sativa
  Predicted polypeptide sequence is orthologous to G1488
ctagtggatccccgggctgcaggtgtcgtttgcagtgtgatgagctggacatggacattgcgcagctggagtggctgtcggggctgttcgacgatgaaccatcccgcacgagccgagttttccgggcgtcaactgcgcggcgccgatcaaggcgtcggcgctgacggcgaacgccggcgtcgtgctgccggacaaggcggaggaggcgctgttccgcagctccagccccatctccgtgctggagcacagcggcttcaacgtggcaaccaatgggggctcctcctcgtcgtcctcctcgtcggcgtcctcctcgtcggagtcgttctccggcagcggccgcgcgtggtccgcgcccgtgtcgccgcgcccggagccgcccgtgctcgtcatcccggcgcgcgcgcgcagcaaacggtctaggccgtccgcgttcccggctgtccgcggcgcgccggcggcgacggagaccaccatcctggtgccgacgccaatgtactcgtccacctcgtcgcactcggatcccgagagcattgccgagtccaacccgcacccgccgccgatgaagaagaagaagaaggccaagaagccggccgctccggccgccgcctctgacgccgaggccgacgccgacgcggcggacgccgactacgaggaaggcggcgcgctcgcgctcccgccgggcaccgtgcggcggtgcacgcattgccagatcgagaagacgccgcagtggcgcgcgggcccgctcggccccaagacgctctgcaacgcgtgcggcgtccgctacaagtccggccgcctcttcccggagtaccgcccggcggcgagccccaccttcatgccgtccatccattccaactcccacaagaaggtggtggagatgcgccagaaggcaacccggaccgccgacccgtcctgcgacctcctgcagtacatccgccgccgggattaatctcccggcggcggcggcggcgtcgtcggaggacggttggtcgtcggtctcagtcccccttagctatatatgtatacatgttagtatgtatgcatgcatgcttgcttcagtcgtcagtgcgtcgtcttcctcgtcatcaccatcaccatggacatggacatggacagcagtgtgatcatcagcagcattgccctcctgaagccatcatccatcatcgatcaccgcccgctctgcggcggctgccatcggcaccagcatcagcatcatcatcaatccatggatcgatcgccggggtcatactggcgttagtgcagctagggcttttcttggggttttatttttttcctttttgtctattgattaattggttccccttaaaaagatgattttttggttttgtatagaggtgggtgagagagagagaggaggaggccacgcagaaaatagatgaatcaccgtggttgttgcattgcagatttgcagttgcttgcaaaattaggtaggtgagaaggagagctaaaccagcagcagagggagacagatttagagaggaaaactttgcagctagtcagtcagtcaattaggaggaggaaaatgagatgtgttttttttaaggggggtgatgaggaggtggagtttgttggtttgctaattagaagtttcttcttgctagtagctactcaggggggacatccatcatagtttatattggagcttgatgtactgaactccgaaaaattctttttgcagttcatctatgtctagggattgataagtgttatttggtttctatactagccattactttgtagccattaattatatatctctatatgccttttttctgtttctcctgccttgttggttggtggtgcctccctctgtacaagttgtgatcatccaatttgaggagatatattcctttatgctctgaaaaaaaaaaaaaaa

SEQ ID NO: 1652 - DNA, 487 bp, Zea mays
  Predicted polypeptide sequence is orthologous to G1488
ctctgaacggggtgagtacccccgccgcctccgaggacggtacccgcggtggcgccgtcgttagcgccagcggtgtacctcgtcaagaagaagaaaaatcggtttcggcgaggaagccgtggcggcccccgaagtcggcgaagcagtgcttgcactgcgggtcgtcgtggacgccgcagtggcgggaagggccgttgggccgcagcacgctgtgcaacgcgtgcggtgtgcggtacaggcagggtcggttgctgccggagtaccggccgctggcgagccccaccttcgagccgtaggagcacgccaacaagcacagtcaggtgatgcagtttcaccggtagtggaagagccagggtcagtaccaccctgtgtccgtggagcatacgtgagccatggacgtgcttcagttttcccagcggtggcaggtgaaggaggagtaccttgtgagggcgattcaccagactttgccgtatccggtggtggacgg

SEQ ID NO: 1653 - DNA, 792 bp, Zea mays
  Predicted polypeptide sequence is orthologous to G1488
  misc_feature (714)..(714): n is a, c, g, or t
ctctcgcccctcgcgttatctccgctcccctcgcgcagcccacgtacaaaacgaaacaaaaaagcgccgagtaacgcactgccccgccgcagatagagaattgcggtgcctaccgctctcgcggcggccatggaggcgacggtgcccgactactacggccgcgacaagaagggctccgacctcttcgtcgtcgacgacctcctcgcgctgccgtgcgacgacgacgaggaggaggaggaaggggttggcgaggcgccgttcctgccggccaactccgcctccgccgccgccatcgtcgtcaagcaggaggccgggttcgggaacgcgtcggccgactcgtccacggtcacggccctcgacagctgcagcaactccttctccggcctcgccgatggcgacttctccggcggcctctgcgagccgtacgatcagctggcggagctggaatggctgtccaactacatgggcgagggcgaggagagcttcgccaccgaggacctacacaagctgcagctcatctccggcatcccctccgggggcttcccctcggcgaacggaccacctgctccggcggccaccgctgccacggcgcagcccggcatgttcctgccggagggccccgtccccgccaaggcccgtagcaagcgctcccgcgttgcgccgggcaactggtcgtcccgcctgctcgttctcccgccggcccgggcctcccgncgtcccccggcgtcatggccatctcgccggcagagtccggcgtctcagcccaggcattccatgtcaagaagccctcca

SEQ ID NO: 1654 - DNA, 615 bp, Zea mays
  Predicted polypeptide sequence is orthologous to G1488
  misc_feature (65)..(65): n is a, c, g, or t
gggcatgaggctcaagccagagcccaggttgtcagccgagcagcagtgcggccaggaagaacccnccaggaaggagcaagagccagacaggaagaggaagaaggcggccaagaagacgtgctacgagagcagcgacgcccccccgtcgtcgggccagcaagagaagcggtgcgccccctgcctgtcctccaagaccccccagtggagggcggggcctctggggcccaagaccctgtgcaacgcctgcggcgtcaggttcaagtccggcaggctgctgcccgagtaccggcccgccaacagccccccctttgtgagctgcttgccctccaactcccccaagaaggtcatgcagatgcggcaggccgtcgcgcagcagcagtgaggccccgatggccggccggccggccgagaacgtctcccgaaatctatcgttggaagcgcgttaggggatctcttagaccgtagcttagtcgatgctcagagaggatgagaacagagactttggttatagtagtagtaggccatcgtcgttagctctagcggtgttctagctcagactgatttgctcggtgtttttagacgtcggattccatacattctcgatgttgtcctggt

SEQ ID NO: 1655 - protein, 386 aa, Oryza sativa
  Orthologous to G1488
MEVAAADYAGGVRVKKEAGGCGGSGDMFLVDDLLDLPCDEEEEETGLCGAYGGGGAGLGAGVVGGGGDDRAAGNASADSSTVTAVDSCSNSFSGLADGDFSGGLCEPYEQLAELEWVSTYMGEETLPTEDLRKLQLISGIPAAPRAPPALAVSAVQLPAGGAGALPTEAPVPGKARSKRSRVAPCSWSSRLMVLPPPPASPPSPASAVISPSESGTAAPAFPAKKAAKSAKKKDGPSPAPAPNAAAQAAAEGRRCLHCETDKTPQWRTGPMGPKTLCNACGVRYKSGRLVPEYRPAASPTFVVSKHSNSHRKVVELRRQKEMQLLHHHQQPPPHVGAGGGGAAGGLLHVTSPLLFDGPTSSAPLFAGADEFLIHNRISPDYRRQAT

SEQ ID NO: 1656 - protein, 271 aa, Oryza sativa
  Orthologous to G1488
MRKPTPYVSLHDVVAFDFVDGDVPFDDLVDGEGLCCPDDPFEEVMRCLSAVDDPFLAAFKLDCSPPTPAADADVDSRSEEHMHADVGGGLDLQRAVGGGDEKAGTPSTVDDVPWLQASAVARKPRRAPAAVRKRVWSLVSPQLATAAAAAVDNSRDEVSSGGGGGGEGGEHCSRPAKRRRKCGEEKRCGHCQTTETPQWRVGPDGPSTLCNACGIRYRIDHLLPEYRPSTSPGFGSDGYSNRHRKVVKLREKKRKKAMLAATATALTSGPV

SEQ ID NO: 1657 - protein, 387 aa, Oryza sativa
  Orthologous to G1488
MEVTAEFGGAYYGGAAGREKKALQQGCGDHFAVDDLLVLPYGEEDETTREGEATGGKEEAAGFGNASADSSTITALDSCSNSFGLADGDFPGELCEPYDQLAELEWLSNYMNEGDDAFATEDLQKLQLISGIPSGGFSTASVPSAQAQAASAAASMAVQPGGFLPEAPVPAKARSKRSRAAPGNWSSRLLVLPPPPASPPSPASMAISPAESGVSAHAFPIKKPSKPAKKKDAPAPPAQAQLSSVPVHSGGSAPAAAAGEGRRCLHCETDKTPQWRTGPMGPKTLCNACGVRYKSGRLVPEYRPAASPTFMVSKHSNSHRKVLELRRQKEMHQQTPHHHQPQVAAAGGVGSLMHMQSSMLFDGVSPVVSGDDFLIHHHLRTDFRPPI

SEQ ID NO: 1658 - protein, 303 aa, Oryza sativa
  Orthologous to G1499
MTHNSSSSSSWDLDMSLGSHHHPLLFDQPPPPPPPPPPPPLPFHLHHHPLDPSPSSSLFPPPPHHHHHAHHLHHPLDLDQRRGHHDYGGGDQGGDEELRLQQEAAAGGGGGGQDGGGGGDQDADEELGAMKEMMYRIAAMQPVDIDPATIKKPRRRNVRISDDPQSVAARHRRERISERIRILQRLVPGGTKMDTASMLDEAIRYIKFLKRQVQELQHQPGPPPPPYPAGAAPAAGPSTSAVGPPGRPFLPLGGGGPMIDWVGLTRPVDIHGPTSSSSSSSMGGALGFGFGCGGGGQSSHGMH

SEQ ID NO: 1659 - DNA, 360 bp, Brassica rapa subsp. pekinensis
  Predicted polypeptide sequence is orthologous to G1499
cactactcttttctccggagatcaagaagaggatgaagacgaagaagagcctgtagaggaactaagtgctatgaaagaaatgatgtacaaaatcgcagccatgcagcccgtcgacatcgatccagcaaccgtcaagaaacccaaacgccgtaacgttagaatctccgacgaccctcagagcgtggcagcgagacaccgtcgtgagagaatcagcgagaggatcagaatcctccagagactcgtgccgggtggcaccaagatggatacagcttcaatgctcgacgaagcaatacgctacgtcaagttcttgaaacggcagatccggcttctcaataatcctcctccgcgcaagatcaagct

SEQ ID NO: 1660 - DNA, 1501 bp, Glycine max
  Predicted polypeptide sequence is orthologous to G1519
ccacgcgtccgaaaaaccgaataccccgggcggcccgcgcgccccggaaggcatggctcagattccgttgacggcgcggtggccggtcctagcacctccgccaccgaaccacggcggttccctctcgcagctcagccggaaatgatgcgcgccgccgagaaggacgatcaatacgcctccttcgtttacgaagcctgtcgcgacgcatttcgccacctctttggtaccagagttgcggtggcttaccaaaacgagacgaaacttttagggcagatgctttactatgttctcactactggctcgggacagcaaaccctgggagaggagtactgcgacatcactcaggttgcaggaccttatggacttcctcctacccctgcgaggcgtgctcttttcgttgtatatcagactgctattccttatattgcagaacgaattagttctagaattgcttcgcgaggcattgtccttgctgactatgagtctgctgagggttttggtgaaaatgcccacaggagccatagtgctcagatttctggcaccagtccttcatcctcgtctggccaatctgttactactctgtcaaggttgaaggggaaaatgagtgcattttggttgcatttggttcagagatggcctacgatgctcccttttgtccgtgagttgttgcagttggttctccgtgctaacctcatgctattctactttgaaggtctctattatcatatatccaaacgtgcggcaggcattcgttatgtatttattggaaaagcatcaaatcaaaggcccagataccaaatactgggagtatttttgttgattcaactttgtataatagctgctgaagggctgcgtcgaagaaatttaacttcaattactggttcagttcatcaagcatccttcgcaacccacgatagatcagcaggacatggtttgcctgttttaaatgaagagggtaatttggcaactccagatattgacaaaagaagctgggtctctgaatcttcatcttctgagtatcatgcaaccagtggggttagcaaatgcacactttgcctgagtaatcgtcagcacccaactgctacttcatgtggccatgtattctgctggaactgtatcacggaatggtgcaacgaaaagccagagtgccctctttgtcgcacgcccataacacactcgagtctagtttgtgtatatcattcggacttctagagtctgctcctctttacgtacatatatagaagatagcattaaaggcagcattttcctcatcttggatcttacaaggactgtatgaacatttaagcaattcaattttgtattaggatttcaataatcaatctgattacactattaggtccgtgtttcatctcttttattatgcaataatgatttttttttttttttggaaaaagataaccattatagcacaacactggatggtgattctgcattaattatttctctccagtgggtggtgctaatgaggtttatgccagta

SEQ ID NO: 1661 - DNA, 834 bp, Oryza sativa
  Predicted polypeptide sequence is orthologous to G1519
attgggaagccattgaatcagaggcccattatcaaatcttgggtatttttctgtgtagttcaggtatgtattcttggtgctgaaagacttccaagaagtaatttatcaacaatagctagttcgattaaccaaatctcatctggaggctatccttcatcaagaggtcgaggtgtccctgttctaaatgaagatggaaatataatcagcgacatccgccatgggaaaactgcagatttggctactagttcagaggcatccaggggtaagagcaaatgcaccctttgtctcagttcccgtcagaatcccactgccacaacctgtggccatgtcttctgctggagttgcattatggagtggtgtaatgagaagcctgaatgccccctatgcagaactccgattacacattcgagtttgatttgtatatatcattcagatttctagcaaatgattactagcaaggggtcatatcattctccagtggattcattaaaatgatactgaatccccacattttggcgagaactcttcttctgaagtgttttagtgtaccaaaagaggagagtagaaaccatccaatgaggctgaagatcaatgctgccattcaactgtattgtagagctcaaataacaaaacaatcaaacagaacaaaattttcattagagctcaaacggatacccatgtatatgtacattgtagacacaacttgattttgtagggtagaacagtggctgactggaatcattagagcaaaatgtatcgacctgaaattctgccgggaaatttaactatttgccaatattagattcgacaattattcaaaaaaaaaaaaaaaaa

SEQ ID NO: 1662 - DNA, 337 bp, Zea mays
  Predicted polypeptide sequence is orthologous to G1519
gtcctagtaatgttaaaccaggtcggagcatccatcttgtaaatgaaggtggaaatatagtcagtatcatccgcagtggtaaagctgcagatatagcttctcattcagagacctccaatggcaagagcaaatgcaccttgtgtctcagcatccggcaaaatcctactgccacaacctgtggacatgttttctgctgtgcaggaactcaatatagtttggtcactatgaagccaagcagcagttcggacaaccaggtgatttgtcaagctctcttggaggctgcagctcactgtgcatgtgagaaaacaactggtttgagaagtttggttcctaaaac

SEQ ID NO: 1663 - DNA, 929 bp, Zea mays
  Predicted polypeptide sequence is orthologous to G1519
ccacgcgtccgtctaatgttcttctattttgaaggtctgtattatcatttgccaaagcgagcagctggtattcgctatgtattcattggcaagccaatgaatcagagacctaggtatcagatcttgggtatttttctgttgattcagttgtgtattcttggagctgaaagactccgaagaagtaatatatcgtcaatagctagttccattaatcaaatatcatctggaggctatccatcgactacaggtcggggcatccctgttctaaatgaagatggaaatatcatcagtgacatccgcagtggtaaagctgcagatatagcttctcattcagagacctccaatggcaagagcaaatgcaccctttgtctcagcatccggcaaaatcctactgccacaacctgtggacatgttttctgctggaattgcataatggagtggtgcaatgagaagcctgagtgccccctatgcagaactccgattacccattcgagtttgatttgtatatatcattcagatttctagcaaatcatttcgcacagtaggagtccatatcatacttcactggcgtcaaaatttccagaccatatttcggcaagaaaactgcatgccaaaatggtttcgtatacttaagtgggagaagagtacgagaccatttcaagaggttaaagatcagagagttgcatacgataatttgttgtaggttgaaagtttagattgaattagggaccacaggtagtagaaattatttattggcagttcggatagtagataacttgtattggacaccgatgtgaattttattggttagaacaatgtccgactcgaatcatcgagctatttagcaatatgttgtgtccattttcgtcgcacttataccagcttgtatgttttgactaagttaggtgcaggtatgttattataatttt

SEQ ID NO: 1664 - DNA, 510 bp, Lycopersicon esculentum
  Predicted polypeptide sequence is orthologous to G1519
gtctggcacataaacatttctgaaatagtgacttttggctccttgtcttctgaaagatcccagttggacattattggctgctcaaaatgttcttttcgtgcagatatcaaatactaggggtcttccttctaattcaattatgtattcttgctgctgaaggtctgagacgtagtagtttatcatcggtttcaacttctgctcaacaagcaccctttggaacctatcaaacttctgcaggccgaggtttaccagttttaaatgaggaaggcaatctaataactgcagaaactgagaagtatggattggttgctgaatccacatcaacctcagagtctcaaggaaacagtccaagcaaatgcacactttgcctaagcagccgccaacatccaacagccacaccttgtggtcatgtattttgctggtattgactcctgaaagtttctctttatagaaaacctaaaaaagagaggtaaatgtgaaagaagagggaaaagacataatgctcttacc

SEQ ID NO: 1665 - DNA, 428 bp, Glycine max
  Predicted polypeptide sequence is orthologous to G1526
cgtgttcttcataattatgcttcaatattggagttacttttacgtcttcggcaatgttgtgatcatccatttcttgtaatgagtcgaggtgatactcaagaatttgcggatctaaacaaactagccaagcgcttccttagaggaacctatactgcttcagaaggtgaagtaaaagatacaccttcacgggcttatgttcaagaagttgtggaagagctacgtaaaggggagcaaggagagtgtccaatatgtcttgaagtatttgaagatgcagtgttaacgccttgtgctcaccgcttatgccgggaatgcctcttgtcaagttggcgaaatgctacatctggcttatgtcctgtttgtaggaaaacaatcagcaggctggatcttatcactgcccctactgagaatcggtttcaggtggatattga

SEQ ID NO: 1666 - DNA, 723 bp, Oryza sativa
  Predicted polypeptide sequence is orthologous to G1526
  misc_feature (657)..(657): n is a, c, g, or t
  misc_feature (663)..(663): n is a, c, g, or t
  misc_feature (673)..(673): n is a, c, g, or t
gccagttctagatgcacgtgctaacataggtcggcgcgcccgcccgtattacaagatttttcaagcatttggccttgtgaggaaggttgagaaaggcataactcgatggtattatccatctatgcttgatgatttggcatttgattcggctgcacttggaattgcccttgaaaagccgctggatttggtgaggctttatttgtctagggcaaccttgatagtggtacctgctaacttaattgatcactggacaacacagatacagcggcatgtttcctcggacacacttaatgtttatgtatggggagatcacaagaaaccatctgctcacaaccttgcatgggactatgacattgtcataaccacatttagtagattaagtgcagaatggggtccaaagaagagaagtgttttaaagcagatccattggtttagggtaatattagatgaaggacacacattaggttccagtctcgccctcacaaacaaattgcagatggctgtttcattggttgcttctaatagatggattctaactggtacccctacgccaaacacaccaactagtcaagttgctcaccttcatcccatgcttaagtttcttcatgaggaagtttacggtcaaaactaccagtcatgggacactggaaatcatangccttntgaggcacanatggaaagacgacgcagtcgtctcctgcagctacttcagaggactatgat

SEQ ID NO: 1667 - DNA, 600 bp, Oryza sativa
  Predicted polypeptide sequence is orthologous to G1526
gcacgaggctcaatattatacatccttcctttctttcgataattataatttctggttttagcatatccattttattaactgaacaataaattataagattctggcagatgcaatgggactggggaagactattatgacaatagctcttcttcttgccgactctagcaaaggatgcgtcactactcagcattctactcacatatgtgaagaagctagtggactgggtgaattgccagttcagcctcatgatgatgtgaagaagctagctatccctttctcttttagtaagcttaggaaacctaaaaccccgcttattgcaggcggcaatctaattgtctgcccaatgacactacttggtcagtggaaggcagaaattgaagctcatgctacaccaggttctgtaagtatatatgttcattatgggcaaaacagaccaaaagaagcaaaccttattggtcagagtgatattgtcctgactacatatggtgttctgtcatcggaattttcaaacgagaattcaacagaaagtgggggtctgtactctatacattggtttagagttgtgctggatgaagcacacatgataaaatctcccaaaag

SEQ ID NO: 1668 - DNA, 2051 bp, Zea mays
  Predicted polypeptide sequence is orthologous to G1526
gagcttatctagtcggcggccgctcgcctcctgggccggcccggttagcaaacacaagaaacctaaggccccactttattggaggaagcaatctaattatctgtccaatgacactaattagtcagtggaaggcagagattgaagctcatactaagccaggcactgcgaatatatatgttcactatggacaaaacaggccaaaagatgcaagcatcattggtcagagtgatattgtcctgactacatatggtgttgtgtcatcagagttttcaatcgatggttcaacagaaaatggggctttgtactctgtacattggttcagagttgtgcttgacgaagcacacatgataaaatcttctaaaagtttgatatccctagctgcggctgctctgactgcagatcggcgctggtgtctcactggtacaccaattcagaacaatttggaggatttatacagccttttccggtttctgaaagttgaaccatggaggaactgggctttgtggaataaacttgtacagaaaccatatgaagaaggtgatgaaaggggcttaaagctactgcagtccattttgaagccaataatgctgagaaggactaaaaattgcacagacaaggagggcaggccaatccttaatttaccccctgcaaacattgaagtaaaatactgtgttttatctgaggctgagaaggatttctatgaagctctatttcgaagatctaaggtaaaatttgatcaatttgttgagcaaggaagggttctgcacaactatgcttcaattttggagttacttttgcgcctaaggcaatgctgtgatcatccattccttgttatgagtcgtggggatacaaaagagtatgcagacctaaacaagcttgcaaagcgttttctgcgtggtggtaatggtgctgttaatggtgattcttgcatcccctctagagcttatatcgaacaggttgtccaagaattgcaaaaggatgaaggggagtgccctatttgtcttgaagcctttgaggatgcagtattaactccctgtgctcatcgtttatgccgagagtgtctcttatctagttggcggagtgcgacagcaggcctttgtcctgtctgtagaatgtcaatgagcaagcaggaccttataactgctcctactgataaccgctttcaaatcgatgtcgaaaaaaattgggttgaatcttccaagatatctgctctcctgcaggagttggaagctcttcgcagttcaggcgccaagagtatcgtgtttagccagtggactgcttttttagatctgttgcaaattccactttctaggaataatttctcatttgctaggctggatgggacgttgaatcttcagcaaagggagaaagttataaaggagttctcagaggacaaaggcattttggttctgcttatgtctctgaaggctggaggtgttggaatcaatcttactgccgcttctaatgcatttgtcatggacccttggtggaatcctgctgtggaagaacaagctgtcatgcgcatccatcgaattggtcaaacgaagactgtttctatcagaagattcatcgtgaagggcactgtcgaagaacgaatggaggctgtgcaggctcgaaagcagcgaatgatttctggagctttgactgaccaagaagtccgcactgcacgtatagaagaactgaagatgcttttctcctgagactacaaaagggctgttgtgcatcggatggtcggcaattcggcatggctaaaacaagatggctggtagccagaatgttggaaggtaagacgagggtaggaaattgcacgcccaaatatcttggcgtttagctgctgttgtgcgcacgatttgtacatcatgaatggttaatggctgacaagagtccaagacgcttcattgagtgaaaatcgaaagcatcatctcaaaattgaatatttctgtttgggttttgtataagtagataaactgaacatttgcagtaatacgaaggcagctacctgctcgatcattaatttaacaataaataaatttggtaaggtggtcaagtat

SEQ ID NO: 1669 - DNA, 731 bp, Glycine max
  Predicted polypeptide sequence is orthologous to G1540
ctcttttttcacctatataccctctaatattctaattctctctcttgatccaacaaacaaacactaccattttgtttgttctgagtagtgatccatgatggaacctcaacaacaacaacaacaagcacaagggagccaacaacaacaacaaaacgaggatggtggcagtggaaaaggggggtttctgagcaggcaaagtagtacacggtggactccaacaaacgaccagataagaatattgaaggaactttactacaacaatggaattagatccccgagtgcagagcagattcagaggatctctgctaggctgaggcagtacggtaagattgaaggcaagaatgtcttttattggttccagaaccacaaagctcgagaaaggcagaagaaaaggttcacttctgatcataatcataataatgtccccatgcaaagacccccaactaatccttctgctgcttggaaacctgatctagctgatcccattcacaccaccaagtattgtaacatctcttctactgcagggatctcttcggcatcatcttctgttgagatggttactgtgggacagatggggaattatgggtatggttctgtgcccatggagaaaagttttagggactgctcgatatcagctgggggtagcagtggccatgttggattaataaaccacaaacttgggtgggttggtgtggacccatataatttctcaacctatgccaacttctttg

SEQ ID NO: 1670 - protein, 289 aa, Oryza sativa
  Orthologous to G1540
MDHMQQQQRQQVGGGGGEEVAGRGGVPVCRPSGTRWTPTTEQIKILRELYYSCGIRSPNSEQIQRIAAMLRQYGRIEGKNVFYWFQNHKARERQKKRLTTLDVTTTTAAAADADASHLAVLSLSPTAAGATAPSFPGFYVGNGGAVQTDQANVVNWDCTAMAAEKTFLQDYMGVSGGGGAAAAAPTPWAMTTTTREPETLPLFPVGGGGGDGAHRHAGHGGFPSNFQRWGSAAATTNTITVQQHLQQHNFYSSSSSQLHSQDGPAAGTSLELTLSSYYCSCSPYPAGSM

SEQ ID NO: 1671 - DNA, 1088 bp, Glycine max
  Predicted polypeptide sequence is orthologous to G1543
ccacgcgtccgccctttcattgttttctgtgtgttttctatggcggttttaccaagtagctcctcaagcttggaattgaccatatctgtacctggttttgcttcttcaccaacccttcttccctcatcatctgtgaaagaattggacataaatcaagtacctcttgaagaagattggatggcatcaaacatggaagatgaagaagaaagcagcaatggagaacctcctcgaaagaaactccgtctcacaaaggaacaatctcttctccttgaagaaagctttagacaaaaccacacgttgaacccaaagcagaaagagtctttggcaatgcaactgaagctgcgaccaaggcaagtggaggtgtggtttcagaaccgtagggccaggtatcctaataataataatgaataaagtggagtaggtgtttattatgcaggagcaagctgaagcagacagagatggagtgcgagtacctcaagaggtggttcggttccctcacagagcagaaccggaggctccagagggaagtggaggagctgcgagccattaaggtgggcccacccaccgtgatctcccctcactcctgcgaaccgctcccggcctccacactttccatgtgtccccgctgcgagcgtgtcacctccaccgccgacaaaccgccctccgccgcggccactttgtccgctaaagtgccgccaactcaatcccgccaaccctccgcggcctgttgaccctataactatagtccatcgcctactctgcacgccacctctactacctcatcatctaattaatcagaaacagggcacaaacttaactaaactttacaaaactaaaaagttagtgtgaatgaagatataatatgtgttagaaaaaataatgtttttttttttttttttactaaaagggcgttttcggatagggaaacttttgtagttagtagtagtactttcaatggtcaatgcgtatctgattattgggctttcatattgactttctcctttttcaaatatggatagaacttttatttaaaaaaaaaaaaaaaaaaaaaaaaaaaaaaaaaaaaaaaaaaaaaaaaaaaaaaaaag

SEQ ID NO: 1672 - DNA, 1181 bp, Oryza sativa
  Predicted polypeptide sequence is orthologous to G1543
tctccctccgcctttgccccgccttccctgcccttttctcttgctgagccgcttctgcattggcttgtgatgatgggggccacttctccgtcaggcctggagctcaccatggctgtccccggcctcagctcctctggttcagaaggggccggttgcaacaacaacaacgccggtggcggctgcaacatgagggacctggacatcaaccagccggcgagcggcggcgaggaggaggagttcccgatgggcagcgtggaggaggacgaggaggagaggggcgtcggtgggccccaccgccccaagaagctccgcctctccaaggagcagtcccgcctcctcgaggagagcttccgcctcaaccataccctcacgccgaagcaaaaggaggccttggcgatcaaaacttgaagcttgcggccgaaggcaaggtgggaggtctggtttcaagaaccgtagggcaagggcgaagctgcccccgtcggtgatggagtgcgagtacctgaagcgctgcttcgggtcgctgacggaggagaaccgccggctgcagcgggaggtggaggagctgcgggcgatgcgggtggccccgcccacggtgctctcgccgcacaccaggcagccgctcccggcgtccgcgctcaccatgtgcccccgctgcgagcgcatcaccgccgccaccggcccgcctgccgtgcgcccgccgccgtcgtcagccgccgccgccgccccctcgcccttccaccctcgccgcccctctgcggccttctaggcccaaggtctcgcatcctaaaggccacaaaaagatgggcctcgccgtcccgtgtaaattgaaggagacgacgcagcggtagagggccccgtgtcggcgttgttgcgtcgggtccagtcgtctcagaggagtcagaggcgtggacaaaatgtttgttgcggtgtttgtgttccattggtcgttgatcttagcttgatgatctgtgattcgcgccttgctcgtctaggtttctcttgggccgacgcatgatcttttttcccccgtgtcggaccttattgggccttttgagatcgacgggccccctccttgtttcgcatgtggacatgttatttcgtccttttgggccaacaattcagcacggtggccaacggtgcgtagttcgtcgccgttttctttcaaaaaaaaaaaaaaaaaa

SEQ ID NO: 1673 - DNA, 1271 bp, Zea mays
  Predicted polypeptide sequence is orthologous to G1543
  misc_feature (807)..(807): n is a, c, g, or t
cctcgaggccggccgggcccctcttctcctctagcttctccttctctctccttcctggacattctctctctctcctctctctctaccatactcagacgagcagaagcagctagggacaccataggcaaactacttcagcaagaaattaaactatctcctacgcaagatcagaagaaactgtgtatggagcaagaagaggttggcctcgccctgggcctctccctcggctctggccaccaccaccaggagctcaagccccaacatccgtcgcatccgtgtgcggcgttgttggagccttctctgtcgctcggcagcccggcgaccaaggatgatggcccgaccgcaccggtgaggaggttcgctgccgtgaaaagggagctgcagacgatggaggggaacgacgacgaggccaccggcagggtacttgtctactcagtggcgtcgtcggcggtggttactgccgacgacgacgaagggtgcaacagcagccggaagaagctgaggctgtccaaggagcagtcggcgctgctggaggaccacttcaaggagcacagcaccctcaaccctaagcagaaggctgctttggccagacaactgaacctgagcccaaggcaagtgggaggtttggttccaaaacagaagagccagaaccaaactgaagcagacagaagtggactgcgagattctcaagcgctgctgcgagacgctaacagaggagaaccggcgtctccaccgcgagctccagcagctccgcgcctttttcatgcccaccgccgccgccgccgcgctctccatctggtcctctgncagcgccttgttgccaccggagcatctgccgccgccggagccaccgccggtgcagaaaataagcctaaggcgggcggccccggcggccgagcgccacacgtgttcagccctttcaccaattctgccgcctgctgaacacgcatacatatgtatatacatgcatgcgcacacatatatacgtatgtggtgcttagcgctagcggctagccacgctctatcattcatcgatggtcatctactagctagatagtaattggttcactagctagatggcatatattcctgtcccctccccccttaattcattagctttgttttttcacaagctaattaatgaattgatagcggcgtcgcgtgaggacgaaaaaaaaaaaaaaaaaaaaaaaaaaaaaaaaaaaaaaaaaaaaaaaaaaaaaaaaaaaaaaaaaaaaaaaaaaaaaagggggggcccgttttaaaagaac

SEQ ID NO: 1674 - protein, 228 aa, Oryza sativa
  Orthologous to G1543
MGATSPSGLELTMAVPGLSSSGSEGAGCNNNNAGGGCNMRDLDINQPASGGEEEEFPMGSVEEDEEERGVGGPHRPKKLRLSKEQSRLLEESFRLNHTLTPKQKEALAIKLKLRPRQVEVWFQNRRARTKLKQTEMECEYLKRCFGSLTEENRRLQREVEELRAMRVAPPTVLSPHTRQPLPASALTMCPRCERITAATGPPAVRPPPSSAAAAAPSPFHPRRPSAAF

SEQ ID NO: 1675 - DNA, 626 bp, Zea mays
  Predicted polypeptide sequence is orthologous to G1637
accctcgaggctggccgggcagaaataaaaaggaaaaatccgggagaggataacaaaaaagaaaaaaacccaaagagattcctctcaccaccaccaaccctagacgatcctcccccgccatgatgcgggacggcgtgcctccgtcggtggccggctccggcggcgcggcgggcggcgacgggcccaggcgatgctcgcagtgcgggcaccacgggcacaacgcgcgaacctgcacggggcggcccgtcaagctcttcggcgtgcgcatcgggggcaagcccatccggaagagcgccagcatggggaacatcgcgcacctcgccgcggagggcagcggcggcagggaggaagggtacggctccgacggggagcgcccgcacaagaagcgaggtgaggcatggactgaagaggagcacaagaagtttctgcttgggttgaataagctagggaaaggcgattggcgtggtatatcccgtaaatatgttgtttcaaggacacctactcaagtggctagccatgcgcaaaagtatttcaatcgccaaacaaatgtgcctggaagaaagagaagatcaagcctattcggtttggtgattgttgacccgtctgctcaacttccgctctcgcgt

SEQ ID NO: 1676 - DNA, 1428 bp, Zea mays
  Predicted polypeptide sequence is orthologous to G1637
gtcgttgtacattgggtacctcgaggccggccgggcccaggggggcggggcaccacaggtactcttctcctgcttggcctcttgtgccgcaaccgcgagtgcggcctacggtagcctccaaagcagcacatccaaagcagggaccgaatggacatggaccggccggaggaggaggggcagcagcggagggagacgatgacgccggtgctcctcaggctgttcggcgtggacgtccaccggggtggcggcagcggggagccggaggagtcgccgatggacctgaggaagagctccagcatgcccgacctcaccatcaacccgctgctgtcgccggaggagaaagagggctgcaaggggtacgcctccgacgacgcggagctggcgtccggccagcagaagcgccgccgtcgcaaggcacaggacaggaagaaaggaattccatggaccgaggaggagcacaggaagttcctggacgggctaaggcagctgggcaagggggactggaggggcatctccaagggcttcgtcaccaccaggacggcgacgcaggtggccagccacgcccagaagtacttcctccggcagaccaaccccggtatgaagaagcgccgggcgagcctcttcgacgtcggtatcgcggactacaaggacaaccaggtgccaggccctcagagcatcgtcgctgccaaaccggcgcctacgcaggagataatccacaccgaccgcggcgacgtccccataccaagatatagaggcctcggagagattttaggcagtaacatgcaggttaatcaactgactgactactactatttcaacaagaactcccatgttcccgcggggacttcgctctccatggcctccggcctggaaacggcctcgaccgtcgacagcctggagctcagcatcgccgtcaacggcctggagctcagcatcgcgcccccttcccggtgcgtctgcggcggcgcggcgggggccatcaaggttctgtgactcggccgggacgccgagggagctactcgcatttggcttcccctgcgagcatgcgtttcatcaagtattatcagcctcgtcaggctgccgcgcgcagccgggtttcggtcttgctggttgtgttggtgtgttctgttctgttttgttgtgcgcaaggaatgtttgtgaagtgcattgcgttgtaatacactaatactagcagtgttgtggaatggaattaggggagagggatcagctgggatttgggggttgatgggtccctgtctcgacttcgagtgggttcgtttcggggtccaatccgaggaggcggcgacgggcgcgaggcgtcgtgtgggtgtggctctgagctccccgatcccgcccaataattggaccgtgccgtccaaaacgcatacgccaactaatcttcggaagaaagtcgcagctttacgttaa

SEQ ID NO: 1677 - DNA, 1374 bp, Zea mays
  Predicted polypeptide sequence is orthologous to G1637
ccggccgggaaggaaatacacagagaccgggcatataaatgtaagcaagtccaatgtaaggccgcccccccaggggggcggggcagcagcggagggggaagatgacgccggtggtcctcaggctgttcggcgtggacgttcgccgggttggcgccagcggggagccggaggagtcgccgatggacctgaggaagagctccagcatgcccgacctcaccatcaacccgctgctgtcgccggaggagaaagagggctgcaaggggtacgcctccgacgacgcggagctggcgtccggccagcagaagcgccgccgtcgcaaggcacaggacaggaagaaaggaattccatggaccgaggaggagcacaggaagttcctggacgggctaaggcagctgggcaagggggactggaggggcatctccaagggcttcgtcaccaccaggacggcgacgcaggtggccagccacgcccagaagtacttcctccggcagaccaaccccgggatgaagaagcgccgggcgagcctcttcgacgtcggtatcgcggactacaaggacaaccaggtgccaggccctcagagcatcgtcactgccaaaccggcgcctacgcaggagataatccacaccgaccgcggcgacgtccccataccaagacgatatagaggcctcggagagattttaggcagtaacatgcaggttaatcaactgactgactactactatttcaacaagaactcccatgttcccccgggcacttcgctctccatggcctcccgcttggaaacggcctcgaccgtcgacagcctggggctcagcatcgccgtcaacgggctggagctcagcatcgcgcccccttcccggtgcgtcttcggcggcgcggcgggggccatcaaggttctgtgactcggccgggacgccgagcgagctactcgcatttggctgtggctctcgggcccctgcgagcatgcgtttcatcaagtattatcagcctcgtcaggctgccgcgcgcagccgggtttcggtcttgctggttgtgttggtgtgttgtgttctgttgtgttgtgttgtgttgtgcgcaaggaatgtttgtgaagtgaattgcgttgtaatactctaatgctagcagtgttgtggaatgtaattaggggagagggatcagctgggattggggggttgatgggtccctgtctcgacttcgagtgggttcgtttcgtgttccaatccgaggaggcgacgacgggcgcgaggcgtcgtgtggctctgagctccccgacccctcccaataattggaccgttccgtcgttggtaggcccgtgccgtccaaaacgtactccctccagtacaataaaggtagtcgtttaggacatgattgtgc

SEQ ID NO: 1678 - DNA, 1112 bp, Glycine max
  Predicted polypeptide sequence is orthologous to G1640
gaattcggctcgagcaacaaccttagcagttaattagcacaacacaaaaggagagagagagagagagagagagagagagagagagagagagagagatggggagaagcccttgttgttcaaaggagggtttgaatagaggtgcttggacagctcatgaagacaaaatcctgagagaatatattagagtccatggtgaaggaagatggagaaaccttcccaaaagagcaggtttgaaaagatgcgggaaaagttgtagacttcgatggttgaattatctcagaccagatattaagagaggcaatatatccccagatgaagaagagctcatcatcaggctccacaagctcctcggaaacagatggtctttaatagctgggaggcttccaggacgaacagacaacgaaataaagaattattggaacaccaatttagggaaaaaggtgaaagatggtcaccaaacaaccactggaaacaacacacagaatccaatgcccaacccatcaccctccctatctcctcctaaactagattcccatgttgtccgtacaaaggctaccaagtgctccaagttgttattcctaaacccaccccctcacccatcaatgcagaacaagttcaagactgaggcagaagaagaagaagaagaagcaaggcttgtgaatggtgtaattagaaaccaaatggaacacactacatacgacaacgggttcctgtcgtttcccgatgaagaaaaagaactctcaacagatttgctcatagatttcaacgtgggggatgtttgcttgtctgatctactcaactcagatttctcaaacacgtacaatttcagctgcactaatgttaaccaccacgagcagttatcgccttgttcggaccaacctgatgccatgttctcagatgaagttctcaaggactggacacacagcaattttgcagacgaagcgaatgcttccaacaaccttcattctttcatttcgtttgagtctactgaggaatgactagtgcaatgataatgacaacaaaaattgcacgtttgtactaatgtcaatatgccttctccaataaaattcgccagttaagtctctttaaaaaaaaaaaaagggcggccgccg

SEQ ID NO: 1679 - DNA, 538 bp, Glycine max
  Predicted polypeptide sequence is orthologous to G1640
aattcggctcgaggcttcagtacttgctacctttctataaaggtagagagaagagaggacccttctcttgcatagttcaagtgagtgagagtgccaaaaaatgggaagggctccttgttgttccaaagtggggttgcacaaaggtccatggactcctaaagaagatgcattgcttaccaagtatatccaagctcatggagaaggccaatggaaatcactacccaaaaaagcagggcttcttagatgtggaaaaagttgtagattgagatggatgaactatctgagaccagacataaagagagggaacatagcaccagaagaagatgatcttataatcagaatgcattcacttttgggaaacagatggtccctcatagcaggaaggttaccagggagaacagacaatgaaataaagaactactggaacacccatctaagcaaaaagctgaaaattcaaggaacagaagacacagacacacacaaaatgttagagaatcctcaagaagaggctgcaagtgatggtggcaacaacaacaac

SEQ ID NO: 1680 - DNA, 773 bp, Glycine max
  Predicted polypeptide sequence is orthologous to G1640
cccacgcgtccgctttctataaaggtagagagaagagaggacccttctcttgcatagttcaagtgagtgagagtgccaaaaaatgggaagggctccttgttgttccaaagtggggttgcacaaaggtccatggactcctaaagaagatgcattgcttaccaagtatatccaagctcatggagaaggccaatggaaatcactacccaaaaaagcaggtaattaaggttttagatgctcaactttcccaattcatttctcaatttgatgtctcatgttctggtttcgatcacaaattattatgtgtaacttttataataattatattaatattgatatatgattgaatgacagtatataattatatgtgtataatcattaaattcataatataaaattacatgtatcttttatccgaaaaattatgctggagtcggatagaataaattctgattcataactctgaatatacagggcttcttagatgtggaaaaagttgtagattgagatggatgaactatctgagaccagacataaagagagggaacatagcaccagaagaagatgatcttataatcagaatgcattcacttttgggaaacagatggtccctcatagcaggaaggttaccagggagaacagacaatgaaataaagaactactggaacacccatctaagcaaaaagctgaaaattcaaggaacagaagacacagacacacacaaaatgttagagaatcctcaagaagaggctgcaagtgatggtggcaacaacaac

SEQ ID NO: 1681 - protein, 271 aa, Oryza sativa
  Orthologous to G1640
MGRRACCAKEGMKRGAWTSKEDDVLASYIKSHGEGKWREVPQRAGLRRCGKSCRLRWLNYLRPNIKRGNIDDDEELIVRLHTLLGNRWSLIAGRLPGRTDNEIKNYWNSTLSRKIGTAATAAAGSRGGSTPDTARATDAASSSSVVPPGQQQQPASRADTDTATAAAAAAATTTTVWAPKAVRCTRGFFFHDRETAPLAAAAPAPAGELGDGDDVDCDYYCSGSSSAATTTSSSSLPAVVEPCFSAGDDWMDDVRALASFLDTDDAWNLCA

SEQ ID NO: 1682 - DNA, 737 bp, Zea mays
  Predicted polypeptide sequence is orthologous to G1645
  misc_feature (649)..(649): n is a, c, g, or t
  misc_feature (688)..(688): n is a, c, g, or t
aagctgacagagagagctagcaacgctctgcaagatccgccatctaaactttgcagcactctactccaccactctcctccgtctgcgactgcgactaggtcccaaatggccgctccaccggtggccgccgctctgtctgcgctccatgaggcacaagagacccacggccatgacgacagccgcgctgggcacgcgagaggccactggcggccagccgaggatgccaagctcaaggacctcgtggcgctgtacggccccaagaactggaacctcatcgccagcaaactccacggcagatcagggaaaagctgccggctgcggtggttcaaccagctggacccgcgggtcaaccgccgcccgttctcggcggcggaggagcagcggctggtggcggcgcaccgcgcccacggcaacaagtgggcgctcatcgcgcgcctcttcccaggccgcaccgacaacgccgtcaagaaccactggcacgtcctcacggcgcgcaggcagcgggagcggaccggcgcgccgccgcgccgacgcaagccctcctcgtcgtcacccgccgcccaccaccaccgtgcaccatctcctctgccgttctgcgccggcaaggccacccgaccccgctcggtgcggcgacggcgacggcgacggnggcgggtccgacgagtccgcgtcgtccacctcctccggnaccgacctctcctccctaggctccgtgtgcgcccccgccgtcccctgct

SEQ ID NO: 1683 - DNA, 828 bp, Zea mays
  Predicted polypeptide sequence is orthologous to G1645
  misc_feature (15)..(15): n is a, c, g, or t
  misc_feature (803)..(803): n is a, c, g, or t
cattgggtacctcgnagccggccgggctgactgacctcagcctcaggctcagctgcaccgatcatccatccccatacaaagacactgtatacatacattttaacaacaacaaggtttagctccgcatggcctattactgcaatgcttgctgcgcagggaagagctgccgcctccgctggttcaaccagctagacccccggatcagcaagcgccccttcagcgacgaggaggaggagcgcctgatggctgcgcaccgcttctacggcaacaagtgggccatgatcgcgcgcctcttccccggccgcacggacaacgccgtgaagaaccactggcacgtcatcatggcgcgcaagtaccgcgagcagtccacggcctaccgccgccgcaagctcaaccaggcagtccagcggaagctcgaggcagcctccgccgcggtcgcaatgccgccgggcgcgggcgcgggagacgtcgccgtcggccagcaccaccacctgctggccgccgccgcggcggcccacgcccacgacgccgcctacagcttcgccgcggacccctacggcttcggcatccgccaccaatactgcaccttcccgttcccgccaggcgccgcttcggctgaggacccgccgccgccagcgttcatagatttcctcggggtcggagccacatgaacgcgcgcgcatgtgcatgcatgctcgacttcaccacgcgccttgcagttgcatgtagtgggatctagctaggacaggtagctcgagcagcctctatctagtatctagctagctacctttgccatatatgangagtaagtacatcgatccaaggctt

SEQ ID NO: 1684 - DNA, 1441 bp, Zea mays
  Predicted polypeptide sequence is orthologous to G1645
ccacgcgtccggtctcctctccccatcttctctcctggaagccgcctcggtcggacccggacaagatggccgccttcttcggtgctgcaccgccgccggctctcgcttcgttccgccacgaggaggaggaggagcagcatcaggacgccgccgaggaggtgtaccacgtggacgatgtcgacgagggcagcggtgacggccgtggccacggcggcgccggccaggggaagctgtgcgccaggggccactggcgccccgccgaggacgccaagctcaaggagctcgtcgcgcagttcgggccccagaactggaacctcatcgccgagaggctggacggcagatcagggaagagctgccgcctgcggtggttcaaccagctggacccgcggatcaaccggcgcgccttctcggaggaggaggaggagcggctcctggcggcgcaccgcgcgtacggcaacaagtgggctctcatcgcgcgcctcttcccgggccgcaccgacaacgccgtcaagaaccactggcacgtcctcatggcgcgcaggcagcgggagcactcgggcgcgctccgccgccgcaagccctcctcgacctcgccctcgccggcgccggcgccggcgccgcacctggcgcccgtcgtcgtcctccaccaccaccaccactacgccggcggctcccctcccatgccgccgttgcacgccgccgacgcccacacgcagtacacggcagcggcggcggcagcggacacccgcgcgcacagcggcggcgagtccgacgagaccgcctccacgtgcaccaccgacctctccctcgcttccgccgccccctgcttctaccagagtggctacgacgtggccccgcgcgccgcggcgttcgcaccgagcgcgcgctccgccttctccgcgccgccggcgacggcgcgctccgacgacaaggtctcgctgcccttcttcgacttcctcggcgtcggcgcggcgtgatgggggggccggcccgggccggccaggcggcggtgtacaggagggcggaggcggtcaaaggacgagagccccggcggcggtgaacccgtgcccgcgcgtagtttagctttagagcccgagttaaatcatcgagaacagaacatggcctgagcttgagagaggaggagaatggcgatccaccattgaactggtgcccgtggcattgcagactaacagctccgcatccgttcggctgctgatgttgctagtagtaatggtacggtgattactctctgctttgggttgggagagacgaatctgcaagcaccaccagaccaagcaagggcgacgatgggtatgggtggatgtttgcagaagaagaaaaaaccgcttgtaacacaaactgcaggacaaaggcagatcagagatcctctgctaactctctttttacaaaaaaaaaacccaagggcggccgctctagagga

SEQ ID NO: 1685 - DNA, 460 bp, Lycopersicon esculentum
  Predicted polypeptide sequence is orthologous to G1645
gatggacagtcaaaactttgtgctagaggtcattggagaccagctgaagatgctaagcttaaagaacttgttgctatttatggccctcagaattggaaccttattgctgaaaagttagaaggaaggtcaggaaaaagttgtagattgagatggtttaaccagttggatccaagaatcaacagaagggcatttagtgaagaggaagaggaaagattaatggctgctcatagattgtatggtaacaaatgggcaatgatagcaagactatttccagggagaacagacaatgcagtgaagaaccattggcatgtaataatggccagaaaatatagagaacaatcaagtgcttataggagaagaaaaatgggacaatttgtttacagaagatcaacaacaacagtagttgaagaagcagataattcaagtggccaaaattctgttaaccactttagtatgaaaa

SEQ ID NO: 1686 - DNA, 529 bp, Medicago truncatula
  Predicted polypeptide sequence is orthologous to G1645
tattctcttccattcttctgtaaacagattgattcagcctcctccttctgtaagcacttgattgttctctgtactttcttgccattataacatgccagtgattcttaacagcattatcagttcttccagggaaaagcctagcaatcatggcccatttgttaccataaattctatgagcttgcattaatctttcttcctcttcatcactaaaagctcttctattaatccttggatccaattggttgaaccatcttagcctacaactcttaccttcaaatccaaaaaaaaaaaaaaagttaagaaaaagaaaatgacccaaaaaaagaggacacaacaaaaagaggaaagaaatgaaatataacctgatctgccttctagcttttcagctatgagattccagttctgaggaccataaagagcaacaagttctttaagcttagaatcttctgcaggtctccaatgacctcttgcacaaagtttagagtgaccagtatctacctctttaccactgacataactattctcatta

SEQ ID NO: 1687 - protein, 338 aa, Oryza sativa
  Orthologous to G1645
MAHEMMGGFFGHPPPPPATAAVGEEEDEVVEETEEGGHGGGVQGKLCARGHWRPAEDAKLKDLVAQYGPQNWNLIAEKLDGRSGKSCRLRWFNQLDPRINRRAFTEEEEERLMAAHRAYGNKWALIARLFPGRTDNAVKNHWHVLMARRHREQSGAFRRRKPSSSSASPAPAPAPPPPPQPVVALHHHHHRYSQQYSGYSGAAESDESASTCTTDLSLSSGSAAAAAAAAAAANIPCCFYQSTPRASSSSTAACRAPRVAAAADTVAFFPGAGYDFAAAPHAMAPAAASTFAPSARSAFSAPAGRGEPPGAVDQRGGAQATTDSHTIPFFDFLGVGAT

SEQ ID NO: 1688 - DNA, 524 bp, Oryza sativa
  Predicted polypeptide sequence is orthologous to G1646
acggcgccgcgggccctcccgcctgcgaacccgagcgcgctccgggctcctccttggcctcctcccgcggcacgatgtcgacgaggaagtcgaacacgtcggtgcgcttcgatgtgcgcggcagacgtcttgcgctgcaggtcggcgcttgttctcctcggcgtcagccacgagcggatggtgagctccaggatgaagagctcgcacgccttggcagaacagcacgggcgcactccgccgagatcatgcgcacgtcctctgtccgccttcatgatcctcttgatccgcgccagcggcagctggtggttcttgaagtccgacgccgacgcgcagctccagcctcctgccgctggtacgcccagaacgcctgcagctgcgcctgctgctgctggagcaggtggtggtgcaggcaccgccggcggcccagcccgcgccaggcacgcccggcaccggggctccggcgcctgcgccgcttagaggatccaagcttaaacgcgtgcatgcgacgtcatagctctttaatt

SEQ ID NO: 1689 - DNA, 792 bp, Oryza sativa
  Predicted polypeptide sequence is orthologous to G1646
ccggccgggaacctcacatatattgtgttcatcctcataccaccaaccaattagtgccagtagcacatttctgcagttgtagttcaagtaaggtatatcattcagagcaacaaagggaagcaatgaagcaaactttggatgtacatagatcgttgaggccaccaatgccaatggctcaacaacaaatggatgaatcttggagggaccgacaaaaggagattgagatgacaaaggacttcagtgagcacatgatccctatggcccgcttgaagaagatcgtatcttctcaaaagggtaacatgatgatgacctttgacatgccagcgttcttatcaaagatgtgtgagctctttgtacaagaacttgctgcgcgtgcatgggcatgtgcccaatctcataaccgatgcatcatactagacatggatattgctgaagccgtagcctctactgagtcttatgactttcttgttgatatcctccacaatcacagtgtgaagcaaaaatccactccttgttcttccaccaagcgttgtaggttagttgatcaaccttctacatctcacattccccaccgacatctgctgccacagtttgctcctacatatactttggccatccctattactcctagtttaatgccattaatttctcaatgcacaccatcctcttttccatccttgccacaagaaaagttcccattgatggcacccacacccattgtgaatagatcaatgttgtttatcaataatatagcaaggggtctgggcttacaagggaacaatatcaatgcag

SEQ ID NO: 1690 - DNA, 1193 bp, Glycine max
  Predicted polypeptide sequence is orthologous to G1652
aacacaacttccacattccgatggaggagtcatgggaaaattggcatcttcatatggaaaccggttgcgagaacgatttcttaggcaagtgtcacggcactgacgatgacgagttcttcagagacatccttcagcaaccaccacctgcggctttctcttccgaaagcgaaagcgatcactccttcctcgctgtccaaaacacttctagcatccccaacgacggtgccgttttgtctcctaggaattacctcgtcaaaagcagcagctccaactccttggtctctcaaaacgcttccaaacgacctcgtcgtttgtcctctcccaggacttacattctgtccttcgacaactcaaccatggttccggccacacccgaaacccgcccccgctcctccaataattcccctctgcctgccaaacgggccctggaaagcccaggcccagtagcccgaaggcccaaccaaggagctaagaagataagaacctcttctcagaccatcgatcacataatggccgagagacgacggaggcaggaactcacggagaggttcatagcactctcagccacgattcccggcttgaacaagacggacaaggcttctgtacttcgagcagcaattgattacgtgaaacaacttcaagaaagggtacaggaactggagaaacaagacaaaaaaaggagtacagagtcagtaatattcatcaagaaacccgacccaaatggaaacgatgaagacaccacctccactgaaacgaactgtagcatccttcctgagatggaagcaagggtgatggggaaggaggtgctcattgagatccactgtgagaaagaaaatggtgttgagctaaaaatattggaccaccttgaaaatcttcatctcagtgttaccggaagcagtgtcttgccatttggaaattctgctctctgcattaccatcacaactcagatgggtgacgggtaccaaatgactgtgaatgatctagtgaaaaaccttagacaattgttctcaaaatcacatgtgctaagcgacagcgatccgtactagtgtatcaaacaatgagttgtagtgtatggaaatcgaaagttttggatttattaccctctttgattttggcttgttttcatgttgatcgtaacgttaataaacaaatactatatgtctgacctggatttatgcccggcatctaccctg

SEQ ID NO: 1691 - DNA, 1752 bp, Glycine max
  Predicted polypeptide sequence is orthologous to G1652
  misc_feature (849)..(851): n is a, c, g, or t
cggcttgagggaccaatatgattgaaagatgtcacatctattaatcagatatattaattaggttgatagcttcagctgtttttcatttcatgaggacttctcatatggagatttcatcaatcagagggttgcctgaaatggggataatagaggatcctaacttcctccatcactggcagttaaactctattgatacaactagcctaacaggtgctccttttggagagattttacaaaagcactcattctctgataactcaaatttcaaccccaaaacatccatggaaacatcaccaactggaattgaaagacctgcaaaacagctcagaaataacagctggaatcacaacaaaagtcaacaacagacaccagaaacacaatttgcttcatgctcaaatcttctttcatttgttaattcgaattacacgagcgaattgggactagtgaaacctaaggtggagatggtgtgtcctaaaatcaacaacaacgctctcgcagacatgttgatctctcaaggaaccttaggaaatcaaaactatcttttcaaggctagccaggaggccaaaaagattgaaacacgtcctaaactttctcaacctcaagaccacataatagctgaaaggaagcgaagagagaagctcagccaacggttcattgctctatctgctcttgttccgggcctaaagaagatggacaaagcttcggttcttggagaagctataaagtacttgaagcaaatgcaagagaaagtgagtgctcttgaggaggaacagaacaggaagagaactgtggaatctgtggtaattgtgaagaaatcccggctatctagtgatgctgaagactcttctnnntcagagaccggtggtacatttgtcgaggcactacctgaaattgaagcaagattttatgaaagaaatgtcctcataagaatacattgtgagaagaataaaggagtcatagagaaaacaatcagcgaaattgagaaactccatctaaaagtcatcaatagcagtgccttgacatttgggagtttcatcctggatataacaattattgctcagatggatatggaattctgcatgacagtgaaggatcttgtgagaagtttacgctcagccttttcatatttcgtgtgaagaaactcgttatgcattccgaaaggttcatgaagaataggagtgcaatcaattataccagttcatataaactattatcaagtttaagttcttcaataataattatgtttccaaggtctgcaatgtctgccatctacaccatgtttgctctgaggttcatttatgaagaagggttttttctagcgatcttttctttttgcatggtcaacttgttgacagtgttattgtcacacaccctactgtttcaagagtgaatgtagagcttgttaggcattttttggcagaaagttgaaaagttcaactagctgtttcccatctatttcttacctaaatctttagaagcaggcctttgttgagtgacttcctatcttcttttttttttttcaggtgttcttgagttacttttttatttgaaacaaaatatacgcctgtaaaagtttggttggatttggtaagtgatggaataatcgtccttttgtttatcttgtgtatatgctcgacatgttgcatggcctcaacatgatattctgcaaaagcattaatgctaccaatttaagcatatgtaaattgtaggtggtggattaagcttaaaaaaaaaaaaaaaaaaaaaaaaaaa

SEQ ID NO: 1692 - DNA, 1468 bp, Glycine max
  Predicted polypeptide sequence is orthologous to G1652
  misc_feature (1006)..(1006): n is a, c, g, or t
ctcaaattcgtcccctccaatccaacaacaccgatcagtttcatggtattgttgtttcttctgccttaagcccaaagcgataagaccaaggtgcttcagtttactcccacatacccggaaacgtttatcagaaaaccagaactttgaagctgaaagccccaaaggccatagaagctacaagtccccatctcacgttcgggatcacatcatcgccgagagaaaacgaagagagaagctcagccagagcttaatcgctctagcagctcttattcctggcttaaagaagatggacaaggcatcagtgctgggagatgctataaagtacgtgaaagagctccaagagcgtatgagaatgcttgaagaagaggacaagaatagagatgtggagtctgtggtgatggtgaagaaacaacggctgagctgctgcgacgatggttcagcttcacatgaagatgaagaaaacagtgaaagactcccccgcgtggaagcgagagtgttagagaaggacgtgctccttcggatccactgccaaaagcaaaaggggcttttgctcaacatacttgtcgagattcaaaaccttcatctcttcgttgtcaatagcagtgtcctacctttcggggattccgtacttgacataaccattgttgctcagatgggaaccggctacaatttgaccataaatgatcttgtaaaaaacctacgcgtggctactttgaaatccatgtcataacaccaacgtgatcttgtctgtttctggtccagcaggatggtctggtggtgggtggtaatattaataatgatattttcatgttttgtggtgtgcagatacccaaaaatgattgaaaatgagttattgtttgaaggtaaaaaatttggtcctccagtctatttttaattttggatttgatctcccactaaattaattcacaaatattatttttttattttataaaatcatgtaatgttcgtcctccagtccacacttgaaccttaacgggttacaagngtgacgttgattattgtcacgtgtcacttttttattgaatgatgactttcacgtgtcatgttttgatgggtcaatgaaaacaacaatgtatttcatcttttatggaattaacatccacatgatacgtgacaatcatcattcaataagaaagtgacacatggtagtcaatgtcactttgtaacaatcaacgtccaattgtgggttgagggaccaacattgcatgattttaaaaagtaggagaaaaaaaaattgtgaattaatttaatgggggacaaaatttgaaattgaagacaaactggagaatcaaaaatgtaattttgccttgattcaaatgctctcttgtcaatttgaatgcacaaaatttatatgtaattgaactttcatttcaaaatttacttctcttgatatttaatgcaaatatttattatatgaattgtttaaatgaaacttcaattttaattt

SEQ ID NO: 1693 - DNA, 1825 bp, Glycine max
  Predicted polypeptide sequence is orthologous to G1652
gaatagcctagaatagcgaaagaaagtgttgctgctaattccatttcagtgacccctaattatgatggaggaattgaacaaaccattggacggatcagcaaccagctggttatccgatttggtaagaaaaaaaaaaaaaaatcattttcattcttccattcttcaaatgcccaaatagatgatcataatccataaatcctttaacccttttgtgttcctcttttgttttgttttatttataggaaatggatgattacaatttatttccagatgaatgtcccttgaacttgaacttgtttgatgaccaagagtttctctcacaagacattgctagtgcccttcaagaacagacacagaccttgcaacaatctttgtcttcagagtgcccttcaaaaactgtgagcaactcatccaccgatgaaaccacttttgactttgagagaccagccaagttgctgaaaacgacaacaagcagtagttgttgtaactctgactcatccaccatcaccaaaagcctttcacccaaactttccccatcgtcatctttttcctcatttcagtctcagattctctcctttgacaatcctaacccaacctcatcttccaacaccaccacccagttttatgggtttgactgtaccttaaacccaacacagaacgagatggtgtcagtgtcagtccccaacatgagaaaaccacggttcccaactcaaaccgcaaaaggttcaccgaaaaatcaaaactttgaaacaaaaacctcacatggtaagaggtctccagctcatgctcaagatcacatcatggctgaaagaaaacgaagagagaaactcagccagagcttcattgcccttgcagctcttgttcctggcctaaagaagatggacaaggcttctgtgttaggggacgctatcaaatatgtgaaagagcttaaagagcggttaacagtgcttgaagagcagagcaaaaaatcaagggcagagtcagtagtggttctgaacaagccagacctctctggcgatgatgattcttcttcatgtgatgagagcattggtgctgatagtgtcagtgactcactgtttgaagtggaatcaagagtatcagggaaggagatgctgctcaggatccactgccagaagcaaaagggtcttttggtcaaattactggccgagattcaaagccatcacttatttgttgctaatagcagtgtattaccctttggtgattctatccttgacattaccatagtggctcagatgggagaaagttacaatttgaccactaaggaacttgtcaagaacctacgcgtggctgcattgaagatattgtcataacatgaacgtggcttgagtatggaggataccctcatgacatatgatatggattggaactctgaatcacatttaatgcgccagccaccgagtaaatcacaaccaaaatggaagccttgttattaatgtgtgatttccgctacaacctgcagtgttccccaatatgtagattcagcttgatcccaagtgatcttgtctttttcgtgttatgttttggtttctcaggccttcagtgtgtgcctgctcgagggaaaaataattgaataattttgtaaagatgttaggaataatttcaatctgacacggcttaattaacatgagcttaaatagagattagaagctggataatggtgacattgacagtttttgatgtaccatttgttcttttgaacatgtttgaaggatgcaaatctctctaatttctggttatgcttccactttaattataatattggccccccagcatttatgttaatcacctactactataatgggct

SEQ ID NO: 1694 - DNA, 1561 bp, Glycine max
  Predicted polypeptide sequence is orthologous to G1652
acgtgtcatgcactcgtcccttacctcggaattcggctcgaggaatggatcaaaccaatggacggatcagcaactcagctggttatccgatttggaaatggatgattacaatttatttccagatgaatgtcccttgaacttgaacatgtttgatgaccgagagtttctctcacaacacattgcttgcgccttccaagaacagacaccgaccttgcaacagcaatctttgtcttcagagtgcccttccaaaactgtgagcaactcatccaccgatgaaaccacctttgactttgagagaccatccaagttgctgaaaacgacaacaagcactagttctaactttgactcatccaccatcaccaaaaccctttcccccaaactttccccatcatcttcctttcaatctcagattctctcttttgacaacaccaacacccagttttatgagtttcactgtaccttaaacccaacacagaacgagatggtatcggtgtcagtgccccaaaagggaaaaccacggttcccaactcaaaccccaaaagggtcaccgaaatatcaaaactttgaaacaaaaacctctcatgctaagaggtctcctgctcatgctcaagatcacatcatggctgagagaaagcgaagagagaaactcagccagagcttcattgctcttgcagcccttgttcctggcctaaagaagatggacaaggcttctgtgttaggggacgctatcgaatatgtgaaagagcttaaagagcggttgacagttcttgaagagcagagcaagaaaacaagggcagaatcgatagtggttctgaacaagccagacctctctggtgataatgattcttcttcatgtgacgagagcattgatgctgatagtgtcagtgactcactgtttgaagtggaatcaagagtatcagggaaggagatgctgctcaagatccactgccagaagcaaaggggacttttggtcaagttactggctgagattcaaagtaatcacttatttgttgctaatagcagtgtcctaccctttggtaattctatccttgacattaccattgttgctcagatgggagaaagttacaatttgaccactaaggaacttgccaagaatctacgcgtggctgcattgaagatattgtcataacatgaacgtggcttgagtatggagaataccctcatggcatatggcatggatattgaaactctgaatcacatttaatgccccagccaccgagtaaatcacacccaaaatggaagccttgttattaatgtgtgatttctgctacaacctgcagtgttccccaatatgtagattcagcttgaccccaaatgatcttgtcttcttcgtgttatgttttggtttctgaggccttcagtgtgtgcctgctagagagggaaaaataattgaataattttgtagagatattaggaataatttcaatctgacatgtcttaattaagattttaattgagttgattaaccagaagggatgagttgtttaatttctatgaataaaaaaaatctgacccggcttaattaacattagcttaacca

SEQ ID NO: 1695 - DNA, 712 bp, Glycine max
  Predicted polypeptide sequence is orthologous to G1652
caaatcatcctcaatccatcataaagtactatacgataatgttcgtatcatggatatttttttttaatacaatctgagaacttccttgatgcactagcacggatcactaattcactattgcatgtcatacacctccaacagatattctctcagttttttcactaggtcatccttggtcatgctgttttcgccattcatctgagcaataatgttgattataagagtagaagtcccaaatggcaatacggtgctactggttgtagatagatggaggtttctaagcaaggcatgtattttgaacactatgtccttttgcttctcacaatggattccaatgagtacttccttatctaggactcttgcttcaacctcaaatagtgatatttctttgttcgtttcacaattgccggtgtttttatctgaggaggcttcagatttccttatgaatgttgctgaatctactttgttttgattttccaactctttaactcgctcttgaagttgttttgtgcaattgacagcttcacgaagcacataagccttgtccatcttcttgagcccaggaatagttgctgaaagtgctataatgctccctgtcagttcctgcctccttttcctctcagcaattatgtgatgccgtgtctcacatgaccttctaaccttcttctttggttgggtttggggcatcaatgcatcaaactcgagctggtgc

SEQ ID NO: 1696 - DNA, 1285 bp, Glycine max
  Predicted polypeptide sequence is orthologous to G1652
gctaaaatgggtttctattttggtaataggagattcgatcaatataaatatatatatatagatatatatatatatatatatatatatgattatatacgttatgtacaggcccgtccgagtcatggctaaaatgggtttctattttggacactaatgactatcatttattcagtgaatatgacatgaactctgtcgaggaacaattggagggagagaattcagtggatcctggtgaactctcatgggaaaatcactcttattcatatctcactaaagaaagcaccacccttttgagcaattcttcatctttggaagagatcaacactggctttgatatgacaagtctcaaacaagatgcttctccacagaaaccgaagtcttgcattctgtcttttgaggattccactttagtgccaattaatcccaagaaaacatgccaaatatatgatcatggtgaacattcaaaggagacacaagaaaagccacacaatagaaaacccctcaagaggggtagacgcttttctcagacacttgatcacatattggctgaaagaaaaaggagagagaatatcagcagaatgttcatagctctttcagcacttattccagacttgaaaaagatggacaaggcttctgtccttagcaacgctatagagtatgtgaaatatcttcagcagcatgtgaaagatttggaacaagagaacaagaagagaaagacggaatccttaggatgtttcaaaataaacaaaacctgtgatgataaacctataaagaaatgtcctaaagttgaagcaagagtctcaggaaaagatgttctcatcagagtaacgtgtgagaagcaaaaggacattgtacttaagctactggccaagcttgaagctcataatctctgcatagtgtgtagcaatgtcttaccttttgggaattccgctctcagcattaccagcattgctatgatggaccatgaattcagcatgacagtggacacgtacgacctagtgaaaatgttgactgaggaattgttggagtgctgtaaattgcaacgataatgagccacgctaacgaattggctaccagtaaatttaaaagtgcattttaagcagttcaagcattttatttggtgtccctattagataattaatattggcagtatcttcatatattatgcatttggtgtgcataatagttgtctttttggccatcttcacaaataatcatcatttttatggcaaaataaaatgattttgtgatttcacattttgtgcattttcaatatttttatatt

SEQ ID NO: 1697 - DNA, 683 bp, Glycine max
  Predicted polypeptide sequence is orthologous to G1652
  misc_feature (10)..(13): n is a, c, g, or t
  misc_feature (674)..(675): n is a, c, g, or t
  misc_feature (681)..(682): n is a, c, g, or t
gggaaaattnnnnttccgataattcttatctggatgaggtcaacgatgaatttggtagtgaagatgaagagggaggttcattttctggaatgggcgagaccgacagaaagaagagaaagcgagaactcgcagagaggttccttgcactttcagccaccatacctggcttcaccaagacggacaagacttcaatcctggccaatgctagtagctatgtgaaacaacttcagcaacgtgtgagggagctagagcaagaagttcaatccaacgtttctagcaatgaaggtgccaccagctcttgcgaagtgaactcatccaatgattattactctggtggtggaccaaatgaaattcttcccgaggtcaaagtaagagtgttacagaaggacgttctcatcataatccactgtgagaaacagaagggcatcatgctcaaaatactttcccagcttgaaaatgttaatctctctgtagtcaacagtagcgtcttgcgatgtgggaaaatcactctcgacatcaccattatggctaagatgggtgacggttacaagatgacggtggatgaactagtgaagaccctgagagtagcgatatcttgatgactcattagctagcctgtcctaatgtacctaccaagcaagtgcagtattaattgtaatttgagaaaaagctannaatgannc

SEQ ID NO: 1698 - DNA, 933 bp, Oryza sativa
  Predicted polypeptide sequence is orthologous to G1652
agctcagccagcgcttcatcgccctctccaagatcgtccctggcctcaagaagatggacaaggcgtcggtgctgggcgacgcgatcaagtacgtgaagcagctgcaggaccaggtgaaggggctggaggaggaggcgcggcggcggccggtggaggcggcggtgctggtgaagaagtcccagctgtccgccgacgacgacgacggctcgtcctgcgacgagaacttcgacggcggcgaggccaccgccgggctgccggagatcgaggcccgcgtgtcggagcgcaccgtgctggtcaagatccactgcgagaaccgcaagggcgccctcatcaccgccctctccgaggtcgagaccatcggcctcaccatcatgaacaccaatgtgctccccttcacctcctcctccctcgacatcaccatcatggccaccgctggagagaacttctcattatcagtcaaagatatcgtcaagaagctaaatcaagcattcaagttatccctgtgaaggacttgctttcctgatcaagtctaatctagatcaaatctttggttggtaatcttcctactacctttttatcattagccttgagagaaatctgaggctgatggttctaattaggtcctttccctgcttctgcttctgaagagagtttgcttgcaatccaccacagagcacaccccctcaaggatttagccattaaccacctgtttttgctgcatgggtgcagagaatttgcagattacctaaatatccacctacaagtcttctattttctctcccatcacatttttttgcatggattgagctagtcactccatgttcttgggagagggtagaaatgtaaaaaagagacctgtctttttctagggcctgtttatcaaggggagtttgactttttcaaaaaaaccttattttcatttctccccttctg

SEQ ID NO: 1699 - DNA, 904 bp, Zea mays
  Predicted polypeptide sequence is orthologous to G1652
  misc_feature (770)..(770): n is a, c, g, or t
tcgaggccggccgggccgggagacaaccccggccgtcagctggcaaaatggaggactcgagcctgttcctgcagtgggcgatgagcacgctgcggcatgagcaacaacccgcggcagccgtcaacgacgactgcagcagcgaggcaacgttcccctcactccaagcgctccgcgaggcctcgcatgcggccgagatggtccaggagctgatcggagaagccccagcgaacagctggagctcgggcgacaccaccgacggcagcataggaggcaacagcaactcggtccctggccctgctgcggcggccatggagcacgatgtctggcctgctgcgtcgtcgaagacctctccggccaggcgcgccttgagcaggagcagcagcgacaccaaccctcccgtgagctggaacttcagcgccgcagcctcggcacagctggccggcagcgccgacggcatgctgccggaattcgcccccaagagcgccctaccgccggaccaagcgtacggatcaccgcgggcaaggagagccggcttgaagagcctggcgggatccatgtcgtcggcggcgtacgctcaagaccacatcatcgcggagcggaagcggagggagaagatcaaccagcggttcatcgagctctccaccgtgatcccaggcctcaagaagatggacaaggcaacgatcctttcagacgcgaccaagtatgtgaaagaactccatggaaagctcagggacctgggaggctggcggcagcaaccggcgcaagagcantcgagacggtggtgctcgtcaaaaggccgtgccctcatgctgcgcccgcgccggacgacgatgccctcccattgtcagcgtcgtcaggcacgccggctgagacgaagacgcagctgccggagatcgaggcccgg

SEQ ID NO: 1700 - DNA, 1547 bp, Zea mays
  Predicted polypeptide sequence is orthologous to G1652
gctcccccgaggactactcctcgccgtctcatcctctccttcggcggccaccacgccagggcgcccaagcaggagctgctcgacgccgccgccgccgcgctgccgtcgttccagcaggcgcgcccggcgcccaagcgctcctacgacgacatgatggccgaggccgccagggcgcctgccgccgccgccgccgccgcacgcccggcctcacagaaccaggaccacatcttggccgagcggaagcgccgcgagaagctcagccagcgcttcatcgcgctctccaagatcgtcccgggcctcaagaagatggacaaggcatccgtgctcggcgacgcgatcaagtacgtgaagcagctgcaggaccaggtgaaggggctggaggatgacgcccggaggcgcccggtggaggcggcggtgctggtcaagaagtcgcagctgtccgccgacgacgacgagggctcctcctgcgacgacaactccgtgggcgccgaggcctccgccacgcttctgccggagatcgaggcccggctgtcgggccgcacggtgctggtgagggtccactgcgacaaccgcaagggggtgctcatcgccgccctctccgaggtggagcgcctcggcctctccgtcatgaacaccaatgtgctccccttcaccgcctcctccctcgacatcaccatcatggccatggctggtgacgacttctgcttgtctgcaaaggatattgtcaagaagctaaatcaagcattcaaatcacccttctgatgggattagcttaatctatgtcaacttttttcccattagccttaaggctttcgcccgcagcggttcggcatcaggtccttccttgcctttgcttccgaagagagttgcttgcagtccccaagagtccccccacacaaagatagccatttccactggttttttgctacatgggtgcagagattgatcacctagctagttacctacttaccatcccattttatctgtctctccagttttttacatggtttgatgttgtcactccatgtttttgggagagagcagattgtaaaaaaaaaacagcctttttttctagggctttgctatataggcctggggagtttgacttttacaaacctaatttttctttctccccttcgcccgtatgttgccctttaattcaccttgttttttccatgagaggatggtgtttttcaaacaccagcacctaccttcgccgtcctctcaaccttgatcacactgctcccagaaaaagcttcagttgtggagaaaatggcgccgtctttttttttaatcagctctgagggggactttgcaagccttgatttggaagtactgtagggatgcctcacttctattgtttctgttttttttgagggtcctacaagttggccgccacttgaaacttgatggagcctttgcctatagttttcacatgtgagttttgttgtcacaggacaggatgaaggtgtagttgttgtcatctcttgtttactctcatacaagcataaataaataaatgtgctcgtttggtaccttggcaccaa

SEQ ID NO: 1701 - protein, 338 aa, Oryza sativa
  Orthologous to G1652
MDDSSFFMQWAMDTLHQLPSDSTAAAAYATDVAGDSGAFPSLQALRNASAAGGGGGFRDLTVQVDQVHRANSWSSSDSPGGGAATAAAGWSPHVTGGGGRGHRPMSWNFSAASAQPTTEDSGGGGGGGVVPAPLQAMETTATARAAVKKGGGGGSSSSAAAPGYVQDHIIAERRRREKINQRFIELSTVIPGLKKMDKATILGDAVKYVKELQEKVKTLEEEDGGGRPAAMVVRKSSCSGRQSAAGDGDGEGRVPEIEVRVWERSVLVRVQCGNSRGLLVRLLSEVEELRLGITHTSVMPFPASTVIITITAKASSLSNHPALLCLYICIKLPCVISS

SEQ ID NO: 1702 - protein, 361 aa, Oryza sativa
  Orthologous to G1652
MAYSTNQIMILQHAWMLVGEANSQLIISTVAHSWYQSNSIEVVLWWFWSRIAQTPTEYGFFGQAMACRTDEENDDDPRALEHLDPLSMQQLAESLANELFNQPQEQQEEQHGYHNPSLRVLPFVGDINKPEGHTPAAAAIRDSFFSLTNGSSSSLNFSALEQQQDSGPMTKFCSPLSEMKRGGRRATSSMQEHVIAERKRREKMHQQFTTLASIVPEITKTDKVSVLGSTIEYVHHLRERVKILQDIQSMGSTQPPISDARSRAGSGDDEDDDGNNNEVEIKVEANLQGTTVLLRVVCPEKKGVLIKLLTELEKLGLSTMNTNVVPFADSSLNITITAQIDNASCTTVELVKNLKSTLRNF

SEQ ID NO: 1703 - protein, 322 aa, Oryza sativa
  Orthologous to G1652
MSTLSNKVSLSSNLLNLQTGLAEEPEELTYMYHQEEHARMQEQFAGTPLVEQPVRFDQFYPASMAPNQFHPSHCSSFPAFGGSSALPSLAFGAVATTKKEQVQQPSPSSSNVLSFAGQVQGSTTTLDFSGRGWQQDDGVGVFQQPPERRSRPPANAQEHVIAERKRREKLQQQFVALATIVPGLKKTDKISLLGSTIDYVKQLEEKVKALEEGSRRTAEPTTAFESKCRITVDDDDGGSASSGTDDGSSSSSSPTVEASIHGNTVLLKICCKERRGLLVMILSELEKQGLSIINTSVVPFTDSCLNITITAKARLALPVYYS

SEQ ID NO: 1704 - protein, 353 aa, Oryza sativa
  Orthologous to G1652
MEDSSLFMEWAMETLQHLHPLPATPPPAGGGYAGDNATFPSLQALRESSVSQNGMAPPEPTAHEGHRASNSWSSGDTDSVSGGGGGAVMEHDGWSTSPNSVRCAAGGGGGGGGGGLWPVSWNFSSAMTQPCNDQATPSNPPTTTRARYGGGGVRYLPAAVSPSPSAQTRRASSKGNGGGGSGSSSAAPYAQEHIIAERKRREKINQRFIELSTVIPGLKKMDKATILSDAVRYVKEMQEKLSELEQHQNGGVESAILLKKPCIATSSSDGGCPAASSAVAGSSSSGTARSSLPEIEAKISHGNVMVRIHGENNGKGSLVRLLAAVEGLHLGITHTNVMPFSACTAIITIMAKE

SEQ ID NO: 1705 - protein, 254 aa, Oryza sativa
  Orthologous to G1652
MDDSSLFLHWAVSTLQHQHPAAVAVVADDDATFFSFQELCDTEEVVVVPVQEEVITEAHGAAERRRRWRRAGDGVRVTAGGRGIHHQEDLGAHGGAAAAYAQLEHVVAERKRREKINQRFMELSAVIPKLKKMDKATILSDAASYIRELQEKLKALEEQAAARVTEAAMATPSPARAMNHLPVPPEIEVRCSPTNNVVMVRIHCENGEGVIVRILAEVEEIHLRIINANVMPFLDQGATMIITIAAKASSSLLY

SEQ ID NO: 1706 - DNA, 716 bp, Glycine max
  Predicted polypeptide sequence is orthologous to G1672
agagagagtctggaatttgagctttagtcagaaaattaaaaaccaaccggattttctttttctatcctgtttctttgcttctcttttttcctctctctctctctttctctttctctctcataaaccgctacatacatgcactttttaaattagcaaaaacgtaaaggtactatatgtgtgtttgaagcagctcctatagccaccttttcctttattatttctttttctcactgccttcagttaaagtagcgagctagataggaaattctggtgtttttccatggttaaagaaggtttatagctcaatcctattagaacaacctcggacatgctcagttgtggactgttccataaaaagggagttgaaatagtatttgaaggcatctggtttcatcaagagagatagcacacgcgcgcgcacgcgccagagatgagttagatcagcaactggagttctgtaagcagctctgatctcatagatgccaagcttgaagagcatcagttgtgtggatccaagcagtgccccggttgccgacacaagtttgaagggaagcccggattggctaggcttgcccgcaggggtgaagtttgatcccacagaccaagaactaatagaacatcttgaagccaaagtggaggcaaagaacatgaaatcacaccctttgatagatgagttcattcccactattgaaggagaagatggaatttgttatacc

SEQ ID NO: 1707 - DNA, 503 bp, Oryza sativa
  Predicted polypeptide sequence is orthologous to G1672
tcttgttatctcctttgctcttctactgctcatcctcctcttctactactcgtcctctttgctctattcacagctagcaacaagaaggaggcttacacatgcatgtgcacggtctctgccggacgcatatgaatcaggcatgaatagggggcacatcagcagctcggagctcatcgacgccaagctcgaggaacgccggatctccacggccaagcactgccccagctgcggcaacaagctcgactgcaaaccggattgggtggggctaccggcaggagtcaagttcgatccgacggaccaggagttgatcgagcacctcgaggccaaagtgagggaagaaggctcaagatctcatcctctcatcgatgagttcatacccacgatagaaggggaggacggcatatgctacacccaccctgagaaacttccaggtgtgaccagggacggcctgagcaagcacttctttcaccggccgtcgaaggcgtacacgacggggacgagga

SEQ ID NO: 1708 - DNA, 602 bp, Zea mays
  Predicted polypeptide sequence is orthologous to G1672
ccttcctcctcttctcttcctctcgatctcgtttctctccaggctcggacggcacagcgcgcggcggcgtggatcccgtctccctctcctcgatccagccctctgaaccacatgcatgtgatcatgcacgggctggtatggtaaagggcgcgccgtgctgctagactcgtatgggctcttggcagcaaggagagctgcagggagcagccatggatggtgcagcggcggcggcgactggaagcggcggcggccaccgcgtcgtgggctcgaggaacgaggagcacgggaagtacctgtcggagtcgagctgctgcccacggtgcggacacaagctcgacccgaagctggactggctggggctgccggcgggggtcaagttcgacccgacggatcaggagctgattgagcacctgcaggccaaggtctggcctgcctcggcagcggcgccgtcgcaccctctgatcgacgagttcatacccaccattgaaggggaggacggcatatgctacacccatcctgagaggctgccaggtttgacgaaggacggcctgagcaggcacttcttccaccggccatccaaggcttacactaccggcactcgc

SEQ ID NO: 1709 - DNA, 2058 bp, Zea mays
  Predicted polypeptide sequence is orthologous to G1672
gccggccgggaatcctcagtcggcctttgactgctccttgacttgaacttcgcgcagcaagacggagaaacaagaaccatccctccccctaccgctgctactcatgcacgcgcgcactgcctcctggtgccgccgcgtatgatccagacatgaatagggcgcacagcagcagcagctccaagctcatcaacgagaagctcgtggaacaccggatctccactgcgaagcactgcccccactgcggcgagaaaatcgacagcaaaccggattgggtggggctgccggcaggcgtcaagttcgatccaactgaccaggagctgatcgagcacctcgaggcgaaagtgaaggatgaaggctcgagatctcaccctctcatcgacgagttcatacccacaatagatggggaggacggcatatgttacacccaccccgagaaacttccaggtgtgacgagggatggcctaagcaagcacttcttccaccggccgtccaaggcctacacgacgggcacgaggaagaggaggaagatacagacggagtgcgacgtccacaagggggagacgaggtggcacaagaccggcaagacgcggccggtgatggtgaacggccgtcagaaggggtgcaagaagatattggtgctgtacaccaacttcggcaagcaccgcaagccggagaagacgaactgggtcatgcaccagtaccacctcggcgacctagaagaggagaaggagggggagctggtggtgtgcaagatcttctaccagacgcaacccaggcagtgcagctggtcctccgaccggggcgccgccgccactgccttggcagcaacggcggcggcagcggcggcgcaggagcagcataggagggatagtggcagtggcagctgctcgtctagggaccacgaggtgtcagccacatcgttcccagccggatacacagtcaccacggccgtcgagatgcagcagcatatgaagcagcctgcggaccatttcagcttcgcgcctttcaggaaaaccttcgaccaggaggttggtataggtggtgatcaggtgccatctaatcagcttggacgttcagagccgcatcatgccggcctggggcagcagccacacggcccggtgctcgcgacgaagacggctgtgcctgctacagctttcctgatcagtaggccatcgaaccctgtctcgactatagtgccacctgcaatgcagcacgcatcagttgttctcgatcatgatcagttccatgtgccagcaatccttctccatcaccatgacaaatttcagccacaacagcaccaacagtcgcagccacaacaaaagcttgaccgcagatctgccggcttggaagaactgataatgggctgcacgtcgtccacaagcacaaaaggagatgcttccattgctcacccccaagagacagaatggccttacacgtactggccacctgacaaccaagatcatcatggatagtagcaacagggacctggtaaatagtggcgatgatgtgaatgctgaaggaacactaaccgcaaccactttcactggaatggtttttgtctgcttgaatatgcagcgttgctttcttggagaatgtacacctacaatagtggggaaagaacagagaaaaaaaacatatctctgtaaatctccctcaataaagaaatgaggataaaactagttaacagtgtgagctctccaagacagaagagacaaaatggccaacgaaaagagaagggggaaagaccgatgggaggaaaggtactgtgtgtgctgacattgaagggatcatgtgtggacagtttagatgtattagaacaccttaatcaagtataactataatcagtttacggtttatcacagttttttattcgtgctacctgttttcccaattgtaaaaactagtggcattgtttaatttgcatgtacattaacccttttaaattccttttagtttctaaattgatgctgattttcctttggttagttcatgctaatatgcatcacgaagaaataaagttagtaagaagcgcaaaaaaaaaaaaaaaaaaggccccta

SEQ ID NO: 1710 - protein, 505 aa, Oryza sativa
  Orthologous to G1672
MYTSPTLLALSFALLLLILLLYYSSSLLYSQLATRRRLTHACARSLPDAYESGMNRGHISSSELIDAKLEERRISTAKHCPSCGNKLDCKPDWVGLPAGVKFDPTDQELIEHLEAKVREEGSRSHPLIDEFIPTIEGEDGICYTHPEKLPGVTRDGLSKHFFHRPSKAYTTGTRKRRKIQTECDVQKGETRWHKTGKTRPVMVSGRQKGCKKILVLYTNFGKHRKPEKTNWVMHQYHLGDLEEEKEGELVVCKIFYQTQPRQCSWSSDRGGGAAATASAVTTAAVQQDQQRRRDSGSGSCSSTRDHEVSATSYSTAGYAVAAAVEMQHLKHAADHFSFAPFRKSFEEVGISGDQVHSNQLGRSEQQHAGQEQQPHRPLLATTTAVPATAFLISRPTNPVSNIVPPAMQHASVVLDHDQFHVPAILLHHDKFQQQQQQKLDRRSAGLEELIMGCTSSSTKGVVYTCTFRKLQFLTPKRQNGLTSHTGLLTTRIIMDSSNKAAFDMH

SEQ ID NO: 1711 - protein, 567 aa, Oryza sativa
  Orthologous to G1672
MDGVVAEDQAGGSGSGHRRLIGSRIEEHRKYMSEESCCPRCGHKIDRKLDWVGLPAGVKFDPTDQELIEHLEAKVRPGGEAAAHPLIDEFIPTIEGEDGICYTHPEKLPGVSKDGLSRHFFHRPSKAYTTGTRKRRKIQPPAAAASSGGGGGNASSSSSASAAAAVARHGHQQQQQQQRSETRWHKTGKTRAVVGGGRQRGCKKILVLYTNFGKHRKPEKTNWVMHQYHLGEAEEERDGELVVSKIFYQTQPRQCAAADAAATASASAVDRRTTSLRDRAAAAAAAAAAAAPMASANVSVAAFHGGAAGIDEFSFAQFRSSFEEAGMGASSSDHQSAMVDQRRRQQQHDDDEHDHRRGGGGHHYVGQQQSVAATFHVVSSPADPIARLMSPAAAHQGTVMLRQPEPPYIYHHQEDERPHQPRKFDGRSTSGSGLEEVIMGCTSRRSKGGETSGGKDGTEWQYPSFWPSDSQDHHGDKDDIEAKQKGETEKEKGEEKQSFSRYTFAKKYSMNKETLKISSILHSGILSESKLPENFPVCVVEGEYDEHGNAWMNLILPFSDSSKLRLM

SEQ ID NO: 1712 - protein, 567 aa, Oryza sativa
  Orthologous to G1672
MDGVVAEDQAGGSGSGHRRLIGSRIEEHRKYMSEESCCPRCGHKIDRKLDWVGLPAGVKFDPTDQELIEHLEAKVRPGGEAAAHPLIDEFIPTIEGEDGICYTHPEKLPGVSKDGLSRHFFHRPSKAYTTGTRKRRKIQPPAAAASSGGGGGNASSSSSASAAAAVARHGHQQQQQQQRSETRWHKTGKTRAVVGGGRQRGCKKILVLYTNFGKHRKPEKTNWVMHQYHLGEAEEERDGELVVSKIFYQTQPRQCAAADAAATASASAVDRRTTSLRDRAAAAAAAAAAAAPMASANVSVAAFHGGAAGIDEFSFAQFRSSFEEAGMGASSSDHQSAMVDQRRRQQQHDDDEHDHRRGGGGHHYVGQQQSVAATFHVVSSPADPIARLMSPPPAHQGTVMLRQPEPPYIYHHQEDERPHQPRKFDGRSTSGSGLEEVIMGCTSRRSKGGETSGGKDGTEWQYPSFWPSDSQDHHGDKDDIEAKQKGETEKEKGEEKQSFSRYTFAKKYSMNKETLKISSILHSGILSESKLPENFPVCVVEGEYDEHGNAWMNLILPFSDSSKLRLM

SEQ ID NO: 1713 - protein, 569 aa, Oryza sativa
  Orthologous to G1672
MLMNLCPAKCQDGRGYPPWNFLAGTGTAGWPYRSDLANPTSLQQQQQQRGDLISLPARRALLKEVIKQLSSVLLAIYIFEVHPHWINRPRVNRVSNITDSHAEKDHHSSTRPPPYAHLYSQLATRRRLTHACARSLPDAYESGMNRGHISSSELIDAKLEERRISTAKHCPSCGNKLDCKPELIEHLEAKVREEGSRSHPLIDEFIPTIEGEDGICYTHPEKLPGVTRDGLSKHFFHRPSKAYTTGTRKRRKIQTECDVQKGETRWHKTGKTRPVMVSGRQKGCKKILVLYTNFGKHRKPEKTNWVMHQYHLGDLEEEKEGELVVCKIFYQTQPRQCSWSSDRGGGAAATASAVTTAAVQQDQQRRRDSGSGSCSSTRDHEVSATSYSTAGYAVAAAVEMQHLKHAADHFSFAPFRKSFEEVGISGDQVHSNQLGRSEQQHAGQEQQPHRPLLATTTAVPATAFLISRPTNPVSNIVPPAMQHASVVLDHDQFHVPAILLHHDKFQLLFYPNIINNEHATQQQQQQKLDRRSAGLEELIMGCTSSSTKGVCFYSKHADERERERNLQYS

SEQ ID NO: 1714 - DNA, 2226 bp, Glycine max
  Predicted polypeptide sequence is orthologous to G1750
ctgaactcttgttcttctttaccgattcaacaacagctcagcagtggtagtacccatgagcctgcagaatctgcactttttttgccttggcttctattctctcctcactttgaatcggaagatatcctttccattcaaggcagcaagcagaagtttcaacgaaagtctcctctcccacacagctactatcttctcaacactattggaatcaccatcatctgaataattcccttttttctttctctttctctcacacacccccatgatgtcaaaagttgttattttctctttattcctatcatcagtcccgaccatgtcttaatatttctttctttcttctttttcaaccttttggaagatttcggtttaaccttccccttcacgattctctctccctctctccctcttattcccaaaccaagcccctatttgtgttcatttcgcgtcacattagaataagaaacgcaatatggaagacagtatcctatgcaaacacacagtgcatcacaccgttaccaagaaactcatctcccccaaaaaatcatcccaaaccaattcgacgacagagcgcagaatagtgcggatttcatacactgatccagacgcaaccgactcctccagcgacgaggaaggtttccccttcgttcgccaaagaatgaagcgctatgttaaccagattgaaatagaaaccgccgccgccgaaaaagttgttcggaaaaggcccgccggtgaggcttgccgccggccggcgaagcttcactccgggaagaagttccgcggcgtccggcagcgaccgtgggggaaatgggcggcggagattcgggatccggcgagaagagtgcgtctctggttgggaacctacgacaccgccgaagaagctgccatggtctacgacaatgccgctattcgtcttcgtggccctgacgcgttaacaaacttcgtaacgccgcctcaaagagattctccgtctccgtctccaccgccggcggcggcggagactccggcggaggtttgcgagatgaaggttgtggtcaccgaagaagcctccggctccggctacgactccagcgaggatcattgccaccacaacctctcctctccgacttcggttctccagttccgaagcaactcgagcgaagaaaattccgagtctcagcagaaagcagaacaagtgttgagagaatgcgagggtgagacagaaacgagtttgttcgaggaaacgggtgagtttttggcgctggataacatgcctttgcctgcctgggatgacgtgttcaatttcgaaacgccagagtaccctcctcttctgtttcaagaggaggagaatctgaatctacttcatcagtcccagatgttgggcgaaacggtgcagttttcctcggaggaagggttcagtgatgaaagcagtatcatgctggccgactcgctcatagatttcgacagagcctgcccttcaccatcctccttgtgccaagtggacgatttcttccaagacattttgtttgcttctgatcctctcgttctgctctgaacactcttaaaacttactaaactgtcattcgttaatcgtcaatcgtccacttcacggcttgcccaatattcatggcagatttttgcttccggtggtaaaaaaaaaatgcctagtttctatttaattaaaatactatatatatatatatatatatatatatatatatatatatatatatatagttttatttgcgtatttatttagatgttttagatgctccgttacaaatagctaacggggggatgagttgagaacttgtgagcgaagttttgtttagtttttggttatatttgtaatctttttgcttaataagtaggatcgtacgttgagacttgagaatgtaatgtatatttgtccagatgttaatctaagtgtaatggcgttcttttctttacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1715 - DNA, 1184 bp, Glycine max
  Predicted polypeptide sequence is orthologous to G1750
cgtacgcgcggtttttatccagacgccaccgactcctcctttgacgaggaaggtttccccttggttcgcaaaagaatgaagcgctatgttaaccagattgaaatagaaaccgccgcggaaaaagttgttcggaagaggcccgccggtgagccttgcaggcgaccggcgaagcttcactccgggaagaagttccgcggcgtccggcagcggccgtgggggaaatgggcggcggagattcgagatccggcgagaagagtgcgtctctggctgggaacctacgacactgccgaagaagctgccatggtctacgacaatgccgctattcggcttcgaggccctgacgcgttgacaaacttcctaacgccaccgcaaagagagtctccgtctcaggcgacaacggtggcggtgaccgaaagaagcctccggctccggctacgactccggcgacgaccattgccagcacaacctctcatctcccacttccgtgctccacttccgaagcaactcggagtctgatcagaaatcagaacaagtgttgagagagtgtgagggtgagggtgagttttggccgctgggataacatgccttctgccctggcttgggatgaagtgttccaattttcgaaacgccagagtaccctccccttctcctttcaagaagggaattttcttcatgattatcagtcccagatgttgggtgaaacgggtaccgttttcctcggaccaagggttcagtgacagtagtatcgtgctcgcagactcgctcatagatttcgacaaagcttgccctccaccatctaccttgtgccaggtggacgatttcttccaagacattttgttagcttctgatcctctcgttctgctctgaacactcttagtcagtcgactcaagttagtaaactctcattcgttaatccttcacgccagattttgcttccggtggtaaaacaaaataatgcttagtttctattaattaataaataaatttttaagtttttagatgctccgttacaaatagctaacggggggatgagttgagaacctgagagtgaagttttgtttaaattttactttattgtttgtaatcttttgcttaataagtaggatcgtacgttgagacttgagaatgttaatgtatatttgtccagatgttaatctaagtgtaatggagttcttttctttaaa

SEQ ID NO: 1716 - DNA, 1335 bp, Glycine max
  Predicted polypeptide sequence is orthologous to G1750
  misc_feature (1305)..(1306): n is a, c, g, or t
gaacatctctgtctctctctcttccttaccccttgcaataaccaccctaaaccctcccatcttctcacacctagcaaattactgccatcaacttattttccttcatcacccaccactctctatttctcacttgcttcatgcaattaaaactaccactaccacctttttccatttccttactcttttcttcaataaaatgagtgacacacaccaaactttcatgtccgtacaaccacccctgaatctccaccacccctttaacccacaagcctcaagctcaaattttgacggcgacccaccatgcaaaaccgccgcaaaaaccaaacctccgcgcaagaagctactccgggtaattctcaccgaccatgacgccaccgattctgactcctccggtgacgacgacgacccaaaaaacccaccgaaacacaaaaaggtgaaaagacaaatcacccacatcaccataaaccttccctctttctcagaagccccaactccagcaccaataccaacaccttcttcgtcttcttctattgatccgacccgtttaaccctacccaagaaacgacccgccgtgcctcgccgccgtagcaagttccgcggggtccggcagcggccatggggacggtggaccgcagaaatccgtgacccgaatcagagaaaacgggtctggctcggaacgttcgacacggcggaggaagccgccgccgtgtacgacgacgccgccttgaagctcaagggccccaacgccgtcactaacttccccctctccgccgccggaaaaacggaacatgataccgcgccgccggaggcggctttctccggcgaaggtttttcatctcccacttccgttctcacttactttgacggagactcgacgccactttacggtttccgttacggcgaggtcgacgcgttcgggtttgacatcgatgcgccgtttagtttgacagacgttaacttaggggtgctgagtcagcggttcgggaaggaagatttccgcgaggttgacccggacgagctcttgacgtggccgagttaaggggcgtatttatcatttcgaaaaaaatacagggaatgtttagtaattctaatgaagtttttttgtcgtattctgcattgaattccgaaactaccctcgtgactaagtttttgtgcagcttagtagagtgttagagagcaatagagtgatccaagtagtagtagagaattttgtcctatgttaatttgtgtaattaattgtattgttatggagaaagaggatatgatggaaagtattagaatgattctcttgtagtttcttatatnnttttataaagtaaagtattagaattaatt

SEQ ID NO: 1717 - DNA, 1813 bp, Glycine max
  Predicted polypeptide sequence is orthologous to G1750
cccacgcgtccgctctacctcccactctcacaatccctctctctctttctatcttcactccggctattacttattagcataactctcttttgctctgccttcccgccaaaacccttctctgtgatcaccaaggattcaaggttgagcgttgaattcttgaaccttgttgttgttgttgttgttgatgtgagtggagtgagatttcacttgaagcgcatccaaagttggccatattctcttctctctttctctctctctcttggaatatatctctagagacgaaaagcaaaagttgttacccataaaacatcttggtttttctttctgcttcaccaccaccaaaagtgtttccaaacgtctcaattcccccccagcatatacatctacttgtccacttttcccccataccctctaaattcttctcttactctttaaaccccacccttcatgcactccagccaacaccatcacacaacaaccttccctcttccctctctcactcaaacaaaaacatccttaaccactccaaaaacactcttttaggcatgtccgtacacgcaaaactgaagcaccaccccatgaacctagcatccccaagttcccattttgaggacgacccaccatgcaaaaccaagaccaaaacccaaaggaggctccttcggatcataatcaccgaccatgacgccaccgattctgactcctccgacgaagaacaacagcagcagcaacaaaaaacaagaagagtgaacagagaaatcacccaaatcaacatgcaacttcctctatcacataatagttccttttccccttcatcttcttattactcttcagcttccacctcatcggaacaaaacctaaagtgcaagagacccaacaaaaagccgccaccttcctccgccgaggcccgccgccgcaacaagttccgcggcgtccggcagcggccgtgggggcggtgggcggccgagatccgcgaccccacccgccggaaacgcctctggctcggaaccttcgacacggcggaggaagccgccacggagtacgacagagccgccgtcaaactcaagggccccaacgccgtcaccaacttccccctcgcgccggaggctacggcgcagtctccaccgctcgccgcggacaacctcagctccgacggcggcgcgtcgtactcggacctagtggcctcgccgacgtccgtcttggcctacgagtgcgactcgacgccgttcgacggtttccgttatctcgacgttgacgcgttcgggttccacatcgacgcgccgttaagtttgccggaagttaacgttaacgttgcgctgacgtgtcatcacgggaagaagcaggaggaggcgtttgatgaattcgatctggacgagttcatgacgtggccttactagtgataaaaatctcagggacagtttggtaaattacaccctgtttgcattgcggaagtgtgagttggaaatcccgaaattgcccccctccccctctcgttgtccaagtttgaaattttgtcgtactcgttggagctttggaagagtgtagagttgttggtacaaaattttatgtagtcgcattttactaccacctgaaacggcgattctttgtgtcgtatttggtagagtttaatttgtagttattatcatgaaaagaagaaaaaaaaaatgaagtgtcaaaactagtgagtgagaaaaggagaaaaggaaagatggtgttatttgagaaggaaggactatattgtaatttcggtatataaattttgataattatttaaagaaactttggtattgtctatatatagatcatgggttaactt

SEQ ID NO: 1718 - DNA, 1238 bp, Oryza sativa
  Predicted polypeptide sequence is orthologous to G1750
tttttgggtgtactgcaataatttgctactatattttattctaatcgaagaacatgtctatatctcacatcaaaggtcttatttagatgcaacatactaattccacaacaccttatcgaagcctaccatactgcatcacatatatcagcaaccataccgtatatacacatcataaccttaccaaatcaggtcacatgcagagtcatcttcacatcataagttcaatactaaccaaaattacacaataccaagtttccaatgatgctatgcataacaataaagctgctaacgatagtaattacggataattggaccctcaggccccgccaacttcttccacacaggcggacacagcatggaaggcacggacacgggttccacagcccgatcgcttcttacgcttgcctgaaatcatcgtccacattggctccggagcaagcacctggacctcacagctactggcctcctccttgacccgaccgccacagctctcaccttcctccttcacccgtggaagaagggtcggcttagctgtcccaattggcaaggtgattggcctcacagctgcttcaggcggtgaaatagttggcttgggtagctccagcggcagcgagtagcagcggacggaggcgaagttggtggcggcgctggaaccgcggaggcggacgctggcggcgtcgtatgcggcggcggcctcctcagcggtgtcgaaggtgccgagccacaggcggcggcggaggtgagggtcgcggatctccgccgcgaacctcccccacggccgctgccgcacgccgcggaaccgcgcggtcggcctcgcctcccccgcccccgcctccatcacgcggcgcttcacgcccccaccaccaccaccaccaccacccaccttacccctccgccgcggccgaggctgcgccaccgcaaccgcctcgtcctcgctggaggacgagtcggtggcgtcggcgtcgcgcacgaggatacgcaccacgcgtccccgcggcgccgcccccgccgccagctcgtgcaggctagggtttgtacccatgcctcgggaaacccacctcaatccatacagggtgttcgatcgatgtggctacgcgtagcctccgcgccccgccatgggagcgtggggggtggaaggcgaggtgggggggctagggtttagggttagggtttggttccgatcgatgcggcggcgtgcggcggggtgggggtgccacgggggcccgctagtttagagc

SEQ ID NO: 1719 - DNA, 1179 bp, Zea mays
  Predicted polypeptide sequence is orthologous to G1750
acccctcactcagcccgtccccttttcccccattgggtccccggaggccggccggggtcttcccgcttccagcgcacccccatcttgagtctcgccgccgcaagcttgtgtaaggtgtaaccctaaccctaaaacacttaccttcgcctccagcaccacgcttccatggaggggcgcggaggctaagtatagccaacctctacaccatatccccatggattgagcggattcccaaggcatgggtacaaaccctcacctgcaagagctggccgcttcggcggtggcggcttctgaaccaccaccgcgggcgcgcgtggtgcggatcctagtgcacgatgctgacgccaccgattcgtcctccagcgaggatgaggcaccgccacttcttcctcggcggaggtcgaggggtggtagcagcagcctgagcgtgaggcgccgtgttatggaaccggctggggcaagctcggccgttcggttccgtggcgtccgtcgtaggccgtgggggcgctgggctgcggagatccgcgacccgcacaaccgccgcagactgtggctcggcaccttcgacaccgctgaggaggctgccaacgcctacgacgctgcgaacatccgcttccgcggtgtcagcgccactaccaacttccctgcggcccgctactcgccccctccaaagccagcgaagcctatcatctcgctgactcctgaacccggaaaggtgatcaccttgccaccggtacctgtgaagccaaccttccctgttcaggtgaaggaagtgggtgggagctggggcggcctggtcaagggagctaggtcggaggtcaaggcgtttgcaccgaagccagtatggaagatgatccccagggtgcaccagaagtttccgggttgtgccgatggctctggcctgcgtgccgtccatgctgcctccatctacgtggaggaggttggcggtggctgatggtccaagtatctgcaattactatcgctagaggttttattgtctatctccatggcatcattataacctggtactgtattattttggttagtgttaaactgttgatgtggaaacctatgactcttgctgtgttatgatcggtggtaatataatgtgtatatggtgacatttggtaataaaaaaaaaaaaaaaaaaaaaaaaaaaaaaaaaaaaaaagaaaaaaa

SEQ ID NO: 1720 - DNA, 1305 bp, Zea mays
  Predicted polypeptide sequence is orthologous to G1750
  misc_feature (1300)..(1300): n is a, c, g, or t
  misc_feature (1303)..(1304): n is a, c, g, or t
ttgggtacctcgaggccggccgggctcctcagcccgttctcttttcccccaccctatcaacacaatttacccttcgtcttcccgcttccagcgcacccccatcttgagtctcgccgccgcaagcttgtgtaaggtgtaaccctaaccctaaaacacttaccttcgcctccagcaccacacttccatggaggggcgcggaggctaagtatagccaacctctacaccatatccccatggattgagcggattcccaaggcatgggtacaaaccctcacctgcaagagctggccgcttcggcggtggcggcttctgaaccaccaccgcgggcgcgcgtggtgcggatcctagtgcacgatgctgacgccaccgattcgtcctccagcgaggatgaggcaccgccacttcttcctcggcggaggtcgaggggtggtagcagcagcctgagcgtgaggcgccgtgttatggaaccggctggggcaagctcggccgttcggttccgtggcgtccgtcgtaggccgtgggggcgctgggctgcggagatccgcgacccgcacaaccgccgcagactgtggctcggcaccttcgacaccgctgaggaggctgccaacgcctacgacgctgcgaacatccgcttccgcggtgccagcgccactaccaacttccctgcggcccgctactcgccccctccaaagccagcgaagcctatcatctcgctgactcctgaacccggaaaggtgatcaccttgccaccggtacctgtgaagccaaccttccctgttcaggtgaaggaagtgggtgggagctggggcggcctggtcaagggagctaggtcggaggtcaaggcgtttgcaccgaagccagtatggaagatgatccccagggtgcaccagaagtttccgggttgtgccgatggctctggcctgcgtgccgtccatgctgcctccatctacgtggaggaggttggcggtggctgatggtccaagtatctgcaattactatcgctagaggttttattgtctatctccatggcatcattataacctggtactgtattattttggttagtgttaaactgttgatgtggaaacctatgactcttgctgtgttatgatcggtggtaatataatgtgtatatggtgacatttggtaatatgttcctgatctatgtgatgcaatgtgctgtgctttgattgtgggatcaaacctgtcatatagtagtacaatctagatcctttcacatgaacagtgatacctagatgtatttgatggttatttcagttgaattaaacaaaattgctcnccnnc

SEQ ID NO: 1721 - DNA, 365 bp, Glycine max
  Predicted polypeptide sequence is orthologous to G1756
gactgaacaagtgatcaaagcatcagaagagaaagtagctctacaaggattgaaagtcacgcgcagcacctaaatgtaaaaaaagcaagaagagccagaacaagagtgtggtgaagcaggtgacaacagcagaaggtcttgatgatgcatgggcatggcgaaaatatggacagaaaccaataaagggttcaccctatcctcgaagctattatagatgcagcagttccaaagggtgtttggcgaggaaacaggttgaaaggagccacttagatcctgcggtttttctggtaacctacactgctgaacacagccatccccacccaactcgaagaaactctcttgctgggaccactaggaagaacaat

SEQ ID NO: 1722 - DNA, 670 bp, Medicago truncatula
  Predicted polypeptide sequence is orthologous to G1765
  misc_feature (598)..(598): n is a, c, g, or t
  misc_feature (613)..(613): n is a, c, g, or t
  misc_feature (615)..(615): n is a, c, g, or t
gataactttgatgacaagaaagaagatgaagttgtgcttcctgggtttagattccacccaacagatgacgagcttgtcggattttatctacggcgaaaagtggagaagaagcctcttcgaattgaactcatcaaagagattgacatatacaaatatgatccatgggatctaccaaaagctagtactgtgggggagaaggaatgctatttcttttgtttaagaggaagaaaatataggaacagcataaggcctaatagagtgacaggatctggattttggaaagctacggggattgataaacctatatattgtgttaaagaatcacatgaatgcattggactcaagaaatcattggtttattaccgtggaagtgcagggaaaggcaccaaaactgattggatgatgcatgaatttcgtctaccacctaaaggaaaaactagcaataatcaagttcttaaccataccaatgatgttcaagaagctgaagtgtggacactatgcagaatattcaaacgaattccatcatacaaaaaatacacaccaaatgtgaaaaaagactcggaagcagcagcattcactattaactcttcaagttccnaaacatgcagcttanantcagaccacacccaaccacaattcttgactttcacaactcacacatggttgttca

SEQ ID NO: 1723 - DNA, 2780 bp, Glycine max
  Predicted polypeptide sequence is orthologous to G1777
  misc_feature (3)..(3): n is a, c, g, or t
ggntagaggtcgtttctctctcttactctctctctttctctgcgtgtgttcgtgagtggagtggcgtatgtgtagctgcgctctctatcgccggcgctctcgtcggaatttccgttattgatttttccgatcaccggattcgatccaatccctaatccctaatcccgcgattccatcaattgaaaaaattgaatagccattgaaccgtttcgtttcggaggtggcggatatggacgattacgcgagcagcgacgaggattaccattacgactccgatcaggaggactccgtcgaggcctacgaaaacgacgagaattacgccttgctctcttccaagggcaccactactaaggtgattacaaaggaatcactgctagctgcacagaaggaggatttgcgcagagtgatggacatgctatcggtgagagagcaacatgctcggacgctgcttatttttcatcgttgggatgtggagaatctgtttgaagtgttagtagacaaggggaaatcatttctctttgctgaagctggtgttagtgtggatgaacatcgcaactctgactcacctgttcctcctgcattcatgtgctacatctgtatggaggaagttcctagtagcaaaacaacgagaatggactgcggtcactgcttttgcaacggctgttggatagagcactttattgtcaagataaatgagggtcaaagtaagcgcattagatgcatggaacacaagtgcaattccatatgtgatgatgccgttgtaagaactctactcagtagagagcaccctcatatggcagagaaatatgaacgctttctgcttgaatcttacattgaagacaataagagagttaaatggtgccccagcacacctcattgtgggaatgcaatacgggtcgaggatgatgaactgtgtgaggtagaatgttcatgtggtgtacaattttgttttagttgtttgtcagaagcacactccccttgttcatgtctgatgtgggagctttgggctaagaagtgtcgagacgaatcagaaactgttaattggataactgttcatacaaaaccatgtccaaagtgtcacaaaccagtggagaagaatggtggctgtaacttggttagctgtatctgtggccaagctttttgttggttgtgtggtggagctaccggccgagagcatacttggtcaagtatagctggtcatagctgtggtcgatacaaagagcaagaaaagacagctgaacgtgcaaagagggatctatatcgttatatgcattatcataaccgatataaagctcacacagactcctttaagattgaaagtaaactgaaagagactatacaagggaagattgccatttcagaagaaaaagattctacactcagagattatagctgggtaaataatggactctccagacttttcagatctaggcgagtcctatcatattcatatgcatttgcattttatatgtttggagatgagctttttaaggatgaaatgacagatgctcaacgggaaataaaacagaacttatttgaggatcaacagcaacagcttgaggcaaatgttgaaaagctctctaaaattttggaggagccttttgaaaccttttcagatgataaggttgttgagataaggatgcagatactcaacctttcaacaattattgacaaactttgtcaaaaaatgtatgaatgcattgagaatgatctattgggttctctcaatcttggcattcatagtattgctccatacaagtcaaagggcatcgagagggcatcagaactttcatttggctggaacaacaaagtcaataatactggtaaatgccttttgtgggttttgtttgaataattagctggaccaaaacccttttgcgttagcattgccattgtttgtgatacctcctctcataatgcattaacaggaaattaagtgagcccaattttgatttcttgcttccatttttgtttcttttgttatgcattaaaatgaagaagtattacttgtagatgaggttacgtatataattatgcttatagtgcttattgtagatcttgttgttatttaccaacatggaaatatggtggcaactcataaatttatatttttagcttccttatcttattatgttatgaatgttcttatgtatgtcttcttcagtttgactttgtggatgctcatcagaaaatgtttctgagtgaaaaggattattgtatatatgctgcaagcgtaggtgtaacagaagaacttgatcgaccatctggatcagggagttcagacgataatggatgttcttctcgtaaacgtgctagaaaagagggtcttggaggtggtggtttttttgatctaaacttgccagcagagtttgtagacagaaattgactttgaaggacaccttattatacgtacaggcgtacaggtctaacaacataaaattgctttgcttgcctttggaaggaaggaattattctttttggatttcacaccccatttgctttctcatatctttcttttagccatatgtctctgctgagataagatatgtttccaaagtttcttattcctatgccatctacctttctgtttgaaatcctagcgctgtatatagataccttggcatttatttgctagtagttttatgtaaatggctaccttgaggacaacttctagggtgcttttattcctatcttatggagttattataggtggaggtaacttcactgatttttcttcccccatgtttacactattttaacttgtttaagttacaattttc

SEQ ID NO: 1724 - DNA, 965 bp, Oryza sativa
  Predicted polypeptide sequence is orthologous to G1777
ccgggctgcaggaattcggcacgaggcgccgaggaggtctccccgacggcgtctcgtcggaattggagcaggaggacgatgacgatgactgctacctgagcgatcaggaggacgacgccttggaggagtccgtcctccaggtgctggaggacgaacgcgacgaggattgccattggtcctccacctccgtgatcaccaaggaatccctcttggcggcgcaggtgattccgcgatctgagattgaagccttttccctttccttgccttggtaaaattttgtttggtttgtttgggattttgcagagggaggatcttaggaaggtgatggagttgctagggttgagagagcaccacgcgcggacgctgctcatccactacaggtgggatgtcgaaaggattttcgagctgcttgatcagaaggggagggacaggctcttctcggaggctggtatccctctccaacctgctaataatcccggctcgccctcctcaacggaggtaacctgcaatgtttgctatgacgatgtgcccctctcggacgcctccaagatggactgcggccacaactactgcaatgaatgctggacaggatatttcattgtgaagataaatgagggacaaagccgccgtatcaagtgcatggctccgaagtgcaatactatctgtgacgaagcaatagttcgtaagctagtaaatgcaaagcggccagatattgcagagcgctttgcaaggttcttgttggaatcttatattgaggacaatgatacagtcaagtggtgcccctgcacaccgcattgtggaaatgctatacgcgtcaaaggtgatattcactgtgaggtggaatgtacatgtggacgccagttttgttttaattgctcctcagaagcacattcaccatgttcctgtgtgatgtgggagctctggatcaagaaatgcccgtgacgagtcagagaccgtgaattgga

SEQ ID NO: 1725 - DNA, 2670 bp, Zea mays
  Predicted polypeptide sequence is orthologous to G1777
gccggttcatcaaaggacgccgcaaagacatcagcccagccttccccaattccggccacacccgctacgcctgtggcgccgcctgccgcctccccttcctcttcgcttcccgtgcaagcttcaccgccgccgtctccgcctcccgtcgcgatgcttccccttccgcgccgcggttcctctatccccgccttccccgcccgcgccggctcttgcacctgaccgacccaatccgcctatctgttcccctcttccgtgcgagaggtactatcgccggccgtttcgtttcggggctgatcggatcggcgtaggctgatgggccgcgacgctgaggagacctcgccgccggtgccctcgtcggaattggagcaggaagacgacgacgactgctacctgagcgatcagggggacgatgccctagaagagtccgttctccatgtcctcgaggacgagcacctcgaggactgccattggtccgcctcatccgtgatcaccaaggaatccctcttggcggcgcagagggaggatcttaggaaggtgatggagctgctagggttgagggagcaccatgcccggacgctcctcatccactaccgctgggacgtggagaggattttcgagcttctcgatcagaagggcagggatagcctcttctcggaggctggtattcctcttcagtacaccaataatgctggcccaacctcctcagcggaggtgacctgcaatgtttgttatgatgatgtgccaccctcgtgtgccttggagatggactgcggccacagctactgcagtgattgttggactgaatatttcattgtgaaaattaatgagggtcagagccggcgtgtcagatgcatggctccaaagtgcaatgctatttgtgatgaagcaataattcggaaactagtcattgcgagacacccagatattgcagaacgttttgaaagatttttactggaatcatatattgaggataatgatacagttaagtggtgcccaagcacaccacattgtggaaatgctatacgcgtcaagggcgatatttattgtgaggtggagtgcacatgtggatgccagttttgttttaattgctccttacgagcacactcaccgtgttcctgcatgatgtgggagctctggatcaagaaatgccgtgatgaatcagaaacagtgaattggataacagtaaatactaagccctgtcccaagtgtcacaaacctgtggagaagaatggtggctgcaacctggttgcatgtatatgtggacaagcattctgctggttatgtgggggtgctacaggtagagatcacacatggtcaactattagtggccacagttgtggcaggttcactgatgatcagactaagaagacagaacaagcaaggcgagacctctatagatatatgcactaccacaatagatacaaggctcacaccgactctcttaagcaggaagcaaagctaaagaatgagatccaggggaagatatccatttcagaaaataaggagtcaaagataaaagattattcttgggtcataaatgggttaaacaggctgttcagatcaaggcgtgttctttcctattcgtatccgtttgcattctacatgtttggtgatgagattttcaaggatgagatgactcctgaggaaagagaactgaagcagatttatttgaggaccagcaacaacagttagaatttaatgtcgaaagactgtctggtttccttgagaaagattttcaactttttaccgatgatgaggtcatggatacaatgaagcatgttataaatctttccaatgtggttgataggctctgcaaacaaatgtatcaatgcattgagaatgatttgttatatcctctacgcacacctcacaacattgctccatacaaatctaagggcattgacagggcctcggagctcaatattagttgggatcctggtgaacaaagttcacagtcaacaaaacatagccaggatgaacacaggaacaaacaagcatcaaatattttgggtaaacgaactcatgaattgcatggttcgagttcttctaacaagcgagagagggtagatgttaacggtggtggtggtgcactttttgatctcaacgtgccagctgaagtggtggacaagatctgaaacttcattatctgatgggtgatggcacattcctttgaactgtacagctgacttaagcttcgtcaccaacataaaggaaaaaatactgttcttttttgctgccttaccaccatagagtacctgcatgtcaaatttttaccctggtgcttggatcccaaggtatagagtagcttttaagttctatatgtcgcatttcatggcgtgatctgaagccaatgttcatagttctgatgaagttgtacccctcaagcaagatgaggatattttggaatagaaccatgcctgtgttgcaaattccagatataatgtatgcagcatggtgaaaagggaattgtttgttgacaagaatgtgggtgattatttcctggcaaatgggtggttctattgccaatgaagacaatgactgattcgtcgtattaaatgtgcactttgttgcttccggcccccccccatcttgtttctaggacagttttgtattcaacctgtgaaaatcccggttttctgggcacacattccagatttttatggctaaaaa

SEQ ID NO: 1726 - DNA, 514 bp, Zea mays
  Predicted polypeptide sequence is orthologous to G1777
cgaggtctcatgaaatatttctgaaaagcttacataagtgccgaatttgtcttagtgaaaatactggcagaaatttcatcaagctcccatgccaccatttgttttgcttgacgtgtatgaagtctcactgcagaattcacgtaacagaagggagtttaaccaagctcacatgccctgatacaacttgctgcagcccacttccaccatcagttttgaaaagcctcctgggagatgattgctataagcgatgggaatcattcgcgttacagaagctcttagatacaatgcctgatctggtatattgtccgaggtgtaatgctgcctgcttggaggatgacaatgatgctcaatgcccagagtgttttttcaccttctgctctttgtgcaaagaacgcaggcatgtggggaaggattgcgttactccagaagaaaagattaggattctgagggaaaaacaccagaaatattccctcccagaaaaacaattgttgaaagaacagagggaaatagatga

SEQ ID NO: 1727 - protein, 624 aa, Oryza sativa
  Orthologous to G1777
MVTDAEEVSPTASSSELEQEDDDDDCYLSDQEDDALEESVLQVLEDERDEDCHWSSTSVCPPTIHRFILVVFVVRVPIASVVDGFLRLQVITKESLLAAQREDLRKVMELLGLREHHARTLLIHYRWDVERIFELLDQKGRDRLFSEAGIPLQPANNPGSPSSTEVTCNVCYDDVPLSDASKMDCGHNYCNECWTGYFIVKINEGQSRRIKCMALKCNTICDEAIVRKLVNAKRPDIAERFERFLLESYIEDNDTVKWCPSTPHCGNAIRVKGDIHCEVECTCGRQFCFNCSSEAHSPCSCVMWELWIKKCRDESETVNWITVNTKPCPKCHKPVEKNGGCNLVACICGQAFCWLCGGATGRDHTWSSISGHSCGRFTEDQSKKTEQARRNLYRYMHYHNRYKAHTDSLKQEAKLKGDIQGKISISENKDSKIKDYSWVINGLNRLFRSRRVLSYSYPFAFYMFGDEIFKDEMTSDERELKQNLFEDQQQQLEFNVERLSGFLERDFQNFSDDEVMDTMKHVINLSNVVDRLCKQMYQCIENDLLYPLRTPHNIAPYKSKGLDRASELNVCWDSSEQGSSIFGKRQLGSSSNNNGRPHKRERNDAHGGAALFDLNVPAEVADKI

SEQ ID NO: 1728 - DNA, 635 bp, Glycine max
  Predicted polypeptide sequence is orthologous to G1792
gcacgagccacattggcatgcctagaagaagaggctgaggatgatgatgaagcagcagaggaataagtggcagcattagtggcaccaccagcagtcatagggtactcatcaggaaagttaaggattgcaaatggacctctcatggcataagcagctctatcataggctctggccgcttcctccgcagtgttgaaagtccccagccacaccctctgaccctgcctcgtggagtctcgaatctccgccgcgaacttcccccacggccgcctccgaaccccccggtaccggacatctccggcatcctccttagccctccccctcgacccttcttcatccatggttgcacttttggtaaggtactaatttttgtgttttttgcatgcatggtaaggtatgacaaggttggagtatatatatatggttgaaaaggcacaatctgattaggccacgcaagcattgttgccacgtgacgattagaagtttctgctattgaaaccaatgaccaatattgaaaagttcttgtgtccattgtatctggatggtcaaggtggtgggctttgcaaggtatagagattcttgtgccgcgctagcactcgctctttgaaacgccttctgcacatcgttgtttgggaatc

SEQ ID NO: 1729 - DNA, 520 bp, Glycine max
  Predicted polypeptide sequence is orthologous to G1792
ggtgaagtaccgtggagtgagaaagaggccatggggtaagttcggagcagagatcagagacccaacaaaacctacgggaaggcaatggttagggacatttgacactgctgaagaagctgctagagcttatgatcgtgcagccattgctttgaggggtgctcttgcaatccttaattttcctcatgagttccattctcatctcccttttatattatcaaattcttccactaagggaaatggaagttcttttgataaggaagttattgagttagagtatttggatgacaaggtgttggaagagcttcttgagttagaagagaagagaaggagtaacgaagactaagatcactggagtactattcattgttttgagatccccggccccttttattttctctagctctccacttgtattaatatctgaacttatgatttagggttcagattgatttccaaaaatcttccccacccattgattgaattaaattgtgtatgcttcaaaaatcttacaattaatgca

SEQ ID NO: 1730 - DNA, 517 bp, Glycine max
  Predicted polypeptide sequence is orthologous to G1792
aagaaaatggagggtggaagatcatcagtttcaaatgggatatgttgaggttcgttatagagggattagaagaaggccatggggaaagtttgcagcagagattcgtgaccctacaaggaaaggaacaaggatatggcttggaacatttgacactgctgaacaagctgcacgagcttatgatgctgctgcttttcattttcgtggccacagagcaattctcaacttcccaaatgagtatcaatctcataatccaaactcttctttgcctatgcctctagctgtgtcagctcctccttcttattcttcttcttcttccacttctaattattccggtgatgataataataaccaccttgtgagaccagctttttctggagaaataatgcaaggtggtgatcatgatgatgatacttttgagttggagtacttcgataataagttgctcgaggaactccttcagatgcaagataacagacacttctaaaagtaaaatataacacaagccagctatgttgtg

SEQ ID NO: 1731 - DNA, 527 bp, Glycine max
  Predicted polypeptide sequence is orthologous to G1792
gtcactaagcaactttactgtatttaattgtacacaggcactacataccaatttaggattaaaaagttgaaccttatcttcctaataatccaagttttcattgatggttttccccatcgcaatcaaggagttcctctaacaatttgtcatccaagcactcaaataccacaacttgtttaccaatctcagtgttagatgatgaggacttcttgctaagagaagtcacattgcaaggagggtgttcatctgggaagttgagaatggccgtagcacctctcatctcaaaggcagcacgatcataagctcttgcggcctcctcagcagtgttaaatgtcccgagccacacacgagcaccatgtctagctgaatctctaatttctgcagcaaattttccccatggtctcctacgtactcctctatacttaatttgcgttggttccccttcattgaccttttcctttaaatcctccatttctgtcacacttatgaatcccttctgtcgtcttctcgccgtacggacgcgtggg

SEQ ID NO: 1732 - DNA, 596 bp, Glycine max
  Predicted polypeptide sequence is orthologous to G1792
  misc_feature (583)..(583): n is a, c, g, or t
cgggattaaggcacacaatggaagaggagtcaaaggagaaaaagaaggacactaaggaggaaccacgttatagaggagtgcggcggcggccgtgggggaagttcgcggccgagattcgggacccggcccggcacggtgcccgagtgtggctggggacatttctcacggcggaggaggctgctagggcttatgaccgagctgcctatgagatgaggggcgctttagccgttctcaattttccaaatgagtatccttcatgctcttctatgaactcatcttcaacattagcaccttcatcttcttcttcaaattcaatgcttaaaagtgatcatggtaaacaagttattgagttcgagtgcttggatgacaaattgttagaggaccttcttgattgtgatgactatgcctacgagaaagacttgcctaagaactgaacggtttgatcaaatttgaatgttagattgatttcaaagcatacctatagtagggtgaatgtcttcatatatgatatgatttccttttaggcagcactttactttggtgagtatggtttataacttaagaatgactttgttgaaccatnttagtttgatcgt

SEQ ID NO: 1733 - DNA, 806 bp, Zea mays
  Predicted polypeptide sequence is orthologous to G1792
tgggacctcgagcggcggggccggtgcacaggaaatctctatccacagacacacaagcagccagtgcagtagtagcccggtatatagagagtgtagcacgattatacaatatatcacagagctagctagttagtatatacgtactatatatatagtctattgctcgctagcttgctgaatcaagctgaactatatagtaagagactaattaaagagctattagccacagcgcgtgatccacgattaatggaggacgacaagaaggagggcaagtaccgcggcgtgcggaagcggccgtggggcaagttcgccgcggagatccgggacccggagcgcggcggctcccgcgtctggctcggcaccttcgacaccgccgaggaggccgccagggcctacgaccgcgccgcattcaccatgaagggcgccacggccgtgctcaacttccccaccagcggaggatcagctgccgcggctcccggcggccggaccagcggcggcggctcctcctcgtccaccacgtcgtcggctccggccagcagggggagggcccgtgttcccgactcggagaaggtggagctggagtgcctcgacgacagggtcttggaggagctgctcgcggaggacaagtacaacaagaactaatgaaacgctagctgatgcacaacatacatatgttggtagtagccttattagccgccgcaacgcgctgctagctagagctagctcttcgctgccgcttccagtaaattatatttaagggagacagaactatattaactttaatatactatactcactacccaatt

SEQ ID NO: 1734 - DNA, 472 bp, Lycopersicon esculentum
  Predicted polypeptide sequence is orthologous to G1792
tgaaagaagaactaatggtggtggcggagagataaaatatcgaggcgtacgtaggcgtccgtggggtaaatttgcagcggagatacgtgactcagcacgacaaggggcacgtgtatggctagggacatttaatactgcggaagaagcagcaagagcttatgatagggcagcttattcaatgaggggacatttagctatactaaattttcctgaggagtataatttacctagtagctcttcacatttttatagtgccggttcttattcttcatcatcaatggcttcatcatcatcgtcatcgtcctcgaggcaagttcttgaatttgaatatttggatgataagttgttggaggaacttcttgattgtgatgaagagccaaactagaggaaataaagatcatttcaaatgtgacggacgcatgcaaaaaggtttcactaagaaagctcatcatttatcatatataagctcaag

SEQ ID NO: 1735 - protein, 136 aa, Oryza sativa
  G3380  Orthologous to G1792
MDGDGGGGWDDQGNGGGETTKYRGVRRRPSGKFAAEIRDSSRQSVRVWLGTFDTAEEAARAYDRAAYAMRGHLAVLNFPAEARNYVRGSGSSSSSRQHQQRQVIELECLDDQVLQEMLKGGDDQYRSAAGSKRNNY

SEQ ID NO: 1736 - protein, 131 aa, Oryza sativa indica
  G3381  Orthologous to G1792
MDHHHQQQQQEGELVAKYRGVRRRPWGKFAAEIRDSSRHGVRVWLGTFDTAEEAARAYDRSAYSMRGANAVLNFPADAHIYARQLHNNNAAAGSSSSSSAAAAAARPPPIEFEYLDDHVLQEMLRDHTTNK

SEQ ID NO: 1737 - protein, 124 aa, Oryza sativa japonica
  G3383  Orthologous to G1792
MEDNRSKDTATKYRGVRRRPWGKFAAEIRDPERGGARVWLGTFDTAEEAARAYDRAAYAQRGAAAVLNFPAAAAAGRGGGAGGAASGSSSSSSAQRGRGDKIEFEYLDDKVLDDLLDDEKYRGK

SEQ ID NO: 1738 - DNA, 2088 bp, Glycine max
  Predicted polypeptide sequence is orthologous to G1793
ttccggtccggattcccccgtccgcccccgcctccgcaagtttcgaaattgaaaagggtgggagagatacaaagtgttcattgatttaaacccttgctagaacccttggtaaagcaagcaaataagggctcaatgaacaacaactggctttcgttccctctttctcctactcattcttccttaccagctcatgatcttcaagcaactcaatatcatcaattttcccttgggttagtgaacgagaacatggataaccctttccaaaatcatgattggaatctgattaacacccatagtagcaacgaaattccaaaagtggctgattttctaggagtgagcaagtctgaaaatcagtcagaccttgcagccttaaacgaaattcattcaaatgattcagattatctgttcacaaacaacagtctggtgcctatgcaaaaccctgtgttggacacacctagcaatgagtatcaagaaaatgctaatagtaatttgcaatcattgacattatccatgggaagtggtaaggattcaacatgtgaaaccagtggtgaaaatagcacaaacactactgttgaagttgcacctagaagaactttggatacattcgggcagagaacatccatatatcgtggagtaactcgacatagatggactggaaggtatgaagctcatctttgggataatagctgtagaagggaaggccaatcaagaaaaggacgccaagtttatttgggtggatatgataaagaagagaaagcagctagggcttatgatttagctgcactgaagtactgggggacatccaccactaccaactttccaattagtaactatgagaaggaattggatgaaatgaaacacatgacgcgacaagaatttgttgctgccattagaaggaaaagcagtggtttctccaggggtgcatcaatgtatcgtggagttacaaggcatcaccaacacggaagatggcaagcaagaattggcagagttgcaggaaacaaagatctttacttgggaactttcagtactgaagaagaggctgctgaagcatacgacatagctgcgataaagttcagaggtctcaacgctgtcacaaactttgacatgagccgctacgacgtgaaagccatccttgaaagcaacactctcccaataggaggaggagctgcaaagcgtctgaaagaagctcaagctctagaatcttcgagaaagcgcgaagagatgattgcactaggatcatccacattccaatatggaaccacaagctctaattctaggctacatgcttaccctctaatgcagcaccaccaccagtttgaacaacctcaacctctgctaactttgcaaaaccatgatatcagttctcacttctctcaccagcaagaccctttgcatcagggttacatccaaacgcagcttcagttgcaccagcagcagagtggtggttcttcttcttatagctttcagaataataatataaataatgctcagttctataatggttataatcttcagaaccaccctgcattgcttcagggaatgattaacatggggtcttcatcttcttcatctgtgttggagaataataatagtaccaataataatgttggtgggtttgtgggaagtgggtttggtatggcttctaatgcaacgtcggggaacacggtggggacggcggaggagctagggctggtgaaggtggactatgacatgccgactggtggttacggtggatggtcggcggcggcggcggcggagtccatgcagacgtcgaatagtggggtgttcacaatgtggaatgactgagggaagggaagctagttctagtaatgtatggcacaacgtacgagttagttaccatacaattttgttatgcttttttcttttttttttgtttttgggttttttaatattctcgcaattggaaaagaaaataggtgctgattttctgtgactaaggaagtgagcaaagaccatatatctatttatatttatgtctcttgttatggcgaatgtttgtgagacttttgcttgatttaggtaaactaatcaaacactgacttatatgtactaatgttttatttgttt

SEQ ID NO: 1739 - DNA, 788 bp, Oryza sativa
  Predicted polypeptide sequence is orthologous to G1793
  misc_feature (322)..(322): n is a, c, g, or t
  misc_feature (423)..(423): n is a, c, g, or t
  misc_feature (441)..(441): n is a, c, g, or t
  misc_feature (483)..(483): n is a, c, g, or t
  misc_feature (493)..(493): n is a, c, g, or t
  misc_feature (495)..(496): n is a, c, g, or t
  misc_feature (502)..(502): n is a, c, g, or t
  misc_feature (504)..(504): n is a, c, g, or t
  misc_feature (507)..(507): n is a, c, g, or t
  misc_feature (511)..(511): n is a, c, g, or t
  misc_feature (513)..(513): n is a, c, g, or t
  misc_feature (515)..(515): n is a, c, g, or t
  misc_feature (517)..(517): n is a, c, g, or t
  misc_feature (519)..(521): n is a, c, g, or t
  misc_feature (531)..(531): n is a, c, g, or t
  misc_feature (539)..(539): n is a, c, g, or t
  misc_feature (541)..(541): n is a, c, g, or t
  misc_feature (546)..(546): n is a, c, g, or t
  misc_feature (550)..(553): n is a, c, g, or t
  misc_feature (555)..(555): n is a, c, g, or t
  misc_feature (558)..(558): n is a, c, g, or t
  misc_feature (563)..(563): n is a, c, g, or t
  misc_feature (565)..(565): n is a, c, g, or t
  misc_feature (569)..(569): n is a, c, g, or t
  misc_feature (571)..(571): n is a, c, g, or t
  misc_feature (575)..(575): n is a, c, g, or t
  misc_feature (584)..(584): n is a, c, g, or t
  misc_feature (601)..(601): n is a, c, g, or t
  misc_feature (612)..(614): n is a, c, g, or t
  misc_feature (617)..(619): n is a, c, g, or t
  misc_feature (627)..(627): n is a, c, g, or t
  misc_feature (640)..(640): n is a, c, g, or t
  misc_feature (645)..(647): n is a, c, g, or t
  misc_feature (657)..(657): n is a, c, g, or t
  misc_feature (659)..(659): n is a, c, g, or t
  misc_feature (663)..(664): n is a, c, g, or t
  misc_feature (666)..(666): n is a, c, g, or t
  misc_feature (673)..(676): n is a, c, g, or t
  misc_feature (683)..(683): n is a, c, g, or t
  misc_feature (689)..(690): n is a, c, g, or t
  misc_feature (692)..(692): n is a, c, g, or t
  misc_feature (694)..(697): n is a, c, g, or t
  misc_feature (701)..(702): n is a, c, g, or t
  misc_feature (704)..(704): n is a, c, g, or t
  misc_feature (706)..(706): n is a, c, g, or t
  misc_feature (708)..(710): n is a, c, g, or t
  misc_feature (712)..(715): n is a, c, g, or t
  misc_feature (717)..(717): n is a, c, g, or t
  misc_feature (720)..(722): n is a, c, g, or t
  misc_feature (724)..(727): n is a, c, g, or t
  misc_feature (730)..(730): n is a, c, g, or t
  misc_feature (735)..(736): n is a, c, g, or t
  misc_feature (744)..(745): n is a, c, g, or t
  misc_feature (747)..(747): n is a, c, g, or t
  misc_feature (751)..(751): n is a, c, g, or t
  misc_feature (754)..(755): n is a, c, g, or t
  misc_feature (758)..(759): n is a, c, g, or t
  misc_feature (763)..(764): n is a, c, g, or t
  misc_feature (774)..(774): n is a, c, g, or t
  misc_feature (777)..(777): n is a, c, g, or t
  misc_feature (782)..(783): n is a, c, g, or t
  misc_feature (785)..(785): n is a, c, g, or t
ggagctccaccgcggtggcggccgctctagaactagtggatcccccgggctgcaggaattcggcacgaggggcacatgaccttgcagcccttaaatattggggtgcagggccaaacaccaaacttaacttcaatgtttctgattatgagaaagaaatcgagaggatgaagaccatgtcccaagatgaatttttggtgtacataagaaggcagagcagctgtttctcaagaggaacttcatcatataggggtgtaacaaggcgaaaggatggtagatggcaagcacggattggtaggattggagaaagtagagacaccaaagncatctatcttggtacctttgaaacggagatagaggcagctgaagcttatgacctagctgccatcgagcttcgtggtgcccatgcttgtgacccacttttgntatttagtaacctacttntaaggttggtttttaaaaattaggagccttattagagggttncaaagttctngnngggccntncgnaggntntnantnnntttgccggtntggtaaangntcaancttnnnnantgnttttngnttantnattnctttttacnccaagttgccccttttnggttcccccgnnnatnnnttttgggntttttttcccgtntcaannntggttccccntncctnngnttggccnnnnttttttngggttnncntnnnnttcnntntntnnntnnnngntgnnntnnnntcnttatnntaaattcnntnggtnccnnccnntttnntttttttttnttnttttnncnttc

SEQ ID NO: 1740 - DNA, 549 bp, Zea mays
  Predicted polypeptide sequence is orthologous to G1793
cccacgcgtccgcccacgcgtccgcccacgcgtccgcccacgcgtccgcccacgcgtccgcggacgcgtgggtgcgcaagtacgctgccccgcggtcgtcgcgcttccacggcgtcaccaggctcaagtggagcggcaagtacgaggcgcacctttgggacaacaccagccaggtcgaaggccgcaagcgcaagggcaagcacgtgtacttaggcagctatgtcgatgaagagcaggctgcaaaggcacatgatttggctgcccttaaatattggggcacagggccaaacaccaaactgaacttcaatatttctgattatgagaaagaaattgaggttatgaagaccatgtcccaagatgaatttgtggcctacataaggagacaaagcagttgtttctcaagaggtacttcatcataccggggtgtaaccagacggaaggatggtaaatggcaagcaagaattggtaggattggtgagagtagagacaccaaagacatttaccttgggacctttgaaactgaagaagaggcagcagaagcttatgaca

SEQ ID NO: 1741 - DNA, 2006 bp, Zea mays
  Predicted polypeptide sequence is orthologous to G1793
cattgggtacctcgaggccggccgggacgtcccccggcagcagtagccccagcccccagtgccgcagttgcgctcagctatctctgctgagccgattagataaatccggcggaggaagagggaagaattatcgtgcgatatttcccccctcccactccctctctctctctctcgatttgcccgagaaatttttttggttgtttcccgcatcactctccactaggccgccgtctcccccgctggtgctcgtcgcttcctgcccaattcggcgccattcgcccggcgcactccctattaattccctgcctcggtagtcactggccgattgccacgtgaaatttcctgttccgttgcctttcgggtgcgcctgaagtacccacacgctactagggttcaatcgtcgtcagcaggcttacctctcaatcactgcggggcggcggctcgagagtttgtggacagttggcgaagagatagttaggtttttttttttgtctcccgtgtccgatggaggaatcggacttgggaggtaatctgggtaagcaaacggaagaggataaggctgcgggagaatcaggggatgagggtaagatcgagaggagccaatctatcaatctgaatagagtgccagcagttgctgtagaggcgatgagcacccagggaaactgtgagacgcacggtgcagcagtgccaggaactaaggatgcaggcacaggaaaggcagggcaatccagtggcgatcgacaggaggagaagttacccaagtgtgagcaggtcgactatggaagtgaagttgaaggctgcgcagatgatgagaaccctggcaagagggctgctttagttactttggttggaaatgaatactgcggcgacgaggatgagagagttcaagtgctcaccattgtcaagaaggacgagcatgcagatgacattgtcgaccgtattaatcctggcacagttgcagggtacagtgaagtgaagggtgctgtaggtgcttctgccgccacttctgcggtgcgacctgctggctcccgatcgtcaagtttccatggtgtgactaggcatagatggagtgggaaatatgaagctcatttgtgggacagttcttgcagagtagagggacgtagaaggaaagggaaacaagtttatctaggaagttatgataccgaggaaaaagcggccagggcttatgatgttgctgctattaaatactggggcgaaaataccagactgaactttccgatttcacaatacggcaaggagttggaggacataagggatttgtctcgagaggaatgtgtgacatacttgagaaggaggagcagctgcttttcaagaggagcttctatttatagaggagtgacaagaaggcagaaagacgggagatggcaagcacgcataggactggttgctggaactagagacatttacctgggaacattcaaaacagaggaagaagctgcagaggcttatgatattgctgccattgagatacgtggcaaaaacgctgtgaccaattttgaccgaagcaactatgtcgataagggtatgcactgtatagaaggcgaaggcttgaggctgcttgcatccaagccagaagaatgacttccaagttcaatgcagtgattgtcgatcgagcagatttggccagacgtatatgcagcttagttggtacatatacagataggagaaccggttgcagtttgtcaatattcctgctttacatgacttgggattacagttaaatcgacccgctagcaaaaaaaagtgtgcaaatgttagtagatttggccagacatatatgaagattttggggttgtatcataaggcctcgtaggatagatctttctgcaaatgttagcgaagccagtgtttatgttctgtttgctagattagcgttatcagtttgcacgttccccttttttttctgaataattgtccttgtatgatcttgagggaatgcgtttacctggtcgttcgccattcttttaaaaaaaaaaaaaaaaaac

SEQ ID NO: 1742 - DNA, 806 bp, Zea mays
  Predicted polypeptide sequence is orthologous to G1793
atcgacacgttcgggcaaaggacctctatatatcgaggtgtaacaaggcatagatggacagggcggtatgaggctcatctatgggataatagttgtagaagggaagggcagagtcgcaagggtaggcaagtttaccttggtggctatgacaaggaggacaaggcagcaagggcttacgatttggcagctctcaagtattggggcactacgacaacaacaaatttccctataagcaactacgaaaaagagctagaagaaatgaaacatatgactagacaggagtacattgcatacctaagaagaaatagcagtggattttctcgtggggcatcaaagtatcgtggagtaactagacatcatcagcatgggagatggcaagcaaggatagggagagttgcaggaaacaaggatctttacttgggcacattcagcaccgaggaggaggcggcggaggcctacgacatcgccgcgatcaagttccgcggtctcaacgccgtcaccaacttcgacatgagccgctacgacgtgaagagcatcctcgagagcagcacactgcctgtcggcggtgcggccaggcgcctcaaggacgccgtggaccacgtggaggccggcgccaccatctggcgcgccgacatggacggcgccgtgatctcccagctggccgaagccgggatgggcggctacgcctcgtacggccaccacggctggccgaccatcgcgttccagcagccgtcgccgctctccgtccactacccgtacggccagccgtcccgcgggtggtgcaaacccgagcaggacgcggccgc

SEQ ID NO: 1743 - protein, 622 aa, Oryza sativa
  Orthologous to G1793
MASADNWLGFSLSGQGNPQHHQNGSPSAAGDAAIDISGSGDFYGLPTPDAHHIGMAGEDAPYGVMDAFNRGTHETQDWAMRGLDYGGGSSDLSMLVGSSGGGRRTVAGDGVGEAPKLENFLDGNSFSDVHGQAAGGYLYSGSAVGGAGGYSNGGCGGGTIELSMIKTWLRSNQSQQQPSPPQHADQGMSTDASASSYACSDVLVGSCGGGGAGGTASSHGQGLALSMSTGSVAAAGGGGAVVAAESSSSENKRVDSPGGAVDGAVPRKSIDTFGQRTSIYRGIDGQEDMKLICGIIAVGEKAKVARGDRMSNYEKELEEMKHMTRQEYIAHLRRNSSGFSRGASKYRGVTRHHQHGRWQARIGRVAGNKDIYLGTFSTEEEAAEAYDIAAIKFRGLNAVTNFDMSRYDVKSILDSSTLPVGGAARRLKEAEVAAAAAGGGVIVSHLADGGVGGYYYGCGPTIAFGGGGQQPAPLAVHYPSYGQASGWCKPEQDAVIAAGHCATDLQHLHLGSGGAAATHNFFQQPASSSAVYGNGGGGGGNAFMMPMGAVVAAADHGGQSSAYGGGDESGRLVVGYDGVVDPYAAMRSAYELSQGSSSSSVSVAKAANGYPDNWSSPFNGMG

SEQ ID NO: 1744 - DNA, 1723 bp, Glycine max
  Predicted polypeptide sequence is orthologous to G1794
caagtttgttcactccacacaaaagcaaccatatttttcagttttcacacctaaatcctttgacccatcatcactattaatctacaagctccatgttttgtttgcaatcccctgcgtctgcttgttggtatcatcagagctttgtgaaacataaagttaaagcagggcatattgcagagggagcaaaccgaatatttcaaaacttgttctactttttattatcactgttgcatttatttcagatatttagtatttgcctacaagtttgttctttagtttaaacacagacaagacgactctttatggcggctataaccaatttgaacttttcttccttgtgtaaaaaaaggttttgtgtgcgtttgtgcgtgttggagttggctttttgaagtgggtgcatgctgaagttatatgtgtatgtgaaagatgaagaacaatagagataaagaaaagggtaacgacgttgaccagagttacagacagcatcacacgttgtcaatgccaatgatgttttctggtttgaacagagagaaggagatgtcagccatgatctctgctttgacacatgtggtttgtggagaagatgagcatcatggtgctgattactctcttcttaatcacaatattaataatactaatagtgcagttgttggtgatgatgattttactgtaacatcaaatatggcttctggttctatgccaccttcttctacttgttcatctcaaggtggcaactctgttctcaagagaagacgggaatatgataatacaaatgatttctcacgtggaggttcattccctgctatttcaacaattgctgaaagttcaagcacggtaacaagaagaacggcgaatacagtatacgattacgaatacagaacagagaacgtgaaagtagtggaggaagaaccgaggagaaaatacagaggagtgagacagaggccatggggaaaatgggctgcggaaataagagaccctttcaaagctactagggtgtggttaggaacatttgaaaccgctgaggacgcagccagagcctacgatcaagcttcattgcgtttcagaggcaacaaagccaaactcaacttccctgaaaacgttagactcagacaacaacaagaacctccgttgaacttgaaccctccaccaccacctaatcatggggctattttgtcaattccttcaaccactgttcacactgaggctcttcagggttcacttggttcaagcaatttttatgagcattcttattcgcatcttcatgagtttcccgtgagtctctacgatcagattgcagagtcaacatctactactatggcttctcatcatcttcaatttttgccgccagcttcttcctcaactatgactatgacatctccgcaggcaccaccttcgatttatcctacgcatccagcggcatggtcttctggttatagttataatagctcttcttctgcttcggggtgatgtaaattgcgttttatttcaagtctctctcgtttttgccccttgtattgtatcattgttactctcctctgttttttgcatttgcaccacgaccatttccatccaggagtggttttttgtgaccatgttattatgatcaagcaaatcatataattcacagttaacagtttagtatctgtgtataatagagttttatttatcctcccatcacatttctccaaacaaccatatcaatcttatatctcttccttcttct

SEQ ID NO: 1745 - DNA, 1023 bp, Glycine max
  Predicted polypeptide sequence is orthologous to G1794
gaaaagggtaacgaggttgaccagagttacatacagcagcaccactcgttgtcaatgccaatgatgttttcgggttttaacagagagaaggagatgtcagccatgatcactgctttgacacgtgtggtttgtggagattattctcttgttcatcacaatattgataatactaatagtgcaattgttggtggtggtggtggtgatgatgtttcaaatatggcttctggttctatgccaccttcgtctacttctttatctcatggtggcaactctgttctcaagagaagaagggaagatgataatacaagtgatttcttacgtggaggttcattccctgctattttaacaactgcggaaggttcaagcacgataagaagaagaagagcgaatacggtatacgattacgaatacagaagagagaaggtgaaagttggaggaggaagaagaagcgaggaggaaatacagaggagtgagacagaggccgtgggggaaatgggctgcggaaataagagaccctttgaaagccagaagggtgtggttaggaacatttgaaaccgctgaggacgcagccagagcgtacgatcaagcttccttgcgtttcagaggcaacaaagccaaactcaacttccctgaaaacgttaggctcagacacactgagactcttcagggttcacgtgcttcaagcaatttttatgacaactcttattcgcatgttcatgatttacccgtgagcctctacgatcagactaccatggcttcttcatcaactatatctatgacttctccccaggcaccaccttcgatttatcctacgcatctactaccggcatggtcttctggttatgcttataatagctcctcttcttctgcctgatgtaaattgctttttatttcgagtcgacataggctatacttttatctcacacaacttagtttgtcattatatctacctatgtttgacactaaactgagttttacttggaagcaacatatgaattgcttctaaaaattcatttttcgttg

SEQ ID NO: 1746 - DNA, 1850 bp, Glycine max
  Predicted polypeptide sequence is orthologous to G1794
ggctcgaggggacataccatatatacatatattatagtttagtttgcactattttaatggtggctggctaccttaattccacatgctaaaattttgcacccctttattatataaccgtttcattctctatagcatctcaaagggtgtcctgagaaggaatcacacaagagaaattttgggtggatcttggcaatttaaatttggtccaaaaatagtaagaaagaaaaccatagtttatatagttttcatgtccttgctaacggtggcgcaccaaagggggtcaggtgagtttatgcggttcacggaaagtcatggcggcggtggtggcggtgacggcgatggtgaatatggttatggacatgatgatggtagaggtggtgggggtggtggttcactagggttgaattttaaccaagtgatgcaacaaggtgaggttacaacgcaaggaggtactttggtttcagggtataacaggggtgatccagatttgagagaaatggtttccgctttgacacatgtggtggtgtcttcagggtcaggccagaggagcaccgaatggatccagcaaagtggttttcctatgatgtctgcatcttctctttcatgtttgtcttctttctcttctccttcttcttctggagcctcttgggttggccacaaaagaggcagagaagaagaagagagtagctcttcccataacatgatccaacaacaacaacaaagtgctccaagactcttcagaaacattggtgacttcatggtgccttctcaaggagactcatcttcagcgacagaagaagcccccacctccacaactacaagtgtaaccgctgtggcaacaacggttactgaaaccccacccccaccgggaggtggggaaaggaggagaaagtacaggggagtgaggcagaggccatggggaaaatgggcagcagaaattcgtgatccacacaaagcagcaagagtttggcttggcacattcgacacagaagaagcagcagcaagagcctatgatgaagctgcattgaggttcagaggcaacagagcaaagcttaacttccctgaaaatgtaagagcagttccacccattcaaccttttcaagccaccactaggctaaccgtttctgattccaccacctctcaattccggccactcgtcacggaggcgccgcccttcattcagcagccacagattcagggctcctctgacttgatcagagattacttgcaatactctcagcttctacagagtgattttcaacagcaacatatacaacatcaacagcagcagcagcggcagcagcagcagcggcagcggcagcagcggcagcagcagcagcaacaacaacaacaaccatctagtttgcttcagcagttgtactataatgcacaatttgcttcacttcaatcaccttcaatgctatcatcatctccttcattttcttcttctgtgtctccagcaccattcccattattcacaacctctgcttctttccccttgttttcaagtcaacaaatgggctatttccagccaccggaaagccgcaatcccgctggcggcgtgccggagtttccaacgtccacatggtcggataccagtagccagccaccaccttctggttgatacagtgttttagtttccttcatattttcctttttcttttttctttctttcattcttagcataaaaaaaaaagacttgttatacttatttcttttttcaagggtgaaactatgatatagttttttttaagtatttttggtactattctcgtatcagaattagagtttcagtaatttatgttgatattcaatacaaatctttattatgtaaaaaaaaaaaaaaaagg

SEQ ID NO: 1747 - DNA, 1585 bp, Glycine max
  Predicted polypeptide sequence is orthologous to G1794
ctcaaagggtgtcctgagaaggaatcacacaagagaaattttgggtggatcttggcaatttaaatttggtccaaaaatagtaagaaagaaaaccatagtttatatagttttcatgtccttgctaacggtggcgcaccaaagggggtcaggtgagtttatgcggttcacggaaagtcatggcggcggtggtggcggtgacggcgatggtgaatatggttatggacatgatgatggtagaggtggtgggggtggtggttcactagggttgaattttaaccaagtgatgcaacaaggtgaggttacaacgcaaggaggtactttggtttcagggtataacaggggtgatccagatttgagagaaatggtttccgctttgacacatgtggtggtgtcttcagggtcaggccagaggagcaccgaatggatccagcaaagtggttttcctatgatgtctgcatcttctctttcatgtttgtcttctttctcttctccttcttcttctggagcctcttgggttggccacaaaagaggcagagaagaagaagagagtagctcttcccataacatgatccaacaacaacaacaaagtgctccaagactcttcagaaacattggtgacttcatggtgccttctcaaggagactcatcttcagcgacagaagaagcccccacctccacaactacaagtgtaaccgctgtggcaacaacggttactgaaaccccacccccaccgggaggtggggaaaggaggagaaagtacaggggagtgaggcagaggccatggggaaaatgggcagcagaaattcgtgatccacacaaagcagcaagagtttggcttggaacattcgacacagaagaagcagcagcaagagcatatgatgaagctgcattgaggttcagaggcaacagagcaaagcttaacttccctgaaaatgtaagagcagttccacccattcaaccttttcaagccaccactaggctaaccgtttctgattccaccacctctcaattccggccactcgtcacggagacgccgcccttcattcagcagccacagattcagggctcctctgacttgatcagagattacttgcaatactctcagcttctacagagtgattttcaacagcaacaaatacaacaacaatcaccttctagtttgcttcagcagttgtactataatgcacaattggcttcacttcaatcaccttcagtgctatcatcatctccttcattttcttcttccgtgtcaccaacaccattcccattgttctcaacctctgctcagttttcctctgcttctttccccatgttttcaagtcaacaaatgggctatttccagctgccggaaagctgccctcccgctggcggcgtgccagagtttccgccgtccacatggtcgggtaccagtggccagccaccaccttctggttgatacagtgtctcagtttccttcatattttccttttttctctttctttcatacttacgataaaaaaatgatttgttttacttatttccttttttaaaaaaaaaaaaaaaaaaaaaaaaaaaaaaaaaaaaaaaaaaaaaaaaaaaaaaaaaa

SEQ ID NO: 1748 - DNA, 1594 bp, Glycine max
  Predicted polypeptide sequence is orthologous to G1794
cccacgcgtccgcccacgcgtccgcaaagaaggattcacacaagagaaattttgggtggatcttggtaatttaaatttggtccaaaaatagtaagaaaaaaaaaccatagttcatttaattttcatgtccttgctaacggtggcgcaccaaagggggtcaggtgagtttatccggttcacggaaagtcatggcggtggtggcgatgacgtcagtggtgacggtgaacatggttgtggacatgatgatggaagtggtgctggaggttcactagggttgaattttaaccaagtgatgcaacaaggtgaggtgacaatgcaaggtggttcattggtttcagggtataacaggggtgatccagagttgagagaaatagtttcagctttgacacacgtggtgtcttcagggtctggccagaggagcaccgaatggacccagcaaagtgggtttcctatgatgtctgcttcttctctttcacgtcggcctgctttctcttcttcttctccttctccttcttctggagcctcttgggttggccacagctgaggcagagaagaagatgagaatagtacttcacataacttgatgccacatcaccatcgaagcgctccaagactcttgagaaacattggtgacttcatggtgccttctccaggagactcatcatcagcgacagaagaagcccccacctccactgctacaactgtaaccgccgtcacaacggcggttactgaaaacccacccggtggtggggaaaggaggagaaaggacaggggagcgaggcacacgccatggggaaactgggcagcagagatccgtgatccacacaaagcagcaagagtttggctaggcacatttgacacagaagaagcagcagcaagagcctatgatgaagctgcattgaggttcagaggcaacagagcaaagcttaacttccctgaaaatgtaagagcagttccacccattcaaccttttcaagccaccactaggctaaccgtttctgattccaccacctctcaattccggccactctccgcggtggcgccacccttcattcagcagccacagattcagggctcctctgacttgatcagagactacttgcaatactctcagcttctacagagtgattttcaacagcaacaaatacaacaacaacagcagcagcagcggcagcagcaacaacaacaacaaccatctagtttgcttcagcagttgtactataatgcacaatttgcttcacttcaatcaccttcaatgctatcatcatctccttcattttcttcttctgtgtctccagcaccattcccattattcacaacctctgcttctttccccttgttttcaagtcaacaaatgggctatttccagccaccggaaagccgcaatcccgctggcggcgtgccggagtttccaacgtccacatggtcggataccagtagccagccaccaccttctggttgatacagtgttttagtttccttcatattttcctttttcttttttctttctttcattcttagcataaaaaaaaaaagacttgttatacttatttcttttttcaagggtgaaactatgatatagtttttttaaaaa

SEQ ID NO: 1749 - DNA, 1172 bp, Glycine max
  Predicted polypeptide sequence is orthologous to G1794
tctaacggcgtttggggtttttttttttttttttttttttggtagaggaataattattattattattattaattagtgtttgaaaaaaatggagagatacgataaaagacgggaaaatatagactcaataaaaacaaagaaacaaaaaaggatcatggggaggaagaagagctatgaccagaggccgaccatgggggcaactgggcagaatacaaggaagaaagtgaagtgatgttctgaggaggagaagttagagaagaggaggttgctggtggcagcggcaaagaagattgaagatgatgagaagccatggtattagaagtcagaaacatcctatgatcataaaggttggtacccgagagttgaaatgggtctgttgatgtggaaacagtgaattgaggttgtcggagagtgacattctcggggaagttgagtttggccttgctgcccctaaaacgaagggcagcttcatcgtaggctctagctgctgcctctaccgtctcaaatgttcctaaccatactcttgctgctttgaatgggtctcttatctccgctgcccattttccccacggcctctgcctcacccctctatattttctccttccctcctccttctttacattctctgttcctcttgttctgtattcgtacacagcatttcccattccactctttgaacattctgcacttgttggcatagcagggaatgatgaaggtggatgtgagaaggatggtgtatatgtatcatgttgtctacttctcttgagagaagaggtggcaacaacataagtagatgaaaagggtgttgtagaaggcatgtttggtttaacagtaacagcatcatcatcatgaggttgatgatgaagaactgaagaagaatcaccggttggaacctctccggagacaacgtgggtcaaagctgagaccatggcagacatctccctctccctattgatacccggaaacagccttgacaataatgcagggttgttcatcatcccttcatggaataatatattgtcaacctcgtttcccttcttctctttaggatttgccacctttaacaaacacgtgtaaacgcaatcaaaaagcttgttttagttagctactagatcgaatccctcgtttctgattgatgcatgcaaaagcaaaaatactaccccttcaatctc

SEQ ID NO: 1750 - DNA, 470 bp, Glycine max
  Predicted polypeptide sequence is orthologous to G1794
aaagaagattgaagatgatgagaagccatggtattagaagtcagaaacatcctatgatcataaaggttggtacccgagagttgaaatgggtctgttgatgtggaaacagtgaattgaggttgtcggagagtgacattctcggggaagttgagtttggccttgctgcccctaaaacgaagggcagcttcatcgtaggctctagctgctgcctctaccgtctcaaatgttcctaaccatactcttgctgctttgaatgggtctcttatctccgctgcccattttccccacggcctctgcctcacccctctatattttctccttccctcctccttctttacattctctgttcctcttgttctcccttctgtcgtcttctcgcagccgtacccttctgtcgtcttctcgcagccgtacccttctgtcgtcttctcgcagccgtacccttctgtcgtcttctcgcagccgtacga

SEQ ID NO: 1751 - DNA, 354 bp, Zea mays
  Predicted polypeptide sequence is orthologous to G1794
gcgggcgcggctgccatggaggagcaccaggcggcaggtgcgctgtccagttattagggtcccgagacgccgcggaggcgctaccgcggggtgcgccagcggccgtggggcaagtgggccgccgagatccgggacccgcacaaggcggcgcgcgtctggctcggcacgttcgagaccgccgaggccgcggcgcgcgcctacgacgaggccgcgctccgcttccgcggcagccgcgccaagctcaacttccccgaggacgcgcgcctctacccggcgtccaccgcgggcgcggcggcgcctctcgacgcggcggcctcgacctgcccacctgtctactccggaggcgtccagggc

SEQ ID NO: 1752 - DNA, 1130 bp, Zea mays
  Predicted polypeptide sequence is orthologous to G1794
ctttttcttaatgagatattatttattatcacgtgcgtcttcgatttagttgcaaccagaatcattatcacatgatcgatacaggattcaacaccaccacaagcaaagaagaaacacaatctcgcaacctcttctcttggatcttgcacggatgcatgcatcttgaacaaaatcatctatctatctgtgtcttctgaaccacaaaagctttgttctttgtggagtagatgggggaaaaaaaggaaggccgtgtatacgtcttatatgaaatgaaacatggagcatggactattgaggtggacgagttgacggtggatactcatactggcttgatccagaccaagaagccgtggtcgccggatagctccacgcactactctccggccagctgcctgcccactgcgccgcctcgccatagctgggagcggaggaggcagaggacgacggcacagaagccacggtaaccgtggaggcggggaaagagtaggagctgctcatggcaccaccaccagcgccagcgccagccccgccgtggccgccatagtcgtagtacagaggatacccgccatgactgctgctgctgccttggccgctggtggccccctgcagaagcatcatctggtactgcaggtagtctgcagagacgacggcggcgctggcctcctgctggtacgacccgcccgccgaggccgccacggccatcgtcgtcgtggatcccgccgccgccgccggagcgaccgcagcggatggcgccgtggtgaggcgcgcgtcctcggggaagttgagcttggcgcggctgccgcggaagcggagcgcggcctcgtcgtaggcgcgcgccgcggcctccgcggtgtcgaacgtgccgagccagacgcgggccgccttgtgcgggtcgcggatctccgccgcccacttgccccacggccgctgccgcacgccgcggaaccgccgctcgccgcccgcctcggcggcggaggccgtgggcgagtagtggccctccatggccgccgcgccctgcacgtcgtgggccgcctgctctcctcctgcgtgcgcggatagatagagatgagatgagtacactgtgcacagcactagctagctagtcgcgcacacggacacggcaccccggg

SEQ ID NO: 1753 - DNA, 636 bp, Zea mays
  Predicted polypeptide sequence is orthologous to G1794
ccgccgtcggcggtggtttcgcgagcgtggcggactccgggaagttgaggttagcgcggctgccgcggaacctgagcgccgccacgtcgtacgcccgggcggcggcctccgcggtgtcgaaggtgcctagccacacgcgcgccgccttgtgaggatcccggatctccgccgcccacttaccccacggccgctgccgcacaccgcggtaccgcctccgcggcgtgccggagccggtggaggacggcgagggggcctgcgagctagagctgggtgacgccgtcgtcgcgggaatccgtgccgctccgtgctcgtgagcggccggtgcaggaagagaggccggcggcggcggcggcgttacatctccggcgtagtagtcgctccaccactggccctcaggcgacacctgctgctgacgggcaccggccgttgccccgccagcgacgaccgtggccagcgcgtcgaccatcatggacgcctcccggctccgctcgtaccccgatagcattcgccacgccgctgccgggtgttggcggtcctagtcgtcctcctcacccccggcgccccaacgacagggccctcgtccaaccgcgaaaaccaccttgggcgcgcagcacatgaatgtagtatgtatgggcc

SEQ ID NO: 1754 - protein, 217 aa, Oryza sativa
  Orthologous to G1794
MAALFEAAETAAIVAALTRVIADGGRGGGGGVCVPPPAPSLVVPPRAGTGGGRRVDVAREEEMVGVVSAGDHAGGANVAEAAAAVVVAAPATARRYRGVRRRPWGKWAAEIRDPRKAARVWLGTFRTAEDAARAYDAAALRFRGRRAKLNFPEEVSRPWQGHDVDHMSCSPPSISNARFLGSWTFGPPQPPSRSVAAAATTLLGGSHGGNGAENGRE

SEQ ID NO: 1755 - protein, 351 aa, Oryza sativa
  Orthologous to G1794
MTVAGASELMSGYYQAQEMSTMVSALARVVAGGGGGGGDGDGDQWAWSSPSPSSSAAAAAARGVQERRREEQAMHELAGYACGGAPSPEFAGSEQSSDTQSASAATMDEHHSPVGGGGNAEGPDTPRRRYRGVRQRPWGKWAAEIRDPHKAARVWLGTFETAEAAARAYDEAALRFRGSRAKLNFPEDARLYPTAATTTTAAPPPAPVAAASPSAAIYPGASQSAEYLRYQMLLQGRLTTATPNQGTLLPFYGGGGGGGSMTNPYGGGGGGAMSGFLGSYYSFPTPSVSVATVPSSTSSAPGNYYSSHGGSHQSMSAAEEWNWENALVYPATAASWSESSYHHHPPPPHTQ

SEQ ID NO: 1756 - protein, 364 aa, Oryza sativa
  Orthologous to G1794
MADQRRRFRGGGDWQASVDDVVDDGGELEAAAAAAARGSVLSGEYQAQEMSTMVSALTWVVAAGHDDHGGGQWSGLVDVPATTLAGGGGGDYGHGAQGSYYYYGAAPTSTPEFVAGGQQEQLSSDVPQGGASLGLAMDEHSPTYTVEASSSADQHGGGGGGRRYRGVRQRPWGKWAAEIRDPHKAARVWLGTFETAEAAARAYDEAALRFRGSRAKLNFPEDARLSSPPAGAGAGGATAAAQTVPVAYPASAVSDYLQYQMLLHGGGGGGGGRYPLYYGGGAAAAMSSSLGPYSSIPTSSVTVASVPSSSSAASSSSGYGAPAEHGEAVQWTSWPDGGGWTYPATTSSWSGSSQYPPPPRPPQQ

SEQ ID NO: 1757 - DNA, 397 bp, Glycine max
  Predicted polypeptide sequence is orthologous to G1804
acgaggcaaatatcattcttccttagcttattattaaagcattatttatttttatatctctcttatattagtactgtttttctttcttatcacctcttctaggaagaagaaaaagatggtgattgaggagggcgagatgaagtcccaaggtgaggtggaatcatggctccagcaagaagcgaagaagaaccaccattctccattattctcatcttcttcatatctgggaagacaaacatcatcgatatactctctcacactggacgagttccagcacagtctatgcgagagcggcaagaacttcggctccatgaacatggacgagttcctcagcagcatctggaacgctgaagagaacagccaagccatcaccaacaacaacgtccctctgtcgtcg

SEQ ID NO: 1758 - DNA, 597 bp, Glycine max
  Predicted polypeptide sequence is orthologous to G1804
gctcggaatccggctattcggctcgatgaagctaacaatagccttgccaggaatgagccactactcaaaaggcagcaaacacttggggaaatgactttggaggatttcctagtaaaagctggggtggtacaagaatcatcatcactattcaagtcttcattactatatcaaaatcagattggtaacattgcaagtaatgggccattgagtgcaagttataggttcaggcatgtaatagggacaggatctagtgtgtcttgtaatgggcttgaaacacaaaacatgttggcacagaataacaacttagttataaaggatgtcactacaaatggtgctgtggagaaatgtccaagcttaggagaatcaagtgggaagggtaataggaagaggatcattgatggccctcctgaagtggtagtagagagaaggcagcgcagaatgttgaagaatcgagaatcggcggcgcgttctcgagcaagaagacaggcatatacagtagagcttgaagcagagctgaatctgctaaaagaagagaacgaaaagctcaaacaaactctggccgatgctgaacgcaagagaaaacacgagatttctcag

SEQ ID NO: 1759 - DNA, 1883 bp, Glycine max
  Predicted polypeptide sequence is orthologous to G1804
cttttttttttttttttttttttttttttttttttttttgtttcataaataattagattgattctggtaattaattacttatatctggcaatagtgccgaccaacgatcaaatcagtaactaaacaagggtgtggtaactggtaagcgtaaacaagatgaaatggcagcaacaatgcaataactatgttggacatttgagtaactagttatcatatgataaagaagcttccaaattggatgatctaatccttcggtgatcttgaacttgaggactcttgcagcttggctttataattaaatttcataactccgaccttttgtttctctgtttcttcaaccggctttgacttgagtagttctttagttttcttctcccctcttgatttgtgtcatgactatttcttcgtttagccacacaagtagtagatgcatcacaacaaactcttgttgtgcgtactaaaatccaagtatttcactgctaccattaccgtgcagtttcttcacaaaggacaactcatgttccttctcaaagctctcagtttctcttttgctttctgagctttggttttaacactaacgttcacttcctcaaaacactgttgttttcttcccctctcgagctcggccagcgcctgtttcagttgggagttctcttctcttaactggtttagttctgcttctaattccactgtgtatgcctgttttctggctctagatctggcagctgactctctattcttgatcatcctcctctgccttctctccaccaccttttccacaggaccatccaccaccctctttctccctctcaaaccccccatgtcaagcccaaactgccctccatcattccctatcccatcagacgaattagccggactcacaggcccacccattcccattgtgggccccaccccatacccaccaccaccacctccaaaacaatgatacccaccaccattatgatccctcttaccatacccaccagaagcctccccaacaacttgttgataacccggtgcaaccacgttactcactgcaccaacatgcctaccaacaaaagaaggagccattgcaacgttgttgttattattcgcgtaatgcggctgatgagagtgagacaccggtagtggcggtgcacacgttgtttcccgaactacaccggccttaaccaaaaaatcctccaaagtcatctcaccaaaagtgggttggcgaggggcagactcggtattatcattaagaacattgctaatgttgttgttcttgttttgttctttttgaatctgggaccaaacctcgtcaacggttttcctacaaagaggagcagggagggacagtgagggttggcgagggaggcttggctgtttccttaatattgttagggtcgacgacagagggacgttgttgttggtgatggcttggctgttctcttcagcgttccagatgctgctgaggaactcgtccatgttcatggagccgaagttcttgccgctctcgcatagactgtgctggaactcgtccagtgtgagagagtatatcgatgatgtttgtcttcccagatatgaagaagatgagaataatggagaatggtggttcttcttcgcttcttgctggagccatgattccacctcaccttgggacttcatctcgccctcctcaatcaccatctttttcttcttcctggaaattgaaattcgaaagcgaagctggtaaatgaagttccttttgtaacagtgacaagagcttattattcttatgatactgaggtgaggatgagatggatgtgtctgttgaatttgagcagccaccgcgcgagttcaaatttgtttagaacatgcaaccccaaattaataaagaggtacagtacatataagcggacgcgtgg

SEQ ID NO: 1760 - DNA, 719 bp, Oryza sativa
  Predicted polypeptide sequence is orthologous to G1804
ttttttttttttttttttttttacagatacaaactagtatactattgtataattttattcatcgttgttttgtacaaacagcgacatgtaaccatataagcagcaaggaccggtgaacacgatggcaagacatgtgggtccaggcaggtttacaagcatcacagcatatatgtatatcaactactaccataataccttcacatcacttagtctgaaagaagacttaatgtgcaaatcctcttcagagcctcagaggctagtgccacaccagaagcaggatgagtgtgccactcgccggtcaccgctatgcccgtttcaccacatgcagctgccgctgcggcgcagctgggctgccacccctatttgcattcatcttctccttggactgctccatcattttctcaaccagcatttgcttctttgtcagtagaaccgtcttctctgcctctttgagacgagcgttctcctgcttgagatagttcagttcagcttcgagctccaccgtataagcctgctttctagcacgggaccgtgcagctgactcacggttcttgatcatgcgccgttggcggcgctccaccgtcttctcggcgcagccatcctctctgtggggacgctttcttgttccattctcaatcatcatcccattcccaatacaattcatcatatcagcatgtgtcatggcactcatcccatctgatcggacgccgtgggtcgac

SEQ ID NO: 1761 - protein, 388 aa, Oryza sativa
  Orthologous to G1804
MASEMSKNVKVTDDQEVTSQERDQSGGTKVGGEEEIAPLARQSSILSLTLEELQNSLCEPGRNFGSMNMDEFVANIWNAEEFQATTGGCKGAMEEAKVVDSGSGSGDAGGSGLCRQGSFSLPLPLCQKTVEEVWTEINQAPAHTSAPASALQPHAGSGGVAANDRQVTLGEMTLEDFLVKAGVVRGSFTGQAAMGSGMVNGPVNPMQQGQGGPMMFPVGPVNAMYPVMGDGMGYPGGYNGMAIVPPPPPAQGAMVVVSPGSSDGMSAMTHADMMNCIGNGMMIENGTRKRPHREDGCAEKTVERRQRRMIKNRESAARSRARKQAYTVELEAELNYLKQENARLKEAEKTVLLTKKQMLVEKMMEQSKEKMNANRGGSQLRRSGSCMW

SEQ ID NO: 1762 - protein, 378 aa, Helianthus annuus
  Orthologous to G1804
MNMDEFLNSIWTAEENQAHTQAHPPTAATIGGGISTSAAMATNGASSSGQFLMGINANSAEPNMIARQVSLSRQGSLTLPGPLSRKTVDEVWSEIQKTRQDHQQPSNDNNSCNEQVPGAQRQPTYGEMTLEDFLVKAGVVREQNHPNAPPVPQQVPASFGLYPTNGNNRIIGPPPSSAHMVRPMLGLSTGGGASVIPPYSPLIRETPGYPGGKRAGNYQQQPPPYGGIGGNAGGVAGGYGQGLGIGSPPSPVSSDGIATTQLDSGNQYALEMGGIRGGRKRIIDGPVEKVVERRQRRMIKNRESAARSRARKQAYTVELEAELNMLKEENAQLKQALAEIERKRKQQFSEEIRMKGVTKCQKVRDKSRMLRRTSSCPT

SEQ ID NO: 1763 - DNA, 2128 bp, Glycine max
  Predicted polypeptide sequence is orthologous to G1838
ggtccggaacgcccccgtcgtcccgcgccgcccctcgcgtcgagcaacaacaccttgcatgcattctacttctcttagttctccccttaaccaaaccaaaaccacttgatctattctttttcatttaatcgaaaaataatagtaactataatatcaccaccacaccgacatggagaagaagtagctgtccgttcaaagagactagttcttcattttgcaccatttcattcatatatctcaatggctcgtgctactaactggctttcgttctctctctccccaatggaaatgctccgaacctccgaacctcagttccttcaatacgacgccgcttccgctacttcctcacatcactactacctcgacaacttgtacaccaacgggtggggcaacgggagcctcaagtttgagcagaatctcaaccacagtgacgtgagttttgttgaatcttcgtcgcagagcgtcggccacgtgccgccgccgccgccgaagctggaggattttctcggcgactcctccgccgtgatgcgttactccgacagccagacggagacgcaggactcgtcgctgacgcacatctacgaccaccaccaccaccaccaccaccaccacggttctacttcgtacttcggcggtgaccagcaggatctcaaggccattactggatttcaagctttttcgaccaactccggctccgaggttgatgattctgcatccatcggaaaagcgcaggccagcgagttcgggactcactctattgagtcctccggcaacgagttcgccgcgttctccggtggcacaaccggaaccttgtcgctcgccgttgcactgagctccgagaaggccgttgtcgcggcggagtccaatagctcgaagaagatcgtggataccttcggccagcggacttctatttacagaggtgttactaggcaccgatggacaggaagatatgaagcgcatctatgggacaatagttgcagaagggagggtcaagccagaaaagggcgtcaagtttatttgggtggatatgataaggaagaaaaggccgcgagagcttatgatttggcagctctgaagtactggggtcccactgctaccaccaacttccctgtttccaattattcgaaggaagtggaggagatgaaacatgtaacaaagcaagaatttatcgcatcattgcgaaggaaaagtagtggtttctccaggggagcttccatatacagaggtgttacaaggcatcatcaacagggtaggtggcaagcaagaattggccgtgtagctggaaacaaagatctttacttgggaacattcgcaaccgaggaggaagcagcagaggcatatgatattgcagccataaagttcagaggtgcaaacgcggtaaccaactttgagatgaatagatatgatgtggaagctataatgaagagttctcttccagtgggtggggcagcaaagcgcttgaagctttcccttgaatcagagcagaaagctcttcctgtgagcagcagcagcagcagcaatcaacagcagaatccacagtgtggaaacgtgagtgccagcatcaatttctcatccattcatcagccaattgcttctatcccttgtggaattccctttgattcaacaacagcatattatcatcacaaccttttccaacattttcaccctaccaacgctggcacagcagcgtctgctgttacttctgccaatgcaaatgcactaactgcactgccaccaacagcagcagctgagttctttatttggcctcatcagtcttattgatctaatcaaaactagaaatcatcttttgttaatttcctggttatgctaacaaatcaaaagctatagtctctggcacagtttagctgacccccctcctctattattaacccctttaggctgctaaaaaagaaaaaaaatgaggtttttgagttggctagtcttagttactgtaggaagctggatatgtaactaactgctcaagaaatgagaaatatttcgtgcatcataattttgcacaagaatttccttaatggcttatagcttgcagtggagtatgaccgcttttgtttaattgtcaatttggcttcgtgttttaaattacagtttataacattcttttgacatg

SEQ ID NO: 1764 - DNA, 1144 bp, Glycine max
  Predicted polypeptide sequence is orthologous to G1838
ccacgcgtccggggactttggtgcatttctggctgtcattaaactttttgactcttctacagtttatttgggtggatatgataaggaagaaaaggccgctagatcttatgatttggcagctctgaagtactggggtcccactgctaccaccaacttccctgtttccaattattcaaaggaagtggaggagatgaaacatgtaacaaagcaggaatttatcgcatcattgcgaaggaaaagtagtggtttctccaggggagcttccatatacagaggtgttacaaggcatcatcaacagggtaggtggcaagcaagaattggccgtgtagctggaaacaaagatctttacttgggaacattcgcaaccgaggaggaagcagcagaggcatatgatattgcagcccattaagttcagaggtgcaaacgcggtaaccaactttgagatgaatagatatgatgtggaagctataatgaagagttctcttccagtgggtggggcagcaaagcgcttgaggctttcccttgaatcagagcagaaagctcctcctgtgaacagcagcagtcagcagcagaatccacagtgtggtaacgtgagtggcagcatcaatttctcagccattcatcagccaattgcttcaatcccttgtggaattccgtttgattcaacaacagcatattatcctcacaaccttttccaacattttcaccctaccaacgctggtgcagcagcgtctgctgttacttctgccaatgcaaccgcactaactgcactgccagcatcagcagcaactgagttctttatttggcctcatcagtcttattgatctaatcaaaactagaatcaaaatctttttctaatttcctggttatgctaacaaatcaaacgccatagtctctggcacagtttagctgacccccctcctctattattaacctaaactaaaaaaggaaaaagaaaaagaaaaaaaagaggaggtttttgagttggctagtcttggttacagtaggaagctggatatgtaactaactgcttaagaaatgagaaatatttcgtgcatcataattttgcacaagaatttcctcaatggcttagcttgcagcattagtatgatcgcttttgtttaaaaaaaaaaaaaaaaaaaaa

SEQ ID NO: 1765 - protein, 490 aa, Oryza sativa
  Orthologous to G1838
MSPPTNGAISLAFPPMGPLPADALIYPFDGLSYDDFVLPVAAAPQHPLPVAVADPAPLLLLPPPSSCTCNGASSGMGAVAPRTLALGATTDGSVMTPTSWGSDGGGGGSSSARAVRSPSPVLPLVQGTGQRTSCYRGVTRHRWTGRYEAHLWDNTCRREGQKRKGRQVTTPVELFLLSVLVDWHLATNFCTLLDTLAELHSAVVPFFFLRKDYQWFHDSDTMTCCFFAFSGYDIEDKAARAYDLAALKYWGANATTNFPKESYVKEIEEMQKMSKQELVASLRRKSSGFSRGASIYRGVTRHHQHGRWQARIGRVAGNKDLYLGTFATEEEAAEAYDVAALKFRGANAVTNFEPSRYNLEAISQSDLPISVSGRRHNSSSNSNNPAPEAGGQITLMSSPPISQQSSSAPPYLIHNLLQFQPCGPPYAPPPPPPPPPPPPQALPLPGSYNFAEPVGFYWPYGDGEEQKVQLNSNMVGMASGGFLHLANAAN

SEQ ID NO: 1766 - DNA, 2043 bp, Glycine max
  Predicted polypeptide sequence is orthologous to G1841
gtgccaaaatcatctccgaggcaccaacatcggcagccacatatttctttatttattggtacagtattgtttttttcttcttcttcttcttcatttttcattaacatatatttctttttcgaagaatcaaaggtagaatctacaatattaaaaaaaactgtataagaaattaaaggtagtggtagtggagtgtgtgtctcgagccgattcggctcgaggcatggtggaagctagagtaatagaggcgcaacatggtcactgtttctgtgggggctatagccagcttctcatcatgttcgatttctcttattcttacccatcttcttatatataaatatttataataacgtgtttcagtttctttctcagaaggaatcagtatataaaacacctgctttctaacggtggcgcaccagaggggtttaggttcaggttcggggaagttcttcgcggcggagcaaggcggcgatgaggaagcggaagagagtactgaggtaggttctgttccgagccatgtggtgtcagcctctgcagcttcggcccaaaccaatcagtgggtgccgcggggaagtggttttcccatgatgtcacgttttatgcatgcgccttctcccgttctgtcttcttcgcatcctcatttgggagttggccacaagagagagcgtgaagatgacactggcgctggtgcgagtggaggtgttgctattgcagcagcttcttcacaaacgcaaacacaagagattgaaagtgctggcggcgacaggaggaggagatacaggggagtgaggcagaggccgtgggggaaatgggcggcagagattcgcgatcctcacaaagcggcgagagtgtggcttgggacattcgacactgccgaggctgcggccagagcctacgatgaagccgcattgaggttcagaggtaacagagcaaaacttaatttccccgaaaacgttgtaccggttccacctcctcctccggttcccgatttaccggcaagtgcggtagccggttccgattccatttccggttccggttcagtggtggcaggtttttcgccgacgctgatgcagggagcgccgtttcagggctcctctgcttttctgagagattattgggggtattctcagctgctgaggagtacaggggacttccatggactcgaccagtggttctttgattctcaaatggcagcgtttcaatcttcttcatcgtcgttgttgccatcgccgccgccgccgtcgttttcgccttcctctgcttcgtatcctctgttttcttccagccagcaaatggggattttccggccgccgggagagcagggtcatggcggagaagacggtggtagtgggtcagagttttcggagcttccaccttcgacgtggtcagataccagtggctatcctcctccaccacctggttgacatggaatacacatttttttctttattctattttttctctttctttggttaaagaaagaacaaggctttcttctgtttatttattttaatttatctgtttttgcttttttagattatttggagtccagttcactgaatttttatgtggttttgggttaaactgttactatttgctgctgttatttgaataaatactatttgaagagtagggagtagggaatgggaggttggaggatgcatgataaaggctttaagcctttgaggtagatacgaatggagtttaagtggtacgaggcagcactttgaagaattgtttagagataaagacaaagcagtacttaggttggaagctgagtttattccagattatcaactcaatggatttgatgttaacattttgtcaacaatccacgcaaaggtgaagaaaccaatatcttttataaaacctgttcccaataaaccaacttttttattaaggaatgacgattgagggatgtatttagaagatataatactaatttagtgtgatatgcataattttggtttttaagctggtgttaattgtttggtaagtgtattaaaatgtctaaatagtaatatttggaagtttgagtaaaaaaaa

SEQ ID NO: 1767 - DNA, 1467 bp, Glycine max
  Predicted polypeptide sequence is orthologous to G1841
attcggctcgaggttttcaaccagaccgtccttcgtcagttaactatgggctaatcacaattcaggaagcccaaaactattaaagaaaccgacaacacaaaggatttgcagaaagtgcagctacttagttccattttcatcctctctccattaactttcagtcaaaacaaaacaaaacctctttaggtgtgaaattccacgtgccaaaatcatctccgaggcaccaacatcggcagccacatatttctttatttattgaaggaatcagtatataaaacacctgctttctaacggtggcgcaccagaggggtttaggttcaggttcggggaagttcttcgcggcggagcaaggcggcgatgaggaagcggaagagagtactgaggtaggttctgttccgagccatgtggtgtcagcctctgcagcttcggcccaaaccaatcagtgggtgccgcggggaagtggttttcccatgatgtcacgttttatgcatgcgccttctcccgttctgtcttcttcgcatcctcatttgggagttggccacaagagagagcgtgaagatgacactggcgctggtgcgagtggaggtgttgctattgcagcagcttcttcacaaacgcaaacacaagagattgaaagtgctggcggcgacaggaggaggagatacaggggagtgaggcagaggccgtgggggaaatgggcggcagagattcgcgatcctcacaaagcggcgagagtgtggcttgggacattcgacactgccgaggctgcggccagagcctacgatgaagccgcattgaggttcagaggtaacagagcaaaacttaatttccccgaaaacgttgtaccggttccacctcctcctccggttcccgatttaccggcaagtgcggtagccggttccgattccatttccggttccggttcagtggtggcaggtttttcgccgacgctgatgcagggagcgccgtttcagggctcctctgcttttctgagagattattgggggtattctcagctgctgaggagtacaggggacttccatggactcgaccagtggttctttgattctcaaatggcagcgtttcaatcttcttcatcgtcgttgttgccatcgccgccgccgccgtcgttttcgccttcctctgcttcgtatcctctgttttcttccagccagcaaatggggattttccggccgccgggagagcagggtcatggcggagaagacggtggtagtgggtcagagttttcggagcttccaccttcgacgtggtcagataccagtggctatcctcctccaccacctggttgacatggaatacacatttttttctttattctattttttctctttctttggttaaagaaagaacaaggctttcttctgtttatttattttaatttatctgtttttgcttttttagattatttggagtccagttcactgaatttttatgtggttttgggtt

SEQ ID NO: 1768 - DNA, 579 bp, Oryza sativa
  Predicted polypeptide sequence is orthologous to G1841
gcacgagggagcgcgagcgcggcgacatggacgagcaccactcgccggtgggcggcggcgggaacgcggaggggcccgacacgccgcggcggcggtaccgcggggtgcggcagcggccgtgggggaagtgggcggcggagatccgggacccgcacaaggcggcgcgggtgtggctcggcacgttcgagacggcggaggccgcggcgcgggcctacgacgaggccgcgctccggttccgcggcagccgcgccaagctcaacttccccgaggacgcgcgcctctacccgaccgccgccaccaccaccaccgcggcgccgcccccggcgccggtcgcggcggcatcgccttccgcggccatctaccccggcgcctcccagagcgccgagtacctgcgctaccagatgcttctgcaggggaggcttaccaccgccacccccaaccaaggcacccttcttccgttctacggcggcggcggcggcggtggctccatgaccaatccctacggaggcggtggcggcggcgccatgagcggcttcctcggctcctactactctttccctaccccctctgtttccgtgg

SEQ ID NO: 1769 - protein, 286 aa, Oryza sativa
  Orthologous to G1841
MAAMVSALASVVAGGGGTSLPAKRPAEREPEEGAAVEGVWWSYCSELAAAAAAPSPAAPFPAGYVPSPGQHSPASAAAGDEEELPSPSSADSSGGTARKRYRGVRQRPWGKWAAEIRDPHKAARVWLGTFDTAEDAARAYDGAALRFRGSRAKLNFPEHATLPPPPTTTTAAAHRCPPPPRTDALLESQELSPGAGGGDPYSQYARFLQGSGGDGGEAAARPGGGASQRTPPATTLLYSFEGDAASAACLWQPESGGGGMGWPATSPAAWLEYGFYPPPERRDTDT

SEQ ID NO: 1770 - DNA, 652 bp, Solanum tuberosum
  Predicted polypeptide sequence is orthologous to G1852
gcgagaatcaatagccaattgagtagagagatgaatttttacagggaaagacattgtccattgcctaaggatacgcctctttgtttgattccaccgacacaaggttaccgcgttcctgttcaatggcctgagagtttgcacaagatttggcatgagaatatgccatataataaaatagctgacaggaaaggacaccaaggatggatgaaaaaggaagggccatattttatctttcctggtggtggaactatgtttcctgatggagctgagcagtatattccgatagctggtggagttttgaggaccgcccttgatatgggatgtggggtggctagttttggtggctatctactttctgaagagattttaactctctcttttgctccaagagattcacataaatcacaaatacagtttgccttggaacgaggaatacctgcatttgttgccatgcttgggacacggaggcttccttttcctgccttctcgtttgatttggttcattgttcacggtgtttgattccttttactgcatataatgcgacatacttcattgaagttgaccggttactccgccctggaggccaccttgtcatttctggtcctcccgtgcagtggcccaagcaagataaggaatggcgggatctccaaa

SEQ ID NO: 1771 - DNA, 945 bp, Gossypium arboreum
  Predicted polypeptide sequence is orthologous to G1852
  misc_feature (640)..(641): n is a, c, g, or t
  misc_feature (678)..(678): n is a, c, g, or t
  misc_feature (723)..(723): n is a, c, g, or t
  misc_feature (741)..(741): n is a, c, g, or t
  misc_feature (802)..(802): n is a, c, g, or t
  misc_feature (817)..(817): n is a, c, g, or t
  misc_feature (837)..(838): n is a, c, g, or t
  misc_feature (861)..(861): n is a, c, g, or t
  misc_feature (866)..(866): n is a, c, g, or t
ctgtctcaaactcacttcaaacacttccacttccctttctatgcaaaaaagctaaaaagtcttcaatgaatcattgaaatttaaatctaatcaaagcttcaacaaaacatgggtcacttaaatctaccaccatccaaacgaaatccgcgccaatggaaacttttggacatcgtctccgccttcttcttcgccctcgtactcttgtttttcttgttggtcttcacccctctcggcgattccttggctgcctctggtaggcaagctttgttgctttccacctccgatccaaagcaacggcatcgtttggtggagctgttggagcttggccatcatcaccagcctatcgaagcttgccctgctgattccgtcgatcatatgccgtgcgaggatcctaggcgtaatagtcagctcagtagggagatgaatttctatagagaaaggcattgccctttgcctgatgaaacgcctctttgcttgatccctcctcctcttggctacaagattcccgttcagtggcctgaaagcttgcacaagatatggcattccaacatgccacacaacaaaattgctgataggaaaggtcaccaaggatggatgaaagaggaaggtccttactttattttccctggtggtgggacanntgtccctgatggagctgcatcgtatatagagaaactnggacagtacattcccataaccggtggaactcttaagacggccctngatatgggctgtagaggntagctagtttggagggtcaatgctaaaagatgcattttgaactctcatttgctcagggatnacacaagcacaatcnaattgttagaagaggatcanncttgtctatgctggcacgcaacncattnctgcttgcttgactaatactgtctcgtgcctacccttacagtatagcacatttgtgaaggtaggtctcgccgaggatta

SEQ ID NO: 1772 - DNA, 802 bp, Medicago truncatula
  Predicted polypeptide sequence is orthologous to G1852
ggtggtttggataacccgtttaccagcctacaatgcaacttatttcattgaagtggatagattacttcgccctggtggatacctagtcatctccggtcctcctgttcggtgggctaaacaggaaaaagaatggtcagatctccaggctgtggcaaaggccttgtgttatgaacagataactgtacatgaaaacactgcaatctggaagaagccagcagcagattcgtgtcttcctaatggaaatgaatttggtcttgagttatgtgatgattctggggacctaagtcaagcttggtactttaaattgaagaaatgtgtaagtagtacgtcatctatcaaaggagattatgctattggaacaattcccaagtggccagagaggctaactgccgcaccttcgaggtcccctctcctgaaaaccggtgttgatgtatatgaggctgacactaagctgtgggtacagagggttgcacattataagaattcactaaatataaaattggggactccatcaatacgcaacgtcatggacatgaatgcattatatgggggttttgcagctgccttaaaatttgatcctgtgtgggtgatgaatgtagttccagctcaaaagccgccaactcttgatgcgatctttgacagaggacttattggtgtctatcatgattggtgtgaacctttttcaacatacccctcgacttatgatctgatccatgcagtcagcatcgaatcacttataaaagatccagccactggtaaaaaccagatgtatattggtgatttgatggtggaaattgatcga

SEQ ID NO: 1773 - DNA, 592 bp, Glycine max
  Predicted polypeptide sequence is orthologous to G1852
  misc_feature (543)..(543): n is a, c, g, or t
ggagagcttgcacaagatatggcacagcaacatgccatacaacaagattgctgacaggaaaggtcaccaaggatggatgaagcttgatggtcctcactttatattccctggaggtggcacaatgtttccagatggagcagagcagtatattgaaaaacttggtcaatacattccaatgaatggcggtattctgaggactgctcttgatatgggatgtggggttgccagttttggaggatatttgctagctcaaaacatattaaccatgtcttttgctccaagagattcacacaaatcacagattcaatttgcacttgaaagaggagtaccagcttttgttgccatgcttggtactcgcagacttccatttcctgcatttggctttgacttagtccattgttcccggtgtttaatcccttttacagcctacaatgcatcttatttcattgaagtggacagattacttcgccctggtggatatttagtcatttctggtccccctgttcagtggcctaaacaagataaagaatggtctgatctccnagctgtggcaagagctttgtgttatgaattgattgccgtagatggtaac

SEQ ID NO: 1774 - DNA, 547 bp, Lycopersicon esculentum
  Predicted polypeptide sequence is orthologous to G1852
tgtgtgactaggacttcatcttccaaaggagaatttgccattgggaaaattccaaaatggccagcgaggctgatgaaagctccttcgagggcaattgtaactaaaaatggagtggatgtgtttgaagctgactcaagaagatgggcgcggagagtcgcacattataagagttcattgaacttgaaactaggaacttcatcagttcgtaatgtcatggacatgaatgcattttttggaggatttgctgcagcattatcatcagacccaatctgggtgatgaatgttgttccagcacaaaagcctttaacacttgatgtcatttatgacagaggccttattggagtttaccacgactggtgtgagcctttctcaacatatcctcggacttatgatctgattcacgtgggagccatagaatctctcataaaggatcccgtttccggcaagatcaggtgcagccttgtcgatttgatggtggaaattgatagaattcttcggcctgaaggaactgttataattcgggactctcctgaagtgatagacaaag

SEQ ID NO: 1775 - DNA, 572 bp, Pinus taeda
  Predicted polypeptide sequence is orthologous to G1852
  misc_feature (431)..(432): n is a, c, g, or t
  misc_feature (460)..(461): n is a, c, g, or t
  misc_feature (469)..(471): n is a, c, g, or t
  misc_feature (498)..(499): n is a, c, g, or t
  misc_feature (525)..(526): n is a, c, g, or t
  misc_feature (556)..(561): n is a, c, g, or t
  misc_feature (565)..(566): n is a, c, g, or t
  misc_feature (569)..(571): n is a, c, g, or t
gaacctcctcagcatgctgtagacataaagaattttttggatatatttaaagctgacacacggagatggcaaaggagagtgacatactataagaatgtgctgaatctgaagttaggatcttcaagtgtacgcaatgttatggatatgaatgcaggttttggtggctttgcagcagcacttattgcagatcctgtctggatcatgaacgttgttcctacttatacaacaaatactcttgctgtgatttatgacagaggccttattggagtttatcatgactggtgtgaggccttctcttcttaccctcgaacatatgattttattcatgcaattagcattgattctctaataagagatctgagtagaggtggaaacagatgtagtcttgttgatttgatgattgaaatggatagaattctccggcctgaagnnactgttgttgtccgggatactcctaagnncattgatnnngttgcaaagattgcaagtgcaatacgnnggagtacagaagtttatgacactganncagagtccaatcgcaaagagaaattgctannnnnnaccnngcnnnt

SEQ ID NO: 1776 - DNA, 440 bp, Lotus japonicus
  Predicted polypeptide sequence is orthologous to G1852
gtacttcaaattgaagaaatgtgtcagtaggacatcttctgtcaaaggagaatattctattggggtgatccccaagtggccggaaaggctaactgctccacagcctaggtccacactactgaaaaatggtgctgatgtatatcaggctgacactaggcgatggttaaggagggttgcgtactataagcattctctaaacatgaagttggggacttcatctgtacgcaacgtcatggacatgaatgcattctttgggggttttgcggcagcattaatatctgatcctgtgtgggtaatgaatgtagttccagctcgcaagccgtccactcttgatgtaatctttgacagagggcttattggagtgtatcatgattggtgtgaacctttctcaacatatcctcgtacctatgatctgatccacgtgtccagcattgaatcac

SEQ ID NO: 1777 - DNA, 613 bp, Gossypium hirsutum
  Predicted polypeptide sequence is orthologous to G1852
atccctttcacagcttataatgcaacttatttcattgaagtggatcggttactacgtccaggtggatatttggtcatctctggtccccctgtacagtggcctaagcaagataaagagtgggcagatctccaggctgtggcaagagcattgtgctatgagttgattgctgtggacgggaacacagtcatttggaaaaagcctgatggagattcgtgtctgccgaaccaaaatgaatttgggcttgaatcttgtgatgaatcaaatgaccccagtaatgcatggtactttaagttaagaagatgcgtgacgtcaacgtcttctgggaatggagaatatcctggtgggattattccgaagtggcccaaacggcttaccagaacttctttcaggccttgggcttgaaaaacgggatggatttgttcgggcagaccagggaggtggacatggagagttgcctattataagatactctgaatctgaagctgggagtcagcagtcgcaatgtatggacataagcattttggagtttgcacacactgtttaatcatttgggatgaagtgtctgctgagcatacttgtgaatttgcaagcttatgattcagatgtggaactc

SEQ ID NO: 1778 - DNA, 575 bp, Solanum tuberosum
  Predicted polypeptide sequence is orthologous to G1863
tggatatggttaccagccgccatttacggcggtgcaatggcaggagctggagcatcaagcaatgatatacaagtacttggtggcaggtcttcctgtgccacctgatcttgttgttcctattcgtcgtagctttgaagccatctcagctaggttctttcatcatcccagcttgggctattgttcctattatgggaagaaatttgatcctgagccaggaaggtgtagaaggactgatggaaagaagtggagatgctcaaaagatgcatatcctgactccaaatattgtgagcggcatatgcatcgaggccgcaaccgttcaagaaagcctgtggaatctcaatctacttcccagtccttgtcgactagtatgtcacaaattacaactgggagcagcaatacaagaggaagtttccaaaatagcagcagcggaagcttccaaaacatgccattatattctgttgctaattcagggaattatggaagcactgcaacaaagctgcagatggagcctgtctcctatggaatagataacaaggactataggtatctccatggaattactcctgatgctgatg

SEQ ID NO: 1779 - DNA, 710 bp, Medicago truncatula
  Predicted polypeptide sequence is orthologous to G1863
tcccggcacacaattaacaccaaaccaaaacggaccaaatggttccttccgacaaagctcgatctgagtctggtctctgactgaacaacaactacaagtgtatgttgtgttagctagatagatagatagatacactattgattcactcactcactgagagttacagtacaaagcagttagaaaaagtatgaatagctctgggggtggcagtagtaacggaggaggtgtagggatgatgatgggttacagtaaatcatcaccattcacagtgtctcagtggcaggaacttgaacatcaagctttgatctttaaatatatggttgctggtcttcctgttccacctgatcttgtccatcctattcattccagctttcactctctttcttctaataatttctttcaccaccctattcctaccttgagttactgttccttctatgggaagaaagtggacccggagccaggaagatgtaggaggactgatggaaaaaagtggaggtgctcgaaggaagcatacccagactccaagtactgtgagcgccacatgcaccgtggccgcaaccgttcaagaaagcctgtggaatcacaaactatggcacagtcgacatccactgtgacatcgctgactgtcgctggtggcagcagcagagctggtaacttccagaacattcccacaacaaatgcatttggtagtgttcaaaatactacag

SEQ ID NO: 1780 - DNA, 466 bp, Lycopersicon esculentum
  Predicted polypeptide sequence is orthologous to G1863
atgtgggagatgagtatggcggctgagaatgggtacagaccgccgttcacggctgtgcagtggcaggaattggagcatcaagctatgatatataagtatttggtggctggtattccggtgccggcggaccttgttgtgcctatacgacgtagctttgaacccatttcagcaaggttctttcatcatcctagcttggggtactgttcctattatgggaagaagtttgatcctgagccaggaaggtgtagaaggacagatggaaagaagtggaggtgcgccaaagatgcatatcctgactcaaagtattgcgagcggcacatgcatcgaggccgcaaccgttcaagaaagcatgtggaatctcaatcgactgcccagtccttgttgactagtatgtcacataatactactgggagcactactgggagcagcaaaacaagcggcaatttccaacgtaacagcagtgaaa

SEQ ID NO: 1781 - protein, 396 aa, Oryza sativa
  Orthologous to G1863
MMMMSGRPSGGAGGGRYPFTASQWQELEHQALIYKYMASGTPIPSDLILPLRRSFLLDSALATSPSLAFPPQPSLGWGCFGMGFGRKAEDPEPGRCRRTDGKKWRCSKEAYPDSKYCEKHMHRGKNRSRKPVEMSLATPPPPSSSATSAASNSSAGVAPTTTTTSSPAPSYSRPAPHDAAPYQALYGGPYAAATARTPAAAAYHAQVSPFHLHIDTTHPHPPPSYYSMDHKEYAYGHATKEVHGEHAFFSDGTEREHHHAAAGHGQWQFKQLGMEPKQSTTPLFPGAGYGHTAASPYAIDLSKEDDDEKERRQQQQQQQQHCFLLGADLRLEKPAGHDHAAAAQKPLRHFFDEWPHEKNSKGSWMGLEGETQLSMSIPMAANDLPITTTSRYHNDE

SEQ ID NO: 1782 - DNA, 465 bp, Glycine max
  Predicted polypeptide sequence is orthologous to G1880
gagatctgcaaccagggattccagagggaccagaaccttcagatgcaccggcggaggcacaaggtgccgtggaagctgttgaagagggaaacgccggtggtgaagaagagagtgtttgtatgcccggagcctagttgtttgcaccatgacccatgccatgctctgggtgatcttgttggaataaagaagcacttcagaaggaaacacagcaatcacaagcaatgggtctgcgagagatgctccaaaggctatgcggtgcagtccgattacaaagcacatctcaaaacttgtggcacccgaggacactcttgcgattgtggccgcgttttctcaagggtggagagcttcattgagcaccaagacgcgtgcaacgtggggaggttggggccagaaacacagccacagccacagacacagacaccggcagtgcaagctgctgcatgcttggctcgaacagcttcaagc

SEQ ID NO: 1783 - DNA, 1118 bp, Glycine max
  Predicted polypeptide sequence is orthologous to G1880
gcacaaggtgccatggaagctgttgaagagggaaactacagcggtggtgaagaagcgagtgtttgtatgcccggagcctagttgtttgcaccatgacccatgccatgctctgggtgatcttgtcggcataaagaagcatttcagaaggaaacacaacaatcacaagcaatgggtctgcgagagatgctccaaaggctatgcggtgcagtctgattacaaagcacatctcaaaacttgtggcacccgaggacactcttgcgattgtggccgcgttttctcaagggtggagagctttattgagcaccaagacgcgtgcaacgtagggaggctggggccagaaacacaatcacaggcacaggcagtgcaagcagctgcatgcttgtctcgaacagcttcaagcgaaacccatttcagcactggttccccttggccacaaagcggtactataataattccaaatcccaccgttacggtagtagaaccctcctcatacaccattgtcactgccgaaaccaacaacaaagtccaccccaacctggagcttcagctctctaataccactcctactgcatcatcacaggaagaaagggttcatcaagagcagttgaggattgcgaaggcgaagaaagcgttggcggaagaggcaaggaagcaagccaagaggcaaatcgaactggccgaacttgagttcactaacgccaagaggataagacaagaagcgcttgcggaacttgacaaagcctatgccttcaaggaccatgcaatcaaacacatcagttcaatcatgcttcaaatcacttgccgagcttgcaagcaccattttcattcgccaaccgacgaccaaatcttctcctacataacacaagctcgccaagtacaaaaacatcgtctcaaacccattattaattaactcttaattagacgacatcgatcccttccttcttttactattactactatgtcaagtgagtgctatggttatgtacgtgtgggattaatagccagctagcgaggtggtggaaaaaatgtgggttattattaatgtaaatgtaaattagttgcagcttgtgccatgttatttaaatgccccctatcatatgatgagcaggttttgctgg

SEQ ID NO: 1784 - DNA, 598 bp, Medicago truncatula
  Predicted polypeptide sequence is orthologous to G1880
ataggcttattctattctaatatatcatatactttatatatcaaattttcttgcttaattttgctatattgagtttagttaccatgttagctaatagcttatctccatcttcacttccatcttctgagcctttttcttgcaatgaaaatggcacttcttccactaataaaaggaaaagaagacccgccggaacaccagatccagatgcagaagtggtgtctctctcaccaaaaacattgttggaatcagatcgttatgtatgtgagatctgcaaccaaggattccaaagggaccaaaatttacagatgcatagaagaagacataaggtaccatggaagctattgaagagagaaacaccagttgttagaaaaagagtttttgtttgtcctgaaccaacttgtttgcaccatgatccttgtcatgctttaggtgatcttgttggtatcaaaaaacattttagaagaaaacatagttaatcataaacaatgggtttgtgaaagatgttccaaaggttatgcagtgcaatctgattataaagctcatctcaaaacttgtggtacatagaggtcattcatgtgatttgtggtcgtgttttctc

SEQ ID NO: 1785 - protein, 420 aa, Oryza sativa
  Orthologous to G1880
MVFDHGARVYVDPDAEVVALSPRTLLESDRYVCEICGQGFQREQNLQMHRRRHKVPWRLVKRPAAATAAEDGGAAGGGGGAGGGAGGGGARKRVFVCPEPSCLHHDPAHALGDLVGIKKHFRRKHGGRRQWVCARCAKGYAVQSDYKAHLKTCGTRGHSCDCGRVFSRKITRSLNLYSDIANYLRMKYIISLSNIAIKVESFIEHQDACNSGRVRGEVVPVATTLPVIRPAALRHHHHHPPPPPPELQLLPASTTAPLAAAFSSNSTTTGSSSHEQHATTMTTTKLQLSIGPAAVVAAASGGGGACAAAAGGEEEQQREEVRRALEEKTAADAARERAREEAAAAERALEDARRARHRARGELEKALALRDHAARLIAQVTCHACRQRSLAVMSMAAIDGHGASAVAREHLRGGGVGAGI

SEQ ID NO: 1786 - DNA, 1244 bp, Glycine max
  Predicted polypeptide sequence is orthologous to G1902
  misc_feature (4)..(4): n is a, c, g, or t
agcncggagggggctcgaggaggatgcaagacccaacagcattccaaggagtgaagccaccccagtttcctgaacaagaacaactcaagtgtccacgttgtgactccaacaacaccaaattctgctactataacaactacaacctctcgcagccacgccacttttgcaagaactgcagaaggtactggactaaaggtggcgctttgagaaacatccctgttgggggtggaagcagaaagaccacaaaacgttcttcatcaaccttatcaaaacgctcttctgcaccatcttcttcctctgcagtttcggatcctgacccgacccggatttgcaccaacccggttgatcaagaccaaagggtgctcaacattggtggtggcagtttcagttcccttctagcttcatctgggcacttcggaaccctcttggagggtctgaatccatctgggtcgggtctcaaaatgggtgaatttgtggagggcgtgagttctgacccgggtctgaatctggtttcgggtctaaacccgggtttgcaggtgcagagtactaatgggaggtcagagagttttctaggtttgcagaatggtgattcaagctgttggaatggtacccatggctggtctgatcttgcaatatacacacctggcccaagttttcaatagaagcttggtgatacaagtttgaggcttttcggcttaaatgcttaatccagcttctcgattatggtgattggtcttatatatataatatatacttaaatactattgttgtgttttttcctggttatagaaaagtttagtggagtttgatcttgggaaattcataacaggtttcaccgttcaaaaagcacttaatgtacaggatattcaaattcacattcttgtgaaatatgaattctatcttgtcaactggatcaatcttcgttcatatttactatatgattatgtaaagagttatataatttgatcaagcctatggagagcatgctatggaggatcatacatacaccagaatgtcactgaagcagcatcctttaggtaaagatttttttttctttcaatagtttatatgctcgtgattggtgtttttcaaacttaccacttgtgaaaatttggggaaaaaaaaggcattttttttgtgaggatggctcggaggatgtgagatgttattatcatatgtaatttggtatgtgtttttgcatagcttttgaagtgtcctcggatatatggaagtttacattgaca

SEQ ID NO: 1787 - DNA, 1485 bp, Glycine max
  Predicted polypeptide sequence is orthologous to G1902
gggagattttctgtttctatttgaaggctgcggagtgcggtagagtcatctcgttacaaactcgggccggatcatttcatctccatcaacctctccaacaaaataaatatccctttaccctattttctcgaatcttgtttgctatctcctgactccggctaaatccttgccttttcagccagttttcctccgtcttcccaacctcaatcacacttatccatcacaccccatgtaacaactttctgtctctagctttgagctttttctttttcttttttcttcaaacacaaaacaactttctggaattagttacttctactctcaataaagtttttttttttttttttttttatcatcagcttcatttattagtattttggtcggttctatatccttcctttttctttttgtcttctttccactttcccctcactttgttgtgagatcttgacaacaaagtgcgtgcttgaaaactgaagtcccttttaggaatacgagaatgcaggatccaacgttgttccaacccatgaaaccccactttccggaacaggagcagcttaaatgcccgcgctgtgactccaccaacaccaagttctgctactacaacaactacaacctctcgcagccacgccatttttgcaagaactgcagaaggtattggaccaaaggtggtgccttgagaaacatccctgttggtggtggaagcagaaagaacacaaagcgatcatcttcatccaacaacaacaccaaacgcgcttccccatcacccccagtttcctctgcacccgctccagaacccgaccctacccggattggccccaccccggttgttggtggcgggagtttcagttcccttttggcatcaagtggccatttgggcctggggaacctcttggagggtctgaattcaagtgggtctaatctgaaaactgtgcaaatggaagagtttggggagaatgttagttcgggtccggttgcggatccggattcgggtcggaatcccgggttggagatgcaaagcaatgggaacgcagagaattttctgagtttgcaaaatggtgattcaagctgttggaatggtactagtggttggtctcaccttgctattttcactcctgggtcaagctttcagtaatgacaaattaatgaatatgattactctgatctgtatatttagacatatgtcgtactattatggaggatcacaaaccagaaggcccctgctataggatcattaggtaaagtttctcctgttttggatttttatatttgtgaattgtggttggtgttcttcagctatatcaatgatggaagagaaatggaaagcaagtcatattttagggcagggtatggggggtatatgaatgttgttgtagtgagattgttttcagtctcatcacgtagaggaagtgttgccatggcttggagattctaatttatttaatctatatatgtgtattttacacgcgcagtttgtcaaaaaaa

SEQ ID NO: 1788 - DNA, 684 bp, Glycine max
  Predicted polypeptide sequence is orthologous to G1902
gagaatgcaggatcaacgttgttccaacccatgaaaccccactttccggaacaggagcagcttaaatgcccgcgctgtgactccaccaacaccaagttctgctactacaacaactacaacctctcgcagccacgccatttttgcaagaactgcagaaggtattggaccaaaggtggtgccttgagaaacatccctgttggtggtggaagcagaaagaacacaaagcgatcatcttcatccaacaacaacaccaaacgcgcttgcccatcacccccagtttcctctgcacccgctccagaacccgaccctacccggattggccccaccccggttgttggtggcgggagtttcagttcccttttggcatcaagtggccatttgggcctggggaacctcttggagggtgtgaattcaagtgggtgtaatctgaaaactgtgcaaatggaagagtttggggagaatgttagttggggtgcgggtgcggatccggattgggggggaatgccggggtggagatgcgaaggagtgggaacggaggggattgtgtgggggggagatgggggtgcaagctggggcgatggggccaaggggggggggggacttggtgttgtggctggtaggggaagctgtggggcgggcgggtgggggcgagggcggtgggggggggggggggggggtgggggg

SEQ ID NO: 1789 - DNA, 1063 bp, Zea mays
  Predicted polypeptide sequence is orthologous to G1902
cctcgaggccggccggggctagcgatcagctgaaactgaaacagcccgtcatctaccattcgcccgccgcaacgctccctgctcggaacagcctgcgttgctcgcccacacgacgccacgcatgcaggaggagccagggcgtcgtcccgtgccgccgttcgcgggcgtggacctccgccgccccaagggctaccccgtggcggttgccaaggaggaggagaggccggcgccgggcggcgacccgtgcccgcggtgcgggtcgcgggacaccaagttctgctactacaacaactacaacacgtcgcagccgcgccacttgtgcaagtcgtgccgccgctactggaccaagggcgggtccctccgcaacgtccccgtcgggggcggcacgcgcaagagcagcagcagcagcagctcctcatcatcctcggcgacgacgacgtcaacctcgcccggcgccgcgcccaaggccacgaagcggtcgaagaactccaagcgccgccgcgtcgcgcctgccccggaccccgccgcgcccggcacggacgcctccaccgccgacgtcgcgagcacggcaccgtccgcagcgacggtgactgcctcggagaagccgagcgcgacggagcacgcagcggcggctgtcgccacggagaagccgccggccgcgcttccggtgtccgtcggcgctttcgcggacacgtccccggcgccagatgctgggagcggcggcgttagggagctgctgccgcacccgagccgcttcgagtggccgtcgggctgcgacctggggccgccctactggggctggggcaccagcgtgttcgccgacaccgacccggcgctgttcctcaatctgccgtgagtgacccgtgacaacgccatggcgcccatggttaactaatcaaccatgatcacacggtcgacgagatgagaggaacagagcacgcagtgcgtcgggctcttgaagctaggcgctgtagtagtctcctaagcttactgttgtctagaccgatagtctcgcgtacttgtgtagttgtgttgatggtttttaatcgccgctttgtactgc

SEQ ID NO: 1790 - protein, 215 aa, Oryza sativa
  Orthologous to G1902
MEVAEGRTVAAAAAGGGGLGGGARTEAEGLACPRCESTNTKFCYYNNYNLAQPRHFCKACRRYWTRGGALRNVPVGGGTRNKVAPAPCTGRRKRAAHAAHAAAPPPTTTASSAPLPLMPPAVAYELPFLPPPPPLPLAAVDPDRRLLDLGGSFTSLLAPAQLHNGHFTTGFLLGTMSSAPPPPPPPATSTPSPAPAAHPPVSDSIWAMGWPHLSI

SEQ ID NO: 1791 - DNA, 2582 bp, Glycine max
  Predicted polypeptide sequence is orthologous to G1927
aaaaaccgaaaaccctcgcaattccccgcgtcacgcgtttctttcctttcaagactctctctctcgctctagttttttcgttccgcgactcagcctttcgaatcctctcacccagagttagggtttttaactctattcgatcggcgatttcgaatactcggaggctcgaatcgtgttgggggttttccgttttgattaaaaaagtttccgttttttgtgttgggtgatcaagggttgtttgatttttttcttgcgatcgagaatgggtgaggcttcgggagctggttccgctgattgtttcagccagatgatgtcgtcgatgccgggttttcgcttccatcccacggatgaggagttggtgatgtactatctgaagcggaagatttgtgggaagaggctgaagctcgacgtgattcatgaaaccgatgtgtataagtgggatcccgaggatttgcctgggcaatctatattgaaaacgggagataggcaatggttctttttctgtcacagagataggaaatatcctaatggtggaaggtctaaccgagcaaccagacgtgggtattggaaagcaacaggaaaggatcgtaacgtgatatgcaattctaggtcagttggagtgaaaaagaccctggttttctacgcaggcagagctcctagtggtgagcggactgattgggttatgcatgaatacaccttggatgaagaggagcttaagagatgccagggtgttaaggactattatgcactttacaaggtttacaagaaaagtggacctggtcctaaaaatggtgaacagtatggtgcaccatttaatgaagaagagtgggcagatgatgacatagtagattttaatattaactcagctgatcaggaggctccaaatgatgttgctgataatggtaatgtaccgctgcctttgcttgatgatgaaatcgacaacatcattaggggaattttggatgatgagcttgtccttgatcagcagcatgtgaatggttatcctgactttcctcaggttgttagtgaagaaacacaaagtactgttgtggatcagttctctgaggctgtgatgttccctgagccagtcagaatcacacagcctagcaaccaattttttgatgcacagcctagctttgacttcaatcggccagttacttctcatctgcatgtttctgaaacatctgaggtcacttctgcttccaacattaaaacaaaggagcttgactttaatgaggatggcttcttggaaattaatgatctcattgatactgaacctacattgtcaaatgttgaaaattctgtggagtaccagcattttgaagatgggttaagtgaacttgatttgttccaagatgcacagatgtttcttcgtgacttggggccaattattcatgaaacagattcacatgcatatacaaatgcccttgtcagcagcaatattgaatgtcaaagttaccaattgctgccaaatccagaggatgccaatcaaactgttggtgaattctggatgcatggtgaaagtaatcagctatcatccccaggtgttgtatatgaatctgttggctttcctacggaaggcaataacaatcaaagtagcactgtggaagatgttgctacaagtagcttgtcctctgctctctgggcctttgttgagtcaatacctactactcctgcatcagctgctgaaagtgcattggtgaaccgagctttgaatcgaatgtctagcttcagcaggttgaagatcaagcacaccaacattgctgcatcaggtaaagacactggaactatgaagagagctggcagaaagggacttccattccttttcttctctattcttattgctttatgtgctttttgttgggtttttgttggaaacttaagactagtaggtagaagtatttctccttgaatatatttatgtaaatccaaagttttgctgctaggtattttgtctgggacctcccagaatgactgttgtctgggatctccccagaattaccaaacagtgctgtcctaacatattctcaaaataaaaaaaaatctttgtgaatactggaggcaatataaggtgtagggtaattctaatgaaccttaattcaagagaaggcgctgtaaaggaatttgcagggtgaattgctaacttgattcataaaaactttagcaagtttttatgcttgtctaatcttatttttggataagtttatttagtttgttctttttggccccatgtaatatattgttctttattaacccggagagcactttattttggagattgattgtacatggataagatcttatcttgtggaatctgtctttgtatttgtaatgatcttttgttggttgtaacttgtaagttgtaacgcctgcattagcattagattaatattgttcgataaataaacatgtgtcctgaataaccggtatgcaactatggatcgagaaccggttatttcatcgacctgcacaattcttgaaactggtgagtagaaaatgggtcaagaatcgactaaaatttgtcaggtctgggtatatttgaaatttatatgtggattattatgagagttacttattattac

SEQ ID NO: 1792 - DNA, 490 bp, Oryza sativa
  Predicted polypeptide sequence is orthologous to G1927
  misc_feature (374)..(374): n is a, c, g, or t
cggacgcgtggggtgccagtcaccaacccattccggcggcggcggcggaggagaccgagatggggagggagaacccgccgctccggtggccgccggggttccgcttcagcccgaccgacgaggagctcgtcctctacttcctcaagcgccggatcgccaccggccgccccaccccctacatcgccgacgtcgacgtctacaagtcccacccctcccacctccctgagaggtcggcgctgcggacgggggacaagcagtggttcttcttcagccggatggaccgcaagtaccccaacggctcgcgggcgagccgcaccaccggcgagggctactggaaggccaccgggaaggaccgctccatctgcaacggcggnggcggcggcaccgcctcggggcgcgcggtggggagcaagaagaccctcgtgtaccaccacggccgcgccccgcgcggggagcgctcggactgtgtcatgcacgagtacaccctcct

SEQ ID NO: 1793 - DNA, 858 bp, Zea mays
  Predicted polypeptide sequence is orthologous to G1927
  misc_feature (45)..(45): n is a, c, g, or t
  misc_feature (61)..(61): n is a, c, g, or t
accctgacccctgaccatggaagaaacaggctgtgcttcagaaancaactccggatccatntcaaaatctgacagtggttgatcaagaccctcaatcggaagctcacggtcagtaattgcatgctcctccattgtagatggtgggctgttggtgttaggaacaggattagcggctgcacccgcaatcactctctcatcgtcgtcatccaaccaatcctcctctcgaaagggagcaccgtactgttcgccgttctttggcccggccccgctcttctggaacagcttataaagcgcgtagaactcccgaccctgcgcagcaggcgggagcgcatcggcaagtagggtatactcgtgcatgacccagtccgtacgctccccgcgcggggcgcggccatggtggtacaccagcgtcttcttgttgccaaccgcccggccgccgccgcagatgaagcggtccttccccgtggccttccagtagccgtcgccagtggtgcggctggcgcgcgagccgttggggtacttgcggtccatccggctgaagaagaaccactgcctgtcccccgtctgcagcgccgacctctcggggaggtgggaggggtgtgacttgtacacttcgacgtcggcgacgtagggagaggggcggccggaggcgatccggcgcttcaggaagtagagaacaagctcctcgtcggtggggctgaagcggaagcctggcggccaccggccccgcggcggggtctccatctcgctctcgccggatggttggtgctggtggcgtgtcgtctgccgggtcaacccgatgctccggctacttatgctaaagacatctcaaggggctgccggttctgccccggccgg

SEQ ID NO: 1794 - DNA, 674 bp, Lycopersicon esculentum
  Predicted polypeptide sequence is orthologous to G1927
agcttcagattcattgattaaggggatattctatggatttctgaagtgggtgttgagattattttgtggttgtgaagaaagatgaagcttttgatggattcatcagcaccatcatcatcatcatcgccatgtaaagagatgaaggtatcggagtgttttggagaaaatagtgttttcccacctgggtttaggtttcatccgacagacgaggagcttgttctgtactacttgaagaggaagatctgtcggcgccggattttgcttgatgcgattgcggagactgatgtgtacaagtgggagccagaggatttgcctgatttgtccaagttaaaaactggggacaggcagtggttcttctttagtcccagagatcgaaaatatcccaatggagcacggtcaaacagggcatcaaagcacgggtattggaaagctactggaaaagatcgtattattacatgcaactctcgtgctgttggagtgaagaagacgctggtcttttataaagggcgagcgccagtaggtgaacggacagattgggtgatgcatgaatacaccatggatgaagaagagctgaagagatgccaaaatgcacaggactactatgcactttacaaggtcttcaagaagagtgggcctggccccaagaatggtgagcaatatggtgcaccttttag

SEQ ID NO: 1795 - DNA, 479 bp, Oryza sativa
  Predicted polypeptide sequence is orthologous to G1930
ccccgggctgcaggaattcggcacgagagcatcgccaacagaaggaagcaagagatagttcgagtcgagttgagttgcatccgtacgtactggggtagaggagagtaggagtgtgctagtgtgtgaggtctactgaaatggacagctccagctgcctggtggatgataccaacagcggcggctcgtccacggacaagctgagggcgttggccgccgcggcggcggagacggcgccgctggagcgcatggggagcggggcgagcgcggtggtggacgcggccgagcctggcgcggaggcggactccgggtccgggggacgtgtgtgcggcggcggcggcggcggtgccggcggtgcgggagggaagctgccgtcgtccaagttcaagggcgtcgtgccgcagcccaacgggaggtggggcgcgcagatctacgagcggcaccagcgggtgtggctcggcacgttcgccggggaggacgaa

SEQ ID NO: 1796 - DNA, 1881 bp, Glycine max
  Predicted polypeptide sequence is orthologous to G1944
ttatttttttaatctcaatttggacagtccgttaggaaagttaggaacccaattacctgaacaacaaaaacaaaggattcattttatctggccattttcatttcccttggaaactcaaaatatttcaaatttcactctttctttctgcacaatattttcccatctatttttttcttcttctcaaaactcacatattagtattttctcccacaaaatttcagctcataatttttatttttcgatttcatccaatcctgctaatttatttttaatgacgaaatttacgcaaatggtgcaaaggtgaagattttccacatcttgtttcatgcccagctcctcaagctagcttttaattttgatttttctcatttcctggcttaaatttttcatcttttctaaaagaaaaaaaatcatttcccagcagcatagcatagtagtagaagttttgggtgattgagtttgaagaagaagaaaaaatatgagatattgatgtgtggttttactttatgttacgtgtgagtggtactacttctcaagtgtttgaacatggagaccagtggcggtgttagcggcggcgttacgctggtgggatcggatgctccgtcggactaccatgtagctccgaggaccgacaacccggctccggcaagcggatccacgacgcagattccggcgacggcgggaagtgttccgccgtcgccacatccgccacacacggcggcgatggaggcgtatccggcgaagatgccggcgaaaaagaagaggggccggccgagaaagtacgcaccggatgggtcggtgaccatggcgctgtctccgaagccgatatcttcctccgctccgttgccgccggtgatcgatttctcgtcggagaagcgcggaaaaataaaaccaactagctccgtgagcaaagccaaattcgagttggagaatttaggtgaatgggttgcatgctcagttggtgctaattttactccccatatcatcactgttaattctggggaggatgttactatgaaggtaatatcattttctcagcaagggccgcgagctatatgcattctttcagctaatggtgtcatatcaagtgtcacacttcgtcagcccgattcttctgggggcacattgacatatgagggacggtttgagattctgtcattgtctggctcattcatgcccaatgaaagtggaggaacacgaagcagatccggtggcatgagtgtatctttggctagccctgatggacgtgttgtaggtggcggagtagctggtctgttggtggctgcaagtcctgtgcaggtagtggtaggaagttttctggcaggaaaccaacatgagcagaagccaagaaaacagaaacacgaggttatatcaagtgtgacaccagctgcagttgttccaatctctacacttgatccagtatcaattctatcagcagcgtcttccatccgcaacgataattggtctgctatgccggcagaggccaaggataagccagctgacattaacgtgtcgcttcctgcagggtaattaacttatatagggcttcattccatctgaatttacatttgctgctgacaacattgtaatgggatggattcctagttgttggctttgatttccgttgtttgttgtgtctgtaattgttgactgtgtaccgggaccagcattgttttcagaggtttaccagcttcctgttcttgtagaatttgagttggctgattaggtatgcttttaatgctgatgttgtgacatgaacaacactttgatgtgatagttattcatgagaatccatcttccctttggagtgatagattgcgcaatccacgttatttctattaagacaatattcctaatttgagaatgatcatttataatctt

SEQ ID NO: 1797 - DNA, 1534 bp, Glycine max
  Predicted polypeptide sequence is orthologous to G1944
tttctcaaaactcacatattagtattttctcccacaaaatttcagctcataatttttatttttctgtttcatccaatcctgctcatttatttttaatgacaaaatatacgcaaatggtgcaaagttgaagattttccacatcttgtttcatgcccagctcctcaagctagcttttgattttgatttttctcattttctggcttaaatttttcatctttttctataaaaaaaataaaattcccagcagcatagtagtagaagtttttggtgattgagtttgaagaagaagaagaagcaaaaaaaaaaaaaaagagagatattgatgtgtggttttactttatgttacgtgtgagtggtactacttcacaagtgtttgaacatggaggccagtggcggtgttagcagcggcgttacggtggtgggatcggatgctccgtcggactaccatgtagctccgaggaccgacaacccggctcccgcaagcggatccacgacgcagattcctgcgacggcggggagtgctctgtcgccgtcacatccccctcacacggcggcgatggaggcgtatccggcgacgatgccagcgaagaagaagaggggccggcccgagaaagtacgcaccggacgggtcggggaccatggccgctgtctccgaagccgatatcttcctccgctccgttgccgccggtgatcgatttctcgtcggagaagcgcgggaaaataaaaccagctagctccgtgagcaaagccaaattcgagttggagaatttaggtgaatgggttgcatgctcagttggtgctaattttactccccatatcatcactggtaattctgggggggatgttactatgacggtaatatcattctctcagcaaggaccgcgagctatatgcattctttcagctaatggggtcatatcaagtgtcacacttcgtcagcccgattcttctgggggcacactgacatatgagggacggtttgaaattctgtctttatccggctcattcatgccaagtgaaagcggaggaacacgaagcagatccggtggcatgagtgtatctttggcaagccctgatggacgtgttgtaggtggtggagtagctggtctgttggtggctgcaagtcctgtgcaggtagtggtaggaagttttctggcaggaaaccagcatgagcagaagccaagaaaacagagacatgaggttataacaagtgtgataccagctgcagttgttccaatctctacccttgatccagtgccaattctatcagcagcgtcttccatccgaaacgataattggtctgctatgccagcagaggccaagaataagccagctgacattaacgtgtcgcttcctgcagggtttgtctttatgtagataaatgtgccgtgaagctgggtttggcatttgctttgaattattttaattttgtcaacggccataatcttcgggcacgtaacctcaatctattgtcttgtatatatataaatgtttcttgaaccttggtttgacacccgttggtttgcaatagttt

SEQ ID NO: 1798 - DNA, 1100 bp, Zea mays
  Predicted polypeptide sequence is orthologous to G1944
tgtcggccgccgcgcccaccccggcggtggtcgtgtccgcgccgacgcccgcgctgcactcgccgctcgggccactcggtgaactggtagcttgtgcttctggtgccaactttacaccacatattattaatgttgctgctggtgaggatgtcagcatgaaggtcatatctttctcccaacaaggtccaagggctatttgcattctatctgccaatggagttatcgcaaatgttacactgcgtcaacaagactcattaggtggtacagttacttatgagggtcggttcgagctgctctccctgtccggatctttcactcccactgatagcggcggcggcaccagaagccgctcaggtgggatgagcgtgtccttagcagccgccgacggccgcgtcatcggaggcggagtcgccggcctcctcgtggccgccagccctgtccaggtcgtggtgggaagcttcctcccgagctaccagctggaccagggcgccaacaagaagccggtgatagagatcacgacagtgccgccggcgcccgtcgggttcaccatctcaagcggggacatggacgacgcgtacagcggcagccagcatccaaggtcggcggcggcgaaagggggctcgaccaccacggcactgttcaaggtggagaactggacggcgcccgtgcccgcgcccgatcaggcgaggaaggcgccggcgccggcgccggaggccaaagtccccgtccccggaggctgaagccgacatcctctacctagctagccggccgaccgtcgatcgatcaggccctgcagcttgttgggaatccagtaattcgtgatccttgtaaccgacgccgtcttagtacagaagtggatcagtatgaatcacccgctgttcatcattaattaggtgtcgacattttcccggtttatatatgtgtggagcttcattacccattgtttaaataacggtgtatgtatactggttagcagtaatacagtcgtcgtagcacagtgcccatttcttctccccccccctgaaacatcaaacaagtaatatacacagcatgtagtgtagtgccttttctgtcagaaaaaaaaaaaaaaaaaagcggcc

SEQ ID NO: 1799 - DNA, 759 bp, Glycine max
  Predicted polypeptide sequence is orthologous to G1944
  misc_feature (5)..(7): n is a, c, g, or t
  misc_feature (612)..(614): n is a, c, g, or t
  misc_feature (668)..(670): n is a, c, g, or t
  misc_feature (685)..(685): n is a, c, g, or t
  misc_feature (695)..(698): n is a, c, g, or t
  misc_feature (708)..(713): n is a, c, g, or t
  misc_feature (738)..(739): n is a, c, g, or t
  misc_feature (753)..(755): n is a, c, g, or t
cattnnnatatatacaagacaatagattgaggttacgtgcccgaagattatggccgttgacaaaattaaaataattcaaagcaaatgccaaacccagcttcacggcacatttatctacataaagacaaaccctgcaggaagcgacacgttaatgtcagctggcttattcttggcctctgctggcatagcagaccaattatcgtttcggatggaagacgctgctgatagaattggcactggatcaagggtagagattggaacaactgcagctggtatcacacttgttataacctcatgtctctgttttcttggcttctgctcatgctggtttcctgccagaaaacttcctaccactacctgcacaggacttgcagccaccaacagaccagctactccaccacctacaacacgtccatcagggcttgccaaagatacactcatgccaccggatctgcttcgtgttcctccgctttcacttggcatgaatgagccggataaagacagaatttcaaaccgtccctcatatgtcagtgtgcccccagaagaatcgggctgacgaagtgtgacacttgatatgaccccattagctgaaagaatgcatatagctcgcgnnncttgctgagaaaatgatattaccttcatagtaacatcctccccagaattaacannnatgatatggggagtnaaattagcannnnctgagcatgnnnnnnattcacctaaattctccaactcgannttggctttgctcannnagct

SEQ ID NO: 1800 - DNA, 518 bp, Glycine max
  Predicted polypeptide sequence is orthologous to G1944
acgaggttactatgaaggtaatatcattttctcagcaagggccgcgagctatatgcattctttcagctaatggggtcatatcaagtgtcacacttcgtcagcccgattcttctgggggcacactgacatatgagggacggtttgaaattctgtctttatccggctcattcatgccaagtgaaagcggaggaacacgaagcagatccggtggcatgagtgtatctttggcaagccctgatggacgtgttgtaggtggtggagtagctggtctgttggtggctgcaagtcctgtgcaggtagtggtaggaagttttctggcaggaaaccagcatgagcagaagccaagaaaacagagacatgaggttataacaagtgtgataccagctgcagttgttccaatctctacccttgatccagtgccaattctatcagcagcgtcttccatccgaaacgataattggtctgctatgccagcagaagccaagaataatccagctgacattaacctgtcacttact

SEQ ID NO: 1801 - DNA, 2508 bp, Glycine max
  Predicted polypeptide sequence is orthologous to G1946
attcccggggtcgacccacgcgtccgctaaagtgtaggtaattcgagcaaggcgcaacccaaagagggtgaccacaacctttaattcaatccatttcccctctctctctgttcaaagccacaatctaattaatttcccattcttctccaacaacttagggtttcccttttcccaacaacaatgccacccattccctaattagtaattacgctttttcttttcctattaaattcatttccccgacatggacggcggcgggtccactccggcggcgccgattccgaacgcgaacgcgccgccgccttttctgagcaagacctacgacatggtggaggacccttccaccgacgcgatcgtgtcgtggagcgcaacgaacaacagcttcatcgtgtgggaccctccgcagtttgccagagaccttttgcccaaatacttcaaacacaacaacttctccagcttcgttagacagttaaacacttacggtttcaggaaggttgatccagatcgctgggaatttgcaaatgagggttttttgaagggtcaaaagcacttgcttaggagtattacacgacgaaaacctgcccatggtcaaaatcatcaacaggctcagcaaccgcatggacagagttcatcggttggggcttgtgttgaagttgggaagtttggacttgaggaagaggttgagaggctcaagagagataagaatgtgctcatgcaagagcttgtgaggttgaggcagcagcaacaggccactgataaccagctgcagactatggttcagcgccttcagggaatggagcaacgacagcagcaaatgatgtcattccttgccaaggctgtccagagccctggcttctttgctcagtttgtacaacagcaaaatgacagcaataggcgcataactgaagtcaacaaaaagcgtcggcttaaacaggaaggtatggctgaaacagagcatgctgctactccagatggacaaattattaaatatcaacctatggtgaatgaagcagcaaaagcaatgcttaggcagatcatgaaatgggatacttcttgtgtagaatctttgaataaaaattctgataactacgtgattggtgatgcttcatcatcttccagtggaatggacagtagcagctcttcaggctggacttctggagtaactcttaaagaggtctctccagcttcggtgcagtcttcacatgttccagctgcaactgggactcaagggcatgtcccctcaaccgttaaacctgaaattttatctgtaccacaagcagtagcttctgaaaaagttatgaaagatggagcacatgatccaccttctatccctgtgtctcaagcagatgtaatgatccctgatcttcctccaataacagagatggtgacaggaaatattcttgatattcctgaagaaaattatatggcaactgagacagatgagggatacatggattcttcattgggggctggtgggtcatttcccattgatttcgaaggtatttcacctgatgcagacattgatgatttgttagccaatcctatttgggatgaaattttgcaaacttcagttccagaggatatcgataccaatgtggctgaagcatccaaagggaatgaggtccaaccaatggaaaatggatggggcaaaactcaacatatggatcaccttacagagcagatgggtcttctttcttccgatgcaaaaagagtttgatatctatgatatatgattaatcttcatattgtctgaggtagtccctgacccaaacaatacatgactgaagtgatgtctataatatataattagtaattacactcccacttggtcactgaaaaagacaatgtttttcatttggtcttcaatggctttttttagtttgttgtgcataccaaggctaaatccaactttctcacacgtgcatttacattgatttttcattcgacttcgtgttgaaaacaagttatgaacttatggccttgtcatggcatcctcaggaagtgtttgtgatcacaagatcagtttttccaatgttataggcaatctgtcaagttgagttatatgtgaacgattcggttctttcccaattttcaagtttccttgatgaggggaaaaagagaacatgttgggtgatgattgactgctcaaggcgtctgaaaaatgcacattggaagatttgctttttgaacaagggcggcaacaatggacagcagtggtacgatgttaagctgcaggctgtttgcttcttcgtcaattttattttgtcctttccgaggttatgtttcaactgatggaaaatagaaggaaatgaaattgaatgatattagtccccattgttgaaattgttcataacatgatggaattgaacttgatggaatttattccatttctttttatccaatgctcttaccccctaatttgggtatatggtagaactattttattgtttgtcaagcaatctccttaccattctgtttgctttaatgaaatgaaaagttctattacgc

SEQ ID NO: 1802 - DNA, 940 bp, Glycine max
  Predicted polypeptide sequence is orthologous to G1946
  misc_feature (503)..(503): n is a, c, g, or t
gcgttcgcccacgcgtccgctctattcctctgacttcccatagaccacaatacactcaccccaggcaaaaaatttcgtttcaaaattgtgatatggacggaagagcgagcagcagcgtgggcggagaagcatcgccagctccagcaccggtgccgataacgaatgcgaacgcgccgccgcctttcttgagcaagacatacgagatggtagaggacccttcgacggactcgatagtgtcgtggagtccaacgaacaacagtttcgtggtttggaaccctcccgagttcgccagagatctcttgcccaaacacttcaagcacaacaacttctccagcttcgttcgccaattaaacacctacggatttaggaaggtagatccagatcgctgggaatttgcaaatgagggatttttgaggggtcaaaagcacttgcttaggactattactcggcggaaacctgcccatggtcataatcatcaacagcctcagcaaccgcatggacangagttcatcggttggggcttgtgttgaaggtgggaagtttgggcttgaggaagaagttgagaggcttaaaagagataagaatgtgctcatgcaagagcttgtgaggttgaggcagcagcaacagaccactgataaccagctgcaaacaatggttcagcgcctaattagtaattacgctttttcttttcctattaaattcatttccccgacatggacggcggcgggtccactccgcggcgccgattccgaacgcgaacgcgccgccgccttttctgagcaagacctacgacatggtggaggacccttccaccgacgcgatcgtgtcgtggagcgcaacgaacaacagctttatcgtgtgggacccctcgcagtttgccagagacctttttccccaatacttcaaaacacacaacttcttccgctttgttagacagtta

SEQ ID NO: 1803 - DNA, 655 bp, Zea mays
  Predicted polypeptide sequence is orthologous to G1946
  misc_feature (28)..(28): n is a, c, g, or t
cctctccccgcgcaccacggccaacagnaaccactccgctcctcgccgtaccgggccgggccgggctcccctacatgacgccaccgttcctcatgaagacctacgaggtggtggacgacccggccacggacgacgtcatatcctggggccccgggaacaacagcttcatcgtctggaacacgcccgagttcgcccgggacctcctgcccaagtacttcaagcacagcaacttctcctccttcgtcaggcagctcaacacctacgggtttagaaaggttgatccagacagatgggaatttgcgaatgagggttttctgagaggacagaagcatctgctgaagactatcaacagaaggaaaccatctttgcaggggaacagccaaccacagcaacctcagtcgcagaacgctcctgtgccttcctgtgtagaggttggtaagtttgggttggaggaagagattgaacggctgaagagggataagaatgttcttatgcaagagcttgtcaggctgagacagcaacagcaaacaactgaccatcagctgcagactttgggcaagcgtcttcaagggatggagtcacggcagcaacagatgatgtctttcctggctaaagcatgcaaagtcctggtttcctagcacagtgtgttcagcaa

SEQ ID NO: 1804 - DNA, 2635 bp, Zea mays
  Predicted polypeptide sequence is orthologous to G1946
gccggccggtccgggataccctccccccccccgccccctggcaattccattttccaattcccctttcctctcatcgcatacaccagcggcggcgccgggaccccgaaaaccctctccccgcacaccacggccaacaggaaccactccgctcctccgagccctagccgtcccgggccgggtcgggctcccctacatgacgccggcgtgaggcaagtgcttagtggatcgcgctggtgggaggatgcagggcggtgtcatggcccatgccgccgccgccgcggcggccgcgtcgacggtgaccacggcggtggcgcccccagtcacggcgcacgcggtggcggtggcgcccccggtcacggcgcacgctgcggcggcggcgggcaacggcagcgccaccgccgcgccgccgccaccgttcctcatgaagacctacgaggtggtggacgacccggccacggacgacgtcatatcctggggccccgggaacaacagcttcatcgtctggaacacgcccgagttcgcccgggacctcctgcccaagtacttcaagcacagcaacttctcctccttcgtcaggcagctcaacacctacgggtttagaaaggttgatccagacagatgggaatttgcaaatgagggttttctgagaggacagaagcatctgctgaagactatcaacagaaggaaaccatccttgcaggggaacagccaaccacagcaacctcagtcgcagaacgctcctgtgccttcctgtgtagaggttggtaagtttgggttggaggaagagattgaacggctgaagagggataagaatgttcttatgcaagagcttgtcaggctgagacagcaacagcaaacaactgaccatcagctgcagactttgggcaagcgtcttcaagggatggagtcacggcagcaacagatgatgtctttcctggctaaagcaatgcaaagtcctggtttcctagcgcagtttgtacagcaaaatgagaagagcagaagaagaatagtagcggcgaacaagaaaaggcggctgcccaggcaagatggtggcctagactccgaaagtgctgctgcttcgttggacggtcaaatcatcaagtatcagcctctgatcaacgaagcagccaaagcaatgctaaggaagatactaaagctagattcttcgcataggttggaatctatgggcaattcagagaatggcaattttctgctggagaattatatgccaggcgctcaagcctttgagagctcttcgtcaacaagaaactctggggtcaccctttcagaggtttcagctaacccaggtttgccgtatggcggcggcggcggcacgagctctgggctgtcagccatctgccctcctgaaatccagtgcccagttgtgatggacaacatgtcgtctaaccaagtgcccagcatgagtgctgtgcctcctgtttcgaaggctacaattgacatgggtattcctgaattctcagctctggcagacttggtgaatgaaggctccgtcgatatccctggaggggcctttgagatgcctggtcctgagtttcctctgccagaaggcgatgacagtgtccccatcgagaccgatgagaccatgtacaacaacaacgacgagactcagagccttccaggcatcatcgactccttctgggagcagttcctggtaggcagccctctctctgccgataacgatgaagttgattcggggtcgccacaggagaacggatggagcaaagtggggaacatcggtgatcttacagaacagatgggccttctgtcatcaacaaatcaccgcgactcagggaatgggctgtagtgtatcttaattaatatacggtagactgggattatcggtaataagcgtcgcctgcagtttttgttatttttccttttggccaaaaaatgatatgccggtatatcaaccactcgctcgacctatatgcgcgggaggggcagtcttccagctgagctctgaatgccacagccacctgcttgtatcaatctatgatgttggcagtcttgagaacaccactgtgacttgttaaatctgtatgcttattcccactctagttgctgatattgtttagtttgttatattggtgcggaaacacgggggttgtttagcaacaaagtataacacgttgctttattacaattcgattctgtacaattccatactccaaccaatatattttccggcaacggaatcaagttgccagatttaaagctttacaatcacgcttacaagggtgtcaaattggtctaatttgtaggaatccacttgaaagattttgttactgtcaaacaggttaccccaaagaaagttgaaaattgttgtttcaagcacaagggcttcatgtaagcacaggttatccaaagcgcgctgagattgcgctgcaatgcgaccaaggagaattacttctgcagtaacccaactagatcatacacgctgttcgtgtagagatctggatggatattgttacgagcatcctgcacttctggtaaggcagtgcaaccagacaaaacaaggagggtcttgcagccggggttctggccaaatagtatgtccgtgtccagtctatcaccaaccatgcacatcccggacgcctccagattgaagcttttc

SEQ ID NO: 1805 - protein, 406 aa, Oryza sativa
  Orthologous to G1946
MGSKKRSPQHPAAAAPPPAVGGGGGGEVSGDGGASTANGPVVPKPSEVAPFLTKVYDMVSDPATDNVISWAEGGGSFVIWDSHAFERDLHRHFKHSNFTSFIRQLNTYGFRKVHPDRWEWANEGFIMGQKHLLKTIKRRKKSSQESPSEIQKAPVKTAPGTENIEIGKYGGLEKEVETLKRDKALLMQQLVDLRHYQQTSNLEVQNLIERLQVMEQNQQQMMALLAIVVQNPSFLNQLVQQQQQQRRSNWWSPDGSKKRRFHALEQGPVTDQETSGRGAHIVEYLPPVPETSGQVNPVEGAICSANSQPVPSPAVATPMDMQTSNVADTLGSSEEPFADNSTLHEWDDNDMQLLFDDNLDPILPPFENDGQMGPPLSVQDYDFPQLEQDCLMEAQYNSNNPQYGND

SEQ ID NO: 1806 - DNA, 1690 bp, Glycine max
  Predicted polypeptide sequence is orthologous to G1948
tttttatctctaacataggtagatagttaaaatgcaactagatttacacagaattcaaattatctaaactactaaagataaaatctaagtaatagagccacaaattcattggatgattccttttccagttttccggatatatgcacaaaaattgttcctcgaaaaagttgtggctagaattgttacattgaattaaaataataggaaaagaagaggctccagttaggcaattaggctttggtcccatccaatcgcaaccaggaaatggatgtggttccttatccagtaacacccccaaacctcatttctctgccacatgaaccctcccaaacacagaaaccatagcaaaaagaaacccagattattgattattaataatggaagccatattcgtcaccaaacccgcttcccattctctcctcttaactaaactctctccgaatcccaaacacttgttccctccacaccaacaatcctttcacaacatccgccacaaacccacgcgcttccgccccgtcatcgctgttttccaaaaccaacatcaacaagatgcagctgcagcttccaaccacaccgaagatgagtcctacggcgaagtcaaaggcatcattggaagcagagccttggaagccgccaccggaatggagtacctcatcgagtggaacgacggccacgcgccgtcctgggttcccgccgacttcatagccaaagacgtcgtcgccgagtacgaaactccctggtggactgccgccaagaaagccgacgagtccgcgttgaaaaacttaatcgaatccgacgacggccgcgacgtcgacgccgttgacgccgacggccgcactgcgctcctcttcgtcgccggactcggctcggagtcctgcgtgaagctgctagcggaggccggcgctaatctggaccaccgagaccggagcggcggcctcgcggctctgcacatggcggcggggtacgtcaggcccggcgtggcgaaggttctcttggatctcggcgcggatcccgaggtggcggacgaccgcgggagaacggcgttggatctggcgagggagattctgaaggtgacgccgaaggggaatccgatgcagttcggacgcaggattggactggaaggtgtgattagggttttggaaggggcagtgttcgagtacgcggaggtgcaggagattctggaacggagaggaaagggtgagaatttggagtatcttgtgcggtggaaggacggtggtgccaacgagtgggtgaaggcgaagtttgtggcggaggatttggtgaaagactacgaggctggcctcgagtacgccgtcgctgaggcggtgctcgcgaaaagggtagcggatgaagggacgccggagtttttggttaaatgggccgatttggaggagcccacatgggagcccgaggagaatgtggacccagagcttgtcaaagctttcgagggaagtaacaaccaggcccagcccagtagtaatgggcccgctgtggtcttttccaatcaggatagccctagcctgtgatttttcatagtttgtttggactgggattttgttgcaaaatttcgggagcaaattaattaataattgttttgtaccaaatcaagttgtggacatgaaaaagctaatcaaatccaatacatattttcctcctggttttagatcgtactttgaatgttttagggaag

SEQ ID NO: 1807 - DNA, 623 bp, Glycine max
  Predicted polypeptide sequence is orthologous to G1948
agataacaaattctatggtaactcatccaacaacgctaatcaatttagtttaacacactaaatggctggaagaaaccaaaagagaaaataacgaagtcaccatgccttcttcccctcagtttccccctttgcttgttggtgacagcatggcatcatgcattacaactacagaaaagcatctttctcaagtagctttaggacttcattttgattgtttagcttcgcaacatcgattggagttttaccatccatattctggagagtaactgcagcaccattttcaaggagaagggccacacattcctttctgccataaccagctgcataatggagagcagtgttcttattcttatccaaagcatccacttttgctccagcctcgaggagaacttgagcacattttacctcgccatatccacaggcaaaatgcaaagcagttcttccctctgaatcttcttcatccttgtcagcaccagaggctagtgcatttttcaagccctaaatgtgtaaaattttagctctcaaatatttcaaatcatacctgatgacactaagacaagggctggattaaacaataccataactagatggcttagcaacctaatccacccttcaaaaatgaa

SEQ ID NO: 1808 - DNA, 722 bp, Oryza sativa
  Predicted polypeptide sequence is orthologous to G1948
cccaaccccaatgctcagagaactccagccctctccatcaccgtccctttccggcttcggctccccaaccggcggctcaccgccgcggcggtgttccaggaccagaccaacccaagaaacccagcgagcaagggaggcgacgacgatgaggcgtacggcgaggtggaccgtattgtgtccagccgcaccatcaagaatccggtgttcgcggaggacggctcggccaccacggtcaccgccacggagtacctcgtcgagtggaaggacgggcacgagccttcgtggatcccggcggaggccatagcggcggacgtggtggcggagtacgagacgccgtggtggacggccgccaagaaggcggacgcggcggagatcactgcgctgctcgcggacgagacgctgcggcgtgaccccgacgcggaggatgcgcaggggcgcacggcgatgcacttcgccgcggggcttggatccgaggagtgcgtgcgcgcgctcgccgaggccggggccgacgtggggcgacccgagcgcgccggcggcgggctcacgccgctgcacatcgcggtcgggtacgggcgcccggcggccgtgcgcgtgctgctggagctgggcgccgagccggaggcccccgacgggcagggccggacgccgctggagctggtccaggacgtgctcgcgaagacgcccaagggcaacccggcgacgttcgagcggcggctggcgct

SEQ ID NO: 1809 - DNA, 541 bp, Oryza sativa
  Predicted polypeptide sequence is orthologous to G1948
  misc_feature (421)..(421): n is a, c, g, or t
ttttttttttttttttttttcaaatttgcaatctgaggctaaagttctgctcaactcaaaaattatcaaagcgctaatgatacattttgcagcagcacaaacattttatcccgttctgttatacacagcaaaaccaggaagaatcgaacaccctccgtcgacgtgcgacacgctgtcacccggcgaccggcggcggcggcggagcatcaccgccagcagccaccccagattgccgctgctcgaactcctggaggagttcggcgtcgacgttctcccccggcccccacgtggccttctcgatgtccacccacttgacaaggtactcccatttcccctgcccttccgccgcctccctattgttgacgacggcctccgcgacggcgtactccagcccggcgtcgaagtccttcaccaggtgctncgtcacccacgccgccctaacccacttcctgtcggcggcgttgcgccaattcaccaagtacttccgacacttggccttgccggggccgggcaccaccttttgcactttggcccaattgta

SEQ ID NO: 1810 - DNA, 942 bp, Zea mays
  Predicted polypeptide sequence is orthologous to G1948
accgcggcgcacttcgccgcggggctggggtccgaggagtgcctgcgcgcgctcggcgcggctggagcggacgtgggccgtcgggagcgcgcggggggcgggctcacgccgctacacatggcggtcgggtacggccgcgcgggcgccgtgcgcgcgctgctggagctgggcgccgacccggaggcccccgacgggcagggccgcacgccgctggagctggtccaggaggtgctcgccagggcgcccaagggcaacccggcgacgttccagcttcggcaggggctggaggcggcgcagaaggagctggagaaggccgtgtacgagtgggccgaggtggagaaggtgatcgacggccgcggcgaaggcaagcggcgggagtacctggtggagtggcgcgacggcggcgagagggagtgggtgaaggcggcgtgggtggcggaggacctggtgagcgacttcgaggccgggctggagtacgccgtggccgaggccgtgctcgacaagaggcaggcggcgacagcgacggcggaaggggaggacagctgggagtaccttgtcaaatgggtcgacattgaggaggccacgtgggagcccgccgagaacgtggacaccgagctcgtgcagaagttcgagcagcagcagtcggggtctgcaggcggtgattgatggcggcagcactgcgccaccgtcgccgcaggtgatagagattacttgatgaaggtgattgcgttttattcgtcgggtattcaaagcactgcccgggttgtattttaggatgaaacttttgtgagtatcatattttcaccggaattgcagtttcagccttcccgcttggaaactttttattcgtcgggtattcaaagcactgcccgggttgtattttaggatgaaacttttgtgagtatcatattttcacccgaaaaaaaaaaaaaaaaagcggcc

SEQ ID NO: 1811 - DNA, 765 bp, Zea mays
  Predicted polypeptide sequence is orthologous to G1948
ttgggaccctcgaggccggccgggacggtgtgtcgtgttcgctccacacgcgccaccaccagagacctcccgctggttacaccaatggaggccgtcctacggcatccatcgctctcgcgcaccaggcctccgaacctgaaccctcccacaacgccatctccatcccttcatgcaccatctcttctccgcctccgcgcgcgccggctcatcgccgccgcggtgttccaggaccagaagccgaaggagccagcaagcaagggaggtgatgacgaggaggaggcgtacggcgaggtggaccgcatcgtctccagccgcacagtcagcagcccggtgttcgcggaggacggctcggccaccgccgccgtcgccacggagttcctggtggagtggaaggacgggcacgagccgtcgtgggtgcccgcggaggccatagccgcggacgtggtggccgagtacgagacgccgtggtggacggcggccaagaaggcggactcggaggcgctggcggcgctgctcgcggacgagacgttgcggcgggaccccgacgcggaggacgcgcaggggcgcaccgcggcgcacttcgccgcggggctggggtccgaggagtgcctgcgcgcgctcggcgcggctggagcggacgtgggcccgtcgggagcgcgcggggggcgggctcacgccgctacacatggcggtcgggtacggccgcgcgtgcgccgtgcgcgcgctgctggagctgggcgccgacccggaggcccccgacgggca

SEQ ID NO: 1812 - DNA, 507 bp, Zea mays
  Predicted polypeptide sequence is orthologous to G1948
ccgcggcggaaccggcgggaccaccgccgccgctgcggacgcgggggacgacccagcggcgggggagaagtaaggacgcacgaccggcgcacccgacggcccgaacggcgaggccggcggcgcagagcacgccgaggcggaggacgacgctggggaggaaggcgagaacgaggacgagaccatcgaccaccacaccgccagagagggcgacgccgagggccacaagaaagcgctggagaacggcgcggacaaggacgaggaggactcggaagggcggcgtggcctccactacgcgagcggctatggcgagcaccagagcgcgcaggcgctcctggaggccggcgccgccgaggacgccggcgacaagaacaagaacaccgcgctgcactacgccgccggatacggccgcaaggactgcggcgcgcaccacctggagagcggcgccgccgagacgctggagaacccggacgggaagacgcccagcgacgtggccaagcgcaacaacca

SEQ ID NO: 1813 - protein, 388 aa, Oryza sativa
  Orthologous to G1948
MEAVLRHPSLSRLKPPNPNAQRTPALSITVPFRLRLPNRRLTAAAVFQDQTNPRNPASKGGDDDEAYGEVDRIVSSRTIKNPVFAEDGSATTVTATEYLVEWKDGHEPSWIPAEAIAADVVAEYETPWWTAAKKADAAEITALLADETLRRDPDAEDAQGRTAMHFAAGLGSEECVRALAEAGADVGRPERAGGGLTPLHIAVGYGRPAAVRALLELGAEPEAPDGQGRTPLELVQDVLAKTPKGNPATFERRLALEAAAKELEKAVYEWGEVEKVVDGRGEGKWREYLVEWRDGGDREWVRAAWVAEDLVKDFDAGLEYAVAEAVVNKREAAEGEGKWEYLVKWVDIEEATWEPAENVDAELLQEFEQRQSGVAAGGDAPPPPPVAG

SEQ ID NO: 1814 - DNA, 2513 bp, Glycine max
  Predicted polypeptide sequence is orthologous to G1950
gaattcggctcgagcttcaatttgattccttcgttgtttcgtcctgagagggtcagccatgacccaaaccctctcattctctctctcaccttcccagaaaaccctagaaattaattaaaaccatccaatcttcttttctccatttccccgatttttttttttcatttctatttcaatcgcaacctcctcctccttccaagtcaacgcggatttcagaattctcgatccatgtcgtccgagatcgaggttgtcgaggaggtgcagtcccgcgacgagcaatcgggggcggaggagagcctccgtaatgacgtgtacacggcggcggcttacggggatttggagaggctgcagagattggtggagcaagagggttgccccgtctccgagcccgacggtttgggctactacgcgcttcagtgggccgcacttaacaaccgcactgccgctgctcagtacatcattgagcatgggggagatgtaaatgcaacagatcatactggtcagacggccttacattggagtgcggttcggggtgctattcaggctgcagagcttttactccaggagggtgctcgagtgagtgctgccgatatgaatggatatcagacaacacatgttgctgcacaatatggtcagacagctttcctttaccacattgtttcaaaatggaatgctgaccctgatgttcctgataatgatggaagaagccccttgcattgggctgcttacaaaggttttgccgattctatacgtcttctgttatttcttgatgcacacaggggacgtcaagataaagagggttgcactcctcttcattgggctgctattaggggcaacttggaggccagtaccgtgttagtacaggctggcaagaaggaagatcttatggtggctgataatacaggcctgactccggcacagcttgcttctgataagaatcacagacaagttgcttttttccttggaaatgcccgaaggttgcttgacaaacgctgtgacgggaacagccgccttggaaagatttccaaattaggacttgctcccgtcctttggtgcataattcttgtgctattggttacgtatattcattcagtcatcttggcaacaaaaatgccaaagctgacagctgcagctggccttcttgcatggtttggagtttttcttgcaagtgttggttcggtgatggtttacaggtgtagcagcaaggatcctggttatatcaggatgaatatgcatgacaatcaggatacaaaagatgacgagcctctcttgaagattgagataaataatcctgctttgctagctggaaattggtcccagctttgtgcaacatgcaagattgtcaggcctcttcgagcaaaacactgttccacctgtgatcgttgtgtggaacaatttgatcaccattgtccttgggtatccaattgcatcggcaagaagaacaaatgggatttctttgtttttcttgttcttgaagttccggcaatgttggttactggtggagtttgtcttacaagagtgttaactgatccacttgcacctcagtcatttggggcatggattcagtatgttgctaacaatcacactggtgcaatatcatttctaatagccgattttttcctcttcttcggtgtgtttactttgacagttgtgcaggctagtcagatatcacgcaatattacaacaaatgaaatggcaaatgcaatgcggtatagttacctcagaggtccaggtggtagatttagaaacccatatgatcatggtatcaagaagaactgttctgatttcttgatcaatggttacaacgaagacgttgagtgcattgaagaattaggtaactcagaggagggtataggaatgatgcatatggcaagaagctcgaacttggcaaatggagactcgcacacccatactgaatatgcaagaggcaatggaaatggccatcatgctattaatgtggattccaattccaacagtaccaactccaaaatacatcatggtcatattaatggtcatgttcattcttcgcattgtagccataataaccatggcaaaaccagaaatgacaacgttcccttgggcttgggtcttggccttggacggaacagatctgttacagcctcatcatgatatttacatacatgtctggtgtttgaacctaacctgtaatgtaacataggcacacatctgggttggtttacgttaattcaatttattgtggctcttttctaccacacccccatgtgcaattttgtgctgttacatttagtcgtcctcttatcgttttttctttctactttttgtaactaatttaagttgcattttaaagatgataagccttgaaatctatgtatgaaattcgaatgtatttgctagagcctagaggtcccgccccccttccttcctatggcggttgctacttgctagtgtgcggatgaaacaaatatatatatatatatatatactggtacaacttattctttttaataaattttcttacatatttaattttt

SEQ ID NO: 1815 - DNA, 3066 bp, Glycine max
  Predicted polypeptide sequence is orthologous to G1950
  misc_feature (3048)..(3049): n is a, c, g, or t
  misc_feature (3051)..(3052): n is a, c, g, or t
ccttttttttttttttttttttttttttttaataaaatcatgacggcactaatcttcaaaatcatgcagtgtactgatgaatcccctaatgatttttatcaaaatcattaagttaaggtagatacacatcttgtcatatgatcaaatggtttcgccaaaaatcaataatcagacaacaaaatgtgcgaactcgatattttacacgactctctttaccaattctgccccgaattacacttaaaacgactcaacagcttaacgttggcttgccacgccttacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatatccgtgagcaaaaacggcttatggtattgcgagcttcagtcgcactacacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatggattctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatctctcagtgcagtgtaacaataaatgcattacaagaccatagataacaaattctatggggactcacatccaacaacgttaatcaatttagtttaacacactaaatggctggaagaaaccaaaagagaaaataacgaagtcaccatgccttcttcccctcagtttccccctttgcttgttggtgacagcatggcatcatgcattacaactacagaaaagcatctttctcaagtagctttaggacttcattttgattgtttagcttcgcaacatcgattggagttttaccatccatattctggagagtaactgcagcaccattttcaaggagaagggccacacattcctttctgccataaccagctgcataatggagagcagtgttcttattcttatccaaagcatccacttttgctccagcctcgaggagaacttgagcacattttacctcgccatatccacaggcaaaatgcaaagcagttcttccctctgaatcttcttcatccttgtcagcaccagaggctagtgcatttttcaagccctccacatcaccaacactagcagtatgatgaacaattgattcatcttcatttcccaaatcttctgtctgcatctgccccagaattttcagcagaggcacctgcatctcccgaattggcaagacccatggcttgtcccaacttctgcaaaacctcctcattattccagtacctcatcatagcagcaggaccgccagtctctatctcctccaaaatatgtttcagagatggatcctccttgatgcgtgccattcttttttcaaggagctccacaagatgctatccctagcttcgataatcaacaatatttttcaaccatgcaacaggttatgcagaatcctaattttatgaccatggctgagcgcctgggtaatgcattgatgcaggatccgtctatgtctgccgctagtaatttactttattgacattatggaacttaatccagcatcttcaactcatttcatgaaatagaagtaaagttgctcttcaatgtcatcttgaagatattaacttattccaaggttcattgatggatggaccaatccagtgaaaggatgaatgcctacagccacatttgctccttcaatcccaggaaaaatattttcaatttgttttagaaccaatcttccctcgtgccgaattcggcaccagaagtagtgaatatgcttgaaggacatgcagatattcctgatgtaatcccagaaccaagtacctacaatgatgatttaaggttcaaagccttaaggaatctccatcaatatcaatcaaaacagagtttgagtggaaaccagagccagagttcaatgacacatacattcacctcagcatctggtggtaatactcacactactagttatattgaggatcatagttcagttgacagtagttagttttctcctttcaccaacttgacgcactttaccagatagcagtggtagctccagatcttagggcttgaaaattttgaccagcatggaaccttctattttcacttgtgtagttttctgctttctgaagaggtctccaaaggagtatgagaagatttttcctttcttccttatgtcacccttatttgatttgattttactttttttgtttctttaatgtacaaatanntnnctacaaataaagca

SEQ ID NO: 1816 - DNA, 1015 bp, Glycine max
  Predicted polypeptide sequence is orthologous to G1950
tggcatttggcaaaactgcgaagaagagcagaagaaataccggagaaaagagagttgttgagcagaagagtgttgtgttgtgcattcgcggaagaagaaggagcagatgggtaatccacggaaaccgagtaccgccgacgagcttcacacggcggcaaggtccggtgatctcatcgccgttaactcaattttggcttcaaatcctttggccgttaattccagagataagcattccagaacacctctgcatttagctgcattttctgggcaagcagaggtagtcacttatctctgcaagcagaaggctgatgttggtgcttctgcaatggatgacatggctgcaatacactttgcttcacagaagggacatttagaagttgtccgcgctctactttcagctggggcctctctcaaagccaccacccgcaaaggcatgacttcattacactatgctgttcaaggttcccatatggaactcgtcaagtacttggccaagaaaggggcaaaccttggtgccaagacaaaggcaggaaagacccctttggatcttgctaccaatgaagaaatccgctcctttctggaggaatatgagaagtcagcaaagaatggagaattgggaaagaaagacaaagataaagctgaagaatctgatccaaagacatccacattgggatctgaaggtgatttgagttctgaacctgctgcagctgctattgatgaagaagacaatgtgggagagaagaggaagaagggtaatgaagatggcacaagagaagaagagtcatcacaaccaaaaaaggctagagttaacttaagtcatctccaaagttccgacgatacccaagaagaagaaaacctgtagtttggtattttcatagtagaactaaaattttgttattgtaatgtagtatgtaattgtatctgatttggaatccctttgttgggttagttggctggactatctgttgactgttaagtaacgaccgattctggattaatacaattttctcttgac

SEQ ID NO: 1817 - DNA, 1829 bp, Glycine max
  Predicted polypeptide sequence is orthologous to G1950
ccacgcgtccactgtgagcgagactcggtagtaatagtatagtctacaaggtttcgtattctactacttgaaacctaactcttccttcttcttctacattactcctatggctcccgatgcttccgacgcacttgcagtaaggcagaaagttcaattatttctgaacgcggctcgtactggttcaattgatctcttgaagaaattggcgttgcagctggacgagggcaaggatttggcgaaatcggtggaagcaataaaggacgccaacaagagaggagcactgcattttgccgcgcgagaaggccaaacctctgtttgcgagtacctcttaaccgatttgaagctctctgtcgattctcaagatgatgatggcgagactgcactcattcatgctgctcgtcagggacataccgccaccgctaaatatctgattgaccacggtgctgatcctactgtggctagcaatttaggggccacggcattacaccattctgcggggataggagatgctgagctgctcaagtacttgctgtccaggggagttaatcctgatctagaaagtgatgcgggaacacctttggtttgggctgctggccatgcccaaccagctgctgtcagtgtactgttggaacatggtgcaaatccaaatgccgaaactgatgatggtattactccactcctttcagctgtggcagccagttctctggcatgcttagagctgttaattcaggcaggtgctaaagtaaatataagtgctggtggagcaactcctttgcacatcgcagctgataatggaagtcttgaactattaaattgcttattgaaagcgggagctgatcctaatgtctctgacgaggatggtgtcaagccaatacaagttggtgctgcaaggggctatccaaaagctgttgagatattgttccccttgacgtccaaagtagatactattcctacttggactgttgatgggatacttgagtatatgcaatctgaaactagaaagcagctggatgaatcgataaatgccaaagaaactaatcagcccaaggaagctgattttccggagcaaaatgtccccgaggtggcacctgaagccaaaaagagagcagcagaagcaaagtcaagaggggatggggcttttaaaaggaatgaccatcatatggctatagatttttatacccaagcaattgatctgaaccccattgatgctactttgctatccaatagaagtctctgttggattaagttgggccaagctgagcatgctttagctgatgcaaaggcctgtagagctttaagaccagattggccaaaagcttgttatagggaaggagcggctctgcgtttgttgcagaaatttgatgaagctgcaaatgctttttatgagggagtaacgcttgatcctgaaaataaggagcttgtaaatgcgttcagggaagctgtcgaggctgggaggaaatttcatggaacggctgaaaataaatcatagtttagccttttgttaataccatgtttcagagagaagagatcaaaatattgcgggtggtgcagccttattcacttgatccttttttccccaatgtgtgtgtgcgtgttttctttaactagttactgtcgtataggaagagtcagctagtaatctgtttcattaaattgttttagtaattataaaggttatgcttatttgacatgttccaaaattgttgcagaattagtacacattatgaaaatggcaatgcaggttcatgggtatttctcccatactgttgtaggattcatttgtttaaagttcagaattttttttatagaattaaaaaaaaaaaaaaaag

SEQ ID NO: 1818 - DNA, 756 bp, Glycine max
  Predicted polypeptide sequence is orthologous to G1950
tttttaagaagacccttacacatttttactacctctatcaaatagtaatttaagtagaaacttattcatgggaaactcccaagtcccaataacaagtaacaacattgggcagcatcattatgctgaacttgttaaacaatctaagatttcattacagatacattttcaacccgaaggcgaagttagagaatacaaggcacccctgctaacaagcagttgacatatatcatcatacccccaaattttagccatgtacaaaggggtagcacccctcttattcacagcattaaggttcactcccttctcagccaacactttcacggtccctacatcgccactctccacagccatgtgaagcggcacgtgaccttcccggtcttcacattccaaatccaaatccgataattcactaagcaccatcaacacatccttgtgccctttaaaagccgccgcgtgaaccgccgtcagaccatactggtcacggtacttcacactcccaccacatctccgtaacagcgattccacttccgccacgtgtccgttcctcgaagcctcaaatatttcttctccctcatttatgtttgtatttgtatctgccacgtgtacttgatcaggggcattattgggattggggattattctcaagccggcttcgaggaggaggtgaaccatgtcgtccgggttgcagcagcttggtggcggctccgaggagcgtctcggcttgggtgggtgacaactcggcgagcatggaacgct

SEQ ID NO: 1819 - DNA, 1210 bp, Glycine max
  Predicted polypeptide sequence is orthologous to G1950
ccacgcgtccgtccacgttattttctgaagtctggtgtgtatttgcggcaaggtttggctccaacaagagaaacgagcaatcatatggtatttgatttttagggtggaagaaaaatcagagtgagagaaaaaatcgatggagatggaagtagacatcgagaagaagcaacaagacgtggtgaaagagaaagacttgttcaaagctgcagaagagggcgaggcatcaacgttcgaagctctctcttctgaaatcctctccaaagccctctctctcagaaacgaagacgctcgttcccttctccacgtcgcagcttcttccggtcactcccaggtagtgaagatagtgttgtcttgtgatgcatctgctggtgtggtgaattgtgctgatgaggaagggtgggcgccgcttcactctgcagccagcattgggagtgtggagatagtggagactctattgagcaaaggagctgatgttaatctgaaaaataatgggggtcgtgctgctctacactatgcggccagcaaaggttgggtgaagattgctgaaatgctcatctcccatgatgccaagattaatataaaggataaggttggttgcactccattgcatcgggcagctagcactgggaaatctgagctgtgtgaacttttgattgaagaaggagcagaggttgatgctgttgatagagctggtcaaactcctctaatgaatgctgtgatttgctataacaaagaggtagcccttcttctgataagacatggagcagatgtggatgtggaggacaaggaagggtacacggtgcttggtcgagccacgcatgagtttagaccaatattaattgatgctgccaaggccatgcttgagtgatcatacaattataagaaaatgagaaaattgtcaggacaggaatgtcgaaagagagcagaattgtggtagttatttcgcaatgccataatggtggttacgttcttgacaaattatgttgctcaggcaaaaagttcatctatacccttatgttcttagttgtcaaaccagtttgttttgggtatttttgtgccagctttaaattaaatcaggaagattagaatttttgttttgataatcccctaaattagcaattcagattgtataagtcaaaacattttaattctagagattttaagaactctccgttagttgattttataagaaatggttcattttactttt

SEQ ID NO: 1820 - DNA, 545 bp, Oryza sativa
  Predicted polypeptide sequence is orthologous to G1950
tcgtcggcgccacggcctcgcagcagcagcgcgatggcctcgtaccccatcgtcacggccatctggagcggcgtcgcgccccgcctggtggcggcgtgcacttcggcgcccatgtcgagcagcagctcgacggcctcggcgctgccgccttcgacggcgaggtgcagcgggcggtgcccttccacgtcctcgcactcgatgtccatgcagcctgacccggcgagcagcgcgatcacgtcgcagtgccctttgatggcagcaaggtggagcgccgtcaggccgtactggtcacgtccccggacgccggcgcgcttgctgaggagggactcgaggctctggaggtcgcctcgcctcgccgccgtcatgaccagttcccaccgttccaggacgtccaccacttcttgatagcccttctcgcgcgcgacgtccagtggagtcctcccgcgcgcgtcggtcgcccgcggcgtcggcgcccatgtccaccagcgccgccgccgcctccgcctccccggccgcggcggcaacgtggaaggggcggtcctacc

SEQ ID NO: 1821 - DNA, 2915 bp, Oryza sativa
  Predicted polypeptide sequence is orthologous to G1950
ctcccgtcgctcggcgcgcggagcaaccgccgcatcaagctccgccgcttcatcatctccccctacgaccgccgatacagaatctgggagactttcctcatagttcttgtagtctactctgcgtgggtctcaccatttgaatttggcttcattccgaagcctacgggggctctagctacagccgacaatgtggtgaatgcattcttcgcggttgacatcattctgaccttctttgtggcttatttggataaaatgagctatatgcttgaagatgatccaaagaagatcgcatggcgttatagtaccacatggcttgttcttgacgtggcctccaccatcccatcagaatttgctcgcaggatactaccttcaaagcttaggtcatatggatttttcaacatgcttcgtctgtggcgtctccgcagagtcagctctctgttttctaggttggagaaggatagacacttcaattacttctgggttcgatgtgcaaagctcatttgtgtcacactttttgctgtgcactgtgcggcatgcttctactatcttcttgctgataggtaccccgtcccaacttctacgtggattggcaattacatggcagatttccatgaacggagcttatggattcgctacgtaacatcagtctattggtcaatcaccactcttaccaccgtgggctatggggatctacatgcagaaaatacaagggagatgatcttcaacattttctacatgctctttaaccttggtttgaccgcttatttgatcggtaacatgaccaatttggttgtccatggcactagtcgtactcgaaactatagggatacaatccaagcagcaacaagctttggagtaagaaatcagctaccacctcggctgcaagatcagatgatttcacatattagcttaaaatacaggacagattcagaaggtcttcaacaacaagagatccttgattcactgcctaaagctattaaatctagcatttctcaatatctgttcttccatctggttcaaaatgtttacctgtttcaaggagtctcaaatgatctgatttttcaactggtttcggagacccacgcggccgccctcccgcccggggaggatgtgattttgcagaatgaagcacccactgacttctacatcttagtttctggtagtgtggagttagtagagcagcaaaatggtgcagaccaggtgatacaagtggctacgtcaggagaggttgttggagaaattggggttctttgctacagacctcagctattcacagttcgaacaagatccttgtgccagttgttgcgtttgaatcgtacagcttttctcagcattgttcaatccaatgttggggatggaactatcataatgaacaaccttattcagttccttaaagagcagaaggagaacagtgtaatggctggtgtcgtaaaggagatagagagtatgctagctcggggaaatctggatttgccaattacactctgttttgcagtaactagaggagatgattttttgttgcatcaacttcttaagcgtggtatggatccaaatgagtcagataatgacgggcataccgcactgcatatagctgcttccaaaggaaacgagcaatgcgtcaggcttctattagaatatggagctgatccaaatgccagagactcagaaggaaaagttccactgtgggaagcgctgtgtgagaagcacgccgccgtcgtgcaactattagtcgaaggcggcgcggatctgtcgtcgggtgacacgggcttatacgcttgcatcgccgtggaggagagcgacaccgagctgctcaacgacatcattcactacggaggcgacgtgaacagggctcgccgggacgggaccaccgccctgcaccgcgccgtctgcgacggcaacgtccagatggccgagctcttgctggaacacggagccgacatcgacaagcaggacggcaacggctggaccccgagagccctcgccgagcagcagggccacgacgacatccagctcctgttccggtcgcgcaaggcggcgacggcgagtggccaccatcacgtcccaagctccaccaccaccagggtggcgccggcggcggcggcggcatcactgatcgggaggttcaacagcgagcccatgatgaagaacatgatccacgaagacgccgacctgcccagccgggttctccccgagaagctccggaggaagcgggtcaccttccagaactccctcttcggggtcatctcgtcgtcgcaggcgcagcgggagaccgaccacccgctctcgaggggtggcctcgcggcgacgggctccccgaacccgagcagcggcagccgcaacgccgtcatcagggtgacgatcagctgccccgagaaagggaacaccgccgggaagctcgtgctcctgcctcagacgctggacatgctcctcgagctcggcgccaagaagttcgacttcgcgccaaccaaggttctcaccgtggagggcgccgaggttgacgaggtggagctcatcagagacggcgatcatcttgtgctcgtcagtaatgaatgggatgcagagaagatgaaaggcaagagctagtaaaggagttgtgtgtttttttttctttttcttttttggttgtttactgttgatttccaagaaaggggagatagaatttaccccggagtccaacggttagctaaggaataactggaaatcattggtatagttattccaccatgaagagatggtgaaattgatgggttacgtccggtgttcgtaagtagagaagcgtaagaatttgattttgttatagcgtgttgtgatgttagcctgtttttgttttagttggcaagttgatctgctggcatgtacagttttacgcttttctaatttttgaaggaaaagtccaaagaatgtaccagtgcttc

SEQ ID NO: 1822 - DNA, 1580 bp, Oryza sativa
  Predicted polypeptide sequence is orthologous to G1950
ccgccccccgcgcttcttccccagttctcatcgagggttttcctctctctctctcgcatcgcatccatcccctcgtgtcgccgccggcggaggctgcggcgagccttcaccccccacccgcccaccgccggcgagccacggcgtgggcgacctcctctcctctcccgatcccctctcgcccttaggtaggggcttctccccagtccccaccacacgcgcgtgcgtggccgacgagcaccccaggttcggatcggatggaagaccagaagaaaaatgcaaaaccagaggggtcttctggctcgcaaaggggagctcccccggcacctgatgcaggccttcccaatccttttgatttttctcagtttagcaacttgctcaatgatccatctataaaggagatggcagagcagattgcaagcgaccctgtgttcacccagatggcagagcagctgcagaagagtgctcatgtgaccggggaacagggtggccctgcattggatcctcagcagtacatggaaacaatgacacaagtcatgcaaaaccctcaattcatgtcaatggcagaacgtcttgggaatactcttatgcaggatcctggaatgtccagtatgctcgagagtttgactagtccttctcataaggagctgcttgaagagcggatgtcccgtattaaagaagatccctctttgaaggggattcttgatgagatagagagtggtggtccatctgctatggtgaagtactggaatgaccctgaagttcttcaaaagattggtcaggctatgtcaattaattttccaggagatgctgctacttccactacattgtctggacctgaagaaactgaagaggatggtggagatgatgatgagtccattgtccatcatactgccagtgttggcgatgcggagggtctgaagaaagctttagaggatggagcagacatggatgaagaagacgctgagggaagaagggccttacattttgcgtgtggttacggtgagttgaaatgcgcagagatccttctggaggcaggtgctgctgtaaacgcactggataagaacaagaacaccccactgcattacgctgctggatatggtcggaaagaatgtgtggatcttctgctgaagcatggcgctgctgtcacgccccagaatctggacgggaagacccccatcgaggtggccaagctgaacaaccaggatgaggtcctcaaggtgctcgagatggacgctttcctataaagaaaccaatgccaaatctcacgctcatcatcaccggctcgtcgctttacagttcagatttttactgcatacccaaatcatcatcgactcttttagctttggttttggtgtggtggtggtacattcgttgaatcgttgctatgtttggtgctccgatttgtaatctgtttcacttccccgttacactgcatcactccgtttcatcctttgtattcctatgttgctgagtctggtgttgcagacgttgctcctgtttttctcagcgttttcgtgtcagattggtagtttatatagataagagatgcactgccccggtgtaaaaaaaaaacaaaaaaa

SEQ ID NO: 1823 - DNA, 1140 bp, Oryza sativa
  Predicted polypeptide sequence is orthologous to G1950
ttttttttttttttttttcgaggtgaatggtcttccctccgtttgcctgccaccttcggagtttttttttcttttgtgttttggtgtctttttctccttcgtgtactcaagctggtaatcagttatacttactgctagttcagtaagaaacacagttagtatcacgctcatacagttctgtccacatcccagcttgccatacgagaacaaaggatatataacaaaacgtagagggtgccatcaaattgcattctcgcgtcctacattagtctagtcagcttcttcctcttcctccatgtcatttgcacttattagatgcccaagtgaaactttggcttttttcagttccggtgacctcagtgcagcagcaatgccatcgcttttcctcttctcgccaaaccccgcttcatcttcgtcttttgtagcctcacccgaggacttgtcatcgtcaggcttctcagcaatcgttgacacagaatcatccttcttctccgatggaagctcacctcccttcttcaatgactgctcacattctttcaggaaatcacgaacatcatccttctctgcaacatgtagagccgtctgacccccttttgtctttgcggcgatgtctgcacctttcttgactaaatacttcacaagctccaggtgggagttctgcgaagcaaagtgcaacgcagtgaagcctttcctgttctttgctttcacagaggcaccagatgccagcagctcacggacaacctctacatggcctttctgagaggcaaaatggatcgcagcggtgtcatccatagctgcagctccaacatcagctttgtgcttgcaaaggcacttcacaagctcaacatgtccagcccatgctgccaaatggagtggggtgcgagagaggcgatctctggaattgagggcgagagggttggcctcgcacagagactccgccgccgccaaatctcccgaccgcgcggccttgtgcagatgcaagtcatcctcctcgcctcctccgcggcctcggcctccacggccacgaccgccgccgccgccgccgccgccgccgtgacgcctccccatctctacgctgcagccgctccggatcagagagcctgcagcccgggaattggatcgaaccctcgtgccgaattc

SEQ ID NO: 1824 - DNA, 577 bp, Oryza sativa
  Predicted polypeptide sequence is orthologous to G1950
aaacctactccgcgcacgcgcctctccttctagaaccttctggaaccctcgcccccgcgaaggcggcgccgccgccgagatggcctcctccccctccgccgtcgtcctgcaggccgccctcgacggcgacctccacctcctgtgtgaaatggccaagaagttggacctgcggggattcaaggacatgaatgggcgaaatgcgcttcacttggctgcaagctatgggcatctggagatctgcaagttcctggtggaggaatcgggccttgatgtcaactcaggctctcacagaggtgagacaccaatacttctcgccgcatgtgacggggacattaatgttttaatataccttcttgatcatggtggtgacccagccatacctaacgcggggggcttcacgccgctgcactacgcagcagagtacgggcatgttgatgttgtgagactattgctgtccaaaggagttcatgtggatcctctgaattatagtggggccccgctgcacttggctaccgcaaatgaccatgatcaggttgcgaaggttctgcttgagcatggtgctgatcccaacagagtt

SEQ ID NO: 1825 - DNA, 1122 bp, Oryza sativa
  Predicted polypeptide sequence is orthologous to G1950
agagcaaactgacatgacagttactacaataattcggggctagtatgaattatggcccagttgatcaaatctgattctagatcagaatggttcatacttaaaaaagacaggattcaaccaaaaaaaattagtacaggttttcgataccaaaatttgttccccttcgttaacctttgtgcagcataacattttcagccttcaagcattgccttggctgcatcaattagtgcaggtctaaagctatcagatgctcgaccaagtacggtatagccttccttgtcctcaatggcaacatcagcaccatgtctaactagcagaagagcaaccgctttgtcctcagaaataacagcatgcattagtggtgtttgtcctgttttgtcaactgcatcaacatcagccccctcctcaattaggaattcacacagttcagcatttcctgtactggcagctctatgtaagggtgtgcacccaaacttatctttcttgttgacatttgcactgtgcgctattagtgtttctgctatattaagccgtcctttactggcagcataatgaagagcagtccggccagcatcggttgtcaaatcaacattagcaccttgatcgagcaggatggagatgatctcagcttttccgctgctcgccgccgtgtggatcggcgcccacccctcctcgtccttcccgttcacaacgctggccgccgcgtcgccgcccatcgcggcaagcactctcaccacctgggcgtggccggaggcggcggcgacgtggaggagggaccggccgtcctcatcgcggagggcgagcgcggcggcgaggtcggcgggggagagggaggagaaggccgcggcgtccccggactccgccgcgctgaagagctccttctccgaatgtctcccaccgcccgcggcggcgctggcggcggcgccgtcgatgtccattgtagcagacatcgtgcttaggcaaaagcgaaggcgcagaagagaaatacgcttcgagcctcaggtttgcgtttccctccggccgcggctcatctcgtgcgcgtctcaaatgagccacacacggctctaaagccacgtatcaggatcagaatcagatacggcaatgatacgataagcctcgtgc

SEQ ID NO: 1826 - DNA, 729 bp, Oryza sativa
  Predicted polypeptide sequence is orthologous to G1950
ttcggcacgaggaaaagcaaaagcttcactctctccacaacgacaaggacagagagaaaaaccccaaattccaatcccaaaccctaatccccgctcgccatgccgagggggcgcgtgcccggcggctcgaccgccaacttcagcgcccacctcatcgcggcccagctcgggatgcagtgccgcatgggtcccgcggcggcggagcagatgaggcgcgtcatcgcgtcgtcggactgcgacaccggccgcgtcatgaggatgtttggtgccatggaaggtggcgacagtgattctgattctgatgactctgcggagacggagaaagttgggccactgcatgaggcagcaagcgcagggaaaatggatacttgcaaacatttggtggagcagcttgggtttgacatcaatgctgaagcaagtgatgatttgggtatgacacctttggcttgtgcggtgtccaagggaaaagcaattgctgtgaggtattttcttgacaaaggtgctgatccaaataagcaagacaacatcggttttactcctctgcactatgctacaaaagaagggtatgatggactggcacgactactgctgtctaaaggggctagtgttgatgttatttcttctaaaggcacagccctgcatcttgctgcctccagttggaagtctggcatcatgaagattctattggagcacaatgcagatccaaacaaggtctccgcagattcagag

SEQ ID NO: 1827 - DNA, 806 bp, Oryza sativa
  Predicted polypeptide sequence is orthologous to G1950
gctgcaggaattcggcacgaggggcgacgggacgggaggcttcctcctcctcctcctactcgagactcgacgccgccacctccacctcccgtctcgtctccagaagcttctggaacacccttccggcttcaattcccccctgctcgggtcgggtagctcccttccatcatccatggccgacgccaccgccgccctctcagctcggagcaaggtgcaagctttcctcgaagcggcgcgtgccggtgatctcgactccctcaagaagctcgctgcggcgctcgacgaggagggcaagggcgtcgccgccgtcgctgctgccgtcaaggacgccaacaagcgcaccgccctgcacttcgccgcccgcgagggccgcacccacgtctgtcacttcctcatctccgacctcgccctccccgtcgaccccaaggacgacgatggtgaaactccactcatccatgctacgcgccaagcccatctccaaactgtaacctatctgcttcaccatggagcagatccttccgttgcttcttccctcggagccacgccattgcaccatgctgccggcatagggaacctggaccttatgaaactatttctctccaagggggttgatgttgaatcagaaagcgatgccggcacacccctcatatgggctgctggtcatggacagcaagaggcagtcatacttttgcttcaacacgatgctaagccaaatactgaaaacgatgatggtattacgcctttgttgtctgctgttgcagcgggttccctcccatgcttggatattctaattcaggcaggtgcac

SEQ ID NO: 1828 - DNA, 613 bp, Oryza sativa
  Predicted polypeptide sequence is orthologous to G1950
acagttgtggatgagctattccctaactgtgatgtacttctgcatagcttcttctgtcggcatagcagaagtacatcacagttgtggatgagctattccctaactggagcatgggttcgagcatgaaaaggaaagatgaagataccacagtatctgcttcaagttcgaagggaccaatgggacctgtatttagcagtttaatgtatgaggaggaagatcagggaaatgactctgaacttggcgatatccatgtttcagcaagggaaggagcaattgatgacatagcgaagcatctggctgctggtgtagaagtcaacatgagagatagtgaaggcagaactccactgcattgggctgtcgaccgtggccatctaaattctgttgagattcttgtcaatgcaaatgctgacgtgaatgctcaggacaatgaaggacaaacagcgcttcactatgctgtcctctgtgagcgagaagatattgctgagttgcttgtcaagcatcatgctgatgttcaaatcaaggatgaggatgggaacacggtgcgggagttatgcccttcaagctggtcttatatgaacctggcaaactgacgacacgatgccctctgcactct

SEQ ID NO: 1829 - DNA, 605 bp, Zea mays
  Predicted polypeptide sequence is orthologous to G1950
taaataaacccaacaagggcaacgtaaagttaaaattctagcggggtcaaatctgattctgtagagagccccgttgtttacacaccagaacaagctttaacacctcgactcagcacagtttctcgtatcacactttccatcgtttttgaccagagcaccagatcatccttcgagcattgccttggctgcatcgatgagtgcaggtctgaagctgttcgatgctcggccaagggcagggtagccttccttgtcctcaacatcaacatcagcaccatgtctaattagcagaagagcagcccctttattctcacatataacagcatgcgtaagaggtgtttgtcctgtcctgtcaacagcatcaacttcagcaccttcctcaatgaggaattcacacagctccgcgtttccagtgcttgcagctctatgcaaaggtgtgcagccaaactcgctcaagcaggatgtcgacgatttgagagttgccggagctcgcggcggagtggatcggcgcccacccctcctcgtcctgcgcattcagcacgctagccgcggcgtcaccaccgcactgggcaagcgcgagcaccacctggggatggccggcagcggcg

SEQ ID NO: 1830 - DNA, 849 bp, Zea mays
  Predicted polypeptide sequence is orthologous to G1950
  misc_feature (715)..(715): n is a, c, g, or t
  misc_feature (796)..(796): n is a, c, g, or t
aattcctcactccactcgccccgcccagccagatctttctagaaccttcagcaaccctagggccccagcgagaggcctctgccgccgccatggcccccaaccccgccgcaatcgccctcctggccgccctcgacggcaacctccgtctcctcaagaaaatgtccaaaaagatggatttgcgggtaacaaaggaccctaaagggctgaacgcactccatttcgctgcaaataaggggtccctggagatttgcaagttcctggtggaggacgtgggggtcgatgtcaactcggtatcaagcgtaggtgcgacaccgatgttttacgctgcactcaagggaaatcttcaggttgccaggtatcttctcgatcatggcagcgatccggcgaaacccagtgagaggggcttaacgccgctgcacaatgcagcagagcatgggcattgtgagattgtaaagctgttgctgtccaaaggagttgacgtggatgttatcaattaccgagggacaccattgcacatgactgctgcaaagggtcagcatcaggccatggaaattctgctggagcatggtgctgatcccaacagagtagtcaatcatatcttctcaccactaatgatggcatgctgtgggaactccttggaatgcatgaagctactgattgaggctggtgctgatgtgaatggtaatagtagctctggaccaactcctttaacggngggcagttgatgatggctcaactgaattcgtcaagttcttgctgggagctggagctgaccctaacattcctaacagcacgnggatattccaatcaagagagcagcagtccgtggtcagcgtgaacttgttgagc

SEQ ID NO: 1831 - DNA, 1748 bp, Zea mays
  Predicted polypeptide sequence is orthologous to G1950
ttgggaccctcgaggccggccgggccactcttcttctgccttcccgactctacctgacttcgcccgctctgagaaattcactctcaccaccaccgcgccgcctccactccccccacacccccggtctgaaacccaagcttccgcttctctcatggccgacgccaccgccgccctctcagctcggagcaaggtgcaggctttcctggaggctgcgcgcgccggcgacctccaatccctcaagaacctcgtcgcggcgctcgacgaggacggcacgggcgccgcctccgtcgccgccgccgtgcgtgacgccaacaagcgcaccgccctccacttcgcggcgatcggatgtcgcaccgacgtctgtgaattcctcatcggcgagctcggcctccctgtcgacccaaaggacgatgatggcgaaactccgctcatccatgcgacacgccagggccatctggacactgtcaagtatcttctcgaccatggagctgatccttcgctggccaccagcctaggagccacagcgctacaccatgctgcaggcatagggaacacggaactcatgaagcttctcctctccaagggagttgacgtcgagtcagaaagtgatgctggcactccccttgtgtgggctgctggtcatggcaaccaggatgctgtcaaacttctgcttcaacacaatgctaagccaaatactgaaaacgatgatggtgtcacagcattgttatctgctgttgctgcaggttccctcccatgcttggaggtcctaattgaggctggtgcaaacccaaatgtcaaggctggtggagcaaccccattgcatattgctgcagatagtggaaatatagaagtcatcaaatgtttgcttaaagctggagctgacccaaatacctgtgatgatgatgaattgaagccagttcaggttgctgcttggagaaataaccatgaagctgttgaacttcttttaccgttaacatccccaattccaggtgtttcaaactggaacgtagatgggattatagaacacatgctccctaaagagtatgaggaaaagtctcaactgaaggaagcgacatctctgaaatcaggcctaacacaaactattgaggtgtcatctgaagcaaaaaagaggtccttggaagccaaatcaagaggtgatgatgccttcagaagaaaggactaccttgtagcggtggatgcttatacgcaggctacagagttggacccaactgatgcaacagtgctctcaaacagaagcctgtgctggctgcgggcagggcaagctgagcgtgctctggaggacgccaaagcatgccgtgcattgagaccagattgggcgaaagcctgctacagggaaggtgcggcgcatcgtctgttacagaggtttgaggaagccgcaaacgccttctatgagggggtgcagcttgagccggagaacacggagctcgtcaacgcattcagggaggccatcgaagccgggaggaagttccatggcgtcaacacgccaaactcaacacaatgagactttgctgtttggttggataggtagatgatgaagcggatggacatgaacgttgtcttagttggaagttggtgagatgatgaatgagatgataatgaaatttgaaagagcgaatttgcagatttattttgtgttttgtgattgttttcttaaacttgttttcttgcgtaaaaaaaaaaaaaaaaaaaaaaaaaaaaaaaaaaaaaaaaaaaaaaaaaaaaaaaag

SEQ ID NO: 1832 - DNA, 2386 bp, Zea mays
  Predicted polypeptide sequence is orthologous to G1950
ccacgcgtccgacatccttgagcatggagcagacataaatgctgtggatcacactggacaaacagcacttcactggagtgctgtacgtggtcatattcaagttgctgaactacttctgaaagaaggagctaaggtggatgctactgatttatacgggtatcaggccacgcatgttgcagcacagtatggtcagactgcattcatttaccacattgttgcaaaatggaatgctgatccagatatccctgataatgatggaaggagccctttacactgggctgcttataagggatttgcagactccatacggcttcttttgtttttggatgcttataggggacggcaagacaaagaaggttgtactccattacattgggctgctattcgggggaatcttgaggcatgcactgtcttagttcaggttggcaaaaaggatgatttgatggtgaaagacaaaactggcttaactccagcacagcttgctgccgataagaatcatcggcaagttgcatttttcctcgacaatgctagaagggtacacggcacaggatgtggtgcgaacaccagatttgggaaattgtcaaaattagggctcgctcctcttctttggtgcaccattattggcatgcttattacatacacacactctgttatatcaggacaatatgccatgactacgacagcaccatttgggatattcgcatggtcaggagtttttcttgcaactgctggcttggtcatgttctataaatgtagcaggaaagatccaggttacatcaacataaatgcaaggggctcgcaaaatcaaagggatgatgaaccgttgctgaagatggagttagaaaatcctgcacttctttctggcaactggtcacaactttgtataacctgcaaaatagtcagacctgttcgttcaaaacattgttctacatgtgatcgctgcgtggagcagtttgaccaccactgcccttgggtatctaattgcataggaaagaagaacaaatgggaattcttcatgttcctcactctagaagtttttgcaatgatcattactggctctgctgccattataagaattgtaagagatccaaattctccatcatcctttggtgcttggattcattattctgcgtttcagcaacctggggtggtttcatttctcgcattggattgttttcttttttttggtgttgcagttcttacagttgttcaagcatcacagatagcaaggaacattacaacaaatgagatggcaaactccatgagatatgcatacctcagaggcccaggtggcagattcaggaatccgtatgatcatgggattcgcaagaactgctctgacttcttgttaaatggatacaatgaggacactgaacggctagagcagacattgcccactgatgaggaaatgggaatgatacagatgacaagtgcagtttcgcagcagaacggtgtcaatcatttacatcatggtaatggcactgaccatagttgcgctgtttcacaagcaaactcaaaacctcatagccaagtgggttcgtctcagtgttgtgaccacagtaagaggactgataggacaccgttgggcctaggattgggccttggacgaaacagtgcgtcccggcagtatgttcggtctcttatcccattgtgatccatcatttggcgatcatgtgtttgtttgactgtagattggatttgttcacttattctgttatacgtgctcttgacatggttcaccatggctgggcagggttaacgttgttgtgccatgagctccggaatactaagatatatctggtgttgtagtttagcgttgaactcagagaagttgaaggtaacgacctggtttgcgagtatcagctgatcagcagtctggaatcagagagcttgtgcagaaaatgtaagagttatggactcatggcagatgcagtagcatgagatgtcttcagaattgttgtgtacatcaggttctgtggtacccctattgtttagcgtgatacgagtttgggaaaaaaaaagtagtcgtaaattgagaaaattgtaaattgattagtaagctcactgcaacactagctgttttcctagttttcattcatttttgggtctggttattgttatgaaccacggaaagaattttcggttttcgggtatgggtacctcagttatatttggtctggttatggtacttactggtggtgcatgtttgtgtgagtgcttagagtttaggctatggccatcagatcatgtatatgactatatgactgtgtaaaacactgttttttatctgattgtgtaaaacagtgtttttgtatcgtacactattgttttatagattgaagtttaaaaaaaaaaaaaaaaaaaaaaaaaaaaaaaaaaaaaaaag

SEQ ID NO: 1833 - DNA, 3136 bp, Zea mays
  Predicted polypeptide sequence is orthologous to G1950
aattcggcacgaggttgaactctcctccctcgcccgcgcgtctccgccgccccaccggccaccgcccgcgcctccgccgcggcagctgtccaaaagctgaaaatagatagaatcacgagggggggattgcctagacaacgatccttagttaatcaaacacgggctgccagattcgggggggcgttcgcgttcctaccctctcatcactctccccgtaaaaccccggctgggtttatctcatcgccgccgggcggcgagcggtgggaggcaatggcagggtgggggccctccaggctgccgacgtgcgggccgtggggccgcggcgtggcgctggagagggagctgtcgcgggacggcagccactacagcatctccagcggcatcctgccgtcgctcggcgcgcgcagcaaccgccgcgccaagctcaggcccttcatcgtctcgccctacgaccgccgatacagatgctgggagacttttctcataattcttgtgatatactctgcatgggtttccccatttgagtttggcttcattcggaaaccggcgggcgccctagctgcagtggacaatgtcgtgaatgcgttcttcgcagtggacatcatcctgaccttctttgtagcttacttggatagaatgacatacttgcttgaagatgatccaaaaaggatagcttggcggtatactaccagttggtttgttcttgacgtggcctccaccatcccgagtgttttttgctcggaagatactgccaccagacctcaggtcatatggatttttcaacatgcttcggctatggcgtctccgtagagtcagctctctctttgctagattggagaaagatagacatttcaattacttctgggttcgatgcgcaaagctcatatgtgtcacactttttgccgtccactgttcggcatgcttctactatcttctcgctgacaggtatcctgccccaacggatacgtggattggcaattcgatgccggattttcatcagcggggtttgtggattcgctatgtagtgtcagtgtattggtcaatcactacgcttaccactgtgggttatggtgatttgcacgccggagaacaccagggagatgatattcaacattttctacatgctattcaaccttggattgactgcctatttgattggtaacatgaccaatctggttgtccatggcaccagccgtactcgaaaatatagagatacaattcaggcagcgaccagctttgcactaaggaaccagttaccaagtcggctccaagatcagatgatgtcacatctttgcttgaagttcaggacagattcagaaggtcttcaacaacaagaaacgctcgatgtcctccctaaggctataagatccagcatttctcagtatctattttccgcccgggtccaaaaggtttacttgtttgaaggggtgtccaatgacctcatttttcaactggtttctgagatgaaagctgaatattttccacctagggaagacgtgattctgcagaatgaagcacccacagacttctatattttagttaccggtagcgcggagttgatagagttgcgaaatggcggggaacagatggctggagtggctaaggcaggagatgttgtcggagaaattggggttctttgctataggccccaactattcacagttcgaacaaaatcattatgccagcttctgcgtatgaatcgcactgcctttctcagccttgttcaatccaatgttgcagatggaacaataataatgaacaaccttatgcagttactaaaacagcagaaagacaacagtgtaatggtgggtgttcttaaggagattgagaacatgctagcgcggggtcgtctggacttgccaattaccctctgttttgcggtaaataaaggagacgattttatgttacatcaacttctgaagcgtggtttggatccgaatgaatcagataacaatgggcatacagcactgcatatagctgcttccaaaggagacgaacaatgtgtcaagcttcttctagactacggagctgatccaaatgctagagactctgaaggaaaagtgcctctatgggaggcattatgtgaaaagcataatgcagtgatagagctattagtagagagtggtgcagagctatcatctggagacacggccttgtatgcttgcatcgctgttgaggaaaatgatgctgagctgcttgagaacgttatccgttacggcggcaacgtaaacagcccaacgaaagacggaaccacgccgctgcaccgcgcggtctgtgacgggaacgtccagatggttgagttgttgctggaacacggagctgacgtcgacaagcaggacagtaatggctggtcgccaagagatctagctgatcagcaaggccatgatgacattcaggctctcttcaaatcacgaaaagcacacaggaagcatgcctcaaatggcagagtggcacctatgctgatagggagattcaacagtgagccctcgatgccagatatgagccatgaaaacgccagagtacgcagcgaagttgttccgcagaagctcctccgaaagagggtgagtttccagaattctcttttcggcgtcatctcttcgtcccacgcccaccaggacaccggccgtctgctctcgaaaggcctcgctggaacagagggtccaaattgccgtcacgactccctcatcagggtgacaatcagctgccccgagaagggggggaacgccgcagggaagctcgtgcgcctaccgcggtcgatggccgagcttctcgaactaggtgcaaagaagttcggcatcaagcctggcaaggtcctgacagttgggggtgctgagattgatgaggtggagcttatcagagacggtgatcatattcttctcgtcagtgatgaatgggtgccagatgttgagcaaattaggccttaacaataagtgagccagctgtggtgctcttattgcaatttgacatgatatggggaaacatgcccctgtgaccctgtgtgcatcagtgcatgtcccccatttaaactgaagtgtagcttatgatggttttgaagctgtaggatgtatccagcttggaaatgaatttgtagtcacaaaaaaaaaaaaaaaaaaaaaaaaactcgagggggggcccg

SEQ ID NO: 1834 - DNA, 1037 bp, Zea mays
  Predicted polypeptide sequence is orthologous to G1950
ctttttttttttttttttttttttttttttttttttttttttaccaaacaagcccttagaattttcattcatgcaacacatgagaactgacattcaactttgtacttgtctttacattcaagatcgccgtacagactaagactagcataacaaaacacacaggtgcaggtggaagtggaaccatctaagtgcacttctattgcatcctcaaggtcaaggctgctcgaaatcactcctcttcctcgtccatgtcattttcacaaactagatgaccaagagaaactttggctttttttactcctgacaaactcgacgcaccaaccaattcgcttttcctcttctcgccctgctctgcatcctcctcatctttcataacctcacctgaagacttgctatcgccctctttctcggcagaatcatccttctccgatggtagctcggcacccttcttcaaggattgctcgcactccttcaggaacgcacgcacttcatcatcctcagcgacatgtagagctgtctggccacctttggtctttgctgtgacgtcaacacctttcttcacaaggtacttcacaagatccaggtgagaattctgagcagcaaagtgcagcgccgtgaagcctttccggttcttggctttcacagaggccccagatgccagcagctcacgggccacttctacatggcctttctgggaagcaaaatgaagtgctgcagtgtcgtccattgctgcagctcccacatcagctttgtgcttgcaaaggcatctcacaacatcaacatgcccagcccatgcagccaggtggagtggtgtgcgtgagaggcgatcccttgaattgacggcgagagggttggactcgcacaccgactccactgctgccgcatcaccagaccttgcggccttgtgcagaggaagatcttcttcctcatctcgcccacgccctcgccctcttcctcttccgccgccgccgccgccgctgtgacgccgtcccatcagtctcgccaatcggttaggtaattcccggccggcccccggg

SEQ ID NO: 1835 - DNA, 635 bp, Zea mays
  Predicted polypeptide sequence is orthologous to G1950
cctcgagtacgagtaactccggagtccggatggctgcagcgatggacgtcgacgaagccggcggcgaggagaggcgaccgtcagagaaggagctcttccgcgccgctgagtccggcgacgccgccgcgttcgcctccctcgcccccgccgacctctccctgcgcaacgaggacggccgctccctcctccacgtcgccgccgctgccgggcatccccaggtggtgctcgcgcttgcccagtgcggtggtgacgccgcggctagcgtgctgaatgcgcaggacgaggaggggtgggcgccgatccactccgccgcgagctccggcaactctcaaatcgtcgacatcctgcttgagcgaggtgctgatgttaacctggttactgatggtggtcgaactgctcttcattatgctgcgagtaaagggaggcttaacatagctgaaaaactaatagcccatggtgctaatgtcaacaagaaagacaagtttggctgcacacctttgcatagagctgcaagcactggaaacgcggagctgtaaaaataaaagcgtgcgtctgtattggtcagctcctacagtcttcagacagaagtgctagaccaaggattgatttttgaaccatcgtagaatagtttcgtt

SEQ ID NO: 1836 - DNA, 721 bp, Zea mays
  Predicted polypeptide sequence is orthologous to G1950
  misc_feature (672)..(672): n is a, c, g, or t
gaggctcggccgggtaatagcccatggtgctaatgtaacaagaaagacaagtttggctgcacacctttgcatagagctgcaagcactggaaacgcggagctgtgtgaattcctcattgaggaaggtgctgaagttgatgctgttgacaagacaggacaaacacctcttacgcatgctgttatatgtgagaacaaaggggttgctcttctgctaattagacatggtgctgatgttgatgtcgaggacaaggaaggctacactgcccttggccgagcatcgaacagcttcagacctgcactcatcgatgcagccaaggcaatgctcgaaggatgatctggtgctctgctcaaagacgatggaaagtgtggtacgagaaaccgtgctgagtcgaggtgttaaagcttgttctggtgtgtaaacaacggggctctctacagaatcagatttgaccccgctagaattttaactttacgttgcccttgttgggtttatttaaccattgtggagtggagacgaataatcaacgtgccgtgacatcggatgacacaggccaacttttctaaaaaaaaaaaaaaaaaaaaaaaatttgccgcctcggaagcactagctgctcaggccacacaggagaacttcgacaagggatcaatcttcccgcccttcactaacattagnaaagatctctgcgcgcattgccgccagccgtggctgcaaaggcttatga

SEQ ID NO: 1837 - DNA, 1148 bp, Zea mays
  Predicted polypeptide sequence is orthologous to G1950
ccggccggggaaagcgcaatcaactctagtctctagccacaactcgaagtacgagtacctccggagtccggatggctgcagcgatggacgtcgacgaagccggcggcgaggagaggcgaccgtcagagaaggagctcttccgcgccgctgagtccggcgacgccgccgcgttcgcctccctcgcccccgccgacctctccctgcgcaacgaggacggccgctccctcctccacgtcgccgccgctgccgggcatccccaggtggtgctcgcgcttgcccagtgcggtggtgacgccgcggctagcgtgctgaatgcgcaggacgaggaggggtgggcgccgatccactccgccgcgagctccggcaactctcaaatcgtcgacatcctgcttgagcgaggtgctgatgttaacctggttactgatggtggtcgaactgctcttcattatgctgcgagtaaagggaggcttaacatagctgaaaaactaatagcccatggtgctaatgtcaacaagaaagacaagtttggctgcacacctttgcatagagctgcaagcactggaaacgcggagctgtgtgaattcctcattgaggaaggtgctgaagttgatgctgttgacaggacaggacaaacacctcttacgcatgctgttatatgtgagaacaaaggggctgctcttctgctaattagacatggtgctgatgttgatgtcgaggacaaggaaggctacactgcccttggccgagcatcgaacagcttcagacctgcactggatcgatgcagccaaggcaatgctcgaaggatgatctggtgctctgctcaaagacgatggaaagtgtgatacgagaaactgtgctgagtcgaggtgttaaagcttgttctggtgtgtaaacaaaggggctctacagaatcagatttgaccctgctagaattttgcccttgttgggtttatttaaccattgtgactaacatctcataagctaagctttggttctcccttctctctttcttttatgtctgttcatgatggcgtatcaggctatcagctaacagatcggtgactgtcacacccggctttaaggaacaaagccaggtgcatctcatacatctcatctttttgaattcaaacttgaatttggatttggtt

SEQ ID NO: 1838 - protein, 943 aa, Oryza sativa
  Orthologous to G1950
MARWGAARMAACGPWGRNRRVGAGDAFEASEVRRDGRSRMMPACGPWGAGHGGGDPALERELSRDGSHYSISSAILPSLGARSNRRIKLRRFIISPYDRRYRIWETFLIVLVVYSAWVSPFEFGFIPKPTGALATADNVVNAFFAVDIILTFFVAYLDKMSYMLEDDPKKIAWRYSTTWLVLDVASTIPSEFARRILPSKLRSYGFFNMLRLWRLRRVSSLFSRLEKDRHFNYFWVRCAKLICVTLFAVHCAACFYYLLADRYPVPTSTWIGNYMADFHERSLWIRYVTSVYWSITTLTTVGYGDLHAENTREMIFNIFYMLFNLGLTAYLIGNMTNLVVHGTSRTRNYRDTIQAATSFGVRNQLPPRLQDQMISHISLKYRTDSEGLQQQEILDSLPKAIKSSISQYLFFHLVQNVYLFQGVSNDLIFQLLRTVTEYAYLVLLLDFVFEVSEMKAEYFPPREDVILQNEAPTDFYILVSGSVVIQVATSGEVVGEIGVLCYRPQLFTVRTRSLCQLLRLNRTAFLSIVQSNVGDGTIIMNNLIQFLKEQKENSVMAGVVKEIESMLARGNLDLPITLCFAVTRGDDFLLHQLLKRGMDPNESDNDGHTALHIAASKGNEQCVRLLLEYGADPNARDSEGKVPLWEALCEKHAAVVQLLVEGGADLSSGDTGLYACIAVEESDTELLNDIIHYGGDVNRARRDGTTALHRAVCDGNVQMAELLLEHGADIDKQDGNGWTPRALAEQQGHDDIQLLFRSRKAATASGHHHVPSSTTTRVAPAAAAASLIGRFNSEPMMKNMIHEDADLPSRVLPEKLRRKRVTFQNSLFGVISSSQAQRETDHPLSRGGLAATGSPNPSSGSRNAVIRVTISCPEKGNTAGKLVLLPQTLDMLLELGAKKFDFAPTKVLTVEGAEVDEVELIRDGDHLVLVSNEWDAEKMKGKS

SEQ ID NO: 1839 - protein, 329 aa, Oryza sativa
  Orthologous to G1950
MEDQKKNAKPEGSSGSQRGAPPAPDAGLPNPFDFSQFSNLLNDPSIKEMAEQIASDPVFTQMAEQLQKSAHVTGEQGGPALDPQQYMETMTQVMQNPQFMSMAERLGNTLMQDPGMSSMLESLTSPSHKELLEERMSRIKEDPSLKGILDEIESGGPSAMVKYWNDPEVLQKIGQAMSINFPGDAATSTTLSGPEETEEDGGDDDESIVHHTASVGDAEGLKKALEDGADMDEEDAEGRRALHFACGYGELKCAEILLEAGAAVNALDKNKNTPLHYAAGYGRKECVDLLLKHGAAVTPQNLDGKTPIEVAKLNNQDEVLKVLEMDAFL

SEQ ID NO: 1840 - protein, 336 aa, Oryza sativa
  Orthologous to G1950
MGGDWQELAQAAVIGLLFAFLVAKLISTVIAFKEDNLRITRSTPTFPSAADTPAAPAPPPASLDGGHGDTSDGSGSDSDSDWEGVESTELDEDFSAASAFVAASAASGTSVPEQAQLQLYGLYKIATEGPCTAPQPSALKLKARAKWNAWHKLGAMPTEEAMQKYITVVDELFPNWSMGSSTKRKDEDTTVSASSSKGPMGPVFSSLMYEEEDQGNDSELGDIHVSAREGAIDDIAKHLAAGVEVNMRDSEGRTPLHWAVDRGHLNSVEILVNANADVNAQDNEGQTALHYAVLCEREDIAELLVKHHADVQIKDEDGNTVRELCPSSWSFMNLAN

SEQ ID NO: 1841 - protein, 174 aa, Oryza sativa
  Orthologous to G1950
MGGDAAASVVNGKDEEGWAPIHTAASSGKAEIISILLDQGANVDLTTDAGRTALHYAASKGRLNIAETLIAHSANVNKKDKFGCTPLHRAASTGNAELCEFLIEEGADVDAVDKTGQTPLMHAVISEDKAVALLLVRHGADVAIEDKEGYTVLGRASDSFRPALIDAAKAMLEG

SEQ ID NO: 1842 - protein, 2278 aa, Oryza sativa
  Orthologous to G1950
MADPSFNFRVGLALRRALPYYNDAGPQSEFFEAATRGNVRRLRELASGKDAEGKAWLADMGFSGIGPLQAAARLGEVESCRCMVEELGFDINAGSQLGHDEVARLLLSRGASIDIAYFHGTPLHIAAAYGKADVMKVLLEHHADPNKVSEELGTPLVATLHATSQGLAESISLKCVKLLVEAGADVNFSDRDTPLVDKQDDQNEKAQLKLCGEKAVKRKDYRGASNFYSQFQNIELAIEMDPTDATLYSNRSLCHLQMTEAEAALFDAEFCIQLRPEWIKGYYRKGAALMLLKKHEKACDAFMAGLKLEPGNAEMEKALRYDRLVNTSYTVVLPLLSSSLCETLASQQTPPLRGGKGDPRENELLNAVTEGNARRLKKMVNTMGEKDRAKFTDMNIDGNGLLQVAAHLGKIEVIRYFVEELGFDVNAGCLSDGVTALASAAMFGEAYVVRYLLEHGADPNKTDETGSVALHFAAKNGYEEVVRLLLSSGARTGIVVAHGTPLHIAVFYRRIGVVKILLDHHVDSNNTSGVWGTPILTALRSAKHGLDESDSLECVKLLVKAGADVNYACPNTPLVVATTAGLTDCIKYLLEVHADPNIPDKQSGRTPVEISASVGRRDHVEILFPFTSSISAVTNWTVEGIIAHGKSRRLTPKIVDLDSKFEIVPNMGMSRYIVKIPYFGMELAALGYAEAARTAEAARQAAAAAATLRAEEERRDLELANAACVRRDADRDRHVGRRDRDFSPHCGGSDLHRDEEWHDLWRDPWIDRALEAQRLWEQAAAIEAQLDFDREQGGRDIGARSPRRQRASPSSDRHRGRRGRSGSPPVVQTIVKDVGGAWPMLTKTNYAEWAMVMKVKLQARHMWDTVWYGDVDYGEDRRALEALLAAVPTEMQSSIVNKRTTKDAWDAIASARIGSDRARRSTLQKLRQDWENLAFKPGEDIDDFVLRLNSLQQRLAQLGDTTIDEERAVEKLLRVVPEKYTQLALSIETLLDFTELTIEEVMGRLKAVDNRKQLPPSEPITIGGKLFFTKEQWLARQQEWKKGEATGSSASGSSSSRKRRPRKWEKARSGALGDANGEHKGSRDDTCHNCGKTGYWAKDCRQAKHGGQAHVAQAQEAAAHVFLSNGSCGDKIDGWCLDTGATHHMTGRREFFSELDSSVQGSVKFGDASTVVIKGVGSILFTAKTGEHRLLTGVYYIPALRNSIISLGQLDENGSRVEIEDGVLRVWDRHRRLLVKVAQPVCLAARRDDDAWRWHERFGHLNFGALKQLGNKEMVQGMPRVEHVEQFCDTCVLTKQRRLPFPRQASFRAEEKLELVHGDLCGPVTPATPGGRRFFLLLVDDVSRYMWVVLHDSKAAAADAIKHHQVAAEKECGRKLRVLRTNNGGEFTAAEFAAYCADEGIQRHFSAPYTPQQNGVVERRNQTVVATARALLKQRGMPAIYWEEAVMTAVHLLNRLPTKALDGKTPYEAWHGRKPVVSHLRVFGCLAFAKELNHVGKLDDRSSPGVFIGYAEGVKAYRILDPATQRVRISRDVVFDEGRGWAWDKAVDDGSTSTLRDFVVDYVHFGGAGGASSSSSPSSSTSAPGSPSAPASPPPPTPPATPPSPATPCSPTPAPTPPVEFATPLSNDEDRVDAYHDDEPLRYHTVDNIFGDQPVLGLATHDFEAELHLAHEDGEPCSFAEANGDVAWRTAMQHEMDAVERNRTWVLADLPVGHRAITLKWVYKLKKDEAGAVIKHKARLVARGFVQQEGVDFDDAFAPVARMESVRLLLALAAQEGWRVHHMDVKSAFLNGDLKKEVYAHQPPGFVIPSKENKVLRLRKALYGLWQAPRAWNAKLDSTLKQMGFQQSSHEAAVYRRGKDGNALLVGVYVDDLVITGTKEAEVEAFKEEMKATFQMSDLGLLSFYLGIEVHQDSSGISLRQTAYAKRIVELGGLTGCNLAYTPMEERLKLSRDSTAEEIWHSLLAVSRFMQRPTTEHQQAVKRILRYVEGTTNYGLHYPRCPGAQHFIGYSDSDLAGDSDTSKSTSGMLFFLSKCLISWQSVKQQVVALSSCEAEYIATTTASTQALWLVRLLGDLLGRDAEAVELRVDSKSALALAKNPVFHERSKHIRIKYHFIRSCLEERSIKASYINTQDQLVDLLTKSLGRVKFQEFRARIGMDESCGKVNDRKAELKSHGEKAVKRNDYLAASKIYSEALELDYFDATLYSNRSLCNLQIGEAQKALLDADRCVELRPKWVKGHYREGAALMVLKEHKKAFEAFLNALKLDPANAEIEKVMW

SEQ ID NO: 1843 - protein, 472 aa, Oryza sativa
  Orthologous to G1950
MPRGRVPGGSTANFSTHLIAAQLGMQCRMGPAAAEQMRRVIASSDCDTGRVMRMFGAMEGGDSDSDSDDSAETEKVGPLHEAASAGKMDTCKHLVEQLGFDINAEASDDLGMTPLACAVSKGKAIAVRYFLDKGADPNKQDNIGFTPLHYATKEGYDGLARLLLSKGASVDVISSKGTALHLAASSWKSGIMKILLEHNADPNKVSADSETPLAATLIASDGLNEPAVLKCIKLLVKAGANLNRAIPDTPLVIATNKDFVECVEYLLEAGANANIPTNNGGKTPIEIAAKSGRRKLVEILFPCTLPIKGVSNWTVEGIITHVKSKKSKKKACAQDKESGTDKKAQLKSLGASAVQGKDYVGASKFYSEAIQLDPTDATLHSNRSFCYLKSGEAREALVDAKTCIGLKPDWPKGYYRKGAALMSLKEYKEACDAFMDGVKLDPASGEMHEAFWEAAAALKKKHLAGKTVSSFD

SEQ ID NO: 1844 - protein, 485 aa, Oryza sativa
  Orthologous to G1950
MEKKDKGRHRGRDGGGGGGGGGGGGGGGVDPAGGGSGGGGPGMGRRGSDARGQQAEAAAAAISGIATRLGFGCTINVGGGMPPQMEFLMACTDGDVARLKEVVDSMDEDDRQSLTSVRMEGYEPLFEAASSGKIDLCKYLVEELGFDVNAEANHDSGMTPLFCAVLDGQEITVKYFLDKGADPNKKDAAGFAPLHEAAKKGHVGIARLLLSKGASVDVSSSEGTPLHVAASNGKSSTVQILLEHRANIQRSQVDAKSFRNRVQVFYVPALPNVILPDCYTPLTAVLSATPEIVNESECLKCMKLLVKAGAIYNLATPDTPLKIATRNGLTECVAYLLEITTVKLSEHDKGSDGDRKSKLKLHGGKAFEEGDYAGAIIFYTEAMKLDPADATLYSNRSLCHLRSGAAQEALLDANDCIKLKPEWTKGHYRKGCAHMALKEYEEACTAFMAGTKLNPLNDEMQDAFWEAAKGMMYEHMAGKRVSSVD

SEQ ID NO: 1845 - protein, 910 aa, Oryza sativa
  Orthologous to G1950
MALLAVALLAAALHADAAPASAAPGSSFPDAYGDRARAAQLPPRKQQPQVAYALRRASATSSAHLHGATSRSFTGVATEGCEQIRVFLGIGCCDEVKARYSRYETIVKLASSIGTVVPVALSIVPYFYQVYTGNFERTIEVYGAPAMLAGSINSIIWLTYSIMASKKDLNLALILMHALLCMSTFTYLMCICACKRATKEGYILGAFFIGCLSAISIVVHWDLNPSKVVKIIFRCFGGISLLSCHYILLNDILGSVPKRSQKVATGFDLILSCITNLVTFIITFHDHPEHTTSLITSGVGFVLNVVEIVLLVIVTIMGYFFPLSEHPDADVEASRHISATRGMIPLEDALGTPETDDFIAVLTHEPQVPQFEVSYLILQVRNEFEIYSLRSMVNPNVQIITREVIQRTMMRIERDHYIQILLQASGIAGQEPDASPSIRGRKRGGSVPLLVYYRCAAVLDVDTARAQAGETPLLLAATFGHTSTAAYLLDRGADPSTPDPNGGDTPLHWAAYNGDRELAKLLLLRGADVGAANPRGTALHVAAARGHAAVVSVLLNHGADPNKIANIVFTPLVSSLLGGSLECMKLLIQAGANVNGAGFNGATPLLLACSRTGSIGFIKCLVESGADPNIPDELDRLPIEIAAIHAEREVIEVLLPLTHQVPTLLDWSVGGIIRYVKYPAYKEWARNASCKRKDELKLQGNSSFNNEDYDAAILLYSMAMKFDNTDAKLYSNRSACWLNLGIGDEALSDAQICSKMQPDWAKGYYRQGMAFSLLQDYASASYVLRRALKLDPQNATVAKALRCYENKIYMTENVLEKRGDVLETACPRMEESGLAFVHQKKRDWSPAAAGRSVPDATFQIDKKILPVWVKIWGVPRRPLLGCGWMYLPPVNNVPESSAPEEQQITVLGSE

SEQ ID NO: 1846 - protein, 336 aa, Oryza sativa
  Orthologous to G1950
MGGDWQELAQAAVIGLLFAFLVAKLISTVIAFKEDNLRITRSTPTSPSAADTPAAPAPPPASLDGGHGDTSDGSGSDSDSDWEGVESTELDEEFSAASAFVAASAASGTSVPEQAQLQLYGLYKIATEGPCTAPQPSALKLKARAKWNAWHKLGAMPTEEAMQKYITVVDELFPNWSMGSSTKRKDEDTTVSASSSKGPMGPVFSSLMYEEEDQGNDSELGDIHVSAREGAIDDIAKHLAAGVEVNMRDSEGRTPLHWAVDRGHLNSVEILVNANADVNAQDNEGQTALHYAVLCEREDIAELLVKHHADVQIKDEDGNTVRELCPSSWSFMNLAN

SEQ ID NO: 1847 - DNA, 527 bp, Glycine max
  Predicted polypeptide sequence is orthologous to G1958
  misc_feature (426)..(426): n is a, c, g, or t
acgcgtccgggagtgggctgagaggctaatcagtgatgatggcacattgacttctaattggaatgaccttcttgctgacaacattcaagatcttgagccaaaggtgaagtttttcataattcaaatcaatattagctttcagaggaaactgattagtaatttatttaagaaatgtgctaggatctcattttattgctttaggggccattccaagtttcaaaaccactttcacagattccaggacatcaatcccaaggtcatcaacaacttcctgcttcatatggagaaaattgcgctggtgctgccctctcttcctcagcaaattctgctcctgctaagtcacgaatgcgttggacaccagaacttcatgaggcgtttgtggaggctgtcaaccaacttggggggagtgaaaaagctactccaaanggtgtgctgaagctcatgaaagttgaaggattaactatatatcatgttaaaagccatttgcagaaatacaggacagctagatatagaccggagtcatctga

SEQ ID NO: 1848 - DNA, 1878 bp, Glycine max
  Predicted polypeptide sequence is orthologous to G1958
caaaagcaagagcctatagttgacggcgttggttggggttctaagattgttttgtttgagttaaacgcgacaaactcaaatacgtgtgcattacaactcctaacccctcaccatcctcttcttctctctcattcatacccctccttttttatttgtattctcagctttgttagattccgtttctggtttttcccaattccatagtactctgttatcgtcgtcatcccttttataggacagacaaagctgattcacttaggagcctcgagagctatgtctacatcttctcgtgttcttcccactccattggaaaacaagtatatgaaacccccagattcttttcagctttcgccagtcagagatctgactgcaaattcagcctcatcaaattcaatcagaagtgctgggaagatgttttcttcaccttctaaatgtcccgatgacttccctttttcctctgtttcacagcatgataggcaatatcaagatcccccctttgtttctcagacaattggtgatagcgtgtcttccgaaatacattcaatgacattcatttctcaccctcaagaaaatgaagatctttcctggggaccagatccatgtcaggatattcttggctttcctgaaaatgtttctgtccagcatgatcaggtggaaaacaatggttgttacataaatgatgataatgtcaaaagatctgattttggggagtgggttgatcagttaatgtcaattgatgattctcttcacccgagctggagtcagcttcttgctgatgacaatgtagcagaaccaaaaccaaaaggcatctcaggttcctccgcagcagcatataccatctggagaagttgttggtaattcagcatcaactgcatcgcagactaaggctagaatgcgttggactccagaacttcacgaggcctttgtggaagcagttaatcaccttggtggtagtgagaaggctactccaaagggtgtgttgaatcaaatgaaagttgaagggcttactatctatcatgtaaaaagccacttgcagaagtatagaactgccagatacaaaccagagccatcagaaggaacgtctgagaaaaaggtgactccaatggaagaaatgaaatctctagacttgaaaacgagtaaggggatcactgaagcattacgtttacagatggaactccagaagcgacttcacgaacaacttgagatccaaagaaagttgcagattcaaattgaagaccaagggaaacgtcttcagatgatgtttgagaaacagagagagatgggtgacagcaaggttaacgtctccttggacgagccttctgctgcagcaccatcagacacagtagaaaccacaaatgaggaacgccacaaatttgaaagcattccaaaagccatacccgaagagaaggagtcaagcacaacaaaacaaattgcaggtgaagctgaagaaatgatcaaggaagatgaagttgcaccacccacaaaacgggtgaaaagttcgtaacagcaggatcgttgttttatgccttctagatttgtttaatattcttagactggtttggactccatggaacttgtagaaatattattggatccaaggatgtttcaacttgctcatttatcacagccatttcctatgaaaatatggcatgagtgccacaagtaatggtggctcattgtgatggaaattttgttaccatcctcttagtggtccttgaggtttttttttttttcttttctttttcacatgtaaactagcatttatttatacctgtgtttaatgtattatatagaaaatcagaattgaaaaataaaagtaatattaagactccaaagaaataatacattttcaaaaaaaaaaaaaaaaagggcggccgc

SEQ ID NO: 1849 - DNA, 2235 bp, Glycine max
  Predicted polypeptide sequence is orthologous to G1958
aacattattacattggggaatgtacatggtacctggtactgcaacaggatcatcaccaatccaatcaccgatagtgagcttcacgcgccaccttggcgcgtagggttgccagctgctattcctccaaccaaaaggagccaaagccaaagcccattcgttcgtcaccgttctgttcactctcgcgagcacccacccaaccttcttcgccttgccggtgatggaattaaaagcacccgccctagtctgcatccaattcttgagcttcacgtgaaccccttctcggattgatgacaacttgtctggtttgggcatcaagaacaaaaaacaagctttgtagaattttactggaaaattatggaagcacgttctgctttctctattgacaggtcaaatgctaagcaactcaatgacatggggatgtctgaagcatttccctcatcgttgcctgcccttccatcgcctctagaagagacattccccaaattatctgattctcgaccagcttttatggaaaaagagcttaaaacaaaaccttttacacattcaagtcatttaacttccagcggagcagttgggcatatgttttcatcttctcctggatattcaactgatcttcatcactcatccttttcatctcatgaaaaacaacctagaaatactcattttatttcacagtcattaagtaacatggcttcattgccattatcttattcttcaaatagtgaaccgataccttctacaacatcaaccccttattccaatggaaacagtgtttcctggcatacagattccttgcctagctttctcgatttccctgccaatacctccattggtaatagtcaagtagaaagcagtgactgcaatatcatggcaactgaagagtattctaagcgaaatgattggcaggagtgggctgaccaattaatcagtgatgttgatcctttgacttctaattggaatgatcttcttgctgacaacattcaagatcttgaaccaaaggtcgcaaaatcatcttctcaacttccaataggacaccaatcccaaagccatcaacaacttcctgcttcatctggagaaaatcgtgttggtgttgccccaacttcctcaacaaattctgcacctgccaagccacggatgcgctggacacctgagcttcatgaggcatttgtggaggctgtcaaccaacttggtgggagtgaaagagctacccctaaaggtgtgctgaagctcatgaaagttgatggattaactatataccatgttaaaagccacctacagaagtacaggacagctagatatagacctgagtcatctgaaggagctgcagagaaaaaactaagtccaattgaagagatgtcatctctagatttgaaaactggtattgagatcacttgaagctctgaggctgcagatggaggttcagaagcggttgcatgaacagcttgagattcaaagaaatctacagttgcgaatagaagaacaaggaaggtaccttcagatgatgtttgagaagcagtgcaaacctggcattgaaacgtgcaaggcaccatcatctgtcatcgagactccatctggggggtcttctgatgccacgaaagattcccctgccaaaactgaaatggaagcatcacaagtgaaccatggcaggtcaggacctgatcaggttaagggcagtacgacatttgaggaaggctcattggaaaagtgcgggaagcctgattctcccaaaactgaacatgctattgctagtgaagatagtgctcaagccccgaagcgtcaaagaactgagtaagccatatgaatctgctgaatcacagtatcaacagtgatactacaagacaatactgaaccatgaaagatttcatttaagaaagattaggctgaatgattggtcgagatcctaacttatgagttcctcctctccaattgtggtcaatgagtacaatgtacatttagcaaaaaggtggtcgcctcagttacttgaaaggctgatgttagttttgccgttagaaatcctccttggtagagagtttgtaaatattagtatcactgtaagccattactaaacttgtgcacactatctatccttagaatgcggaacccccttcctgagctctatactttatgccccagaaaaagaaaataaaaaacaatgagtcaagtcaacgagcttgtagctcaacttgatgataaaaaaaaaaaaaaaaaaaaaaaaaaaaaaaactcgaggggggg

SEQ ID NO: 1850 - DNA, 802 bp, Glycine max
  Predicted polypeptide sequence is orthologous to G1958
tcgagacctctctactaatagctcattctgatttcatcatatcatcaactatacatcatcccaattgtccaattatcatatttcttcgaagatactggaccatccaatcttcagcaacatccaagccattattccaaagaatagcagtgtttcctggcatacatgattccactgccatagctttctagagattttcctgaaaataggctctattgataatatatcgggtagaaagtagtgcctgccctataatggcatctgaggagtattctaagcaaaatgattggcaggagtgggctgagaggctaatcagtgatgatgacactttgactactaattggaatgaccttcttgctgacaacattcaagatcttgagccaaaggtgccgctccaggttcctgatcctcggccacagattccaggacatcgatcccgcggtcatcaacaacttcctgcttcatatggagagaattgcattggtgctgccctctcttcctcagcacatgtttgctcctgctacgtcacgaatgcgttggacaccggaacttcatgaggcgatggagacggctggcaaccgacttggggggagtgaaagagctactccagcgggcgtgctgaagctcatgaaagatgaaggattaactatatataatgttaaaagccattagcggaaatgcaggacagttagatttacaccgtagtcatctgaaggagatatggacaaataaacaagttcctgtgaatagatggcatgtatagatgtgagaactggtattgagatcactgaagctctacgactac

SEQ ID NO: 1851 - DNA, 882 bp, Glycine max
  Predicted polypeptide sequence is orthologous to G1958
aacttattaccattggggaatgtacatggtacctggtactgcaacaggatcatcaccaatccaatcaccgatagtgagcttcacgcgccaccttggcgcgtagggttgccaagctgctattcctccaaccaaaaggagccaaagccaaagcccattcgttcgtcaccgttctgttcactctcgcgagcacccacccaaccttcttcgccttgccggtgatggaattaaaagcacccgcccttatctgcatccaattcttgagcttcacgtgaaccccttttcgggagtgggctgaccaattaatcagtgatgttgatcctttgacttctaactggaatgatcttcttgctgacaacattcaagatctggaaccaaaggtcacaaaatcatcttcacaacttccaatagaacacctcgcgccgcgccagccgcaacttcctgcttcatctggagaaaaatcgtgttggtgttgccccaacttcctcagcaaattctgcacctgccaagccacggatgcgctggacacctgagcttcatgaggcatttgtggaggctgtcaaccaacttggtgggagtgaaagagctacccctaaaggtgtgctgaagctcatgaaagttgatggattaactatataccatgttaaaagccacctacagaagtacaggacagctagatatagacctgagtcatctgaaggagctgcagagaaaaaactaagtccaattgaagagatgtcatctctggatttgaaaactaattatccaaatcttatcacttaactggagaagagaacagatagatggacaaaaagtggtattgagatcactgaagttctgaggctgcagatggaggttcaaaagcggttgcatgaacagcttgag

SEQ ID NO: 1852 - DNA, 2072 bp, Oryza sativa
  Predicted polypeptide sequence is orthologous to G1958
  misc_feature (2054)..(2054): n is a, c, g, or t
gctcgtgtggcccaggggctggctcgtgcgggcgggggtccgcctcgcgaaaggccgcgtgccaccatttctccccacatctcatccctctctctctcctcgcttctctctctttcgcaggcgaaggcgaaggcgaaggattcgggctcagctcctccgcctccgccgatctctcgccggagatgtgtcagccctaggagaggagaagctttctttttttggaaaatcgagtcaacaaaaggtcttgccaattaacacagtgaaggataattctggcttgagtgtttgtaaatggagagaataagcaccaatcagctctacaattctggaattccggtgactgtgccatcgcctctgcctgctataccagctaccctggatgaaaacattcccaggattccagatgggcagaatgttccgcgggagagagaattgagaagcacacctatgccacctcatcagaatcagagtactgttgctcctcttcatgggcattttcagtccagtaccgggtctgttgggcctctgcgttcgtcccaggcgataaggttctcttcagtttcaagcaatgagcaatatacaaatgccaatccttacaattctcaaccgccgagtagtgggagttcttcaacgctcaattatggatcacaatatggaggctttgaaccttccttgactgattttccaagagatgctgggccgacgtggtgtcctgatccagttgatggcttgcttggatatacagatgatgtccctgctgggaacaatttgactgaaaacagttctattgcagctggtgatgaacttgccaagcacagtgaatggtggaatgattttatgaattatgactggaaagatattgataacacagcgttgtactgaaactcaaccacaggttggaccagctgcgcaatcatctgtcgcagttcaccaatcagctgccccacaatcagtttcatctcaatcaggagaaccttctgcagttgctataccctcgccctctggtgcctccaatacctccaactccaagacacgaatgagatggactcctgaacttcatgagcgctttgtagatgctgtcaatctacttggtggcagtgaaaaagctactcccaagggtgtgttaaagctaatgaaggcagacaatttgaccatttatcatgttaaaagtcaccttcagaaatacagaacagctcgatacagaccagaattgtctgaaggttcttcagaaaagaaggcagcctcaaaagaggacataccatcaatagatctgaaaggagggaactttgatctcactgaggcattgcgtctccagttagaactccaaaagaggcttcatgaacagcttgagatccaaagaagtttgcagctgagaattgaggagcaagggaagtgccttcagatgatgctcgagcagcagtgcatacctgggacagacaaggcggtggatgcttcaacctcagcagaaggaacaaagccatcttctgatcttccagaatcttctgccgtgaaggatgttccagagaacagtcagaacggaatagccaaacaaacagaatcaggtgacagataatgaggatgtgatgagggtctctccaagatgtggacccaagtggccattgaatgggctcgatggctatctgactgatgtttggcaaagctaaaattaaatcgtttttgccttttcacggggaacagaacattgttgtgaacagcatatcaaagcttgccccagcgcttgtagctagactttagttgtacagtaccccaaacacggcagcgacgattccgtgttaatgggatgatctttaggtttcagaaggcagcacaagcaaatttgcactgatgtactctttgtcaggtggtttgacttcttgctttctttgttgttagggactggatagcatggattaggaatttgattatgatgaactaattcaagaaattgccataatctttggtaccttgtgcgcctggaacatgtaaatggtaccaaacaacaatatgatatgtttaccttcatgttcaaaaaaaaaaaaaaaaaaaaaaaaaanaactcgagactagttctc

SEQ ID NO: 1853 - DNA, 508 bp, Oryza sativa
  Predicted polypeptide sequence is orthologous to G1958
gcacgagggctccagtctttatgtaataataatacccatgggggacacactgtgccaacgtttttcccagctcctgcctgtggcgcgccagattacatggatactataactgtccctgataatcacacccagagcggctcctctactgttacatctgatgctgctaaacaaaatgaatggtgggcagatataatgaatgatgactggaaagatattctagatgcaacagctactgattctcagtcaaagtccatggcccaaccttccaattctgctgcatcacagcctgctttcaatcagtcaacttcatcccatagtggcgatatttgtcctgtcacaagtcctcctcccaacaacagcaatgcctctgcaagtaaacaacggatgagatggaccccggaattggatgaatcttttgtccatgctgtaaattagcttggtggtagtgaaaaagctactccaaaaggtgtgctcaagcttatgaaagttgatggtttgacaatctatc

SEQ ID NO: 1854 - DNA, 2079 bp, Zea mays
  Predicted polypeptide sequence is orthologous to G1958
cctcgaggccggccggggcctcacatctcattcctctcctctctccgccccccctctcgctcgagctctgttggaggcaggagggcaggccagggcgccaggccaggcgaggtggttcggttgacgagttcttcctcttcctcgacatcgccgatcccgccacgcgctgcccgcagcggaggtgagacacaataatcttagatggagaggttaagcaccaaccagctctacagttctggtgttcctgtaaccgtaccaacatctctgccttgtataccagtctctctggatgagagcttcccgaggcttcccgatgcacagagtgttttgatggagagagaattgaggagcactccactaccacctcaccagacaactgttgctcctatccgtggtctgtttcactccaatactggatctgttggtcctttgtgctcacctccgtctgtaaggttctcttcgcattcaaatcctgagcaataccccaaccacaattcatacaattctcaagtaccaagcactgcaagttcctcaacgctgaattatgggtcacaatatggaggctttgaaccatccataaccgatttcccaagagacattgaaccaacttggtgccccgatccagttgagagcattcttggatactctggtgatgtccctgctgggaataatttgactgggaccacttctattggagcttcagatgatcttactaagcaaactgaatggtggacagagtttatgaatgaggattggaaggacatggttgataacccgacttccacagaaactcaaccggttgggcaacctgtgcaatcatccaactcagttcaccaatcagctacccaacaaacagtttcatctcaatctgttgaaccgttggcagttgtggcaccctcacccactgctggctccaatactggcaaggcacgcatgagatggactcctgagcttcacgagcgctttgtggatgctgtcaatatacttggtggcagtgaaaaagcaactcctaagggtgtcctgaagctaatgaaggcagacaatttgaccatttatcatgtaaaaagtcatcttcagaaatacagaacagctagatacagaccagagttatctgaaggctcttctgaaaagaaagtggcatcaaaagaagatataccatctattgacttgaaagggagttttgatctcactgaagcacttaggctccagttggaacttcaaaagcggcttcatgaacagcttgagatacaaagaagtttgcagctaagaatcgaggaacaagggaagtgtcttcagatgatgctagagcagcagtgcatacccggggcagaaaaggcgcaggatgcttcaaccgctgcagatgaattgaggtcaccttctgagattccagaatcttctaccgtcaaggaagttccagaaaacagtcaaaatggatcaaccaagcaaacaaaataagctaagggccgatgaagttgcaagcatgaaatgtgtttcatgatccgattggctgtttccaggcttaaatcaagttgtttttgtccttccgtgggaacagatgaacgctatagttaacttccttgcaaagcctggctaggtgcatgtaactaggagttagttgtatattacctaccctcacggtatcactgaatcccagtgttatgcggatgatgtagtcttcagaagacagcgcaagcacattgtcaggggtttgacttgttttgccccccattacttaggtatcaagtagcgtctcctaggcatttgattatgggctaattcaagtgtttacaataatgtttagcacctgttgtttaaaacatgtcatggtaccaaatatgacgaagatgtattgcatttatatgagagaatgagagatttgaactgctttagtttggtcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgttttaagggatccaattttacttccccgggtttgcaaggtaaaagtttttttttggggcccccaaatttaaattaa

SEQ ID NO: 1855 - DNA, 897 bp, Zea mays
  Predicted polypeptide sequence is orthologous to G1958
atttcggcacgagggttgcggggatgggggggcggttgcaatacaatactggatctggggggcctttgtgctcacctccctctgtaagggtctcttcacattcaaatcctgagcaataccccaaccacaattcatacaattctcaagtaccaagcactgcaagttcctcaacgctgggggagaggggacaacatgtttgtcctttaccatccataaccgatttcccaagagacattgaaccaacttggcgcccccatccaggtgagagcattcttggatactctggggatggccctgctgggaataatttgactgggaccactgctattggagggggagatgatcttactaagcaatctgaatggtggacagagtttatgaatgaggattggaaggacatggttgataacccgacttccacacaaactcaaccggttgggcaacctgtgcaatcatccaactcagttcaccaatcagctacccaacaaacagtgtcatctcaatctgttgaaccgttggcagttgtggcaccctcacccactgctggctccaatactggcaaggcacgcatgagatggactcctgagcttcacgagcgctttgtggatgctgtcaatatacttggtggcagtgaaagtgcgtactgcttgcagacatatgtctcccatgattgattcgttttgacattttccttaaattgttgcagaagcaactcctaagggtgtcctgaagctaatgaaggcagacaatttgaccatttatcatgtaaaaagtcatcttcagaaatacagaacagctagatacagaccagagttatctgaaggctcttctgaaaagaaagtggcatcaaaagaagatataccatctattgacttgaaagggagttttgatctcact

SEQ ID NO: 1856 - DNA, 1787 bp, Zea mays
  Predicted polypeptide sequence is orthologous to G1958
attcggctcgagggcagaggtgcgcttccccgtcgccccggccgcggcggcctgccggcctcctcgctcccccccagagtaatggattaatgctttaagcaaggtaatgaaatgtaccagaagtgacttatggaaaggaaggagcttgttcactgttctgaatgaggaagtttaatctgatgcagtctcaaaagagcagagttttgggagcaatgtcatcctctttgcctattctgccaaatcctttgaaagggagcttcccaaggcctcataacccccagcatattcctatgttgaggcagcttcctgatgactctatgcccttgtgtattgacacacatcagtctgttagtttgcacccaagagctggtgttatcggggtaccatattcaggctacactgctagtccacttgattctgtgtctaaccttgatagccagacaatggctgcaccctttatttctcagtcatccaattttgaagctctccagtctctatctgataataccccagaaacacacactaaggcagcctggttcacatcttctatggatgtttcaccactcaacacagataatattgctgcttctgatgttaatcaaatccatagtatacgtcctgctatgacatctgatgagagtgctacacaaaatgattggtgggcagatataatgaatgatgattggaaagatattcttgacgcaacagctactgattcccactcaaaagccatgattcaaatttccaactcagctacatcactacctgcagtaaatcagtcagcttcatctcatagtagggagatttgtcctgttgctagtcctcccaatagcagcaatgcttcagttgccaaacaacggatgagatggaccccagaactccatgaatgttttgtagatgctgtaaatcagcttggcggtagcgaaaaagctactcctaagggtgtgctaaagcttatgaaagttgatggtttgactatatatcatgtcaaaagccacctgcagaagtaccgcacagcccgctataaaccagacctgtcagaaggtacatcggaaaaaaggacagccactgaagagctggtcctggacctgaaaacgagcatggatcttactgaagcgctgcgccttcagatggaagtccagaaacggcttcatgaacagcttgagattcagagaaaattgcagttgcggattgaagagcaaggaaagtatctgcagatgatgtttgaaaagcagagtcaatcgagcacggagaaagtccaggatccatcctcaagggatacaacagctaaaccgtcatctaatcagagccagtctacaaacaaggatagtggtgcaaccatggacccaaatggaacaggagacatcgcacggactgcagaactgggagaacgttcgtctgaattaggtgtaaaacagaaactcgtagagatcgaagaatctggtaccgaagtagccacaggcgacagatctaagatctcccaagagaagcggcgcaaactgcaagatagttaacatatcggttgcactattcagacatagctgttcaaaccgtttgcttggtgaaaaattggtaatctgtgtgtcgaattcgactattgatccgtgagtccattggtgagttgtaccgctcttcagttagccatatatatttataaaggatccaaaggaggaccaaaggagaacttcctggcaaaaaaaaaaataaaaaaaggaacaggtgctatccccgaagttatggggtaaaataaggtcttgaaatttagctttcaaaaaaaaaaaaaaagg

SEQ ID NO: 1857 - protein, 291 aa, nicotiana tabacum
  Orthologous to G1958
MNDDDALTSNWNDIMLDTGIADAEPKMQYQEQKQPSNFPVHQGQPLQQVPTASVETSAIVPASSTASGASSKQRMRWTPELHEAFVEAVNKLGGSERATPKGVLKLMKVEGLTIYHVKSHLQKYRTARYKPEALEGSSEKKESSIGDLSALDLKTGIEITEALRLQMEVQKQLHEQLEIQRNLQLRIEEQGRYLQEMFEKQCKSIPSTDLVKASSSIAEDASAQSTDAVQRSSNKNDPAVPPSNPQEAGDYITQKVGEKQKEQEREDLGNLETNNSSSSNTPPTKRAKLDE

SEQ ID NO: 1858 - DNA, 1572 bp, Glycine max
  Predicted polypeptide sequence is orthologous to G2007
ggggaaaaccctgggaaaattatttcaaaacaaactcatttggttagaaaacccaccctaaaatcacggggaatttttccatgccacttattatcccacctttgggctaaaagctaagttcggggttattaaaaatcttttcctttaacttgggacttttttttcgtctacgtttttatccatttatttttaatgggacagtaaaacaggaaacgagagaatacaagtgaacttgtaatcacaaaagattttaccattattttcaaagtagacttctttgtacaatatgtttctgcactcactagacatttcccatttgttatgtccctaccgtacacataaatacatgcagcatttaattagaagaagaaagtacgtacgtactgtgccattttgatgatgatttggttttgctttgctatcaattttgtgttttggttggcgaggaacctcacaagaggaaacgttcaccttccaccttccgagagaaacatttttgtaaaatactaggtagataaaattcaacaccaagaacctaaatttgagcccgtggtattttgtcacatttatagatttgatatcttacccttaattttctttcatagacaattaaattcccgtgctaatgcccctcttccttcattcctatcgtttgcagtgcatgtgactctatctcgttgaaacaggtaaacccaaaatcatgaataccaaagtcttgacagtccaataaccaagcacaattatcctcccaagatggtaacaaacccatgttattactagtattctcaaggttaggtgttgtgtcccataatgcttccaccagaggagtttcatccagccacatgctgtttaatagagaatcgtcgctgcaaatgctatctagcaaaagtgaatcatccccagaagaattttcagcttgtgatgaacttgaattctcctctgagttgagaagaatcccttcagtttctttgacctgatcatcaaggttattgccaggttgcggcaaatgctctgcaggggaggatgaactatcctgagaagatgctgcagcttgttttttgagaggctcatgagtaacgggatcaatacctatcttaaggagttttttcttgatatgggtgttccaatgatttttaatctcattgtctgttcttccgggtaacctggcagcaatcttggaccacctgagacagcaatcggcatgcagatcaataacaagttgctcctctgcctctgtgagtagccctctcttcaagtctggacgaagataattcgtccaacgaaggcgacaactcttgccacagcgcttgaggccagcgagctttggcacggcgcgccaacagcattggccattggtgagaatgaagttgatgagcttcttgtcttcctcagcagtccatggacccttcttcaccccaagtttgtcacagcagggttgccttcccatagcactaacacaaaaacaacaccacttcctagctagctgaccaatattgcaattccccaaactaaatgcaaaagtcttaccaacactagcttgtaatgagtaatgacccccccttctgtcgtctt

SEQ ID NO: 1859 - DNA, 1076 bp, Glycine max
  Predicted polypeptide sequence is orthologous to G2007
ttttttttttttttttttcacgttcaaatctcgtgtgtatcactttcttgacaaataataaataaggagaactttatctaatattcatcaagaaagttataaacacaaaatttgaacgtgacatggacacgagaggatttattcccattttgtcacattcacatatacacatattttttgattgcatgctctgtttcttaaggacaactaactttaattaccatatgtactgcatcctaaagcccttttctgtccatgcctatagcttgcagtacatttgtttcaacctcgctgaaacaattgaagccaaaatcatgaataccaaagtcctggcagtccaacaaccaagcacaattatcctcccctattggtaagcccatgttattatttgcattctcaactttaggtgtattgtcccataatgtgtccatcagaggagtttcatccagccacatgctgttaattagagaaacatcactgcaaatgctatccaccaaaagggattcttccccagaagaattttcagccggtgatgaggttgaattctcttctgagttgagaaccccatcattttgctcaacctgatgaatgttaatgttattcacttgtgagaaatgctctgcaggggatgaactatctttggatgagacttgtttgttaagaggttcgtgagtaacaggatcaatacccatcttaaggagctttttcttgatgtgggtgttccagtgatttttaatttcgttgtctgtcctacctggtaacctggcagcaatcttggaccacctgttgccaagacgggcatggagatcgataacaagctgctcttcagcctgtgtgaggagccctctcttcaagtcaggccttagataattagtccaacgaagacgacaactcttaccacaacgccgaagcccagcaagcttgggaacagctcgccaacagcactggccattggagagaatgaagtttatgagttttttgtcttcctcagcagtccatggacctttcttcaccccaagtttgtcacagcagggttgcctccccataccacttgctagcaaccaatgtaaagtgac

SEQ ID NO: 1860 - DNA, 815 bp, Zea mays
  Predicted polypeptide sequence is orthologous to G2007
ggaggctcactccacgcagcagttgccaggcgcttgtcactccagccagcggcagcccttttccttggcgaggcttggtttagtttagcccgcctgcggtctgccgcctgccaagtgccacctgagacctgatagccgcaaccgtgagaggctggtagcccgtagccggcatccctcgccctcgacccatttgaacagggcctcgagctttgcctctgctgctgctcgcttgatccgtctcttgccgtagtatactacgcgtgctcgatcggcggcggcggctctacgacccgcggccgggatgggtcggcagccgtgctgcgacaagctgggggtgaagcgggggccgtggacggcggaggaggaccgcaagctcatcaacttcatcctcaccaacggccattgctgctggcgcgcggtgcccaagctcgccggcctgctgcgctgcggcaagagctgccgcctgcgctggaccaactacctccgcccggacctcaagcgcgggctcctcacggacgccgaggagcaggtcgtcatcgacctccacgccaagctcggcaacagatggtcgaagattgctgccaagctaccgggcaggactgacaacgagatcaagaaccactggaacacgcacattaagaagaagctgatcaagatgggcatcgatccagtcacgcacgaacccctcgaccggaagacaaccagcagcggcccggctacaacctctcagtcaaccaagtctgacgaggcgaccaaggagcagagcccgcagaacgacgacgccgtgataggggacgtgcccgccgatggttgca

SEQ ID NO: 1861 - DNA, 3330 bp, Zea mays
  Predicted polypeptide sequence is orthologous to G2007
ccacgcgtccggtcgcggtcgcgaccaagcgacgacggcgagggagggaatgtacgccgctgtcccccactctcctccccactcccaccgcagtccatcgacagtggagggttcccggaagcaaagcgccagcggcaggtaagcagaagcctggctagctggcctctggtatgtggttggctcaaggattacaggatttcaatcagtaacaatcaagtatgaggaaggaacaacaacgggtgtccaagcttgggtggttggcttgccggttacagcaagtcaattagtaactacagatgggaggaaggcgaccgacggtatggctgacatgagaccctgtctaactcatgtttcttccttccttccctcatcagccgtcccgtcgatcgggcaaataaagttgcgcctagggaggaaggaaccaggcggcaggctgcccgtgccgacgtggatcgggccagagctaggtaagtgcacctgtgggctgtggtcggcaggcgatcgaaggtgagtgagccggtgagccccgccatgcactgacggagtcactgccgactctcgtcgtccgatctctttttactgtggacgaatgggtgcgtgcagcctatctgcctatgggaagcgagagggggcccgggactgggttgagcaccttgtgcgcaaaggcatggtggcgtctggggccggctgcaggcgtgtgcgcacctgcacgagcgtgcagtcgcggcgcgtggctgcagtttggtgtgcctgggacggggactcgtgccgtgtgtcctgcgcgaggtggttttgcggctggctgacggaatggttgatggaatccttgcgtaaggacgcaactgagaggtaagcccccctcgtccccgtcccccgtgggaaacgggagtgccaaagccttgtggcacaccaaactgtagcttttgatcgtgcatggtggggcgcctacctgatgctacgcaaacttttgtgtcgcagcttcagttaccctgaagagcagggcaagctagcaaaaggtgaaagcgtttggtcacgtagaatccatacaggtcatacatatatagcagtcgcaactcgcaactcgcacgtagagcgtagaggttcaaatctgagccttagttcagaatgcagcttcagtttgggagttcgttcgtgcatagcaggccctatagctggggttagtcgtgtgcaaggattctccatgtggacaacacaacacaagcaagcaagctaatataaggttggatttaaaagtcgcagaacaattcatgacgtgcttggaaaacgttggtagcgtcttttaatgcttgatctaaaggctaagttatcatccatgggctaggtttgtttgttagtattaccctgtccagtgcaagggcaggtaggaggtagagagagaccgagcaagtactaacctttcatggccccggtctgcccccccagctccctctttcccttgggggccgctgtgtgctccgtcgccatcgcgggggataaaaggaaaaggctccgaggaaacagtataaaagcgcccccggcacgcacgcacgcacgcaggctcactccacgcagcagttgccaggcgcttgtcactccagccagcggcagcccttttccttggcgaggcttggtttagtttagcccgcctgcggtctgccgcctgccaagtgccacctgagacctgatagccgcaaccgtgagaggctggtagcccgtagccggcatccctcgccctcgacccatttgaacagggcctcgagctttgcctctgctgctgctcgcttgatccgtctcttgccgtggtacgcgtgctcgatcggcggatcgtcggcggcggcggcgggaagctctccgacccgcggccgggatgggtcggcagccgtgctgcgacaagttgggggtgaagcgggggccgtggacggcggaggaggaccgcaagctcatcaacttcatcctcaccaacggccattgctgctggcgcgcggtgcccaagctcgccggcctgctgcgctgcggcaagagctgccgcctgcgctggaccaactacctccgcccggacctcaagcgcgggctcctcacggacgccgaggagcaggtcgtcatcgacctccacgccaagctcggcaacagatggtcgaagattgctgccaagctaccgggcaggactgacaacgagatcaagaaccactggaacacgcacattaagaagaagctgatcaagatgggcatcgatccagtcacgcacgaacccctcgaccggaagacaaccagcagcggcccggcccacgcgtccgagtcaaccaagtctgacgaggcgaccaaggagcagagcccgcagaacgacgacgccgtgataagggacgtgccggccgatggttgcagcccgacggaatcgagcacgaacaccgtgagcaccggcggaagcagcagcagtggtggcggcggccatgaccaagacccgctggtgaagtggcttttggaagaggagcctgccaccggcgacgaggcgtggctgaacttcactggcagtgtcgacgtggacgagttcagcagcattgccgccggtccggagttgttgccgtgggatggcgcgaccgactggctgctcgactaccaagattttggattgggggactcgagcttggtcgatggctacatggtcaacaacaacagctcaaacggagcaaagttctagctagctagccgaagatgtcatctcatctgcttgtgttgctttgctgccagtgaacgtagatacgtaagtaataaaagcattggtatcgaggttgtcaaaggtggatgaccacatcgcaggaagatcatgaagagtccttgcacgcactcctgtatctcgaaccaactaacggctgggatgcaattgagaaggggaggagcacaggccaatcaatctcaaagagataaaactggttcttgaagatctcgaagaaagatgtgtttcttcacaatcacaaagagaggttgtagaagttcttgctgttgtatacatggttgcgtatatattgctaaattgtaccttgttaggccattttgttcgcaaattgcacgagtcactaattagtcagcaaaaatgtgtgcataaagaagagcagttgaaatccccgcggcccgcgcggtgggtgacgttcttttagttacgttgtggatgacgttgatgcatttatagggtatttggtttgaggaataagttatctggtttgtagaatggaataagttatccatcatcacctcattaatcatggttagtactaacatgagtaattgagtcattccaccaaaaaaaaaaaaaaaaaaactcgagagtacttctag

SEQ ID NO: 1862 - DNA, 399 bp, Zea mays
  Predicted polypeptide sequence is orthologous to G2007
  misc_feature (309)..(309): n is a, c, g, or t
ggtgatagtaaatgatcaatggggagacagccggctgtgacaggagggggtgaagcgagggccatggacagcggaggaggacaagaagctcattagcttcatcctgacacatggccggtgctgctggcgggcagtgcctaaactcgcagggctgcttcgttgcggcaagagctgccgtctgcggtggactaactatcttcgccctgacctcaagcgtggcctcctcagcactgccgaggagcagcttgtcattgacctccatgccaagctcggaaatagatggtcccagattgctgccaagttgcctgngagaacagacaacgagatcaagaaccactggaacacgcacatcaagaagaagcttgtcaagatgggtgtcgacccggccacacacgagcc

SEQ ID NO: 1863 - protein, 326 aa, Oryza sativa
  Orthologous to G2007
MGRQPCCDKLGVKRGPWTAEEDKKLMSFILTNGHCCWRAVPKLAGLLRCGKSCRLRWTNYLRPDLKRGLLTDAEEQLVIDLHAKLGNRALAPTSLISVAKRTLHVDSEIESILLGPVASLENGRKLFKKWSKIAAKLPGRTDNEIKNHWNTHIKKKLIKMGIDPVTHEPLDRKQESPATTSQSTVTAESSKSGEATRQQSRQLDDAVVRDMSVSAGGDSPPESSTNTASTAGGSSSSSSSHHQDPLVKWLLEEDLLPTGDEPWLNFTASNDVDEFSSIAATGATPALPWDVGMTTDWLLDYQDFGMGDSSLVVDASMVNSSNGSNF

SEQ ID NO: 1864 - DNA, 1031 bp, Glycine max
  Predicted polypeptide sequence is orthologous to G2010, G2347
tcctctaaagcggccgcttttttttttttttttttttttttttttttacccaaaagaagcaatatctttttattctaacccaatggaagataagagcacaccccaatcaagaagggtgcttctataggataacaatggtgataaggcaaacagaaaaaaaaaggcactctatccaaataagaaaaacagagctcaggaaactagctagcttacattgcatattaagacatcaggctttggctgttggaagtttttgggatttttgattcttgctcatgtgaacatacaatacaaagtggtttttattatataccttgggttgtaagaaaccaaagggtgacagaagagagagagctttgtgaacactttggcttcatctgatgttgaaagacttgtagccggaactccctggtaggttcatctgaattctctccctctcatttgcaagcctgcagtgtgttgtttccttagggtgatggcctttggtgctgccctcattggaagcttccgggttgcttttccggcgccgctcgttgtgtccggccaaccggcggcggcagcttctcttggattcatcaaactctgccaggtcatggaacctgctacattgctggcaaaacctctgccttagccctgcaaccaccacaacaggtgcctttgaatgaaactcacacaccttgtggcggcgatggtacctctttgcatcagttaaatcagcaccacacctctctgcttgacatgaaggtggagaaacccctccactacctccacttgaccctcttctcccaccactactaccaacccctttcttcttctcttcttcagtaatactaacgccactttcatcctcctcctctacttcattttccacttcctcttccactgtgctattctttctcaccctctcaaacaatgctctctccctctccattgtgcaaaggggtggtgacaatgatgaaggatatgcttgttgttgagctaggacttttggagccccttctgtctcttctcgcagccgtacggacgcgtgg

SEQ ID NO: 1865 - DNA, 1403 bp, Oryza sativa
  Predicted polypeptide sequence is orthologous to G2010, G2347
ggtctctctctctccctctctcctcctcctcctcctcctccgccttccacttccacttccactcatgagctcgagctcgagctagctctagctctctccaccctcctccagccaccgcttccacctcccctaggaggctagcacacagcacacagtagcactagctcgtcgtcgatcacgcgcgccaccgcccatggaccgcaaggacaaggcccgcaagaacttctcctcgtcgtcctcctcctcggccgcgtccatggccgcgctcgccgccgcggcggccgcgggggacggcggggcggcgctgccgtcccccatggaggaggacaagaagcccaggctggtggcgtcgtcgctggcgcccgtggcaggcggcggcggcggcggttcctcctcgtccgctgctgttgctgctggcgcgtcttctagctcctcctcctcctcggtggccgcggcggcgaggaggggcgcgggccgtgccggcggtggcgccccgtcgggcggcggcggcgggccgaggtgccaggtggagaggtgcggcgtcgacctcagcgaggctgggcggtacaaccggaggcacaaggtgtgccagacgcactccaaggagcccgtcgtcctcgtcgctggcctccgtcagcgcttctgccagcaatgcagccggttccatgagctgacggagttcgacgacgcgaagaggagctgccggcggcggctggccgggcacaacgagcggcgccggaagagcgcggcggacacggcgcacggcgagaactgccgccacgccgaccaggacgccggccggagccaccagggcaccgggaacccgccgttccagatcagataaacctacctaagcatgctccctctcttctgtcatgcagccatgctagtgtgagtgtgtgtgttcgtgccactactactactacatgtctacatcgatctatctacctatatatatccaccacctacgtcccttcttcctcaaatcaatcaaatctatctatctatctatttatctatccctgaatctatctctatccggtgtgctttgctgctgctgattaactggcagtgtgatcatctccctctactgctgctacatatatgcagtgctatgctggagaggcataaatgtgctatatatatgttctctgccacaaccctaagctaattgtaacctgttgattaagcaggtgttctagggattctctctctctctctctgtgtgagggtgtgtttgatgtgtaattgtactattgcctttgcccaacagaaacttgtaggctgcagtgtgcctatgtatgctgttgtgccgggatggcagtggtaatatatgctgtttgagtcaaaaaaaaaaaaaaaaaaaaaaaaaaactcgagactagttctctctctcctcgtgc

SEQ ID NO: 1866 - DNA, 777 bp, Zea mays
  Predicted polypeptide sequence is orthologous to G2010
tatgccggactcctcctcctccgccggcacaggcggcatggccccctcgagctcggcggcgccgggccgagctgccaggtcgagcggtgcagcgccgacatgggcgtggagaagcggtacaaccggaggcacaaggtgtgcgacgcgcaccgcaaggcgtccgtcgtcctcctggccggcctccgccagcgcttctgccagcaatgcagccggtaagccccgcctgcctgcttgctcggaggcacatgcacatgggcgcagtgcagtgtgcagtccggccggcgtgcgtgactcgtacgtgagtgagttcgtgacatgctcaaaggcaccggccgctttcagtttgtacgggtactactactactaaactaaacgagcttaattcgaccttgaaaagtaaacttgcttgcctgaagcgcatcgggtcccttgagaaagcttgcagctttttttcttgggtcatggatagcacggtgagctgctggattggatcctaagctagctaggttgctctctcaactcaagatcttgcagaagcgtctctcagtctcatgcaacctctttggaggttattaatcaaaccgtgctagctcctctgcctggagcttctctccgcctgtgtcactctttcttgacccccggccctcgtctgctcgcaggttccacgagctgtcgcacttcgacgacaccaagcgcagctgccgcctgcgcctgggcgggcacaacgagcggcgccgggagaacccggcggaggcgcaagaccagcacggcgggcgg

SEQ ID NO: 1867 - DNA, 1108 bp, Zea mays
  Predicted polypeptide sequence is orthologous to G2010, G2347
gcggcgtccggcgacggctcggacgactccggggcggccaacaacaacggcgcgctgccgctgccgctgccgccgccgcacggggtggaggacaacaacagtcccgcggagctggcgggcgcgggtggcacctcccgggcggtggcgaggagggtcgcggcggccggcgcctccccggcggcggcggcgaggaggggcgccgccttgaacgccgcggcggccggcggcgccgggccgagctgccaggtcgagcggtgcagcgccgacatgggcgtggagaagcggtacaaccggaggcacaaggtgtgcgacgcgcaccgcaaggcgtccgtcgtcctcctggccggcctccgccagcgcttctgccagcaatgcagccggttccacgagctgtcgcacttcgacgacaccaagcgcagctgccgcctgcgcctggcggggcacaacgagcggcgccggaggaaccccgcggaggcgcaggaccagcacggcgggcggggcgacccggggagccaccacctccagatcagataaaaacctactacgtcagcatgctctctctcttctgtcatgcaggacgcacgcacctagcgtcgtcaccgatccatagtccgatatgtgtctcaagtgttgtgtgtgcgcgctctcgccgcctacccctgtcctgcagtgttgcgtagtatatggttctacgacctacacgtactgctgctactactgcgtgctaactttaatctgatggcagtccacagctagctagcacatcacctcctgtaagtaatgtgcttatctatatgtgcaccgaccggaaccggaggcgtgcgtacctacgctgatctgccacgaagcctactagtagttaaatgtaacgtaacctgcaggcaattaagcagggcgctgctatatatagcgtaattaattgtgcgtatgggtatggtggttcgattatcggatgtgtaatccctgtacgtggccgggcccgtgccaaagcgtacggtgacctgtgcaggctctgtgtgtcgatgatgttgtactctgataatgatataatccattgtggtaatgtatgctatttaaaaaaaaaaaaaaaaaaaaaaggcggcgctcg

SEQ ID NO: 1868 - DNA, 554 bp, Glycine max
  Predicted polypeptide sequence is orthologous to G2059
cagtggcttccctagcatcttcttctgccagaccaaaatttccaaacttgactttgtttttgccggaaccctccatggtgtactcatcaatatcatcctcaaatataaaaggtggtgaagtcatgtcagctacttcagacccctcatatcatgtgtctcagtttggccaaaaccagcatcaagcaggtagtggggatgcacacaaaatgaacaacaacctaacaaattcgcggtccaagtctttcaacgagaattggttgagtgccactaggactcagcctttgaagtatggtggaagaggcaagctgtttaaaggtgtgaggcagagacactgggggaaatgggtagctgagattagattaccaacaaacaggacaagggtttggctagggactttcgactccgccgaagatgctgccatcgcatatgacacagcagcatacatactacgaggagaatatgctcaattgaacttcccagaactcagcatgtaattcaagcaaattctctgaaaggctaccactgctgcacttgtggaggcaaaatacaagcaa

SEQ ID NO: 1869 - DNA, 1301 bp, Glycine max
  Predicted polypeptide sequence is orthologous to G2085
attcggctcgagctccctttcattttccctcacactcatcattctcaaaaaacacgcccaaattctaatcaaattagggttagggttttcaactcccctcgaattatccctgtaatgcagtgcgattcccgggtcctaccatggagccatcagcaatgtacggaccctcccagcccctgaacatcccctcgcggatcggcgctggcgaaagagacgacggctccggcaacgagcccgccgtcgacggccaccaccaccacattcagtacgaaacgcacgcgctcgatgacggtgccgccggtggcgccgtggttgtcgaggatgttacgtcggacgcggtctatgtctccggcggtggaggccccgaggagtccagccagcttacgctgtcgtttcgtggccaagtttacgtcttcgatgccgttacgcctgataaggttcaagcggtgttgttacttttgggtggatgtgaactatcttcgggtggttcgccatgtgtggatcctggggctcaacagaatcaaaggggttcaatggaatttcctaaatgtagtctaccacaacgagctgcctcattagataggttcaggcagaagaggaaagagcgatgctttgataaaaaagtgagatatagcgtacggcaagaagttgcgctcaggatgcatcgtaacaagggtcagtttacttcatctaagaaacaagatggagctaatagttatggtactgaccaagattcaggacaggatgatagtcaatccgaaacctcatgtaaacattgtggcactagttcaaaatccaccccaatgatgcggcgagggccatctggtccaaggtcactttgcaacgcttgtgggcttttttgggcaaataggggtgctttgcgagacctttctaagagaaatcaggaacactctcttccaccagttgagcaggttgatgaaggtaatgactcggactgtcggactgccactgccgaccctgcacataacaatcttcctgctttctcagagcatgataatccagctttggtagctgatcataaagttttccagtctcagaaaatgttgaagtagtttactctggcataagtaggtctatagttcttccattcagattgaccaataggaatgtacagacataacaatactcccatcaatgcaagaactttgtttttatatggttggatctatggcattaaccattgatctctggatgtataacctgaaacttgaatgatgacttggtgatggtctcacccaataccttgaatttaattttacacgtagattttttgttcaagg

SEQ ID NO: 1870 - DNA, 1549 bp, Glycine max
  Predicted polypeptide sequence is orthologous to G2085
atgcagcgtcaccggtgcgcgactccacgcgtccgggacactttaacagcattctctctctctcgagtctcttccccccgactcggcgccccgccgccccccgcaacacaacggacacattctgagactatttatagttatccccattctggttatgttctttctttcttactccctctcaatcaaaccgtgttagggttagaactaagattagggtttctttactttacccgcgtaatgtaatgcgtcgaaaacccccaattctaccctccttccaacaacaacaatgttcggctccatgaacaagatcgtctccgctgaagacaccgacggctccgtctccgaccaccacatccattacagttcccacaccatcgaagacgacggcgccgcctccgatcaccacatccattacagttcccacaccatcgaagaggacggcgccgtctccaaccaccacatccattacagttcccacaccatcgaagacgacggcggcgccactgtcgaagaggtttccgccgttccgccccttgaaatctctatcaacgattctagccagctcacgctctcgtttcgcggccaagtctatgtcttcgacgctgttacacctgataaggttcaagcagtgttgttgctgttgggaggaaatgaactaacttcgggttcgcaatgtgcggagctatcatctcaaaatcagactggtgaggaggaatatcctgcaaaatgtagtctaccacagcgagcagcgtcattgaataggtttcgtcagaagaggaaagagcggtgctttgataagaaagttagatatagtgtacgtcaagaagttgcactcaggatgcatcgaaataagggtcaatttacttcatcaaagaatcaggatggaactaatagttggggttcagatcaagagtcagggcaggatgctgttcaatctgaaaccttgtgccacacattgtggaataagttcaaaatccactccaatgatgcgtaaggggccatctggtccaaggtcactttgcaatgcttgtgggcttttttgggcaaataggggcactttgagggatctttctaagagaaaccaggaacactctcttgcaccacctgagcaggttgatgagggcagtaataataatgactttgactgtcggagtggcatccctgcacaacataacaatcttgttaatgataacaaagctttggtatctgatcgttgagttttccactcacaggaaatgcaagtccttgactgtgacattcgcaggtttttagtaattccattcagtttgacctatagaatgtacagtatatagcaaagctctcgtcaatacaagagcggtctatttctatactctctgatcagttgcattaaactgtttatctatgactgtacaaactggaatttggaatgacttgatcgcatacaagagatctattcctttactctcggacagttgcattaactgttttatctatgaatgtataaactggaatttgaaacgaacttgatcctcattccgtggtctggtggttttagtttagtctagtg

SEQ ID NO: 1871 - DNA, 1380 bp, Glycine max
  Predicted polypeptide sequence is orthologous to G2085
  misc_feature (485)..(485): n is a, c, g, or t
  misc_feature (562)..(562): n is a, c, g, or t
tattatttgcagctgctatgtttgctgtagcggccattctatagtcaacaattccaatacagcattttcgggggtagtcactcgactcactcccagccatcttccttcattaactactttatttgtttcttactttgttactattgtgtgacaaattttgaccttttaatacatttaagatgaaattgacattagtgcttttatgtttttgcttccccttcccatatgacaaattgtgtacaacaagatttcaaatataaggcatgcttcaacagcatcctctgccagcaagttggatatatatgctcaagtgaatggctaattttggacattgagatttttgttgctatagccatgggtatgcgtgtgtgtgtgtgtgtattggtatgtacatggttgcattggtttaacaaattgctttggttttatcagcaagaacctttttgggcatttgttatttcatatgtaattaatgctatcaaagnaagaagttcatatcttcccacggactattgcacatcatctatgttccacattttattcttattgctcaccattttanggtgtttgatttaatttgcatcaatgtatatttcttatttgatttttaaatgtagcgtcaagaagttgcactcaggatgcatcgtaataagggtcaatttacttcatcaaagaatcagggtgggactaatagttgggggttcagaatcaagagtcagggcagggatgctgttcaatctgaaaaccttgggctgcacacattgtgggaataagttcaaaatccactcccatgatgcctagggggccatctggtccaaggtcactttgcaatgcttgtgggcttttttgggcaaataggggcactttgagggatctttctaagagaaaccaggaacactctcttgcaccacctgagcaggttgatgagggcagtaataataatgactttgactgtcggagtggcatccctgcacaacataacaatcttgttaatgccggcccagcttaacaatcttgttaatgataccaaagctttggtatctgatcgttgggtttcccccccccaggaaatgcaagcccttggctggcacattcgcaggtttttagtaattccattcagtttgccctatagaatgtccagtatataccaaagctctcgtcaatacaagagagctctatttctatactctctgatcagttgcattaaactgtttatctaggcctgtacaacctggaatttggaatgacttgatctcatacaagagatctattgctttactctcggacagtggcattaactgttttatctatgaatgtataaactggaatttgaaacgaacttgatcctccaaaaaaaaaaataaaaaaaaaaaacaaaaa

SEQ ID NO: 1872 - DNA, 499 bp, Glycine max
  Predicted polypeptide sequence is orthologous to G2085
tgaacaaaaaatctacgtgtaaaattaaattcaaggtattgggtgagaccatcaccaagtcatcattcaagtttcaggttatacatccagagatcaatggttaatgccatagatccaaccatataaaaacaaagttcttgcattgatgggagtattgttatgtctgtacattcctattggtcaatctgaatggaagaactatagaaaaattatgccagaggaaactacttcaacattttctgagactggaaaactttatgatcagcttccaaaagctgattatcatgcttctaaaaagccagaaaaatggtattttccagggccggaagggcaatcccaccagtccaagtattaaccttattaaaccggctaacctgggggaaaaaagggttcctgatttctttaaaaaaggtctcgcaaagcacccctatttgcccaaaaaggcccacaagcgttgcaaagtgaccttggaccaaatggccctcgccgcatcattggg

SEQ ID NO: 1873 - DNA, 1309 bp, Zea mays
  Predicted polypeptide sequence is orthologous to G2085
aacaaaaaatctacgcgtaaaattaaattcaaggtattgggtgagaccatcaccaagtcatcattcaagtttcaggtgatacatccagagatcaatggttaatgccactgatccaaccatataaacacaaagttcttgcattgatgggagtatcgctatgtctgtacattcctatcggtcaatctgaatggaagaactatagacctacttatgccagagtcaactactccaacattttctgagactggaaaaccttacgatcagctaccaaagctggattatcaggctctgagaaagcagcaagattgttttgtgcagggtcggcagcggcagtccgacagtccgggtcattacctccatcaacctgctcaactggcggaagagagtgttcctgatgtctcttagaaaggtctcgcaaagcacccctatttgcccaaaaaagcccacaagcgttgcaaagtgaccttggaccagatggccctcgccgcatcattggggtggattttgaactagtgccacaatgtttacatgaggtttcagattgactatcatcctgtcctgaatcttggtcagtaccataactattagctccatcttgtttcttagatgaagtaaactgacccttgttacgatgcatcctgagcgcaacttcttgccgtacgctatatctcacttttttatcaaagcatcgctctttcctcttctgcctgaacctatctaatgaggcagctcgttgtggtagactacatttaggaaattccattgaacccctttgattctgttgagccccaggatccacacatggcgaaccacccgaagatagttcacatccacccaaaagtaacaacaccgcttgaaccttatcaggcgtaacggcatcgaagacgtacacttggccacgaaacgacagcgtaagctggctggactcctcggggcctcctccgccggagacatagaccgcgtccgacgtaacatcctcgacgaccacggcgccaccggcggcaccgtcctcgagcgcgtgcgtttcgtactgaatgtggtggtggtggccgtcgacggcgggctcgttgccggagccgtcgtcgctttcgccgccgccgatccgcgagggcatgctcaggggctgggagggtccgtacattgctgatggctccatggtagtaggacccgggaatcgcactgcattacagggataattcgaggggagttggaacccctaaccctaatttgattcgaagttgggcgtgttttgtgagtatcatgtgtgcgtgggcgtgtgaggcgggggagaatgaaagggagtgaagag

SEQ ID NO: 1874 - protein, 784 aa, Oryza sativa
  Orthologous to G2085
MAIDGFLLLSNSLAAAAAAFSSALSATCTPEMRRRLASGPQDRCPHTSAISEGTGYSTRWERGVGGGDAMMHMLVAPDGGGGGEMPPPYGGAAAAPPPPMEQELELHRDNADDGLDGHVRCLRCGISGNATPHMRRGPDGPRTLCNACGIAYRKGKMRRMIEAEPPIDEAALAKLVPEVGMEFESEDKAYEFYNKYAGHVGFSVRKSTSHKSSGNITKVRTFVCSREGYNRDKKSLEAKKPRLDTRIGCPARLIIKVTPESKYRVTDFKADHNHQLAPPSTMHMLRSQRILTELQSGEAELSDDSVMTPTTKATGDLVVRQIGFLRSISLLPADYKNYLRSKRMKAMQLGDGGAILKYLQTMQMENPAFFYTMQIDEDDKLTNFFWADPKSREDFNYFGDVLCLDTTYKINGYGRPLSLFLGVNHHKQTIVFGAAMLYDESFESYRWLFESFKIAMHGKQPAVALVDQSIPLASAMAAAWPNTTQRTCAWHVYQNSLKHLNHVFQGSKTFAKDFSRCVFGYEEEEEFLFAWRSMLEKYDLRHNEWLSKLFDERERWALAYERHIFCADIISALQAESFSSVLKKFLGPQLDLLSFFKHYERAVDEHRYAELQADFQASQSYPRIPPAKMLKQAAHTYTPVVFEIFRKEFELFMDSVLFSCGEAGATSEYKVAPSEKPKEHFVRFDSSDCSCICTCRKFEFMGIPCCHMLKVLDYRNIKELPQRYLLKRWRRTAKSANEENQGTLLFLICMRIHFAEAHDAGDLNLNIIPSARCLLHDTGVEAVR

SEQ ID NO: 1875 - protein, 76 aa, Oryza sativa
  Orthologous to G2105
MPLTLLCLAFSPFAWPPSLPPPPQTPDAIAGCKNKAEAGAGRWLRQDTLELLTIRPEMDTVLQEATLNGAIWEEIS

SEQ ID NO: 1876 - DNA, 445 bp, Glycine max
  Predicted polypeptide sequence is orthologous to G2110
ccagtggaggaaatatggacagaagatagcaaaaggaaatccatgtccaagagcatactatcgttgcacacttgctccagcatgcccggttaggaaacaggtgcaaagatgtgctgatgacatgtccatcttaatcaccacatatgaaggaactcacaaccacccaattccagcttcagccacagccatggcttccaccacttctgctgctgtttccatgttgttgtcaggctcttcaacatctcagcctacagatcacagttttgcctatcatgcaaattctcctacactgttcagtggtgtcaatttcagtcttttagaccaaccaagagcaaaccaagtcttgttaccaaccccttcctcacatttactcccaacaatcactctagaccttacttctactccatcctattcattaaatcaagggaattgtttaccatcaaac

SEQ ID NO: 1877 - DNA, 809 bp, Oryza sativa
  Predicted polypeptide sequence is orthologous to G2114
gttcgaaattcatcgagaatgtgaactctgaacagaagaatccccacaaacgtgcagtcattttcaatgacaacgtgttttttacaatctggaatgataggttatattgagcagaacataaatattgagttgctcaggtgttgtacagatctaccctactcaacctataatacatgctcaaaatctttcttgctgagacgaatttgctagtcaatcgaaaattgagctgtaatttgtagattataacgcagagatattaacaagctgcaaccagttgtatctgtatgtaccactaagctccaaatatgactgaaacaaccctaatatgcgatgcggctccaccaagtcaagttttcattctggcttagacgcaagcagcttcaagcctgccccttctatacagtgcatacccttctccatgtagttgcttcgatcaaagttggtcaccgcatttttgccacggatctcaatagcagcaatgtcgtaagcctccgctgcttcttcctcagttttgaaagttcccaggtaaatgtctcttgttccagcaaccagtcctatgcgtgcctgccacctcccatctttctgccttctagtaactcctctataaatagaagcccctcttgagaagcagctacttcttcttcttaggtatgttacgcattcctctcgagacatgtcccttatgtcctccagttccctttcgtattctgaaaccgaggaattcagctttgtattttggccccagtatttaagagctgcaacatcatatgacctgggcagctttttcctcgggatcataacttcctaaa

SEQ ID NO: 1878 - DNA, 1204 bp, Oryza sativa
  Predicted polypeptide sequence is orthologous to G2114
  misc_feature (585)..(585): n is a, c, g, or t
  misc_feature (588)..(588): n is a, c, g, or t
  misc_feature (596)..(596): n is a, c, g, or t
  misc_feature (620)..(620): n is a, c, g, or t
  misc_feature (631)..(631): n is a, c, g, or t
  misc_feature (742)..(742): n is a, c, g, or t
  misc_feature (744)..(744): n is a, c, g, or t
ttttttttttttttttttttttttttttttttttttttttttttttttttttttaacttgcctagctatcattatgccaaagagtaatatcaaccgaacacccccaacatcacatggtcctatctctggagctggtaaacaccagcatgacaacacggcagataagaatatctcgaaaaacacatacaagcgcgggaaaactaaaaagggccaacttggtgttaaaaagaaaataaataaaacaaaaaacaatttacaagttgtattcttttatctatcgtccagcgagcttcgcagccttcgatggaccctctagtagctttggaacctctgatgaggcttctaattttttcaaaccatcttcacagtagttactaatatcaaagttggtcacagcatgggcaccacgaagctcgatggcagctaggtcataagcttcagctgcctctatctccgtttcaaaggttccaagatagatgtctttggtgtctctactttctccaatcctaccaatccgtgcttgccatctaccatcctttcgccttgttacacccctatatgatgaagttccccttgagaaacagntgntctgcttnttatgaacaccacaaattcatctngggacatggtnttcatcctctcgatttctttctcataatcagaaacattgaagttaagtttggtgtttggccctgcaccccaatatttaagggctgcaaggtcatgtgcccttgcagcattntnttcagtaacatagcttcctaggtacacatgcttccccttgcgcttgcggccctcgacctggctgctgttgtcccagaggtgcgcctcgaacttgccgctccacttcaacctcgtgacgccgtggtaccgcgacgaccgcggcgcggcgtacttgcgcatggtctccgccaccagcttccctcctcctcctcctcctcctccctccgccgccgcagccgctttcccatcatccccgccgccgtccgcgacggccagctgctcgtcgagcgccgcgatctcctcgccccccgccgcggccggctgctcctccgtctccggaggaggaggaggcgcggggtccgaggcggcgggttgcacggtggccatcgccgcgaggtgaatcttcttcttcttggatttctcctcggcgaaatcttcgagagctcgtcgcggcgcaaaccctagccgccggcccttgtcc

SEQ ID NO: 1879 - DNA, 552 bp, Zea mays
  Predicted polypeptide sequence is orthologous to G2114
gcttagcatccaattccattttctagcctcctcaatgtttggctgaatgcattcgattcgaacgttaactcaccttcttgttcttgcaatgccaatgcaatgtcaacaacgacgagcagtctacctaggcggctatgacagggaggagaaggctgcgagggcttatgacctggcagctctcaagtactgggggcccctcgactcaacataaatttcccgctgagccactacgagaaggagctgcagcagatcaagcacatgtcgaggcaggagttcattgcacacctgagaaggcatcaccagcacgggagatggcaggccaggattgggagggtcgctggcaataaggacctgtaccttggcacattcagcacgcaggaggaagcggcggaggcgtacgacatcgcggcgatcaagttccgtggcctcaacgcggtgaccaacttcgacatcagcaagtacgacgtgaagcgcatctgcgccagcacccacctcatcggcggcgccgacgcgtgcaggcgctccccgacgcggcaaccgactagtgagctc

SEQ ID NO: 1880 - DNA, 1292 bp, Zea mays
  Predicted polypeptide sequence is orthologous to G2114
ctccagggaccagatccggggtcggccgcacccgctcccgcgcacttgaagattcgcgaaagacagcgcgaccgacccacggcgatggccaccgtccaccctcaatccccggcgggtcccacccatctcccgcaggaggagcgacacggggacgccccggtaccgcccgccgtctccggcgaacccgccgccgcagcggaggcgggcggcgagatcgccgcgctcgacaagcagctcgccgtcgtcggcggcggcgaggagaggaggccggccggggccggggccggggccgccagcgcaggcgggggagggaagctggtggcggaggccatgcgcaagtacgctgccccgcggtcgtcgcgcttccacggcgtcaccaggctcaagtggagcggcaagtacgaggcgcacctttgggacaacaccagccaggtccatgcccgcctgcgcttgggctcgcccgtgtacttaggcagctatgtcgatgaagagcaggctgcaaaggcacatgatttggctgcccttaaatattggggcacagggccaaacaccaaactgaacttcaatatttctgattatgagaaagaaattgaggttatgaagaccatgtcccaagatgaatttgtggcctacataaggagacaaagcagttgtttctcaagaggtacttcatcataccggggtgtaaccagacggaaggatggtaaatggcaagcaagaattggtaggatcggtgagagtagagacaccaaagacatttaccttgggacctttgaaactgaagaagaggcagcagaagcttatgacatcgcagcgatcgagcttcggggtgttcatgcagtcaccaactttgacattagtaattactgtgaagatggtttgagaaaattagaaggcccatcagaggtggctaagcttggaagtccgtcggaggttgtgaagctcgctgggcaatagatactagattagcaacgtgtaaattagtttctatttcgtttcttttgtcttcatattctctcccttttgtattcctggttttttttgccgttttgtgatttcctccttgccttattggcaagccagtatttacccgattcgaaaggacaatgtgatgttgtattttagcctcacagaaaggtattactaacctttgatgtcactgcagaagtcgacaccatgttagaaatttagttcattcgtcgatgagcatgtctagtgttattatataattgtaagctactgtttctaatgggggaggaatgaaaacagaacatgaacataagttgcattgt

SEQ ID NO: 1881 - DNA, 516 bp, Oryza sativa
  Predicted polypeptide sequence is orthologous to G2117
ctgcagtaagcagaatcaaagcagattaaccctcatctacttctggccctctaagagttctccactaagcaagcgaaaacagccatgctgcaccaccattaccatggcgaggtggccagcctgcactgcctctcacctgcaagcctaccattcagttcccactaccacagcaacatgatcaccatggcaccctcgcccttccacttcccagcagctacctgtgaacctatccaggaattgctccctgtggtagcgggcaatcgtccagccggctctggcagcacagatgacgcctaccagatggcagcggaggaggagcggaggcggcggaggatgatctccaaccgggagtcggcacggcggtcgcgcatgcgcaagcagcggcagctcatcgagctgagggggcaggttgtccacctccgtgacgccaaccggcgccttcttgatgagctcaaccaagcaatgaggggctgcagtgatgtccactgcgagaacactctgctcatgaaggagagg

SEQ ID NO: 1882 - DNA, 666 bp, Medicago truncatula
  Predicted polypeptide sequence is orthologous to G2130
ctcatcctaaaggtttataggctataacccttcttcttcacggttctctttatattctaaaaccgggcctatttgttccttaaccacacacactcttttttctttgtcataagagtcaaacacaatggaaaaacagagtatcctatgcaaatacacagaacatgaaactgttacaaaaaaactcatcacaacaaagaaaaatggtcacagtaacaacaacaacaatacaaccataaacccaagagttgtaagaatatctgtcaccgacccagatgcaaccgactcatcaagtgatgaagaaggacaaatacaaaccttcagaaacagaacaaaacgttatataaaccgtattgaaattgaaaccactacaaaagctgttgttagcagaaaaagacccgccggagaaacatcaactgtacgacggccggcgaagattccggcagtcaacaacggtaaaaagttccgtggtgtacgacagagaccatggggtaagtgggctgcagagattcgagatcctgcacggagggttcgtctttggttaggtacttttgaaactgcagaagaagctgctatggtttatgacaatgccgctattaagcttcgtggaccagacgctttaacaaacttcctcacaccgccgctgaaagaagatattccggtagaacc

SEQ ID NO: 1883 - protein, 276 aa, Oryza sativa
  Orthologous to G2130
MSPADSLAAGRSRRVGASMPRPKRVRVYFVDADATDTDSSGDERSRPRVREVIDIDVGAASPAPAPKHPRRLVPTATAALARRRAGMAASRRFRGVRRRPWGRFSAEIRDPSLQKRLWLGTFDTAEEAAAVYDDAALRIKGSHAVTNFPSDSDTPSAKAKQMKLHPRRHTTPDKTPSSSTAAAAKASVPDPTPAPPEEDRANDSSFNPFASPTSVLRYAAADEVTAPSFEHLLVELGDLSAPPPSTKAAEFDWLPWWEGEDFVTAGLTASNAVSVK

SEQ ID NO: 1884 - protein, 342 aa, Oryza sativa
  Orthologous to G2130
MVEVIVEKKARRIVRGRWHVEASNEAAAAAPAVAAPAPRVVRVLCRDHDATDSSGDDDGEDDAPRRARLLVHEIHVARQPVAMSPAAASSSQRRRVGPMKRTESAVDATMDATAAAPERKFRGVRKRPWGKYGAEIRVSQQSARVWLGTFDTAEEAARVYDHAALRLRGPSATTNFPMTPAAPSPPPSRATYAGAASGYDESSDESQLVGSPVSVLRPMPARATAKKEAKEEDDSAPDILGISAGDGLISPFTCDVLNFPPPDEDMFGGGISFGEPTPPPMVFDDDCMARLGHAPNDDEHPVTSSSFLDGDLGDLPSWTEVDGFFSDVGGDDLFAAEPFPAL

SEQ ID NO: 1885 - DNA, 1973 bp, Glycine max
  Predicted polypeptide sequence is orthologous to G2140
cgtcagctcggaattcggctcgaggcaaaatattcttatataaatagccttggagtttgtattatccttcaatagagttagtttcatatataaaacaggaagcaacaactgcaacagcagctatagaccctagggaaatgatacaggaagatcaaggacagtgttcttctcaagcgatcaataactaccaccaagcctatcaagagcagcttctccttcagcaacagatgcagcagcagcagcaacaacaacaacaaaacaatgatatctttggtggaggattgaacatgtaccctggtggtgaagtttctcaaatcatgcatcatcatcatcatcaaccatggtctatgactatgcctcatcaccatcatcatcatcatcaggttcatgacccttttcttgtccctccccaaacttcaccctatgcaagcttgttcaacagaaggggtccttctcttcagtttgcatatgatcatggttcatcttctgaccatcttaggatcatatctgaatcctttgttggaccggtggttcaacccggttcagcaccctttggcctccaaaccgagttggctaagatgactgctcaagaaatcatggaggctaaggcccttgcagcttccaagagtcacagtgaagctgaaaggagacgcagggagagaatcaataaccatcttgctaagctgcgcagcttgttgcctagcacaaccaaaacagataaagcatcattgctagcagaagtgatccagcatgtgaaggagctgaagcgtcaaacctctctgatagcagaaacgagtccggttccaacagaagctgatgagttaacagtagtggacgaagctgatgaagatggaaactcagtgatcaaagcctctttgtgctgcgaagataggtcagatctgttccctgaactcatcaagaccttgaaagcgttgaggctaagaacgcttaaggctgagataacaacgcttggtgggcgcgtcaagaacgtattgttcatcactggagaagaaacagactcatcaagcagtgaggaccatagccagcaacaacaacagtgctgcattagctcaatacaagaagcgcttaaggctgtgatggagaagagcgttggggatcatcatgagtctgcttctgcgaatattaagaggcaaaggaccaatataatatcaatgtcctaggaacggatcgaggtctttatgaattttatttaattaaaggcctatatatgcatgatcattattattattattactatctactaattaattagttgttatataagcatatatatatattttgattttgatttgcatattttttggggggtgtggtttggcttttacttttttttcttttcttgttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaaaaggggggcccccccccctttggacctctgcccccgggaattatattccggccgggaccctggggggtccccttttttccttttggggggcctttttaaaactgggggaaacccgggcaaaaactggttcccggggggaaatggttatcggttaaaatttccacaaaaaaattggccggaaataaaaaagggaaaccccgggggggcccctggggggccccaccccaataaaatggggtgcccccccgggcccttttcaaaggggaaaccctgtctggccgttttttttataaaccgccaaccccgcgggaagaaggggtttttatcgggccccccgggggttctttttttccccgggaaaccgggaaaccttaatgcccttaaccccctggccctgaagagatgggaaagggggcccccttttttttcccccacagggaaaaaaccctttctgggggggggcaaacgggggaaataacaaagtt

SEQ ID NO: 1886 - DNA, 1491 bp, Glycine max
  Predicted polypeptide sequence is orthologous to G2140
  misc_feature (26)..(26): n is a, c, g, or t
  misc_feature (31)..(31): n is a, c, g, or t
gtacgcccatgcaggttatccggatnccggnaaattcccggggtcgacccacgcgtcctataaaataggaagcaacaacagcaacagcagcagctatagaccctagggaaatgatacaggaagatcaaggacagtgttcttctcaagcgatcaataactaccaccaagcctatcaagagcagcttctccttcagcaacagatgcaacaacaacaacaaaacaatgatatctttggtggaggaggaggattgaacatgtaccctggtgctgaagtttctccaatcatgaatcatcatcatcaaccatggtctatgactatgccacatcatcatcaccatcatcaggttcatgacccttttcttgtccctccccaaccttcaccctatgcaagcttgttcaacagaagaggtccttctcttcatcagtttgcatatgatcatcatggttcatcttctgaccatcttaggatcatatctgaatcccttgttggaccggtggttcaacccggttcagcagtaccctttggcctccaaaccgagttggctaagatgactgctcaagaaatcatggaggctaaggcccttgcagcttcgaagagtcacagtgaagctgaaaggagacgcagggagagaatcaataaccatcttgctaagctgcgcagcttgttgcctagcacaaccaaaacagataaagcatcattgctagcagaagtgatccagcatgtgaaggagctgaagcgtcaaacctcgctgatagcagaaacgagtccggttccaacagaagctgatgagttaacagtagtggacgaagctgatgaagatggaaactcagtgatcaaagcctctttgtgctgcgaagataggtcagatctgttccctgaactcatcaagaccttgaaagcgttgaggctaagaacgcttaaggctgagataacaacgcttggtgggcgcgtcaagaacgtattgttcatcactggagaagaaacagactcatcaagcagtgaggaccatagccagcaacaacaacagtgctgcattagctcaatacaagaagcgcttaaggctgtgatggagaagagcgttggggatcatcatgagtctgcttcggcgaatattaagaggcaaaggaccaatataatatcaatgtcctaggaacggatcgaggtctttatgaattttatttaattaaaggcctatatatgcatgatcattattattattattactatctactaattaattagttgttatataagcatatatatatattttgattttgatttgcatattttttggggggtgtggtttggcttttacttttttttcttttcttgttaatggtgtgcgctggcaaatgttgttactttatatgtattctccatcaacatcatcatcggtataagaaatgaggaaatgagagtttgggggggttttttgttaaaaaaaaaaaaaaaaaaaaaaaaaaaaaaaaaaaaaaaaaaaaaaaaaaaag

SEQ ID NO: 1887 - DNA, 1027 bp, Glycine max
  Predicted polypeptide sequence is orthologous to G2140
  misc_feature (13)..(14): n is a, c, g, or t
ttaacaactttcnnacagcatcttacacaaaggctttgctttcttcatatgtcatgaactacttatcccagaaccccaaagttgttattattcacgggaagagaattcgtgactgaagaactttttgactaccaaggtacaatatggtagaaagagtccactaattctgtctatggtcaaaagagtaaagttgctatctgtgactgtgaatgctcccaagacatgtacaaacccagattctgattcacatgattagtacaaactttccctaacaagtgaaaaggctatttgctaatgccactcactcactccctcttcatattcagatatatgccatgcatatggattatggagatttaaattacatatttaagaagaaaagttctcaaaagaaatctcctatagatgaagaactgaatatagaaatcctccttctcttcctgctttctaacatgtcctgtgaaacagaaaatctatctaacactgatcttagagcttgatgaacagaccctgccagaaactggcggtactcgggatcttcaatattttgttctttgcagctaattatcacaaacacactattcatccttcctcccaaggttgcaatctcagcccttattatcataagatgaagtgcatcaagtgcttgtcttatatcggccaataacccgggtttgtattcacaacatagtgatgccttgattgagtaagggaaaccattcaatccaccctcctgttcttcaactcttatttcatcactgtccttcggtatcattaggccttcactagcttgtgtcgcattcgttttcagctctttcaaatgtctaataacctcacccagcaaggttgctttgtccaacttcttagcaccaggaatgacagagcgaagtgtatcaagatgtgcattaattcttgctctccttctcctctctgcctcactatggttcttcaaggcttcaatgcttctctcaggagacacacccttgcgttccaatttgacaggggcctctacaagctctcccttctc

SEQ ID NO: 1888 - DNA, 1421 bp, Glycine max
  Predicted polypeptide sequence is orthologous to G2140
aaatccaaaacagctttaatttgccagcttagtaagacaaatagtacattctctcacaaactttttttaacacaacttttattatgggataagcggggctctcattatatgagggcacatatgctatttaacgaatctcatttattgttcagggagattcacccaataatagaaaacatattaaacaatatactatcagttgtgttgttagcattcctcaaaaaataagaaatgttaataccacactctaacacttgcagcagaaacagataacataacacatcaaattcttgacatcagcacaaacaaaacccatggttgcatgtggaattggatgtttcaataaagcatagtcttctcctcttgcttgcatgtgatgttcttggtgagaaatccagggaggcagaagccttttccatcacagaacatagtgcctggtgaacagtacttgcaagagcttggcatttttcaaaatcaatattattaatgttttctttgcaacaagtgaagacaaacacattcttcatcctacctgccaaagttgaaatttctgccttgactagatgcagtggaagggaatcaagggtctgtcttaggtcagatagtatttcaggtctgaaatcacagcagatagttgcactgtaagacatggatccttctcctccctcatgatcattatatggttcaactttcacttcatcagcatcctttggaatcagaaaacccttgcttacttccgctgcatttttcttcaactccttcacttggctaatcacttcagccagtaaagtggctttatccatcttttcagtggatggcacaaggccacgtagtgttgcaagatgaccgtttattctctccctcctcctcctctctgcttcactgtggttcttcaaagcagccaaagctttggcctcacaaatctcactcttccctacctttgcagctgcaaggcacttcaccagctctcccttatcactctcaaataccaaagaatgtggtgatgatgaccagtcattgcaagcgccattgcaagctccaaggttatgcaaagtaggattgaacaaccccgaaatatcggagccagaagaagaagaggttttgtcatagaaggagtaaaccatagtcctaaaggttttaaattgcagtcgtccttgcggttttattttgatccttgatgttgtaaaaaaattgccaacaaatacagccgatgcaaccacagttacaatcacgatgggcccttagaccttgacttatgtagtggaaattgcggtcgtggacttaaaacctttcaaacttttttagtggagtggagctacaagagaaagataagaaggaaattaacccggtggacaagttcgagttgcgaaccagaaagaaagcttttggaagtggatggtgccttgtgaaactgctacgtt

SEQ ID NO: 1889 - DNA, 382 bp, Glycine max
  Predicted polypeptide sequence is orthologous to G2140
agctcagccgagctgttttatgcataacacacgaggctcttcttatatcaggatgcctatgaccatcaaggctcatgttctgaccatcttaggatcagatctgaatcccttgctggaccatcggaacaacccggctcaacagtaccctttggcctccaagaccgagttggctaagatgactgctcaagaaatcatggaggctaatgcccttgcagcttcgaagagtcacagtgaagctgaaaggagacgcatggagagaatcaataaccatcttgctaagctccgcagcttgttgcctagcacaaccaatacagataaagcatcattgctagcagaagtgattcaacatgtgaacgagctgaagcgtcaaacctcggtgata

SEQ ID NO: 1890 - DNA, 501 bp, Glycine max
  Predicted polypeptide sequence is orthologous to G2140
atgagggctaatgttcccacctgaagtctctccaaccttgcaacaacaatcatgggccatgcctccggttcactccttcaactccaacccggttcactacatcaacaacaacaacacaaacccggttcatcatcatcatgagcaagcaccatttcttgtccctcctcccacaacaccttcaccctatgcaagcttcttcagcagcagaagggttgtcccttctcttcagtttgcatacgagggtccctcttctcatcttgatcaccaccaccatctgaggatcatttctgacacccttggacccatggttcaacccggttcagcagcaccctttggactccaagccgagctgggaaagatgactgctcaagacatcatggaggctaaggctcttgctgcttcaaagagccacagtgaagctgaaagaagacgtagagagagaatcacaaccattttgccaagcttcgcagtttgtttctaacaccaccaaaacagacaaag

SEQ ID NO: 1891 - DNA, 1019 bp, Oryza sativa
  Predicted polypeptide sequence is orthologous to G2140
agcgttcaatcgatcgatcgatccccgcggctcggtttgtgttgcgttcttccagatcgatttgatagatgggtgctcatggagaccaccgccaccaccaccaccatcaagaagccggggtgctcgtcgacgaggaggaggaggaggtgatcgagcaggcttgcggtggcccgacgagcggcgtggtggagcaagaggtggggggagacggtggtggagtgtgccaagatgctgccggcatggtgttcgaggcgaccagtagcgtcgggagcgtgagcgccaccatggggccgccgccgatcatgtgctggccaccgccggcgcagcctgtccacggtgcaatccaccaccaccacaacctaggcggcggcggcggccagcagagcccgttcttcccgctgctgccgccctgccccctcagcccccgccgcacccccgttcttcgccgacttctacgcgcggcgggcgctccagtacgcgtacgaccactccggcggcgcgtcgtcgtcgtccgacccgctcggcctcggcgggctctacatgggtcaccacggctcccacgtcgccggcatgatgatgccgccgcccttcgctccgtcgccgttcggcgacctcggccggatgaccgcgcaggagatcatggacgccaaggcgctggccgcgtccaagagccacagcgaggccgagcgccgccgccgcgagcggatcaacgcgcacctcgcccgcctccgcagcctcctccccaacacaaccaagacggacaaggcgtcgctgctcgcggaggtgatccagcacgtcaaggagctgaagcggcagacgtcggagatcacggaggaggcgtgcccgctccccaccgagtcggacgagctcaccgtcgacgcgtcgagcgacggaggacgggcgcctcgtcgtgcgcgcgtcgctctgctgcgacgaccgcaccgacctcctgccggacctcatccgcgcgctcaaggcgctccggctgcgcgcgctcaaggccgagatcaccacactcg

SEQ ID NO: 1892 - DNA, 592 bp, Oryza sativa
  Predicted polypeptide sequence is orthologous to G2140
  misc_feature (544)..(544): n is a, c, g, or t
  misc_feature (584)..(584): n is a, c, g, or t
  misc_feature (591)..(591): n is a, c, g, or t
accaattatcatgtacatgaagtgatcaaatctcacccacaagcatatctctcgcaccattccaccctatagaaacgagataacaagacgctgtttgcactagctatttgacagccgacaagaaccagttaggtaaaactcagtaggatgcaggtttgaatggctgaatgccaacctctgcaactgcaagaaggcaagaaactgcaagagctgcagccatacgatggctgcaatccttcagtgtacagaggcccaattctgctgccccggcaggccaactcggcgccgccggccgtgccgccggagatgtcgtcctcgtcggggtcagggagaagcgcgacggaggcgagagcgttgaagatccacagcgaggctgaacggcggcggcgagagaggatcaatgctcatctgacaacactgaggagaatgatccctgatactaagcagatggacaagggccaccttgttagccagagtggtggaccaagtgaagggtctgaagagggaaagcaagtgagatcacaccaaagaacacctcttcctncagagaaccaacggaattcttccatcgatgcttcaccggngacgctng

SEQ ID NO: 1893 - DNA, 565 bp, Oryza sativa
  Predicted polypeptide sequence is orthologous to G2140
gcacgaggagaaataatcgaacctcatatagcattattgagttaatcgtcattaattcatataggtggggattttggatagatggctgcatgccagcagcagatttggcaagaagggaagcagcagcagcatctgcaccacggtggctatgatgatctttcttcagtgtacagaggcacggttgtgctgccacggcggcagggcggcctggcgcgggagccgccgccgccgcggccgtcatcgtcgtcggggaggagcgcggcggctcaggcgacggcgatgaggatccacagcgaggctgagaggcggcggcgggagaggattaatgctcacctggctacactgaggaggatactccctgatgctaagcagatggacaaggccaccttgctagccagcgtggtgaaccaagtgaagcacctcaagacgagagccaccgaggccaccacgccgtcgacggcggcgaccatcccaccggaggccaacgaggtgaccgtccaatgctacgccggcggcgagcacaccgcggccgcgcgcacctacgtccgcgccaccgtcagctgcg

SEQ ID NO: 1894 - DNA, 548 bp, Oryza sativa
  Predicted polypeptide sequence is orthologous to G2140
ctgcttgctgcatcatttcttgacaactgcagtgttcttgatgctgttgcttcatctgatccatctcattttccccgtgttactgcagtgacagccgacaagaaccagttaggtaaaactcagtaggatgcaggtttgaatggctgaatgccaacctctgcaactgcaagaaggcaagaaactgcaagagctgcaggcatacgatggctgcaatccttcagtgtacagaggcccaattctgctgccccggcaggccaactcggcgccgccggccgtgccgccggagatgtcgtcctcgtcggggtcagggagaagcgcgacggaggcgagagcgttgaagatccacagcgaggctgaacggcggcggcgagagaggatcaatgctcatctgacaacactgaggagaatgatccctgatactaagcagatggacaaggccaccttgttagccagagtggtggaccaagtgaaggatctgaagaggaaagcaagtgagatcacacaaagaacacctctccctccagagaccaacgaagtctccatcgaat

SEQ ID NO: 1895 - DNA, 1769 bp, Zea mays
  Predicted polypeptide sequence is orthologous to G2140
  misc_feature (45)..(45): n is a, c, g, or t
ggccgctttttttttttttttttaaacccagcaagcaacataganaatgtgcaacgagcagtagtccttatccctctacgtcaatcgcagggaaaacaatctcaagtcagacaagaacccgcccgcctcgcaagacacatacatatattctccctcgctctcaaacccttttccactcacgaagagcagagctgttgctagagctggtcgtcttcctcttcctcttcctcctcctgcctcgatctgacgagagctcagccttgccttagtctcgccatcgcagaaggcagaagcactagttcctgacagccacaaaaccaaccaaaggccaagctaccgtgaggcgagggaaagggaaagatcacatatcgcctattcgcctacctctgcgtgcatcagaagatgatccccttcataaagatgaaacattcccattccctccactagaagctccgggaggacgcagcaagctcaccgaagccagcaaccgatggatcagaggcgcgtcacggcgaggttcggcagcaagacgagctcggagcggaggatgctgcggcgagtgaggctccccttctggtcctgccctccaaaccggcctccaggcacctgagcgcctcaaatcctcgatagaacagctggtctcgtgctcccctcccccctgtctctctactctgactttctttctttctttctccgctccgctccccgtgcccctcctgctccttggaccctgcctgttctgtcagtcagtctccctccctagaacggcatggctctgcgttttgtgtgatctcgtcgcgagcctgtccgccggtgccggtgcctcaatccccttgggagaagcaagggctcctgtctggtccgtgttcttgggaaccagggccttggtactgctgctgccgcgtgcttcactgcttcctggctgctccgatcctctcgtctcgtgtgtgaaagaaacattccggagcccacgcgtccgcccacgcgtccgccgcaacttgctggatgcaagagctgccctgtccctgccctgagcccctgtttccatcggaaaaggcaacagctcttgcgtgcttggcacctgccgagtaattcgttatatatacagtgctcccacgaagcactagttggcagctgctgcgctgttatgttcttgtgcctcgtggatcgtccccgtcggcctcgaagctttccacgacgaaatggacgacatgggctccgtccccttcgccgacgccgggctcctcgacgggttctacggcggtagccatggacatggtggtgactacgagctgctcgctagccagctgggagcgggagcgtcgtcgacgtcgcctgccatcttagacggcagcgtgccgctggtcgacgccgcggcctccgcggaggaggcgacgaggagtaagggagaccacctccaggatgacaaggcggcgatggcgctcaagagccacagcgaggcggagcggcgccggagggagaggatcaacgcgcacctcgccacgctccggaccatggtgccctgctccgacaagatggacaaggccgcggtggttggctgaggtgataacccacgtgaagaagctcaagtccaccgcggcgcacatccgagaccgctgcgccgccgtcccggccgacgcggacgacgtcgtcgtcgagctggtccatggcggcgcggcgccgccgtcggccggaggcggcgtcctcgtcagggcgacgctcagctgcgacgacggcgcagacgtgttcgcggacgtcaggcacgcgct

SEQ ID NO: 1896 - DNA, 500 bp, Lycopersicon esculentum
  Predicted polypeptide sequence is orthologous to G2140
accaggcagcttccaagagtcacagtgaagctgaaaggagacgcagggagagaatcaataaccatcttgctaagctgcgcagcttgttgcctagcacaaccaaaacagataaagcatcattgctagcagaagtgatccagcatgtgaaggagctgaagcgtcaaacctcactgatagcagaaacgagtccggttccaacagaagctgatgagttaacagtagtggacgaagctgatgaagatggaaactcagtgatcaaagcctctttgtgctgcgaagataggtcagatctgttccctgaactcatcaagaccttgaaagcgttgaggctaagaacgcttaaggctgagataacaacgcttggtgggcgcgtcaagaacgtattgttcatcactggagaagaaacagactcatcaagcagtgaggaccatagccagcaacaacaacagtgctgcattagctcaatacaagaagcgcttaaggctgtgatggagaagagc

SEQ ID NO: 1897 - protein, 223 aa, Oryza sativa
  Orthologous to G2140
MVTDGECSAAAVRKGGSPAVRSHSEAERKRRQRINAHLATLRTLVPSASRMDKAALLGEVVRHVRELRCRADDATEGADVVVPGEGDEVGVEDEDDDEGERDEGCYVVGGGDRRWRRRVRAWVCCADRPGLMSDLGRAVRSVSARPVRAEVATVGGRTRSVLELDVVVASDAADNDRAVALSALRAALRTVLLNREELLAAAAAAATDGYKRPRFSPRCSSLT

SEQ ID NO: 1898 - protein, 267 aa, Oryza sativa
  Orthologous to G2140
MGSAPFGDAVAGGGLYEYQGYHGGFAGGHGLGQPAGRAPALDDGETEGMDASAAAAVAAMEMAKRNCGGGREEKAAMALKSHSEAERRRRERINAHLATLRTMVPCTDKMDKAALLAEVVGHVKKLKSAAARVGRRATVPSGADEVAVDEASATGGGGEGPLLLRATLSCDDRADLFVDVKRALQPLGLEVVGSEVTTLGGRVRLAFLVSCGSRGGAAAAAMASVRHALQSVLDKASSGFDFAPRAASLLGSKRRKVSTFESSSSSS

SEQ ID NO: 1899 - protein, 363 aa, Oryza sativa
  Orthologous to G2140
MWEGGSHDAAAQLLPWFVGEPAAAAVGGYGGCVDVVGQGGVFGFGFEAAAAPVVTRQQRGGAAAAEGSSRGGGGKPAVVSGLLGSLQAELGRVTAREIMDAKALAASRSHSEAERRRRQRINGHLARLRSLLPNTTKTDKASLLAEVIEHVKELKRQTTAIAAAAAAGDYHGNDEDDDDAVVGRRSAAAQQLLPTEADELAVDAAVDAEGKLVVRASLCCEDRPDLIPDIARALAALRLRARRAEITTLGGRVRSVLLITADEQQQQHCDDVDDDEDGHRLLLRHGIDGAGAAADDDDECAASHRRHECIATVQEALRGVMDRRAAASSGDTSSSGGAVVAGGGGGSIKRQRMNYGVHEQCSV

SEQ ID NO: 1900 - protein, 209 aa, Oryza sativa
  Orthologous to G2140
MSSSSGSGRSATEARALKIHSEAERRRRERINAHLTTLRRMIPDTKQMDKATLLARVVDQVKDLKRKASEITQRTPLPPETNEVSIECFTGDAATAATTVAGNHKTLYIKASISCDDRPDLIAGITHAFHGLRLRTVRAEMTSLGGRVQHVFILCREEGIAGGVSLKSLKEAVRQALAKVASPELVYGSSHFQSKRQRILESHCSIMSI

SEQ ID NO: 1901 - protein, 323 aa, Oryza sativa
  Orthologous to G2140
MGAHGDHRHHHHHQEAGVLVDEEEEEVIEQACGGPTSGVVEQEVGGDGGGVCQDAAGMVFEATSSVGSVSATMGPPPIMCWPPPAQPVHGAIHHHHNLGGGGGQQSPFFPLLPPLPPQPPPPPPFFADFYARRALQYAYDHSGGASSSSDPLGLGGLYMGHHGSHVAGMMMPPPFAPSPFGDLGRMTAQEIMDAKALAASKSHSEAERRRRERINAHLARLRSLLPNTTKTDKASLLAEVIQHVKELKRQTSEITEEACPLPTESDELTVDASSDEDGRLVVRASLCCDDRTDLLPDLIRALKALRLRALKAEITTLGGRVKN

SEQ ID NO: 1902 - DNA, 504 bp, Glycine max
  Predicted polypeptide sequence is orthologous to G2143
gccaccacccaccactttgattaatccaccaccaccttcctccaatttcgttctacaacaacccatgacacctcatcttgaacccaacccggagaagaagaattctgtggcggctatgagggagatgattttccgtgtagcagtgatgcaacctgttcatatagacccggaatccatcaagccaccgaagagaaggaacgtgaagatttcgaaggatcctcagagtgtggcggcgagacacagaagagaaaggataagcgagagaataaggatccttcagagattagttcccggtgggaccaaaatggacacggcttctatgttggatgaggccatacactacgtgaagttcttgaagaaacaagtgcagacgctggaacaagcaggggcaactagacccttgaatgttgttggcttccctactactgtgtccaacgccaataataatgttaattattctagttttgtgaagagttgccaaccttatccaatgctgggttcttc

SEQ ID NO: 1903 - DNA, 518 bp, Glycine max
  Predicted polypeptide sequence is orthologous to G2143
cccatactctctgctcctaactttttctctcttctcccctttcttccattcctccttgtctctcgcaacgcgaaattcatggacgtggacatactgaaaacttccacgagtgacaacatcagcatggacatgatgatgacgatgatgcaaatggaaaagttccctgaattttgtgaacctttttataacaacaacaacccatgacaccccatcttgaacccaacttggagaagaggaattctgtggcggctatgagggagatgattctccgcgtagcagtgatgcaacctattcatatagaccctgaatccatcaagccaccgaagagaaggaacgtgaagatttcaaaagatccgcagagtgtggcggcgaggcacagaagagaaaggataagcgagagaataaggatacttcagagattagttcctggtgggaccaaaatggacacggcttctatgttggatgaagccattcactacgtgaagttcttgaagaagcaagtgcacacgctgggacaa

SEQ ID NO: 1904 - DNA, 1146 bp, Glycine max
  Predicted polypeptide sequence is orthologous to G2144
gaacaaagcaacaaacttcaatgatagttcagtaatagttcgttcaatgattttacaatctaaatcaatcaatcacttgaaagattgaatgattactatagttagtatacatagtgatagtaatatattaaataaaaatagcataccaattcttcttccttgctggctgaataaaatccaggtttccaactgactctgacaaaatagagttagggaaaacctgctgaatgttgaggctgctcaaatcatgactaattgctaatactatatttgttatatacactaataggctaattgctactggtaccaccacctttgtagtttccctttagagctccatcttcaactgatttgaatgcagagatactgaatttgccgatgagtcataactcaagagtgagttttctggagtcatgaaattagtgttgtcttcttccctcccccaaaggggttggtggagtgcatcaaacggccatggttgctgatattgttgtctgtttccgttctgtgggatttctggccacatgacaggtgcaactgtcggagggaagttacagtccattggagtcactccttcagtagccagtaagctgtcgaggttgaaatcaattactgggttaactgctgccagtttcattgataatatctccacttcattctgtagagattgcacatggttgatgattttatccagaaccaatgccgttcccgatatcttgttgcaacccgggaccagctcttgtaaaagcttcatccgagcatttatcttctctctcctagccctttctgctaagctatggctatcagtggcttgacctcgacgaactcgaacgtgaacgtacggaagcttctcgccgtcgccggaaatctcgtcggcggcggcgacgctcttgctcttcttcgacgacgctttaaccttcttctctcgctccttcctcttcgcagttttcagattctggttctccacggcgagatcggagacggagcctccgccgccgccgccgtgagtggagctcgggttggaatcggtctccggcagctctcgcttcacctccggcgagttcgagttcgagctctggccggcgaagacggagaacctggcggcgcgatcgatcagcgcggcgttggagggaaaggtgaggttgc

SEQ ID NO: 1905 - DNA, 1563 bp, Glycine max
  Predicted polypeptide sequence is orthologous to G2144
atactatatttgatatatacactactaggctaatagctactggtacgacttctgtacgctttcagagctccatcttcaattgatttgagtgcagagaagctgagtttgccgacgagtcataactcaaaagtgagttttccggagtcatgaaattatggttgacttcttccctctcccagagaggttggtggaatgcatccaattgccactgctgttgataatgctgccggttgccattgagtgggatttctggccacatgagaggtgtcaccatgctaggtaagttattatccattagagatgccccatcagtagccaataaactgtcgaggctgaaatcaattctagggttaactgctgccagtttcattgataagatctccacttgacgctgtagagattgcacatggttgatgatttcatccagaaccattgccgtccctgatatcttgtcgcagcctgggaccagctcttgcaaaagcttcatgcgagcgttgatcttctctctcctagccctttctgccaagctatggctatcagtggcttgacctcgacgaactcgaacatgaacgtaaggaagcttctcgccgtcaccggaggtctcatcggcgatgcttttactcttcttcgacgatcctttaactgttagcttcttctctcgctcctttctcttggcggtcctctgattgttgttctccaccgcgggatccgaaatgcaacccagcctcgagctcgagcacgggttcgaatcggtctcctgtggctcgttcttcactctatccaaattcgaaacggaaccggtcccggccggaaccaggcacgcctcctccggcggaagcggcgagttctcgccggcgaacacagagaacttcgcggcgcgttcgattaaggcggcgttggaagggaaggtcaaattgctgccgaaagaattgagcaggtagggtttctggttcgcgctgacatggcaattaggcggtttccgagcgctgtcagattccggcgagtgaaggagctccaccgcctgcgtcggcgggagttcaagcagcgcggtgaacgagctcgcgttttccggagctggcaccggcgccatgattccctgaatttcttcgttgaattgaattgactcgagcgtagcgccgtcatgcacggatccgcgcaatcctcccggagcttggtccattgagcgaacaaaacgcagcgtagaaggtccaattgaaccgtacacacctcaaattttgtctttacttggacgaattctgaaccgtgacagtgttgaaattggagaaaatgaggaaatgaagaatgtgtgtggggaatttcgttacgagtggagtgagagatagaagaagcaaagcttcaatggcggtcaatgaaattcatctctctctttctttctctttctctccggttctgtgattctgtctctgagattgcttctcggccatttgaagtactgcgaaagcaacgatgctacgctacggttactctactactgttgaatcatacgagtacggttccagccatacagtttcgttgaggtaaggttaaagggtaggttgggac

SEQ ID NO: 1906 - DNA, 1709 bp, Zea mays
  Predicted polypeptide sequence is orthologous to G2144
  misc_feature (384)..(384): n is a, c, g, or t
  misc_feature (409)..(409): n is a, c, g, or t
cgggctctccctaggtccctacctctccaatcttctccttccttgaccccagcggaggaggagccagggcgtgcgagtgcgaactgcgaacgcagcagcagcagctcacgcgcgcacggcacaccagtgagtgacaccacctctcgcctcagcgccgcccccctataaataatggcgccactctcccctacccccgcctccgctcccgtgtcctcctcccctcgttcccttgtcccggacgcctccgccgagccgatgcgccgcgcctcgccgccgcaggagctccccgtcgccaggggcgagatccaggcggcgctggcccccgccaatgcctcctccgcgggcgcccacggaggcggaggctccttcccggcgctgctgggnactccccacctcgcgggccggggangctgctcctcccccgcacgacgccccccgccctagccacagcgcccgcgccaaccttcccctccgacccgcacctcgtggaccgcgccgcgcgcttatccacgttcgcgcccccgtccccgtccccatcctccacgggggcgggccggcccctccccgccgccgctaacgccggcaagcgcaaggccgaccccgtcgaccgtgcctccaaggggaaggcggcgaagaaggggaagacggcggaggagaagctcgcgggcggcgacggcgacgacgagaagccggcgtacgtgcacgtgcgggccaggcggggccaggccacggacagcctccgcctcgagcaaaaaaccactcatcaggcgagacgcgagaagatcaatgcgaggatggagctgctcaaggagctggtccccggctgcagtaaggtatcaggaacagcgttggtgctagatgagatcatcaatcatgttcagtctctccaaaggcaagttgagtacttgtcaatgaggcttgcaactgtaaacccgaggggcgattttggtgggctagacagctttctgaccacggagtgtggaaggatagcaagcttcaactgcaagaacggaatcgacttggagcaggtaacctggccagaaatgggtgttcatggagcaaggcagctgatgcaactccaacagcagttctggcatggcgatttggcgcatccacaccaagtggcttcacagtgggaaaagcggggggatggccatcctcccgtcttcagcaactccagtccctctctcttcggctatgatctaacaagctctggagcccagcaaaacccggcgagcaagctaaagaccgagctttgatcgacaacggtaaatagcatgtcaggggagcaagatggacatatggggggagggggacacagaatttcagcaaattgatcaaggcacaaacgagctgcgaatgaatgatggctgtggatggttgatgtcaagcccagcgaaatcaacattttcagagaggggatgtacatatagcgatagagatactgttggtgttgagctgaagacggggatgcatatgatgggcgaggataccgcagtcgttggagagacaggcaagccctgttgctatcgttgcagagatggccaagcgataccctggtttcgttactgatgatgatgacattcttagtgtatttctgacgactataatggcagtcttaaggttatatgggcagcattttttacgaacgcaagacatttcaacaagcattggaaaatttggcaacccaaaaaaaaaagggcggccgc

SEQ ID NO: 1907 - DNA, 1219 bp, Zea mays
  Predicted polypeptide sequence is orthologous to G2144
cccccctgggtcgacccagcgtccgcgccaaccttcccctccgacccgcacctcgtggaccgcgccgcgcgcttatccacgttcgcgcccccgtccccgtccccatcctccacgtccccggccccgcccctccccgccgccgctaacgccggcaagcgcaaggccgacgagaagccggcgtacgtgcacgtgcgggccaggcggggccaggccacggacagccacagcctcgccgagcgggcgagacgcgagaagatcaatgcgaggatggagctgctcaaggagctggtccccggctgcagtaaggtatcaggaacagcattggtgctagatgagatcatcaatcatgttcagtctctccaaaggcaagttgagtgtggaaggatagcaggcttcaactgcaggaacggaatcgacttggagcaggtaacctggccagaaatgggtgttcatggagcaaggcagctgatgcaactccaacagcagttctggcatggcgatttggcgcatccacaccaagtggcttcacagtgggaaaagcggggggatggccatcctcccgtcttcagcaactccagtccctctctcttcggctatgatctaacaagctctggtgcccagcaaaccccggcgcgcagtcctatatcaccttcctgaatgaatttagttgtttgtcgcttacttcacatatcacagcctggcttgccccacaacttttgtctcttagtttgtcccgccagtgctctcttgagaacaaagtgtactgataggtaaatttaaaaatttgctgtccaaaacctgaggtgaatattttctactatctaggggaagtttctgaagtatacaaagctatttatagtcatggccaaatcttgaatatgctagcatagtagcattgctgttatattggcccagatagcaaatagacacagaaacacaggtgaagcaaaagacatacagaagcatgtggcagtacagtgaccaagtgttttgcattagctaataaacgtgatagagagccagagatcccaactaggagtccctctgtttgcttatggaatttggaaacaacacagatatctaatttgagttgccgcgccctttttcagaggaaaacttctatttccactgcttcagaactatcagcattatccacttttcatactaacaaaaaccatgagcccaggacttcgctagaaagattagcagattagagtgt

SEQ ID NO: 1908 - DNA, 714 bp, Medicago truncatula
  Predicted polypeptide sequence is orthologous to G2155
ctcacagagatatcacaacaaaggaccaaaaatgttctcaaactttcaacaacaacaacatcataacctatttcaaccttcacgtgaatgccaaacctcagaagaagatgaaacccgaagcagcggtgggcccagcccaaacaaaccttcctgtaacgacggcgccaccattgaaattggtcgtaggccaagaggccgtccacctggctccaaaaacaagcctaaagcccaatcacaaatcataatcaatcactcctccgaccctgccatgagcccacacattctcgaaatcccagaaggcagcgacgtcgttgaagcaatatcccggttcagtaacagaagaaaaaccggtttatgtgtattaaccggttcaggcactgtagctaacgttacactccgtcaaccttctggtcctcctggcaccaccgttacttttcatggtcgtttcaacattctttcaatctccgccacgttcttctctccgttagaatcctcaccacccatgaacaaagaattctcaatctcactcgccgcacctcagggtcagatcgttggagggtttgtcgtcggtccgttgcttgccgccggtacggtgtttgtcattgctgcttcctttaacaatccttcttatcatagattacctttggaagaggatgtgaggaataactcagtctccggcggctatgaagagaagtcgccggcgcagctttctgg

SEQ ID NO: 1909 - DNA, 824 bp, Medicago truncatula
  Predicted polypeptide sequence is orthologous to G2155
tcacccttttcaactttctcatcatgaatgtcaaccaatcggtgaagatgataacaacaaccaccagcggcggcgttgctaccactcagaaacctaacacctccggcgacggtgcaactatcgaggtttctagacggccgagaggacgtccacctggctcaaaaaacaaaccaaaaccacctattatcatcacaagggatccagaaactgtgatgagtccttttattctagatatttctggtggaaatgatgttgttgaagctatttcagagtttagtcgtcgtaagaatattggtttatgtgttttaactggttcaggaactgttgctaatgttactcttcgtcaaccttcaactacaccaggaaccaccgttacttttcacggccgttttgatattctttctataactgccacttttgttcctcaacaacacggtgtttctccggcgattccgagtaacttctcgatctctcttgctggacctcaaggacagattgttggaggaattgttgctggaaatttgatagctgcagggacggtgtttgtgattgcttcttcgttaataatccgtcgatcataggttgccgttggaagaagatgaaggtggaaactcggtgtctggtggtggtgaaggaaactcgcagaatgtttccggtgcggtggacagtggacaagtcagggtggtgggtggtgagtcctgtgggatgttcgatgtacaactgtcatttgccgtcgtcggatgtgatttgggctccgtctgctagacccccaccaccttactgatatcatcatcattcacattttcataaacctttgttgcaaa

SEQ ID NO: 1910 - DNA, 573 bp, Glycine max
  Predicted polypeptide sequence is orthologous to G2155
cagcaacaacatcctaagagtgaaacaccacctagtatgttctcaaagcttcagcctcagcaccatcctttcccgcaccaccctttccaactctccgccgaggatgccaccaccatcaccccgagcaccgctcagaaggccaactcctccggcggcgacggcgcgaccatcgaggttgttcggcgtcccaggggacgtccgcccgggtccaaaaacaagcccaagccaccggttatcataacccgtgacccggaacccgctatgagtccctacattttagaagtgtctggcggaaacgacgtcgtcgaggccatcgcgcagttcagtcaccgcaagaacatgggaatctgcgtcctcacgggttctggaaccgtcgctaacgtcacgctccgtcaaccttccaccacgcccggcaccaccgttacttttcacggccgtttcgacatcctttctgtttccgccaccttccttccgcagcagtccggcgcttctccggcggttcccaacggattcgccatctcgctcgccggaccgcaggggcagatcgtcggaggacttgttgccggcgggctg

SEQ ID NO: 1911 - protein, 852 aa, Oryza sativa
  Orthologous to G2192
MDLFVAIALGLERMVRRNSDTTSKRVDQINSKWQFHLSIDDNTDSSCLFKERLTQALRYFKESTDQHLLVQVWAPVKSGDRYVLTTSGQPFVLDQQSIGLLQYRAVSMMYMFSVDGENAGELGLPGRVYKQKVPEWTPNVQYYSSTEYPRLNHAISYNVHGTVALPVFDPSVQNCIAVVELIMTSKKINYAGEVDKVCKALEAVNLKSTEILDHPNVQICNEGRQSALVEILEILTVVCEEHKLPLAQTWVPCKYRSVLAHGGGVKKSCLSFDGSCMGEVCMSTSDVAFHVIDAHMWGFRDACVEHHLQKGQGVSGKAFIYRRPCFSKDISQFCKLEYPLVHYARMFGLAGCFAICLQSMYTGDDDYILEFFLPPNCRNEDDQNALLESILARMKKCLRTLKVVGNGDTNEVCLQISNVLIIETEDLKTNVHFENSEGCFRESPESNGSQRVHEVDNDGNKVSIMSERHLLADDNSQNNGASVGRPNGSGASDSLHKSNKPPERRRGKAEKTISLDVLQQYFSGSLKNAAKSLGVCPTTMKRICRQHGISRWPSRKINKVNRSLSKLKQVIESVQGSDAAFNLTSITGPLPIPVGPSSDSQNLEKASPNKVAELSNLAVEGDRDSSLQKPIENDNLAILMSQQGFIDANNNLQLEADKASHSRSSSGEGSINSRTSEASCHGSPANQTFVCKPIASTFAEPQLIPEAFTKEPFQEPALPLSRMLIEDSGSSKDLKNLFTSAVDQPFLARSSNLALMQNSGTVTIKASFKEDIVRFRFPCSGSVTALKDEVAKRLRMDVGMFDIKYLDDDHEWVKLACNADLEECMEISGSHVIRLLVSDVAAHLGSSCGSSG

SEQ ID NO: 1912 - protein, 407 aa, Oryza sativa
  Orthologous to G2295
MARRKIPIGLIAHRQKRAATYAKRKESLRKKAEELSTLCGVRVAFVCAGPVVPGGGGGAAGKEEVWESEEGVLAEYRALPPEARAQHAHRVYLEEEVGKERAKLARVRQDGAFPSWDAALDGITADEARALLESIDAARAAANARREALGLPDDGNGVDDDGGLDLQQQQEHVPPGGSDAVVVPVGHGVLQYTGSGGGNQMQTTPAADGINCADLYGAVPWDDTFQPQVMRTGDHFVPMDGYLWQAPGNGWPDLATGCTNESCSCNAAAAAAAMPAMYPPTLDTVHGSFLAAPAQPIPIAFSTSTDFIDAPNDFLTMGLCGGFTNVGDYSAAQPQSSADGGFQLGDTFAAEPGDTQSQNWGSFINVVSDDSAQCNCNAAIHLDQMYYLFGGTGGGEPSDTQSRHWGS

SEQ ID NO: 1913 - DNA, 1657 bp, Glycine max
  Predicted polypeptide sequence is orthologous to G2340
aattcggctcgagctcgtgccaaagaggcttattgaacacttgcagcagctagagccacaatttcaatgcccctgattagtttgtctgtccatcacagtacatagtataataatcataaaccctttttctcagcgaggcacacagtatcattactacactttttttttcactccattgttttggcaagtcctcaacccccctccccccagcataaagagctataattcccttctcagccacaatatggctttgtaaaatgggaaggactccttgctgcagtcacgaggaattgagaaaaggggcatggacggttcaagaagaccagaaactaattacttacattcagaaacatggcacaggaagctggcgtaccttgccacagaaagcaggtcttaaaagatgtggaaagagttgcaggctgagatggtttaactaccttagacctgacattaagagagggaaattaagccaagaagaagagcagacaattatcaaacttcgggcggttcttggaaacaggtggtcaagtattgcaaagcacttacccatgcgaactgataacgaaatcaagaactattggaactcatatctgaaaaagcagttcgaaaagaatgctgtggatccctcaagttcaaaaccaaatagcactgatagttcctcagaatcaaaatctaatgacacgtgcatggttccatcagagaaaactgattgccatgaaccaaacaccagccaatctcatcagcacaacttatcaaggtcaatctcatcatcaactcatcttcttaacaaagttgctagtaaaattctggcatcagggtacctagaactaatcaaatcatgccaacctgttgttgctgggaacagcaaaagtgaaagtgtggttaaaactggtattgggttagaaagtgacaatattagagacccccttgagcctaatttgacctcaccaagtcattctataacttctgctaagttactgaacaagatggctacttccctccctcataaagttcatggccttgaagctgcaaaagctgtgttctcaaaactgatggaaaacagtgaaaaaggtgccactgctagtgatgatagctttgttggaggttgtttaaatgctttaagcccttttgaggataaaccacacataacaaaaacaattgactccccttctggtcctacactaatgttcaaccatgttaccacaccctcatgcttttcagaagataatgaagataactggcaatgcgtttcatctaactatgtttccttcaaaatttgtgctgcgaatggtggtgactgcagtgtctctgagatcaacttgggtgagtcttccagttccacatccagcttcctgtttgagaatgctgaccttggaacgtgtgatgatgagataagcaagtacatccagtattgtagggaaaaaaatttgtggacatccaatgctaataatgtaggtattacaaggccctatgatgtaagaggaagatatctaaagagagataatatatcctaatagagtgtttgatatatcaccatgtttatatagaggtgtttgacggaggaatttatgtatcatcactctatttgtaataagaaattatattcttccttataatttttttttactcaaaaaaaaaaaaaaaaaaaaaaaaaagg

SEQ ID NO: 1914 - DNA, 1535 bp, Glycine max
  Predicted polypeptide sequence is orthologous to G2343
ccattatttattctcattcaaaacccaccatttttacagtcaaaaaacaagcaaattgaagatgctttccatatatatcttcaaaatcaaactttccttcgggttacaatcgcctttattattattccttctcttttttttttccctcttccatgtcaaaacactcaataaagtaataaacacatcacgcttggttatatatataacatcttatcttcactcatttttggcaatctttgcaatcagcaatcgaaagaggtttgaaaaaaaataatcaaaagaagaaaaagcaatctctgcaatataagtttcagcctgggccggaccattcctgaaaactcttcctggttagagggagcatgagaaaaagagtatagtggggagtggggacagtccttgttgcagtcataaagaggaaggaaaaggtgaaagtgtattgtttcccatatttgacgtgtttggtgctagttcttcccctcgaagttgtccttcaacattaatattgtcccagaaaagaaagctgggacattgttgttgattctccacccactcattcaaatcttgtctccgcaaacactctagtgccatttctccttcctcgtctatactacaagactgtacttccatatttggcaccatgttttcaacgttctctatcaatggtggcagataattcgtagtatcaataacggttgctgctgtaaaagttgctgctagttgaggaggaagagcatggacttgatggtggctcatgttccacgtttcactactgctcaaacccaatgaatcttggaacagttctgctcgtacattattggtggtgtctacagttgttgtcccttgatctaatgaactagtgtcaaacataaatagggggcacgtcgaggaaaataaggtttcttgcaccggtggctttgctgttacattttcttggttgccatagtgatctagttgattggaattaaaattgaattggagctggtgatgatcaacactttgtgtagtggtgattgatgaagtcaccgtagaaggctttctaattttctttttgatccaagaattccaatagttctttatttcgttgtcagttctacctggtaagtggcttgcaatgtgagcccatctgttgccaacgaccccgtgaagacttataattaacttctcctcttcaggtgtaaacctgcctcttctaatatcaggcctcaaataattaatccatctcaggcgacaactcttaccacacctttgaagcccagctttctctggaacttcactccagcaaccatagccgtgagtggtgatgtatctgatgagcttctcatcttcctcgggggaccaaaggcctctcttaaccttctgttggttgcagcaagaatggtgacccatctttatttatttccttggtgccttgggccgggctcgggtcttcctcctccattcctgtcttttagtcttgttccctcagtggccttttattgcctggattaaatacggggatttgtatgccaatgcaatagttaagttaggtctctctc

SEQ ID NO: 1915 - DNA, 701 bp, Glycine max
  Predicted polypeptide sequence is orthologous to G2343
  misc_feature (82)..(83): n is a, c, g, or t
tacatggttggtggtgtctactgttggtgtccttgtatctaatgaactagtgtcaactataaatagggggcacgtcgaagannaataaggtttcttgcatcggtggctttgctgttaaattttcttggtggccatagtgatctagttgattggaattataattgatctgggcgggggggggatcacccacttggtgtagtggtcattgatgaagtcaccgaagaaggctttctaattttctttttgatccaagaattccagtagttctttatttcgttgtcagttctacctggtaagtggcttgcaatgtgagcccatctgttgccaacgaccccgtgaagacttataattaacttctcctcttcaggtgtaaacctgcctcttctaatatcaggcctcaaataattaatccatctcaggcgacaactcttaccacacctttgaagcccagctttctctggaacttcactccagcaaccatagccgtgagtggtaatgtatctgatgagcttctcatcttcctcgggggaccaaaggcctctcttaaccttctgttggttgcagcaagaatggtgacccatcttaattaatttctttgaagctatgtgcaagggtcttcttcctcgagccgaattccgagctttcgttccctcattggccttttattgcctggatcaaatgcggggatttcggacgcgtgg

SEQ ID NO: 1916 - DNA, 599 bp, Glycine max
  Predicted polypeptide sequence is orthologous to G2343
tagattgttatcatggttgggaaagtggtatagtattagattggaattgtaattgacctggtcagaagaattgtgatcgatactttgtgcaatggttgttgaagacaccgaagaagtctttcttattttcttttttatccatgagttccaatagttctttatttcattgtcagttcgacctggcaagtggcttgcaatgtgagcccatctgtttcctacgaccccgtgaaggcttataattaacttctcctcctcaggtgtaaacctccctcttctaatatcgggtcttaaataattaatccatctcaagcgacaactcttgccacacctttgaagcccagctttttctggaacttcactccaacagccatatccatgagtagtaatgtatctgatgagcttttcatcttcctcaggagaccaaagtcctcttttaaccttctgttggttgcagcaagaatggtgacccatgtttctaggctttgctatgtcgtcttcttctttttccttcttttatattcttgttccctaagtggccttgtattgccttgatcaaatgctgctcgagccgaattccgagcgtgcatacgacgtcatag

SEQ ID NO: 1917 - protein, 331 aa, Lycopersicon esculentum
  Orthologous to G2343
MGHHSCCNQQKVKRGLWSPEEDEKLIRYITSHGYGCWSEVPEKAGLQRCGKSCRLRWINYLRPDIRRGRFTPEEEKLIISLHGAVGNRWAHIASHLPGRTDNEIKNYWNSWIKKKLKKTSKSSTNTTSITDHHHHQHQNQRPQLTNYNTITSQQDIFFTQDIGTKSQVLLQDSTLFNSPNQLFFFDGGSLDSMTNVLINDATNRNATNNTSLFQETSILNSEFCWQVDQQQVQTSSYAIGMNSNYLPPLIESMVPPMEIPSSNNNNNIILEGQENNNELNEWNSQVDTQQCCPSYLFWDQENGSIGGDHEIIDPTTSNNMGQILSSFPSTL

SEQ ID NO: 1918 - protein, 664 aa, Oryza sativa
  Orthologous to G2379
MVSKKKKTVSRHTTESEEGRHSFEIVGYSLKKGIGVDEFVESATFAVGGYDWCIRFYPDGKGDGAKDYISVYLELLTKDCAVRAAYDLRLVNLATGLPKSVYSETTHRMFNSEDSSKFAPHYATFMHRSQLEMEASGYIKDDRLTIECFVTVVVQESMASNTVKAHELIKVPPSDILENFGELLEKGEGADVTFVVGGEKIAAHKIVLAARGLLHFIYTDSLPDMDDLSDDDYYEMIRLLLVAADRYAMDRMKLQCESILGEHLDVQTVATTLALADQHNCNGLKDVCIEFIATQNKMDDVVATEGYMLRTCPSVLVDVFEKASFQQQASWLQSAPISFQGFRPQESWMHSPNQVVGSASSHGSESASQCPARQEENNLVNIEESSDNSQETGRRGTRVNWTEEENLRLLSSWLNNSLDSINGNDKKGEYYWRDVAAEFNGNASSNNRKRTVVQCKTHWGGVKKDIAKFCGAYSRARRTWSSGFSDDMIMEKAHALYKSENNDKTFTLEYMWRELKDQPKWQRILEEDSKNKRTKISESGAYTSSSNQETEEETSRKEKRPEGQKKAKAKLKGKGKKPAPSPLGDQPSQDFVLFNEAVKLRAEAVLKSAEATTKSAEAKKEQTRMEKYQTYLKLLDKDTANFSDAKLKRHEAVLEKLATELAEE

SEQ ID NO: 1919 - protein, 290 aa, Oryza sativa
  Orthologous to G2379
MGRSHRLPALQDNKKRQLISSRQVKAAKTEVRRATRTNWTEEENLRLISAWLSNSVDPTDGNDKKGEYYWKDVADEFNNNRPTNGHKRTVKQLKTHWGNVKKDIGKFCGVYAQVRRTCTSGHSDDMIMEKAHLWYKNQSNQKKPFTLEYMWRELKDQPKWRSIIKKEENKNKRTKISESGAYTSSSNQETEEESSNKERHPEGQKKAKERLKGKGKGKAQSSPLGNQPSQNIVLYNEAMKIKAEALLKSAEATAKSAEAKREQIRMEKWQAYIKLEEKDTSNFSGEAEKA

SEQ ID NO: 1920 - protein, 399 aa, Oryza sativa
  Orthologous to G2379
MYYAIELIKLHVLAEEVDIGIVQALLMLSNLHINIVPSFGNMGALGIDLCRDLHPVVNGFLQQASWLQSAPISFQGFRPQESWMHSPNQVVGSASSHGSKSASQCPARQEENNLVNIEESSDNSQETGRRGTHVNWTEEENLRLLSSWLNNSLDSINGNDKKGEYYWRDVAAEFNGNASSNNRKRTVVQCKTHWGGVKKDIAKFCGAYSRARRTWSSGFSDDMIMEKAHALYKSENNDKTFTLEYMWRELKDQPKWRRILEEDSKNKRTKISESGAYTSSSNQETEEETSRKEKRPEGQKKAKAKLKGKGKKPAPSPLGDQPSQDFVLFNEAVKLRAEAVLKSAEATTKSAEAKKEQTRMEKYQTYLKLLDKDTANFSDAKLKRHEAVLEKLATELAEE

SEQ ID NO: 1921 - DNA, 1429 bp, Glycine max
  Predicted polypeptide sequence is orthologous to G2505
tgtttatcatacaatcaataattgcatttttttttcaattgacactatggtacttgacaaacaatggattgaaatattacaactaatgaagtcttctaatcaagtgaaaaacataacaaacaatcttaaatcgatcagtatcaaaatatatgtcctttttaaaatggttagagcctttgtaattatctccaaccttgaatgcacttaatttgtttataaatttcactataataaagggaaattaatcattgttttccataggcccagaagtccatctctcccctcaatgaaagttgattgatctggtggacagactgtggatttgcctcttcaaacctgacccctttggatgagtcctcatttccagcaagatgagaggtcactagcctatcaagaacaccccattcgtttattccttcacctcttccggttcccatttcttgatttggttcacacgacccaacttccatacctgactccgaaacttgatatcttaggccatcactgccgctctcacagtctctagggtttgtcatgagttgctttgccatgataggggtgtctgatgtatatgaataatcataaaccataggcttttgggtctgaagaagaggctcggattggaagagtgagtatggagggttttgcaagtgtggcggcgggtaatggagagccagctcaggcttatcaagctcaagccctgatgagttcctaggattttgctgttgatgtagtaagtagtgattttctctataggaccgtgcattagtgtttgaagaattgttgatttggtgatctggtttatgtgtagacccaccttcattttcaatcttgaataaattcttcttcttgaacactctgcacaccacccagccatcttcattggcacttccttgaggatcattgccatcttctaggcggtactcatgcatgatccaatcagtcttttgtccatgaggagctcttcctttgtaaaacacaagggtttttctcattccaatcttcttgaagctattcctaatgcacttgtctcttcctgttgctttccaaaaccctgcgttcgttgctctattagtccttgaacctgtagggtactttctatccttgtgactgaagaaataccactcgttttgtggagtagatccaattctacatctttcttgcaagtcccaaggctccatcttgttcaagtcgacctctctaatgacatccatgtcaaacttctgaaaggacaccttcttcttcaagtagtaatgaagcagctcttcatccgttggatgaaatctaaaccctggcggcacaccaccattagtcgacgaacccatcttattatctacaaattcaaactctcaatcacttaccaaatagatatttcaattcgctctatgaacttaatcgatttgaagctcgagccgattcggctcgagag

SEQ ID NO: 1922 - DNA, 802 bp, Zea mays
  Predicted polypeptide sequence is orthologous to G2505
  misc_feature (758)..(758): n is a, c, g, or t
aattgaagctctagctagctagctactttgcaaagtttgcgtgcttcgatcgtctcgatggctgacttctcgtccagcaacggcgtcccgccggggttccggttccaccctaccgacgaggagctgctgctctactacctcaagaagaagatcggcttcgagaagttcgacctcgaggtcatcagggaggtcgacctcaacaagatcgagccatgggacctccaagagagatgccggatcgggtctgcgccgcagaacgaatggtacttcttcagccacaaggaccgcaagtacccgacggggtcgcggacgaaccgcgcgacgacggccgggttctggaaggcgacggggagggacaagtgcatccgcaccagctaccgcaagatcgggatgcgcaagacgctcgtcttctaccgcggtcgcgccccccacggccagaagtccgactggatcatgcacgagtaccgcctcgaggaaatcgacgaagcccagggcggcaccagcgaggatggatgggtggtgtgccgcgtgttcaagaagaagtgtttcttcaagatcgccggaggcggcgaagggagctcaagccagagcgcggacgccggcgccggccacatggccgtgtcgtcaccactgggtggccacgaccacgctgacagggccgccatggcatctcactacatgcacgggatgcacccgcagtaccacccccagcacgcctcttccttctactactcccagatgcaaccaccggaggcggnctactcgcaccacgtgcaggtccaggacctcctcacaaccaccg

SEQ ID NO: 1923 - DNA, 1262 bp, Glycine max
  Predicted polypeptide sequence is orthologous to G2520
cggattcggctcgggtaggccacagtcacacacagcctttgcctttgcctttgctgttcagtgctcccactcccagtccgggccgaggcagaaaatatcggaaactaacctttcacactcacacatccatcgtcatatctgaattggcaactcattattaaatcaattacgaaaacgaagaaacccaacaaaacaatggtagtagcttagctaattgcctaattgaatgaatctcaatggaacctcctctcatcaacgactccacattctcttccgctaacccttccttgtccgagatttggccctctcattttcccacagaccacactcccagtaacaagagacacctctccccctcgactgattgtggcagcaataaacatatcaaatcatcaggatcaggatcccaggatcaaaacggtgccttgaaggcgggtgaagtggacgcgacttcagtagccggtaacaagttacctgaacaaacggcgaaacctagttcttccgagcagccacctaagcaagactatatacacgtgcgagctagaagaggccaagccaccgatagccacagtctggctgagagagctaggagagaaaagatcagtgagaggatgaaaattcttcaagatatagttcccggctgcaacaaggtaattggtaaagcacttgtgctggatgagataattaattatatccagtcactgcagcatcaggttgagttcctttctatgaagcttgaggcagttaattcgagattgagcatgagccctactattgaatgttttccttcaaaagaagttggcactcagccatttgaccttgccggaataatatttggatcacaaccggccaggggatatgctcaaggatcacagccgggatggctgcatatgcagatagctggtggttttgagaaagcaacataatttgagggaggttcattgggaatgacagatcaatcagtgtggttggttttccattgaaaaggaaaaaagtcacttggctggttggttagcatgcgctgctctattaacaacctagtcaattgatgcaaaatgttgtaaggtctgtatgttctttgtcatagtatgatatcgattgtaagaaatgcatctaatttcctcgcgcatcatctgactgggaacgtagtgctgcaccatgttagcaattgaaataatcttattgtggtttagttttcgtttcaaaaaaaaacaaaccaaaaaaaaaaaaaaaaaaaaaaaaaaaaaaaaaaaaaaaaaaag

SEQ ID NO: 1924 - DNA, 1312 bp, Glycine max
  Predicted polypeptide sequence is orthologous to G2520
caatgccactcttcttcctttctctttcccactgagagagactgcaaactaatttctagtattccgacacagataatggatccggcggcgatgatgaacggcggcgccaacccgacgtcgtatcacctgtcagagatctggcagttcccgcctcccaacgcgccagacgagctgggactcagaaggccccacttcacccacggcttcgcggacttcgccccggatccgacccgagacgccgtcccgggtcgcgacccggccagcattgcccagaagaagcgccgcgacgcctcggccgaggaggaggaatccgctaagggcgcctccaccaccaatgccgtgaatgaggggggtggtgttggtgatgggaaacgggtcaagacgagtgagagtgggaaaggtgaaggagaaaccagttcaggaaagcttgcggagcaaagtggtaagccaccttcggagcctccaaagcaagactacattcatgtccgagccagaaggggtcaagctactgatagccacagtcttgcagaaagagctagacgcgaaaagatcagtgagaggatgaaaattcttcaggatatagtcccgggttgtaataaggttattgggaaagcattggtccttgatgagataattaattatatccaatcgcttcagcggcaagtagagtttttgtcaatgaagcttgaagcagtaaattcaagactggcccccagaattgaagtgtttcctcctaaagattttgatcagcaaacatttgatacaactggcatgccgtttgcttcccaagctacaagagagtatagccgaggttcatcaccagaatggttacatatgcaggttggaggtggttttgaaagagcaacgtagtctttgaaatcccatcacctgataataaatgcatataggatcattaatctctccatcagagctcccataaatcatatactcaaggtgttgttgcttagtcctatagacacctcattccctgttttctacaagagaggcatggagctgtggtttgtttccacaggatcacttcagttagtactcaagcaactccatttgttagtgtgttggaaaatgaattcatttacccaatatgtagtttagtatgctgatactcttcatataacctttaaaatgattgttattattcttgtaaaagaatgctgcttgtcctgaatacataaaggcttacatattgtgtaatagtatcaacattgttgtttgtctgtgaagctgtgttgaataaattaagcccatgtgattttgttaaaaaaaaaaaaaaaaaggagacagaaaaaaaaaa

SEQ ID NO: 1925 - DNA, 581 bp, Oryza sativa
  Predicted polypeptide sequence is orthologous to G2520
cgggctgcaggaatcggcacgaggtttttttttttttttttttttttttttttatagcaagagaattattgatggttattacttttctttcatgctacgaatgagcgtgacctgccgaaattccgtggaatacatgaatctgatgagaattgtatcccggtacagatgtaaaaatactgtgctcgcagtctctaaatacatgagctccatgctatgaatgaaatcgaatttggagcacgagagtttcgaaaaataatctaaagccgtggtttctgactgaactcatggtatgctttattttgggccaccatcctgactttgttctgttcatgtcactctttcataggtgccaccaatctgcatgtggagccattccgatggtgttgatccctgggcgtattctcttggtgtttgtggatcaaacgtcaatccaggagccgtgttgtatacctgagcaccaaaatcttagggtggaaatgcttcgattccattattcacatgagcattaacagcctcaagcttcatggacaaaaactcaacttgccgttgcaaagcctggatataattaattatctcatcaa

SEQ ID NO: 1926 - DNA, 811 bp, Zea mays
  Predicted polypeptide sequence is orthologous to G2520
ctcgaggccggccgggatataaaggcagtctaagaacagaggttgaaactgactcaagaagtgctggcaaggctgttagtagaaacattccagcagcagagccaccaaaacaagattatatccatgtcagggcaaggaggggtcaagcaactgatagtcatagtcttgcagagagggcacgtcgtgagaaaataagtgaacgaatgaaagttctccaagatcttgtgcctggatgcaacaaggttattggcaaagcatcagtacttgatgagataattaattacatccagtcgttgcaatgtcaagttgagttcctgtccatgaaactagaggcagtgaatgcccaggcaaaccagggagttgaagtatttccagccaaagattacggttctcagacatacaacacagctcctgggctgacatttgatacgcaaaccagtagagaatacgcccagggcacgtcgacctcggaatggcttcacatgcagattggcagtggctatgaaagggtttcatgaacgagatgaatccaggcagccgctaaataaagtgaaccatgatcaatcatggccgtgcttgtagatcattctttttcattttttttgaaaccatcatgttccagacgcattttttattcatgcttggagctgtaattccagccggaacatgtatttttgatgaggcgctcatttgtttccccatctgaatctcaagactgtttctgctgttcatgtattccatggaatttctgtagatcgcgttcgtctgtcagaaggatgaataaatcagttgatgctttgattttgaatcc

SEQ ID NO: 1927 - DNA, 407 bp, Zea mays
  Predicted polypeptide sequence is orthologous to G2520
gggcaaggaggggtcaagcaactgatagtcatagtcttgcagagagggtaagtggaatgtaacattttctgttgtaaaaatgctattgtatgaatttcaagtggtctaaaacggtaggagcatcacttctgtaagttacatacaacatgaacttgaccacttaaagatcttgttgttttaacaggcacgtcgtgagaaaataagtgaacgaatgaaagttctccaagatcttgtgcctggatgcaacaaggttatgtggcaaagcatcagtacttgatgagataattaattacatccagtcgttgcaatgtcaagttgagttcctgtccatgaaactagaggcagtgaatgcccaggcaaaccagggagttgaagtatttccagccaaagattacggttctcagaca

SEQ ID NO: 1928 - DNA, 1716 bp, Zea mays
  Predicted polypeptide sequence is orthologous to G2520
cacctagtgaaaaaaatgacagaaggacagaagctgaaacaaattcagggaacgctagcaagtctgctgataaaaagcctgcacctaaagagccaccaaaagactacatccatgtgagggctagaagaggtcaagcaacggacagccatagcctcgcagaaagagcacgacgagagaagataagtgaacggatgaaagttcttcaagatattgtccctggatgcaacaaggttatcgggaaagcatcagtccttgatgagataataaattacatccagtctttacagcgtcaagtagagtttttgtccatgaaacttgaagcgattaatgctcatgtgagcaatgcaactgtagcttttccaaccaaagattttggtgttgcgccatataatactgctcctagcctgacgttggacccacaaacgccaagggaatacgcccagggctcgatgtcagattggcttctgtcatgggcatcatagggagcgagaggcaacagccaagctgggataaggctagagaataagattaagattagctgggataaggctagagaataagattgagatgagagaattgtggagagttagcagcagataagtccaagaaagtaggagttagttgagagtttgtagaagttggttagctatagggctatttataagccgcatggcagcagagaataaatcaagcaagatcattatcaaaccaatctctctctcttgcaatgaccctctcaagcgcctagggctgctaccctagaaccaagcctgcggcagaggggtataacctcgccggagaagacagctatccccatggaccgaaggtcgacagaaagactacacatatttacaatgggcaaaacaagccaagtacatattgtgtgtgtactttttttgtactccagatcacttatctacgttcaccaaactgatgcggagacgaaacacctcgtggacagctccacggttaagaatggcaagaatctctgctccctcagccgtggtgagctcacctagcgagattttgcgggactcgtactcatcaggcaaccggaaaccatagaaccacctaccaagcttgagcaagttcacacaaaccatcctttctgatacactgtgagcttggagtgctttactgacttcagctggcagcacatgcaaagatgcgatcgagtagtgcagtccaattaggtttattatcgcactatggttccttgaaaacaagaaaaactggacatcgagaaatcctatatcaagtatcatggccaaatcagcaatagctttcagatagtattcggattcaagtgacgcattctctcagctagggtcctccacgttgtcccccatcagatcttgcaccagccattcttcgttgtcggctgatgtagagagctttccagccctgcatacgggacgacgacgccgacgcctccgccacggcagctggccaccggcagcgaaagaggcgctcccagatgcagtcggcgtcgcaggctctgcgccaggtgcgcgagcagccgccgagcgcgcacacatcagcctcctggaggcgggaggcgacgtctagggcgatgtcctcggggaggtcagtccacctccccgccgatgagagctccatttcgcgcgattcccctttcgccgctgcgactgtacagtaccagactaccagagcatcttcaaggtgtgagaaatttcactattgtgtcccggccgg

SEQ ID NO: 1929 - protein, 265 aa, Oryza sativa
  Orthologous to G2520
MDPAPTLAAELWRTPYLGGGGGGGGGGRGLEAAASGVTEQSNGSRGGGGGGGAGRRRQREAPALEDDSSRIVSTSGGGGGGQDLTDSEAKRFKASKSSGDNSSLRTEAETDSRNASKSGDQNPPPPEPPKQDYIHVRARRGQATDSHSLAERARREKISERMKILQDLVPGCNKVIGKASVLDEIINYIQALQRQVEFLSMKLEAVNAHVNNGIEAFPPKDFGAQVYNTAPGLTFDPQTPREYAQGSTPSEWLHMQIGGTYERVT

SEQ ID NO: 1930 - protein, 256 aa, Oryza sativa
  Orthologous to G2520
MDPAPSLAAELWRPHHHRHHFEASSVVTDQGSGSRGGGGSGRRRPRSDAGPEDDDLSKVVSTSAASGGGGGGGQDSDAPEAKRLKPMKSSDKNDSLRTEAGTDSGNSSKAADKNATPPEPPKQDYIHVRARRGQATDSHSLAERARREKISERMKILQDLVPGCNKVIGKASVLDEIINYIQSLQHQVEFLSMKLEAVNSHMINGIVAFPSKDFGAQPYNTAAGLTFDPQTTREFAQGSTSEWLHMQIGNAYERVT

SEQ ID NO: 1931 - DNA, 423 bp, Glycine max
  Predicted polypeptide sequence is orthologous to G2557
aggtggtttcaggcttatctcagagacttcaccaaagtccaagagacccagatggattcataagcatcctggttcatcaaatatcaacttccagcagccaaattcatctgtgacaccttcctttgaagaacctgatcctgaggtcatagcacaaatgaaggaaatgatatatagggctgcagcttttaggccagtgaacttgggccttgaagcggtggaaaagccaaaaaggaagaatgttaggatatcaactgatccacagacagtggctgccaggcaaagaagggagagaataagtgagaggattagggttttgcagaagattgtgcctggtggaagcaagatggacactgcatcaatgcttgatgaagcagcaaactacctcaagtttctcagatcacaagtcaaagcactggaaaatct

SEQ ID NO: 1932 - DNA, 417 bp, Glycine max
  Predicted polypeptide sequence is orthologous to G2557
ggttaggatatcttctgatccacagactgtggctgccaggcaaagaagggagagaataagtgagaggattagggttttgcagaagattgtgcctggaggaagcaagatggacactgcatcaatgcttgatgaagctgcaaactacctcaagtttctcagatcacaagtcaaagcactagaaaatcttggtaacaagcttgacacaatgaattgtcctcctactaacatagccttctctttcaacccttcttttcccatacaaacacatttccccatgcaaaaccctagcagccacatccaatactccaagggttgaaaacttgacatgaatattatcatggaagataagatgtaaaaaggggtctgagaacccataacctctaattttattccatccagtgagtatgattaacgtat

SEQ ID NO: 1933 - DNA, 701 bp, Glycine max
  Predicted polypeptide sequence is orthologous to G2557
ggctagaaaatgaagatcagatatgttaatcgttgagattggtaatgaaatgataggggtcatggggggttgttttgtttgaccccatgggaatgatggatgtgacagaggggtggtgtttgcatgggaaaagaagggttgaaagagaaggcaatgctagtaggaggacaattcattgcatcaactttgtttcctagactttccagtgccttcacctgtgacctgagaaacttgaggtagtttgcagcctcatcaagcattgatgctgtgtccatcttgcttcccccaggcacaagcttctgcaaaaccctaatcttctcatttattctctcccttctgtgccttgcagccacagtttgtggatcagttgatatcttcacattcttcctcttcggcttttcagccacctccaacccaaagttcactggcctaaaagctgcagccctatatatcatttccttcatttgtgcaattgcctctggatcaggctcttcaatggaagaagaaatggatgaatttggttgctggaaattgatattatttgaggaggaactcatatcccatcttgatttcttgcattctggttgattaatatctgagacaagtctgaaaccaccttcttcaataggagaagaattctgaacaatactgaagcaggaatcaccaactttgatcattttagattgatcatgggcatgact

SEQ ID NO: 1934 - DNA, 545 bp, Zea mays
  Predicted polypeptide sequence is orthologous to G2557
cgggccctaggccgtcggcgcggcgggggcgggcgcggagaggccccggcggaagaacgtgcgcatctcgagcgacccgcagacggtggcggcgcggctgcggcgcgagcgcgtgagcgagcgcctgcgcgtgctgcagaagctggtcccggggggcagcaagatggacacggcgtccatgctcgacgaggcggccagctacctcaagttcctcaagtcccaggtccaggcgctggaaaccctaggcacgacgacggcgaccaacgccaacagcagcgcgagcgccaccaccagcaggagcagcgcggcgagcaggtcgccgcagtacaactattacggcggcggcggcaataataataatcctgccggctttcttggattcagtaacgttatttctccggctgggtatgtaaatccgggtgcatcgtcgtcgaatactggcagcaacaaactgctgttttagtgactgttcttgtgtgattgttgtttgtcgtccggagcggacgatgcacatacacatgcatgcatgcatgttgctgtttccc

SEQ ID NO: 1935 - DNA, 1614 bp, Zea mays
  Predicted polypeptide sequence is orthologous to G2557
cgaggaccatcctcgctaccctgcaggccggcactgcactgcactgcagtctacagaactcgtcagtcacagatcggtgcaggcggtctgcacctgcatcacctaaccaattcctcgattagtctgctgttgcgatttgcgaggcaggtcagcttgtgtttcttcattctgtttgcacgatgctgcaatctttttgcagcagccactaaacctgtaccaagtcttcttgcctgagggcagaggcaggctccgtcagtcacgccggcggcgtacagatcatggaggactttggcggctggaatatgcagtatgcagcagagctatgcctgccaagccgccgggacgacgacgacgacggcctcctcggtgacttcctaggcggcggcggtttggacatccgttctgaccatggcggcctcaacctgccctcgtcgcaccctgctgtccagaaccttgtgccctgccacggcggcgtgagtctttccgtttccgacgccttcatgggcctggacacggcggatatgctcgctagcgtcaccggcgcactggactgcagcctcctcgacacgtttgcttgcggttcggacgccgtcgtcgtcgccgaggagcccgccgcgcagcccaccgcgtcgagcaacgccttctccggatacagcagcaccacgggcggcaattacggcaacatctcctccggcgagtccaacacgtacggcggcagcggcggaggccatgacacggaggttgcgtcgccgacctgcgcctcgaagcggaagctggccggcaagtaccctgcaatagccgcgtcggcctcggccacagccacgacgacaacggcggaggggcaggttgcagccccgcggcgtggcacgaagcgcgactccgcgacgtcgtcttcgtcgaccagcgccacggtcgccgggcatggcggcggcaaccatgcggccggaggaggcgggtcgtcgtcggtcggcgacgggaacgggtacgagccggactcggaggcaatagcgcaggtgaaggagatgatctaccgcgcggcggcgatgcggccggtgcaccagctcgtgtgcggggccgccggcggcgagccgccgtcttcgtcccagaacaagccgcggcgcaggaacgtgcggatctcgagcgacccgcagacggtggcggcgcggctgcggcgggagagggtgagcgagcgcctgcgcgtgctgcagcggctcgtgccgggcggtagccggatggacactgcgtccatgctcgacgaggcggccggctatctcaagttcctcaagtcgcaggtcaaggcactggagagggcaaaccctagtagtaatggtggctacaacgacagcagcttcctgccgcagaattacacggggtgcctctgtgtcgacggtggcaccagtgttgcctttggaagcgatggcgccattgggggctacgtaaaaccaggtaggaacatgcaccggtagcgatgcaataatgtaaccattgatgcgagtgagcgatatatgagagaagtactgcagtactgctactggattttgagtttaataaggctttactgtatttctgagtaataataatcaaaacgatttgatttaaaaaaaaaaaaaaaaa

SEQ ID NO: 1936 - DNA, 423 bp, Glycine max; identical to SEQ ID NO: 1931
  Orthologous to G2557

SEQ ID NO: 1937 - protein, 393 aa, Oryza sativa
  Orthologous to G2557
METFGWAGGGQLMHHDDIYLPRSVGCGRPFELDDAFLGACFGAQLQCDGGVGGGDGGGCLQGTSGFGAVAGDPLGLLCSGDVFASVAEGAGGAHDDGLLDAALAFSRNQLGGAACDGSDGGAVSNGAMLSSYSGTTGGNISSGESNNYSGGGGGYDAEVVSPTSTMSAATQSLHPKRKLYDDHHHPAGIAAAAAAPPLAPCPRPTTGAVAAKRRASTSATSITFGHQPHHHHAGATTAGYEPDMEAMAQVKEMIYRAAAMRPVHLGTEAAADKPRRKNVRISSDPQTVAARLRRERVSDRLRVLQKLVPGGNKMDTASMLDEAASYLKFLKSQVQKLETLGTTTTTSKLPQQYYSGNINSSNNHHGFLGFAANNNTISAGYANSNAGNATKLL

SEQ ID NO: 1938 - protein, 146 aa, Oryza sativa
  Orthologous to G2557
MRPVTLGGAASASDPSSAAPPPPQRPRRKNVRISSDPQTVAARLRRERVSERLRVLQRLVPGGSKMDTATMLDEAASYLKFLKSQLEALETLGNGNGNGNLLHHGYYTGSRNATATAATGSSNSTVLAFGRDGLAGFVKSNRNLQL

SEQ ID NO: 1939 - protein, 484 aa, Oryza sativa
  Orthologous to G2557
MFRSAVAVSQLATTTTVWMDRGFNEMILSESVWNGGGGGGDGDGGAVVLPPEVGGVNAVDGSGMTMLERLVLDEALAAAILELQGIQAPGCGGGGGKVAVVPPPTAGDGGVEAAVAFAAMATGTPAYADVDADVLQRQRQHHHRHQGAMGMAAEYDVAPATPAVTLSAVPPPPPPPAFATAAASVDGGGAMDATVFSGIGNDDVVDAVSATVAMTTATATTSQCERVRGGGGGGGCGRKQRRPGRKRKAAEPTAAAAAADMSSQDNPLCSLLASNTAGADGGIQIAFSTSAPASKRAKPSLSSSSSSISFDGRGPGGNCGGGGGDDPLYEPDTEALAQVKEMIYRAAAMRPVTLGAEDAGERPRRRNVRISSDPQTVAARQRRERISERLRVLQKLVPGGAKMDTASMLDEAANYLRFLKSQIRELQTLDRRNYPNAAMSINTAAATTMATSSSPTYNNSNAAMPAFAFPETLGCGGGGVEQLI

SEQ ID NO: 1940 - DNA, 925 bp, Glycine max
  Predicted polypeptide sequence is orthologous to G2719
  misc_feature (896)..(896): n is a, c, g, or t
  misc_feature (911)..(911): n is a, c, g, or t
gagttaatcaacgttaatcaacttgttctcgttaattagtactgaaaaatgacttccaagatacaaatattatcaatcctaggcatgttggccatgttctttcttatctccacggaggtgttagccactggattacatggtgttggtgttggtggtggattacctggtgttggtgttagcgctggattacctggtgttggcactggattacatggtgttggcggcgctggattatctggtgctggtggcgttggattatctgccgacgcgggattatctcgtgctggtgacgctggattatctggtgctggtggcggccgtcgtggtcgtgctggctccccttctttgtgttttttctctgtcattttctcgaacaggtgaaaggcgacgacaacgatgaccggtggccacgatcgcgtgaagggttcatggagtcctcaggaggatgcgacgttgctgaaactcgtgaacgagcacggggcacgcaactggtccgtcataagcgccggaatttccgggcgttccggcaagtcgtgccgtctgcggtggtgcaaccagctgagtccggaggtgcagcaccgtccgttcactccggcggaggacaagatgatcataaaggcgcacgccattcacggaaacaaatgggccaccatctcgcgcctcctccccggccgcaccgacaacgccatcaagaaccactggaactccactctccgccgccgtcgcgcggtggagtcatcctcctcctcatcggcgtctccgccggcgaaacgtcactcttccttgtttgacacgcttcaccctttcaagaaacagtgcatcgagaaggaaaacgaagaagagcgagtgctgagtcccgttacgacgtcgttgagtcttttctcgagcgcgaattnccgaggcttagcgtnacggcgtgccatgc

SEQ ID NO: 1941 - DNA, 1875 bp, Zea mays
  Predicted polypeptide sequence is orthologous to G2719
cattgggtacctcgaggccggccgggatctagcggcagagaccaaagtgcccatcgcaccatgtcggccgccgaaaccgctgtttctccgacgacgccgccgcagccgcagctgcaatcggatccgaacgccgccgccgacgcggccagttccaattctctctgggtggccgacgagacgcaaaccctaaccgaggtcctgctccaaccccaaccaaaccacctgtcgcctcctccttctggtgaaggggacgacgggatcactgcctccggtgctcctgttggtggggacgccgcggcatccgcttctgctgctgcggcggctaacgcgacgatagaagagcgggtgagggggccgtggtccccagaggaggacgcggtgctgagcaacctcgtggagaagttcggggcgcggaactggacgctgatcgcgcgtggcatcccggggtcgctccggcaagtcctgccgcctgcgcgtggtgcgaatcagctcgacccccaagtcaagcgcaagcctttcactgaagaggaggaccgcattataatggcagctcatgctgtccatgggaacaagtgggcatctatcgcaaagcttttggatgggagaaccgacaatgccatcaagaatcactggaattccaccctgaggcgtcgctactgcaatgatggccaatgcaagcatggtggttctgtggagcgaagtatctcaaaggtgtccagggaagtttcagaagaaccttggcctttaaacgatcttaattccttcaccgctatggatgtaaaggatgatcctgtgcaaacggctccagatacttctcctcgggcaaggcacatcacagatcattgttctattactcaagtagttgatccaccatacctgtcccgaccagcggcaaagattggtgctttcagaccatattatctaggacacacggaacctacccaacaagaaatgccaggtggctgtcgtcaagtttgactcaactcataaagtctcgactcctgaaagcgaggtattcaagtttgttgatcctatatgctttgctgctgaggtgccagacaaatgtgggtatggttgctgcggtgctcatgagcagcatcgtaagaactcattgctgggtcctgagttcagtgagtttgaaggtcatccacctgttttaaatattagctttgcttcattggtatcagaaattagcagcattgcctggatgagaagtggtatgcaaagcagtgattccagcaacttgatgcaatcaattccaccaacctgacaaagtaggaatcttatgtcagtggcggatccagaaacagatcaaatgaggggctaagttatggattggggaggctggagatggctgcaatgcgaatgaatggaaccaccatgtaaataatgtgcgaattacaaacgcgtgtgggttgctgtgtgccgtgcgcatgggtgatgaactgatggacctgcattgtgctgttatgcgcctgcatcttgtaatcgtgggccttcttcgtattactatgctgaaatcactaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcccttttaaagaaacaaagttaacgaccccggcaatgcggaggaaaagtttttttttggggcacccaaaataaaatccatggcccgtggtttaaaaacgcggggatgggaaaaaccttgggttacccaaattaatagcctttgagaaaaatccccttttcgccggttggggaaaacaaaaaaagcccccacacctatcccctttc

SEQ ID NO: 1942 - protein, 413 aa, Oryza sativa
  Orthologous to G2719
MSSETAASPPPPPPNPPAADSTHSSPASMTDETHGAGAHPDESQPHRSSSSSSSPPVAVDGETRVPLPVRSLPQPSHPSPPPSGEDEDDVVITGQIAVGDAAGAAMEERVKGPWSSDEDTLLSNLVEKLGPRNWTLIARGIPGRSGKSCRLRWCNQLDPQVKRKPFTEEEDRIIMAAHAIHGNKWAAIAKLLVGRTDNAIKNHWNSTLRRRHCTGGRCTQGGVMKRAIPERPRSVSEEPWPLGNLSSLNVREAMEAPAQTVSESYVGAWQIGDQSCKTEVVDPPYLARPVAKVGAFKPYNVGPAQSSQKEMLSFATKFDSNLHPFKPENGVCKFVDPTSFAAEVPNKCGHGCCSSHGQLRKNSLLGPEFNEFEDHPPISDSSFASLVSEISSIAWMKSGLQSSDTLARSVPPA

SEQ ID NO: 1943 - protein, 242 aa, Oryza sativa
  Orthologous to G2719
MALEGAAGGGGVGGGGGPPGQEAGKKVGWSKEEDKLLRELVRKQGGKDWGVIATAFPGRTDKSCRLRWRQHLDPSVDVALPFSAGEDRKIVELHRVHGNRWATIAAFLPGRSDNAIKNRWNTHLRKRHAQDVQQRPSGGLALGLGGGGGAGQAAGGKLTPVCLQLFPPTQAPPIGENLPGPARSAVPELLKLFPLAPGDLKDNASAAAAMDVGNEAVRALPELRLSPAAVVFDAMPLQAIRM

SEQ ID NO: 1944 - DNA, 1059 bp, Glycine max
  Predicted polypeptide sequence is orthologous to G2789
ttagagtaaacgaagttataattaagcaagaaggagaatgaacagtgatgataataagagaaagtcgaaattaaaaataaaaaaagacaaacaaaaataaaataagaaaaagaagaaaacaaagataaccgagaaaaaaaccatgaaagtaaaacactttgttaaaagggagggcgagcactgccaccccaataaccctcagccggtaattgaattgaattgagaagattctgaggcactccatggaaaagagaagaactatttggatctcccacaagctgttgttgttgctgttgcggctgcgattgtgattgttgctgagtccccgggattcctggggaccctaatccttcggtgccatgatatggcaccggagtttcctcttcctctaagggtagtctctcataagcagcattaccaaatgaagcagccatgatgaccacagggcctgaagccacaaggggtcccaccacacttccacctactacctgtccctgtccgccagccagatatatggctagtcctgacgccgctggcggagccggcggcggcaggaatgaaccggacagggacagaatctcgaaccttccgtgaagggtcacgacggcacttggcgaggccggctgtcggagtgtgacgttggtgacggtgccacttccgctgagcacgcagatgccacgctgccgccgcctcgcgaaggcggtgacgctctccatgatgtcacagccgttggtgatttccatgacatgggatcggagggcgttggcactgtctcttgtgatgataatgggtggtttgggcttgtttttggaccctgcgggtcttcctcttggtcttctccccatgtcactccctcctccctcttctgacccgggttccttgccctccccgccgccgtgggggggcgtggtggccccgcctccgccaccgacgttctcatcgcgatctcgcttctggccgcggccattgccggcttcgtcctcggtgttttggttgttgtggtggggctggaattgatggtgagggtgtaagtgaagatctctagttagaaaaggtgga

SEQ ID NO: 1945 - DNA, 488 bp, Medicago truncatula
  Predicted polypeptide sequence is orthologous to G2789
tggcaatgggagcttaagccgaggccaaaaaagagaacgaaaaacaaaccaaaaccacctatcatcatcacgagggacagcgcgaacgcactccgatcccacgtgatggaagttgcaaatggatgtgacatcatggaaagtgtgacggtctttgcgcgaaggaggcagcgtggtgtctgcatccttagcggaagtgggaccgtcacaaacgtgactctccgtcaaccagcatcgcctggtgcggtagtcacacttcatggaagatttgagatattatcattatctggctctttcctgccgccgcctgctccaccagcggcgtcaggattagccatatatctagctggtggacaaggacaggtcgtcggtggtagcgtggtgggaccgttgttagcttccggtccggttgttatcatggcagcttcctttggaaatgctgcttatgaaaggctacctttagaagatgaagaaacaccagtgaatgtgcc

SEQ ID NO: 1946 - DNA, 2169 bp, Glycine max
  Predicted polypeptide sequence is orthologous to G2830
ggctcgagaaaagatagagcaaggaactcataaaagtgggaggaatgtggggttgaaagcttatgttgtgtgccaagtgcttgagattgttgtcaaaaaggaaataaaacaagctgaaataaaatctacacaagtcaaaatcaggaggttcttccgaccagaagatttatcaaatgagaaggcatattgctctgatatacgagaggtgtattacagtgatgaaacatatataatctctgtagaatccatagaagggaaatgtcaagtcagaaaaaagaatgatattcccgaatgcagtgctcttggtggaatcttccaaaatgtttttttctgcgagctcttgtatgatcctgccactgggtcactgaagaagttgccggctaatataaaagtaaaatattcaagtggacaaacatctgatgctgcagctagaaagaggaaaggaaaatgtatagagggagatggtgtttcagagtccacaaaggaaggaaaaacattaaatgataaacgtttagcaaccttggacatttttgcaggctgtggtggcttatcagaggggttgcagcagtcaggagtttcatcaactaaatgggctattgagtatgaagaaccagccggggatgcatttaaagctaatcatcctgaggcattggtgttcattaacaattgcaatgttattcttagggctgtaatggagaagtgtggggacacagatgattgtatctcaacatctgaggctgcagaattggctgcaaagcttgatgagaaggaaataagtagtttaccaatgcctggacaagttgatttcattaatggtggtcctccatgccagggtttctctgggatgaataggtttaaccagagcagttggagtaaagtccagtgtgagatgatattggcattcttatcctttgctgattatttccggccaaggtatttcttgttggagaatgtgaggaactttgtgtctttcaataaaggacagacattccgtttaactttggcttcacttcttgagatgggctatcaggtgaggtttggtatccttgaggctggagcatttggggtttctcagtcaagaaaaagggcattcatatgggctgcttctcctgaggatgtgcttcctgaatggccagaaccagtgcacgtcttttcggcccctgagttgaagatcacattatcagaaaatgtccagtatgctgctgtccgcagtactgcaaatggtgctcctttacgtgcaataactgttcaagatactattggtgatctcccagctgttggcaatggagcctcaaaaggaaacatggagtatcaaaatgatccagtctcatggtttcaaaagaagattcgaggtgatatggttgtcttgactgatcatatatcaaaggagatgaatgaattgaacttgattcgatgccagaaaattcccaagagaccagcacctggtctcttggcgtgaccttccagaagaaaagataaaactgtctagtggacaagttgttgatttgataccatggtgcttgccaaacacggctaagcggcacaatcaatggaagggactgtttggcaggttggattggcaaggaaatttcccaacttccgttacagaccctcagccaatggggaaggttggaatgtgcttccaccctgaccaagataggattcttactgttcgtgaatgtgctcggtctcaaggcttcccagatagctatgaatttgctggcaatatcatacacaagcaccggcagattggtaatgctgtgcctcctcctctagcatcagcattggggagaaagctcaaggaagcagtggacagtaagagctccacttagaagatgggccttctacattaggtcatgcttattgtattcataacagtcaccaagatattgcaaatcatcattccgggttccaaaaactagaaacccttgtatatagtgatatccattggtcatttgttgaggctaattccttgtttaactttcctcaaccaaggaattgaatggatgatgctcattttctatcaactaggattttcttgattagatggtattttggctgtttatgaaagaaatggttgggaattgattacctcccaatgtgtagttgaaaattgagaccaattttttttaacctgttatgaatatttgttgttgccactatttggct

SEQ ID NO: 1947 - DNA, 1699 bp, Arabidopsis thaliana
  G5  Predicted polypeptide sequence is paralogous to G974
ttttttttttgcaatctccccctaatctgttgtttctcgcttcttcttctgttaatcatctgtctttcaaaaagaaagaaaaaagaaaaattcgatttctgggtttgtttttgtcatacagaaaaaaatcaagcttatgaatttgtgtttaattttttgttttaatttgaaaggcaggttttttcagaacgagatcgttttttcaaatttcttctgattttacctctttttttcttcttagattttagtgaatcgagggtgaaatttttgattccctcttttcggatctacacagaggttgcttatttcaaaccttttagatccatttttttttaattttctcggaaaaatccctgtttctttacttttttataagtctcaggttcaattttttcggattcaaatttttattttaaatggcagctgctatgaatttgtacacttgtagcagatcgtttcaagactctggtggtgaactcatggacgcgcttgtaccttttatcaaaagcgtttccgattctccttcttcttcttctgcagcgtctgcgtctgcgtttcttcacccctctgcgttttctctccctcctctccccggttattacccggattcaacgttcttgacccaaccgttttcatacgggtcggatcttcaacaaaccgggtcattaatcggactcaacaacctctcttcttctcagatccaccagatccagtctcagatccatcatcctcttcctccgacgcatcacaacaacaacaactctttctcgaatcttctcagcccaaagccgttactgatgaagcaatctggagtcgctggatcttgtttcgcttacggttcaggtgttccttcgaagccgacgaagctttacagaggtgtgaggcaacgtcactggggaaaatgggtggctgagatccgtttgccgagaaatcggactcgtctctggcttgggacttttgacacggcggaggaagctgcgttggcctatgataaggcggcgtacaagctgcgcggcgatttcgcccggcttaacttccctaacctacgtcataacggatttcacatcggaggcgatttcggtgaatataaacctcttcactcctcagtcgacgctaagcttgaagctatttgtaaaagcatggcggagactcagaaacaggacaaatcgacgaaatcatcgaagaaacgtgagaagaaggtttcgtcgccagatctatcggagaaagtgaaggcggaggagaattcggtttcgatcggtggatctccaccggtgacggagtttgaagagtccaccgctggatcttcgccgttgtcggacttgacgttcgctgacccggaggagccgccgcagtggaacgagacgttctcgttggagaagtatccgtcgtacgagatcgattgggattcgattctagcttaggggcaaaataggaaattcagccgcttgcaatggagtttttgtgaaattgcatgactggcccaagagtaattaattaaatatggattagtgttaaatttcgtatgttaatatttgtattatggtttgtattagtctctctgtgtcggtccagcttgcggttttttgtcaggctcgaccatgccacagttttcattttatgtaatctttttttcttttgtcttatgtaatttgtagcttcagtttcttcatctataatgcaattttattatgattatgtg

SEQ ID NO: 1948 - protein, 334 aa, Arabidopsis thaliana
  G5  Paralogous to G974
MAAAMNLYTCSRSFQDSGGELMDALVPFIKSVSDSPSSSSAASASAFLHPSAFSLPPLPGYYPDSTFLTQPFSYGSDLQQTGSLIGLNNLSSSQIHQIQSQIHHPLPPTHHNNNNSFSNLLSPKPLLMKQSGVAGSCFAYGSGVPSKPTKLYRGVRQRHWGKWVAEIRLPRNRTRLWLGTFDTAEEAALAYDKAAYKLRGDFARLNFPNLRHNGFHIGGDFGEYKPLHSSVDAKLEAICKSMAETQKQDKSTKSSKKREKKVSSPDLSEKVKAEENSVSIGGSPPVTEFEESTAGSSPLSDLTFADPEEPPQWNETFSLEKYPSYEIDWDSILA

SEQ ID NO: 1949 - DNA, 1246 bp, Arabidopsis thaliana
  G9  Predicted polypeptide sequence is paralogous to G867, G1930
gtgtttcttctttctgctaaaaggttataatttttgtttcttggtttggtgagaatcttcaagaaactgaaacaaagaaaatggattctagttgcatagacgagataagttcctccacttcagaatctttctccgccaccaccgccaagaagctctctcctcctcccgcggcggcgttacgcctctaccggatgggaagcggcgggagcagcgtcgtgttggatcccgagaacggcctagagacggagtcacgaaagctaccatcttcaaaatacaaaggtgttgttcctcagcctaacggaagatggggagctcagatctacgagaagcaccaacgagtatggctcgggactttcaacgagcaagaagaagctgctcgttcctacgacatcgcagcttgtagattccgtggccgcgacgccgtcgtcaacttcaagaacgttctggaagacggcgatttagcttttcttgaagctcactcaaaggccgagatcgtcgacatgttgagaaaacacacttacgccgacgagcttgaacagaacaataaacggcagttgtttctctccgtcgacgctaacggaaaacgtaacggatcgagtactactcaaaacgacaaagttttaaagacgtgtgaagttcttttcgagaaggctgttacacctagcgacgttgggaagctaaaccgtctcgtgatacctaaacaacacgccgagaaacactttccgttaccgtcaccgtcaccggcagtgactaaaggagttttgatcaacttcgaagacgttaacggtaaagtgtggaggttccgttactcatactggaacagtagtcaaagttacgtgttgaccaagggatggagtcgattcgtcaaggagaagaatcttcgagccggtgatgttgttactttcgagagatcgaccggactagagcggcagttatatattgattggaaagttcggtctggtccgagagaaaacccggttcaggtggtggttcggcttttcggagttgatatctttaatgtgaccaccgtgaagccaaacgacgtcgtggccgtttgcggtggaaagagatctcgagatgttgatgatatgtttgcgttacggtgttccaagaagcaggcgataatcaatgctttgtgacatatttccttttccgattttatgctttcgttttttaatttttttttttgtcaagttgtgtaggttgtgattcatgctaggttgtatttaggaaaagagataagacc

SEQ ID NO: 1950 - protein, 352 aa, Arabidopsis thaliana
  G9  Paralogous to G867, G1930
MDSSCIDEISSSTSESFSATTAKKLSPPPAAALRLYRMGSGGSSVVLDPENGLETESRKLPSSKYKGVVPQPNGRWGAQIYEKHQRVWLGTFNEQEEAARSYDIAACRFRGRDAVVNFKNVLEDGDLAFLEAHSKAEIVDMLRKHTYADELEQNNKRQLFLSVDANGKRNGSSTTQNDKVLKTCEVLFEKAVTPSDVGKLNRLVIPKQHAEKHFPLPSPSPAVTKGVLINFEDVNGKVWRFRYSYWNSSQSYVLTKGWSRFVKEKNLRAGDVVTFERSTGLERQLYIDWKVRSGPRENPVQVVVRLFGVDIFNVTTVKPNDVVAVCGGKRSRDVDDMFALRCSKKQAIINAL

SEQ ID NO: 1951 - DNA, 831 bp, Arabidopsis thaliana
  G12  Predicted polypeptide sequence is paralogous to G24
gtgtcggtgaattttttgaaacttcttctcttttgcggtttcgtgttccactcctctcttcttggcccacgtgttcatcaatctctccctccgcatgtaatcgcttcgccgtcaatatcacatctttcttcttctttatctttaaaatctctttagatcgattcttttgtggattcttgaaatctccggagaaaaccactatggagacggcgactgaagtggccacggtggtgtcaactccggcggttacggttgcggcggtggcgacgaggaagagagataagccgtataaagggataaggatgaggaagtgggggaagtgggtggcggagataagagagcctaataaaaggtcaaggatctggcttggctcttactctactcctgaagcggcggcgcgtgcttacgacacggcggtgttttatctccgaggtccttctgctcggcttaacttcccggagcttttagccggagtgacggtgacgggaggaggcggaggaggagtgaacggtggtggagatatgtcggcggcgtatataaggagaaaagcggcggaggttggagcacaagtggatgcgttagaagcggcgggggcgggagggaatcgtcatcatcatcatcatcaacatcaacgtggtaatcatgattacgtagataatcatagtgattatcgtattaatgatgatcttatggagtgtagtagtaaagaagggtttaagaggtgtaatggatcgttggaacgggttgatttaaacaaattacccgatccggaaacttcagatgacgattaggaaagcaaaaaatagaaacaaaaaaaaaaaaaaaaaaaaa

SEQ ID NO: 1952 - protein, 196 aa, Arabidopsis thaliana
  G12  Paralogous to G24
METATEVATVVSTPAVTVAAVATRKRDKPYKGIRMRKWGKWVAEIREPNKRSRIWLGSYSTPEAAARAYDTAVFYLRGPSARLNFPELLAGVTVTGGGGGGVNGGGDMSAAYIRRKAAEVGAQVDALEAAGAGGNRHHHHHQHQRGNHDYVDNHSDYRINDDLMECSSKEGFKRCNGSLERVDLNKLPDPETSDDD

SEQ ID NO: 1953 - DNA, 553 bp, Arabidopsis thaliana
  G30  Predicted polypeptide sequence is paralogous to G1792
ctcttctgacgcacaacagtatatacacatacacagatatatggatcaaggaggtcgtagcagtggtagtggaggaggaggagccgagcaagggaagtaccgtggagtaaggagacgaccttggggtaaatacgccgcggaaataagagattcgaggaagcacggagagcgtgtgtggctagggacattcgacactgcggaagacgcggctcgagcctatgaccgagccgcctattcaatgagaggcaaagctgccattctcaacttccctcacgagtataacatgggaaccggatcctcatccactgcggctaattcttcttcctcgtcgcagcaagtttttgagtttgagtacttggacgatagcgttttggatgaacttcttgaatatggagagaactataacaagactcataatatcaacatgggcaagaggcaataaagggaatacaatcggtattaactgaaagttatgtgaaagaccattttcagttataacaaataaaataaaatcccaagcgtacaaagctgtttctaaaaaaaaaaaaaaaaa

SEQ ID NO: 1954 - protein, 133 aa, Arabidopsis thaliana
  G30  Paralogous to G1792
MDQGGRSSGSGGGGAEQGKYRGVRRRPWGKYAAEIRDSRKHGERVWLGTFDTAEDAARAYDRAAYSMRGKAAILNFPHEYNMGTGSSSTAANSSSSSQQVFEFEYLDDSVLDELLEYGENYNKTHNINMGKRQ

SEQ ID NO: 1955 - DNA, 929 bp, Arabidopsis thaliana
  G40  Predicted polypeptide sequence is paralogous to G912, G913
cttgaaaaagaatctacctgaaaagaaaaaaaagagagagagatataaatagctttaccaagacagatatactatcttttattaatccaaaaagactgagaactctagtaactacgtactacttaaaccttatccagtttcttgaaacagagtactctgatcaatgaactcattttcagctttttctgaaatgtttggctccgattacgagcctcaaggcggagattattgtccgacgttggccacgagttgtccgaagaaaccggcgggccgtaagaagtttcgtgagactcgtcacccaatttacagaggagttcgtcaaagaaactccggtaagtgggtttctgaagtgagagagccaaacaagaaaaccaggatttggctcgggactttccaaaccgctgagatggcagctcgtgctcacgacgtcgctgcattagccctccgtggccgatcagcatgtctcaacttcgctgactcggcttggcggctacgaatcccggagtcaacatgcgccaaggatatccaaaaagcggctgctgaagcggcgttggcttttcaagatgagacgtgtgatacgacgaccacgaatcatggcctggacatggaggagacgatggtggaagctatttatacaccggaacagagcgaaggtgcgttttatatggatgaggagacaatgtttgggatgccgactttgttggataatatggctgaaggcatgcttttaccgccgccgtctgttcaatggaatcataattatgacggcgaaggagatggtgacgtgtcgctttggagttactaatattcgatagtcgtttccatttttgtactatagtttgaaaatattctagttcctttttttagaatggttccttcattttattttattttattgttgtagaaacgagtggaaaataattcaatac

SEQ ID NO: 1956 - protein, 213 aa, Arabidopsis thaliana
  G40  Paralogous to G912, G913
MNSFSAFSEMFGSDYEPQGGDYCPTLATSCPKKPAGRKKFRETRHPIYRGVRQRNSGKWVSEVREPNKKTRIWLGTFQTAEMAARAHDVAALALRGRSACLNFADSAWRLRIPESTCAKDIQKAAAEAALAFQDETCDTTTTNHGLDMEETMVEAIYTPEQSEGAFYMDEETMFGMPTLLDNMAEGMLLPPPSVQWNHNYDGEGDGDVSLWSY

SEQ ID NO: 1957 - DNA, 803 bp, Arabidopsis thaliana
  G41  Predicted polypeptide sequence is paralogous to G912, G913
ctgatcaatgaactcattttctgccttttctgaaatgtttggctccgattacgagtctccggtttcctcaggcggtgattacagtccgaagcttgccacgagctgccccaagaaaccagcgggaaggaagaagtttcgtgagactcgtcacccaatttacagaggagttcgtcaaagaaactccggtaagtgggtgtgtgagttgagagagccaaacaagaaaacgaggatttggctcgggactttccaaaccgctgagatggcagctcgtgctcacgacgtcgccgccatagctctccgtggcagatctgcctgtctcaatttcgctgactcggcttggcggctacgaatcccggaatcaacctgtgccaaggaaatccaaaaggcggcggctgaagccgcgttgaattttcaagatgagatgtgtcatatgacgacggatgctcatggtcttgacatggaggagaccttggtggaggctatttatacgccggaacagagccaagatgcgttttatatggatgaagaggcgatgttggggatgtctagtttgttggataacatggccgaagggatgcttttaccgtcgccgtcggttcaatggaactataattttgatgtcgagggagatgatgacgtgtccttatggagctattaaaattcgatttttatttccatttttggtattatagctttttatacatttgatccttttttagaatggatcttcttctttttttggttgtgagaaacgaatgtaaatggtaaaagttgttgtcaaatgcaaatgtttttgagtgcag

SEQ ID NO: 1958 - protein, 207 aa, Arabidopsis thaliana
  G41  Paralogous to G912, G913
MFGSDYESPVSSGGDYSPKLATSCPKKPAGRKKFRETRHPIYRGVRQRNSGKWVCELREPNKKTRIWLGTFQTAEMAARAHDVAAIALRGRSACLNFADSAWRLRIPESTCAKEIQKAAAEAALNFQDEMCHMTTDAHGLDMEETLVEAIYTPEQSQDAFYMDEEAMLGMSSLLDNMAEGMLLPSPSVQWNYNFDVEGDDDVSLWSY

SEQ ID NO: 1959 - DNA, 908 bp, Arabidopsis thaliana
  G42  Predicted polypeptide sequence is paralogous to G912, G913
  misc_feature (851)..(851): n is a, c, g, or t
cctgaactagaacagaaagagagagaaactattatttcagcaaaccataccaacaaaaaagacagagatcttttagttaccttatccagtttcttgaaacagagtactcttctgatcaatgaactcattttctgctttttctgaaatgtttggctccgattacgagtcttcggtttcctcaggcggtgattatattccgacgcttgcgagcagctgccccaagaaaccggcgggtcgtaagaagtttcgtgagactcgtcacccaatatacagaggagttcgtcggagaaactccggtaagtgggtttgtgaggttagagaaccaaacaagaaaacaaggatttggctcggaacatttcaaaccgctgagatggcagctcgagctcacgacgttgccgctttagcccttcgtggccgatcagcctgtctcaatttcgctgactcggcttggagactccgaatcccggaatcaacttgcgctaaggacatccaaaaggcggcggctgaagctgcgttggcgtttcaggatgagatgtgtgatgcgacgacggatcatggcttcgacatggaggagacgttggtggaggctatttacacggcggaacagagcgaaaatgcgttttatatgcacgatgaggcgatgtttgagatgccgagtttgttggctaatatggcagaagggatgcttttgccgcttccgtccgtacagtggaatcataatcatgaagtcgacggcgatgatgacgacgtatcgttatggagttattaaaactcagattattatttccatttttagtacgatactttttattttattattatttttagatccttttttagaatggaatctncattatgtttgtaaaactgagaaacgagtgtaaattaaattgattcagtttcagtat

SEQ ID NO: 1960 - protein, 216 aa, Arabidopsis thaliana
  G42  Paralogous to G912, G913
MNSFSAFSEMFGSDYESSVSSGGDYIPTLASSCPKKPAGRKKFRETRHPIYRGVRRRNSGKWVCEVREPNKKTRIWLGTFQTAEMAARAHDVAALALRGRSACLNFADSAWRLRIPESTCAKDIQKAAAEAALAFQDEMCDATTDHGFDMEETLVEAIYTAEQSENAFYMHDEAMFEMPSLLANMAEGMLLPLPSVQWNHNHEVDGDDDDVSLWSY

SEQ ID NO: 1961 - DNA, 1454 bp, Arabidopsis thaliana
  G182  Predicted polypeptide sequence is paralogous to G196
cgtcgacgatcagattcttgcgtatagctgtatatatacaccaagatacactcatcatcgtcatatatagattatgtgcagcgtctctgagcttcttgacatggaaaacttccaaggagacttaaccgacgtcgtacgaggaatcggaggccacgtgttatcaccggagactcctccctcgaacatctggcctcttcctctgtcacatccaacaccatcaccgtcagatcttaacataaaccccttcggagatccctttgtgagcatggacgatccactcctccaagaactaaactccatcacaaactccggctatttctccaccgtaggagataacaacaacaacattcacaacaacaatggtttcttggttccaaaggtatttgaggaggatcatataaagagtcaatgtagtatcttcccaagaatccggatctcgcatagtaacatcatccacgattcttctccgtgtaattctccggccatgtcggctcacgttgtcgcagccgcagcagccgcctcgccgagaggcatcatcaacgtagacacaaacagtcctagaaactgtctattggttgatggtaccacgttctcctcgcagattcagatatcttcccctcggaatctaggccttaaaagaaggaagagtcaggcaaagaaggtggtgtgtattccggccccggctgcaatgaacagccgatcaagcggagaagtggttccatcggatctatgggcttggcgtaaatacggtcaaaaacctatcaaaggctctccttttccaaggggttattatagatgcagcagctcaaaaggttgttcagcaagaaagcaagtcgaaagaagccgaaccgatccaaacatgttggtgattacatatacctccgaacataaccatccttggcccatccaacgcaacgctctcgccggctccacacgctcctccacctcctcctcatctaaccctaatccttccaaaccctcaaccgcaaacgtaaactcctcatccattggctcccaaaacaccatctacttgccttcctccaccactcctcctcctaccctctcatcctccgccatcaaagatgaacgaggggacgatatggagttggaaaacgtagatgatgatgatgataaccagattgctccatacagaccggagcttcatgatcatcagcaccaaccagatgatttctttgcagatcttgaagagctagaaggagattctctaagcatgttgctttctcatggctgtggcggcgacgggaaggataaaacgaccgcgtccgatgggatcagcaatttcttcgggtggtcgggagataataattataataattacgacgaccaagactcaaggtcgttatagtatagtgttaattacaggtaaacaaattatattaaattaagttgagcttgtgaaaatgaagatcatatggtctggtcaggttgggggc

SEQ ID NO: 1962 - protein, 430 aa, Arabidopsis thaliana
  G182  Paralogous to G196
MCSVSELLDMENFQGDLTDVVRGIGGHVLSPETPPSNIWPLPLSHPTPSPSDLNINPFGDPFVSMDDPLLQELNSITNSGYFSTVGDNNNNIHNNNGFLVPKVFEEDHIKSQCSIFPRIRISHSNIIHDSSPCNSPAMSAHVVAAAAAASPRGIINVDTNSPRNCLLVDGTTFSSQIQISSPRNLGLKRRKSQAKKVVCIPAPAAMNSRSSGEVVPSDLWAWRKYGQKPIKGSPFPRGYYRCSSSKGCSARKQVERSRTDPNMLVITYTSEHNHPWPIQRNALAGSTRSSTSSSSNPNPSKPSTANVNSSSIGSQNTIYLPSSTTPPPTLSSSAIKDERGDDMELENVDDDDDNQIAPYRPELHDHQHQPDDFFADLEELEGDSLSMLLSHGCGGDGKDKTTASDGISNFFGWSGDNNYNNYDDQDSRSL

SEQ ID NO: 1963 - DNA, 825 bp, Arabidopsis thaliana
  G197  Predicted polypeptide sequence is paralogous to G664
atgggaaggtctccttgctgtgagaaagaccacacaaacaaaggagcttggactaaggaagaagacgataagctcatctcttacatcaaagctcacggtgaaggttgttggcgttctcttcctagatccgccggtcttcaacgttgcggaaaaagctgtcgtctccgatggattaactatctccgacctgatctcaagaggggtaacttcaccctcgaagaagatgatctcatcatcaaactacatagccttctcggtaacaagtggtctcttattgcgacgagattaccaggaagaacagataacgagattaagaattactggaacacacatgttaagaggaagctattaagaaaagggattgatccggcgactcatcgacctatcaacgagaccaaaacttctcaagattcgtctgattctagtaaaacagaggaccctcttgtcaagattctctcttttggtcctcagctggagaaaatagcaaatttcggggacgagagaattcaaaagagagttgagtactcagttgttgaagaaagatgtctggacttgaatcttgagcttaggatcagtccaccatggcaagacaagctccatgatgagaggaacctaaggtttgggagagtgaagtataggtgcagtgcgtgccgttttggattcgggaacggcaaggagtgtagctgtaataatgtgaaatgtcaaacagaggacagtagtagcagcagttattcttcaaccgacattagtagtagcattggttatgacttcttgggtctaaacaacactagggttttggattttagcactttggaaatgaaatga

SEQ ID NO: 1964 - protein, 274 aa, Arabidopsis thaliana
  G197  Paralogous to G664
MGRSPCCEKDHTNKGAWTKEEDDKLISYIKAHGEGCWRSLPRSAGLQRCGKSCRLRWINYLRPDLKRGNFTLEEDDLIIKLHSLLGNKWSLIATRLPGRTDNEIKNYWNTHVKRKLLRKGIDPATHRPINETKTSQDSSDSSKTEDPLVKILSFGPQLEKIANFGDERIQKRVEYSVVEERCLDLNLELRISPPWQDKLHDERNLRFGRVKYRCSACRFGFGNGKECSCNNVKCQTEDSSSSSYSSTDISSSIGYDFLGLNNTRVLDFSTLEMK

SEQ ID NO: 1965 - DNA, 687 bp, Arabidopsis thaliana
  G212  Predicted polypeptide sequence is paralogous to G676
atgagaataaggagaagagatgaaaaagagaatcaagaatacaagaaaggtttatggacagttgaagaagacaacatccttatggactatgttcttaatcatggcactggccaatggaaccgcatcgtcagaaaaactgggctaaagagatgtgggaaaagttgtagactgagatggatgaattatttgagccctaatgtgaacaaaggcaatttcactgaacaagaagaagacctcattattcgtctccacaagctcctcggcaatagatggtctttgatagctaaaagagtaccgggaagaacagataaccaagtcaagaactactggaacactcatctcagcaaaaaactcgtcggagattactcctccgccgtcaaaaccaccggagaagacgacgactctccaccgtcattgttcatcactgccgccacaccttcttcttgtcatcatcaacaagaaaatatctacgagaatatagccaagagctttaacggcgtcgtatcagcttcgtacgaggataaaccaaaacaagaactggctcaaaaagatgtcctaatggcaactactaatgatccaagtcactattatggcaataacgctttatgggttcatgacgacgattttgagcttagttcactcgtaatgatgaattttgcttctggtgatgttgagtactgcctttag

SEQ ID NO: 1966 - protein, 228 aa, Arabidopsis thaliana
  G212  Paralogous to G676
MRIRRRDEKENQEYKKGLWTVEEDNILMDYVLNHGTGQWNRIVRKTGLKRCGKSCRLRWMNYLSPNVNKGNFTEQEEDLIIRLHKLLGNRWSLIAKRVPGRTDNQVKNYWNTHLSKKLVGDYSSAVKTTGEDDDSPPSLFITAATPSSCHHQQENIYENIAKSFNGVVSASYEDKPKQELAQKDVLMATTNDPSHYYGNNALWVHDDDFELSSLVMMNFASGDVEYCL

SEQ ID NO: 1967 - DNA, 1104 bp, Arabidopsis thaliana
  G216  Predicted polypeptide sequence is paralogous to G2719
atgaacggagaaatctctcgtccgccggagctaatatcgtcccggaatccttgcaagagttttgaaaatgcaatacacaaagcagttgaggcagagctcgccgagctagcgaaaagcgacgcgaacggcggcggaaagagtaaagtgaaaggaccttggttgccggagcaagatgaggctctcacgaggcttgtgaaaatgtgtgggccgaggaactggaatctaatctcccgtggaatcccaggtcgctctggtaaatcttgccgattacgttggtgtaatcagctcgatcctatcctcaaacgaaaacctttctctgatgaggaggagcatatgataatgtctgcacaggcggttcttgggaacaaatggtctgtgattgctaaactcttacctgggagaacagataatgccattaagaatcattggaactctaatcttagacgtaaaccagcagaacaatggaagattcctctattgatgtctaatacagagatagtatatcaactgtatccatcaatggtcagaaggatatcaaacgcatcccccaaagaacatctacctcaagaagaagaaaccggtgtattaagtgatgataaaatggatgatgaagcaaaggagcctcctcgggagcaaaatagtaaaactggtgtttatcgtccagtggctcgaatgggtgctttcagtgtctgtaaaccaggatacatggctccatgtgagggacctttggttcaagcatcaagacctgactcattggctggtaaatttcttcagtctctttgttatgatcctattatcccttcaaaatgcggtcacggttgctgcaaccatcaagacagcacaacactgtcatcatcgtcggtgctgggatcagagtttgtggattatgaggaacattcttctgcagagttagataaagaattgatctctatatcaaatgacctgaacaatactgcttggattaggagtgggaaggaagctgaacagagtttgaaggctgatgatcagtttcgtcgtgagtatgctcactcgaaatttagtggaatggtaaacaatggtgtatcaagtcagatggtgagacaagatttaagggctttgagctaa

SEQ ID NO: 1968 - protein, 367 aa, Arabidopsis thaliana
  G216  Paralogous to G2719
MNGEISRPPELISSRNPCKSFENAIHKAVEAELAELAKSDANGGGKSKVKGPWLPEQDEALTRLVKMCGPRNWNLISRGIPGRSGKSCRLRWCNQLDPILKRKPFSDEEEHMIMSAQAVLGNKWSVIAKLLPGRTDNAIKNHWNSNLRRKPAEQWKIPLLMSNTEIVYQLYPSMVRRISNASPKEHLPQEEETGVLSDDKMDDEAKEPPREQNSKTGVYRPVARMGAFSVCKPGYMAPCEGPLVQASRPDSLAGKFLQSLCYDPIIPSKCGHGCCNHQDSTTLSSSSVLGSEFVDYEEHSSAELDKELISISNDLNNTAWIRSGKEAEQSLKADDQFRREYAHSKFSGMVNNGVSSQMVRQDLRALS

SEQ ID NO: 1969 - DNA, 1033 bp, Arabidopsis thaliana
  G221  Predicted polypeptide sequence is paralogous to G1322
ctctcttattctctcactcttttttttttatattcctctctctctaaatctataaaatatatttaaaaacttgatcgtatataataaagtaaataaagaataataacaaaaaaaatggagaaaagaggaggaggaagtagtggaggttcgggatcatcagcagaagcagaagtgagaaaaggaccatggacgatggaagaagatcttattcttatcaactatatcgccaaccacggcgatggtgtttggaattctctcgccaaatctgcaggtctaaaacgaaccgggaaaagttgccggctccggtggctgaactatctccgccccgacgtacgacggggaaacatcactccagaagagcaacttatcatcatggaacttcatgctaagtggggaaacaggtggtcgaaaatcgccaaacatcttccaggaagaacggacaacgagatcaaaaatttctgtaggacaagaattcaaaaatacatcaagcaatcggatgtaacaacaacatcgtccgttggatctcatcatagctcagagatcaacgatcaagctgcaagcacgtcgagccataatgtcttttgtacacaagatcaagcgatggagacttattctcctacaccgacatcatatcaacataccaatatggaattcaactatggtaactattcggccgcggcagtgacggcaaccgtggattatccagtaccgatgaccgttgatgatcaaaccggtgaaaactattggggcatggatgatatttggtcatcaatgcatttattgaatggtaattgattgatcggtggacaaaacatggaatattaattgagtattatatatgatttttaggagtactattattagtacgtgacatgtatatgtttttgcctcgttgtagaggtttggggttataattaatatataatgttatctaatatgcaaccttgatacatatttggatctttattgaacccatgttatacataaataaaattgttgaaggggtcataaaaaaaaaaaaaaaaaaaaaaaa

SEQ ID NO: 1970 - protein, 226 aa, Arabidopsis thaliana
  G221  Paralogous to G1322
MEKRGGGSSGGSGSSAEAEVRKGPWTMEEDLILINYIANHGDGVWNSLAKSAGLKRTGKSCRLRWLNYLRPDVRRGNITPEEQLIIMELHAKWGNRWSKIAKHLPGRTDNEIKNFCRTRIQKYIKQSDVTTTSSVGSHHSSEINDQAASTSSHNVFCTQDQAMETYSPTPTSYQHTNMEFNYGNYSAAAVTATVDYPVPMTVDDQTGENYWGMDDIWSSMHLLNGN

SEQ ID NO: 1971 - DNA, 584 bp, Arabidopsis thaliana
  G225  Predicted polypeptide sequence is paralogous to G226, G682
ctctctctctcactcttttcttttccgagaacccaacaaaaaaaaagctactattaatccttcccctcgtgaggaaatcatttcttcttgtttctcgagatttattctctttctctctctctttctctgtgtgtttcgtgtcttcagattagttcgatgtttcgttcagacaaggcggaaaaaatggataaacgacgacggagacagagcaaagccaaggcttcttgttccgaagaggtgagtagtatcgaatgggaagctgtgaagatgtcagaagaagaagaagatctcatttctcggatgtataaactcgttggcgacaggtgggagttgatcgccggaaggatcccgggacggacgccggaggagatagagagatattggcttatgaaacacggcgtcgtttttgccaacagacgaagagacttttttaggaaatgattttttttgtttggattaaaagaaaattttcctctccttaattcacaagacaagaaaaaaaggaaatgtacctgtccttgaattactattttggaatgtataattatctatatatataagaagaaaaaattgcttaggaattt

SEQ ID NO: 1972 - protein, 94 aa, Arabidopsis thaliana
  G225  Paralogous to G226, G682
MFRSDKAEKMDKRRRRQSKAKASCSEEVSSIEWEAVKMSEEEEDLISRMYKLVGDRWELIAGRIPGRTPEEIERYWLMKHGVVFANRRRDFFRK

SEQ ID NO: 1973 - DNA, 489 bp, Arabidopsis thaliana
  G228  Predicted polypeptide sequence is paralogous to G254
atggtgactgtaaaccctagccaagctcattgtttgcctatgaaaatgagtctaccgggtttcaatactcttccccacacggcaacaacgataccggtttccatacggagcaataggacgatgtcgttttttgaggatccaacaaagaaggttagaaagccttacactatcaccaaatctagagagaactggacggagcaagaacacgacaagttccttgaagcccttcatctatttgaccgggattggaagaaaataaaggcctttgttggatcaaaaacagtgatacagatacgaagccacgcacagaagtactttctcaaagttcagaagaatgggactaaagaacatctcccacctcctcgaccaaagaggaaagccaatcacccatatccacaaaaagctcctaaatgtggcaaccttaaaccttttatctttctacttccgcttttgttactttatctcattttctcatggttatgtttttga

SEQ ID NO: 1974 - protein, 162 aa, Arabidopsis thaliana
  G228  Paralogous to G254
MVTVNPSQAHCLPMKMSLPGFNTLPHTATTIPVSIRSNRTMSFFEDPTKKVRKPYTITKSRENWTEQEHDKFLEALHLFDRDWKKIKAFVGSKTVIQIRSHAQKYFLKVQKNGTKEHLPPPRPKRKANHPYPQKAPKCGNLKPFIFLLPLLLLYLIFSWLCF

SEQ ID NO: 1975 - DNA, 916 bp, Arabidopsis thaliana
  G231  Predicted polypeptide sequence is paralogous to G2007
ttccatatctcttccatttcgctctctatttcacatccccatataacataatatacaatcacacatatcatttctatatagtatttaatggggagacagccatgctgtgacaagctaggggtgaagaaagggccgtggacggtggaggaagataagaagcttataaacttcatactaaccaatggccattgttgctggcgtgctttgccgaagctggccggtctccgtcgctgtggaaagagctgccgcctccggtggactaactatctccggcctggcttaaaacgaggccttctctcgcatgatgaagaacaacttgtcatagatcttcatgctaatctcggcaataagtggtctaagatagcttcaagattacctggaagaacagataacgaaataaaaaaccattggaatactcatatcaagaagaaacttcttaagatgggaatcgatcctatgacccatcaacccctaaatcaagaaccttctaatatcgataattccaaaaccattccgtccaatccagacgatgtctcagtggaaccaaagacaactaacacgaaatacgtggagataagtgtcacgacaacagaagaagaaagtagtagcacggttactgatcaaaacagttcgatggataatgaaaatcatctaattgacaacatttatgatgatgatgaattgtttagttacttatggtccgacgaaactactaaagatgaggcctcttggagtgatagtaactttggtgttggtggaacattatatgaccacaatatctccggcgccgatgcagattttccgatatggtcaccggaaagaatcaatgacgagaagatgtttttggattattgtcaagactttggtgttcatgattttgggttttgactgttcaccattgacatattggcaacgc

SEQ ID NO: 1976 - protein, 266 aa, Arabidopsis thaliana
  G231  Paralogous to G2007
MGRQPCCDKLGVKKGPWTVEEDKKLINFILTNGHCCWRALPKLAGLRRCGKSCRLRWTNYLRPGLKRGLLSHDEEQLVIDLHANLGNKWSKIASRLPGRTDNEIKNHWNTHIKKKLLKMGIDPMTHQPLNQEPSNIDNSKTIPSNPDDVSVEPKTTNTKYVEISVTTTEEESSSTVTDQNSSMDNENHLIDNIYDDDELFSYLWSDETTKDEASWSDSNFGVGGTLYDHNISGADADFPIWSPERINDEKMFLDYCQDFGVHDFGF

SEQ ID NO: 1977 - DNA, 1046 bp, Arabidopsis thaliana; identical to SEQ ID NO: 39
  G233  Predicted polypeptide sequence is paralogous to G241

SEQ ID NO: 1978 - protein, 273 aa, Arabidopsis thaliana; identical to SEQ ID NO: 40
  G233  Paralogous to G241

SEQ ID NO: 1979 - DNA, 660 bp, Arabidopsis thaliana
  G247  Predicted polypeptide sequence is paralogous to G676
atgagaatgacaagagatggaaaagaacatgaatacaagaaaggtttatggacagtggaagaagacaagatcctcatggattatgtccgaactcatggccagggccactggaaccgcatcgccaagaaaactgggctcaagagatgtgggaaaagctgtaggttgagatggatgaactacttaagccctaatgttaacagaggcaattttactgaccaagaagaagatctcatcatcagactccacaagctcctcggcaacagatggtcgttgatagcgaaaagagttccgggaagaacagacaaccaagtaaagaattactggaacacacatctcagcaagaaacttggtctcggagatcattcaactgccgtcaaagccgcatgcggtgtagagtctccaccgtctatggcccttataaccacaacgtcctcctctcatcaagagatctccggtggaaaaaattcaactctaaggttcgacactttagttgacgaatccaaactcaaaccaaaatccaaactagtccacgcaacaccaactgacgtagaagttgcagctacggttccaaatctgttcgataccttttgggttcttgaagacgacttcgagcttagttcactcactatgatggattttactaatgggtattgcctttga

SEQ ID NO: 1980 - protein, 219 aa, Arabidopsis thaliana
  G247  Paralogous to G676
MRMTRDGKEHEYKKGLWTVEEDKILMDYVRTHGQGHWNRIAKKTGLKRCGKSCRLRWMNYLSPNVNRGNFTDQEEDLIIRLHKLLGNRWSLIAKRVPGRTDNQVKNYWNTHLSKKLGLGDHSTAVKAACGVESPPSMALITTTSSSHQEISGGKNSTLRFDTLVDESKLKPKSKLVHATPTDVEVAATVPNLFDTFWVLEDDFELSSLTMMDFTNGYCL

SEQ ID NO: 1981 - DNA, 731 bp, Arabidopsis thaliana
  G249  Predicted polypeptide sequence is paralogous to G1322
ccgccgacatggagaaaagagaaagtagtggtgggtctggatcaggagatgcagaggtgagaaaagggccatggacgatggaagaagatttgattctcatcaattatatcgccaatcatggtgaaggtgtttggaactctctcgccaaatctgcaggactaaaacgcaccgggaaaagttgccggctccggtggctgaactacctccgacctgatgcgcgacggggaaatatcacaccagaagaacagctcaccatcatggaacttcatgcaaaatggggaaataggtggtcaaaaattgcaaagcatttaccaggaagaaccgacaatgagataaagaatttttggaggactaagatccagaaatacatcatcaagagcggagaaacgacgaccgttggatcacaaagctccgagtttataaaccatcatgcgacaacgagccatgtcatgaatgatactcaagaaaccatggatatgtattctccaacgacgtcgtatcaacatgccagcaatattaatcagcagcttaattatggtaattatgtgcctgaatccggttcgatcatgatgccattatctgttgatcagtccgaacaaaactattggagcgtcgatgatctttggcccatgaatatatataatggtaattaataaataagttcgttaaaacttatatatatttacggtccaaagagggttctatataaacagagtactgtatgggattgc

SEQ ID NO: 1982 - protein, 214 aa, Arabidopsis thaliana
  G249  Paralogous to G1322
MEKRESSGGSGSGDAEVRKGPWTMEEDLILINYIANHGEGVWNSLAKSAGLKRTGKSCRLRWLNYLRPDARRGNITPEEQLTIMELHAKWGNRWSKIAKHLPGRTDNEIKNFWRTKIQKYIIKSGETTTVGSQSSEFINHHATTSHVMNDTQETMDMYSPTTSYQHASNINQQLNYGNYVPESGSIMMPLSVDQSEQNYWSVDDLWPMNIYNGN

SEQ ID NO: 1983 - DNA, 918 bp, Arabidopsis thaliana
  G255  Predicted polypeptide sequence is paralogous to G664
agcatcatcatcatcagaagaagagagtcatgggaagatctccttgctgcgagaaagaacacatgaacaaaggtgcttggactaaagaagaagatgagagactagtctcttacatcaagtctcacggtgaaggttgttggcgatctcttcctagagccgctggtctccttcgctgcggtaaaagctgccgtcttcggtggattaactatctccgacctgatctcaaaagaggaaactttacacatgatgaagatgaacttatcatcaagcttcatagcctcctaggcaacaagtggtctttgattgcggcgagattacctggaagaacagataacgagatcaagaactactggaacacacatataaagaggaagcttttgagcaaagggattgatccagccactcatagagggatcaacgaggcaaaaatttctgatttgaagaaaacaaaggaccaaattgtaaaagatgtttcttttgtgacaaagtttgaggaaacagacaagtctggggaccagaagcaaaataagtatattcgaaatgggttagtttgcaaagaagagagagttgttgttgaagaaaaaataggcccagatttgaatcttgagcttaggatcagtccaccatggcaaaaccagagagaaatatctacttgcactgcgtcccgtttttacatggaaaacgacatggagtgtagtagtgaaactgtgaaatgtcaaacagagaatagtagcagcattagctattcttctattgatattagtagtagtaacgttggttatgacttcttgggtttgaagacaagaattttggattttcgaagcttggaaatgaaataaatgaatagtattagattcttaatttgtaggtctgataatgaatgttagattcgcggccctctagacaggcctcgtaccg

SEQ ID NO: 1984 - protein, 269 aa, Arabidopsis thaliana
  G255  Paralogous to G664
MGRSPCCEKEHMNKGAWTKEEDERLVSYIKSHGEGCWRSLPRAAGLLRCGKSCRLRWINYLRPDLKRGNFTHDEDELIIKLHSLLGNKWSLIAARLPGRTDNEIKNYWNTHIKRKLLSKGIDPATHRGINEAKISDLKKTKDQIVKDVSFVTKFEETDKSGDQKQNKYIRNGLVCKEERVVVEEKIGPDLNLELRISPPWQNQREISTCTASRFYMENDMECSSETVKCQTENSSSISYSSIDISSSNVGYDFLGLKTRILDFRSLEMK

SEQ ID NO: 1985 - DNA, 723 bp, Arabidopsis thaliana
  G342  Predicted polypeptide sequence is paralogous to G343
atggacgtctacggcatgtcttcaccggacttgcttcgtatcgacgaccttctcgatttctccaacgacgaaatcttctcttcctcttccaccgtcacttcctccgccgcttcctccgccgcttcttccgaaaaccctttcagctttccttcttccacctacacttctcctactctcctcaccgacttcactcacgatctctgcgttcccagtgacgacgcagctcatctcgaatggttatcgcgattcgttgacgattcattctccgatttcccagcaaatcctttaaccatgaccgttagacccgagatttcattcaccggaaaacctagaagtcgccgatcaagagcaccagcaccttccgtagctggaacttgggctccgatgtctgaatcagagctttgtcactccgtcgctaaacctaaaccgaagaaagtctacaacgctgaatcggttacggcggatggagcgaggcggtgcacgcactgtgcctcggagaaaacgccacagtggagaactggaccgcttggacctaaaacactttgtaacgcttgtggagttcgttacaaatcagggaggcttgtaccggaatacagaccggcgtcgagtccgacgtttgtattgactcagcattcgaactctcatcggaaagttatggagctccggcgacagaaggaacaacaagaatcttgcgttcgaattccgccgtttcagccgcagtaa

SEQ ID NO: 1986 - protein, 240 aa, Arabidopsis thaliana
  G342  Paralogous to G343
MDVYGMSSPDLLRIDDLLDFSNDEIFSSSSTVTSSAASSAASSENPFSFPSSTYTSPTLLTDFTHDLCVPSDDAAHLEWLSRFVDDSFSDFPANPLTMTVRPEISFTGKPRSRRSRAPAPSVAGTWAPMSESELCHSVAKPKPKKVYNAESVTADGARRCTHCASEKTPQWRTGPLGPKTLCNACGVRYKSGRLVPEYRPASSPTFVLTQHSNSHRKVMELRRQKEQQESCVRIPPFQPQ

SEQ ID NO: 1987 - DNA, 1099 bp, Arabidopsis thaliana
  G350  Predicted polypeptide sequence is paralogous to G545
acagttgtacaaaaaagcaggcgtggtaccggaccggtaattcccggggatatcgtcgtacccacgcgtccgctcgacacgcaacttccttcctcttcagactcctctgactttactatatataacacacacactttcatttcttgtttcttcaaatcaaatcttttcatttacaattatctttcttctcaatttagaacttagtagctagtcttcaagataatggcacttgaaactcttacttctccaagattatcttctccgatgccgactctgtttcaagattcagcactagggtttcatggaagcaaaggcaaacgatctaagcgatcaagatctgaattcgaccgtcagagtctcacggaggatgaatatatcgctttatgtctcatgcttcttgctcgcgacggagatagaaaccgtgaccttgacctgccttcttcttcgtcttcacctcctctgcttcctcctcttcctactccgatctacaagtgtagcgtctgtgacaaggcgttttcgtcttaccaggctcttggtggacacaaggcaagtcaccggaaaagcttttcgcttactcaatctgccggaggagatgagctgtcgacatcgtcggcgataaccacgtctggtatatccggtggcgggggaggaagtgtgaagtcgcacgtttgctctatctgtcataaatcgttcgccaccggtcaagctctcggcggccacaaacggtgccactacgaaggaaagaacggaggcggtgtgagtagtagcgtgtcgaattctgaagatgtggggtctacaagccacgtcagcagtggccaccgtgggtttgacctcaacataccgccgataccggaattctcgatggtcaacggagacgaagaggtgatgagtcctatgccggcgaagaaactccggtttgacttcccggagaaaccctaaacataaacctaggaaaaactttacagaattcattttataggaaattgttttactgtatatacaaatatcgattttgattgatgttcttcttcactgaaaaattatgattctttgttgtatacttgatgtttctgaaaaagatataactttttattaaaaa

SEQ ID NO: 1988 - protein, 238 aa, Arabidopsis thaliana
  G350  Paralogous to G545
MALETLTSPRLSSPMPTLFQDSALGFHGSKGKRSKRSRSEFDRQSLTEDEYIALCLMLLARDGDRNRDLDLPSSSSSPPLLPPLPTPIYKCSVCDKAFSSYQALGGHKASHRKSFSLTQSAGGDELSTSSAITTSGISGGGGGSVKSHVCSICHKSFATGQALGGHKRCHYEGKNGGGVSSSVSNSEDVGSTSHVSSGHRGFDLNIPPIPEFSMVNGDEEVMSPMPAKKLRFDFPEKP

SEQ ID NO: 1989 - DNA, 889 bp, Arabidopsis thaliana
  G351  Predicted polypeptide sequence is paralogous to G545
ttttgactgatagtgacctgttcgttgcaacaaattgataagcaatgcttttttataatgccaactttgtacaaaaaagcaggctttaaaggaaccaattcagtcgacctcacgcaacttcctctcttctcaagattcttctccatacttcaccttcttctatatatctctctgctctcaaattaggttttaaattttctatagcaatggcgcttgaagctcttaattcaccaagattggtcgaggatcccttaagattcaatggcgttgagcagtggaccaaatgtaagaaacgatccaaacgttcgagatctgatcttcatcataaccaccgtctcactgaggaagagtatctagctttctgtctcatgcttcttgctcgggatggcggcgatcttgactctgtgacggttgcggagaagccgagttataagtgtggcgtttgttacaagacgttttcgtcttaccaagctctcggcggtcataaagcgagccaccggagcttatacggtggtggagagaatgataaatcgacaccatccaccgccgtgaaatctcacgtttgttcggtttgcgggaaatctttcgccaccggtcaagctctcggcggccacaagcggtgccactacgatggtggcgtttcgaactcggaaggtgtggggtctactagccacgtcagcagtagtagccaccgtggatttgaccttaatattataccggtgcagggattttcgccggacgacgaagtgatgagtccgatggcgactaagaagcctcgcctgaagtaagtctttgttgaagacctggaagtttatcaaatgtaaatatcaaatttcaatttcaaggaacagttttgttgattctattaccaatacacaatacggcggcc

SEQ ID NO: 1990 - protein, 193 aa, Arabidopsis thaliana
  G351  Paralogous to G545
MALEALNSPRLVEDPLRFNGVEQWTKCKKRSKRSRSDLHHNHRLTEEEYLAFCLMLLARDGGDLDSVTVAEKPSYKCGVCYKTFSSYQALGGHKASHRSLYGGGENDKSTPSTAVKSHVCSVCGKSFATGQALGGHKRCHYDGGVSNSEGVGSTSHVSSSSHRGFDLNIIPVQGFSPDDEVMSPMATKKPRLK

SEQ ID NO: 1991 - DNA, 774 bp, Arabidopsis thaliana
  G370  Predicted polypeptide sequence is paralogous to G361, G362
atggacgaaaccaacggacgaagagaaactcacgatttcatgaacgtcaacgttgaatccttctctcagcttcctttcatccgccgtactcctcccaaagaaaaagccgccattattcgtctcttcggccaagagctcgtcggtgataactccgacaacttatccgcagaaccttctgatcatcaaaccactaccaagaacgatgagagctctgagaatatcaaggacaaagacaaagaaaaagataaggacaaagacaaagataacaacaacaacaggagattcgagtgtcactactgcttcagaaacttcccaacttctcaagccctaggtggacatcaaaacgctcacaaacgtgaacgtcaacacgccaaacgcggttccatgacatcataccttcatcatcatcagcctcatgaccctcaccacatctacggcttcctcaacaaccaccaccaccgtcactatccgtcttggacgacggaagctagatcatactacggcggagggggacatcaaacgccgtcgtactactcaaggaatactcttgctcctccttcttctaacccaccgacaatcaacggaagtcctttaggtttgtggcgtgtaccgccttccacgtcaacaaatactattcaaggcgtttactcatcttcaccagcttcagcgtttaggtcgcatgagcaagagactaataaggagcctaataactggccgtacagattgatgaaacccaatgtgcaagatcatgtgagtctcgatcttcatctctga

SEQ ID NO: 1992 - protein, 257 aa, Arabidopsis thaliana
  G370  Paralogous to G361, G362
MDETNGRRETHDFMNVNVESFSQLPFIRRTPPKEKAAIIRLFGQELVGDNSDNLSAEPSDHQTTTKNDESSENIKDKDKEKDKDKDKDNNNNRRFECHYCFRNFPTSQALGGHQNAHKRERQHAKRGSMTSYLHHHQPHDPHHIYGFLNNHHHRHYPSWTTEARSYYGGGGHQTPSYYSRNTLAPPSSNPPTINGSPLGLWRVPPSTSTNTIQGVYSSSPASAFRSHEQETNKEPNNWPYRLMKPNVQDHVSLDLHL

SEQ ID NO: 1993 - DNA, 2502 bp, Arabidopsis thaliana
  G392  Predicted polypeptide sequence is paralogous to G390, G391, G438
atgggaggaggaagcaataatagtcacaatatggacaacgggaagtacgtgaggtacactcctgaacaagtggaagctctggagagactctacaatgactgtcctaaaccgagctctatgcgccgccaacagctaatccgcgaatgtcctatcctctccaacatcgagcctaaacagataaaagtctggttccagaaccgcaggtgtagagaaaaacagcgaaaagaggcgtcacgacttcaagctgtgaataggaagctaacggcaatgaacaagcttttgatggaagagaatgaccgcttgcaaaagcaagtgtctcacttggtttatgagaacagctattttcgccaacatcctcaaaaccaggggaatttggctaccacagatactagctgtgagtcagtggtgacgagtggtcaacaccacttgacccctcaacatcagcctcgtgatgctagtcctgctggattattgtccattgcggatgaaactttaacagagttcatttccaaggcgactggaaccgctgtcgagtgggtccaaatgcctgggatgaagcctggtccggattccataggaatcgttgctatttctcatggatgcacgggaatcgctgctcgtgcttgcggccttgtgggtcttgatcccacaagggtcgcggagatcctaaaggataagccttgttggttgcgtgattgcagatctctggatatagttaacgtactatccactgcaaatggtggaacccttgaactaatctacatgcagctttatgcgccgacaacactggcaccagctcgtgacttctggatgctacgttacacatctgtaatggaagacgggagccttgtgatatgcgaacgatcactgaacaatacacaaaacgggccaagtatgcctccgtctcctcatttcgttagggcagagattttaccaagtggttacctcattagaccttgcgaaggaggtggatccattcttcacattgtcgatcatttcgatcttgagccatggagtgtgccagaagttcttcgttctctctatgagtcctccactttactcgcccaaagaactacaatggccgctctgcgctatttgaggcaaatatctcaagagatttcacaacctaacgtaacaggttggggaagaagaccagcggctcttagagcacttagccaaaggcttagcaaaggattcaacgaagcagtgaatgggttcagcgatgaaggatggtccatcctagagagtgatggtatcgatgatgtcactcttcttgtgaactcctctcccacaaagatgatgatgacttcaagtctcccatttgccaatggctacacttctatgcctagcgcggtcttatgtgccaaagcttccatgttattacaaaatgttccaccttcgattctgctgcggttcttgagggaacatagacaagaatgggcagacaatagcatcgatgcatattcggccgcagccatcaaagcaggcccttgtagcttaccaatccctcgcccagggagctttggtggtcaagtcattcttcctctagctcacactatagagaatgaagagtttatggaagtcattaagcttgagagcttggggcactaccaagaagacatgatgatgcctgctgatatcttccttctgcaaatgtgcagtggggtggatgagaacgcagttgaatcatgcgcagagcttatatttgcaccaatcgacgcatctttctctgatgatgcaccaatcattccttccggtttccgcatcattcctctagattccaaatcagaggggttgagtcctaaccgaacgctagacctagcgtcggctctagacgtagggagcagaacagccggagattcatgtggaagcagaggaaactcaaagtccgttatgactatagcgtttcagctagcttttgagatgcatatgcaagagaatgtagcctcaatggctagacagtatgtaagaagtgtgatcgcgtcggttcaacgggtcgcacttgctctctctccttcttctcatcagctaagtggcttgcgtcctccacccgcgtcacccgaagctcacactctcgctcgctggatctctcactcttatagatgttaccttggcgttgatcttctcaaacctcatggaactgatcttctcaagtctctttggcaccatcctgacgctgtcatgtgttgctcactcaaggccttatctccggtattcacatttgcgaaccaagctggtttagacatgctggagacgacgttggtggcacttcaagatatcactctcgacaagatcttcgacaacaacaacgggaagaagactttatcctccgaattccctcagatcatgcaacaggggtttatgtgtatggatggaggaatatgcatgtcgagcatgggaagagcagtaacgtacgagaaggctgttgggtggaaagtgttgaacgacgacgaagatcctcattgtatctgcttcatgttcctcaactggtcttttatatga

SEQ ID NO: 1994 - protein, 833 aa, Arabidopsis thaliana
  G392  Paralogous to G390, G391, G438
MGGGSNNSHNMDNGKYVRYTPEQVEALERLYNDCPKPSSMRRQQLIRECPILSNIEPKQIKVWFQNRRCREKQRKEASRLQAVNRKLTAMNKLLMEENDRLQKQVSHLVYENSYFRQHPQNQGNLATTDTSCESVVTSGQHHLTPQHQPRDASPAGLLSIADETLTEFISKATGTAVEWVQMPGMKPGPDSIGIVAISHGCTGIAARACGLVGLDPTRVAEILKDKPCWLRDCRSLDIVNVLSTANGGTLELIYMQLYAPTTLAPARDFWMLRYTSVMEDGSLVICERSLNNTQNGPSMPPSPHFVRAEILPSGYLIRPCEGGGSILHIVDHFDLEPWSVPEVLRSLYESSTLLAQRTTMAALRYLRQISQEISQPNVTGWGRRPAALRALSQRLSKGFNEAVNGFSDEGWSILESDGIDDVTLLVNSSPTKMMMTSSLPFANGYTSMPSAVLCAKASMLLQNVPPSILLRFLREHRQEWADNSIDAYSAAAIKAGPCSLPIPRPGSFGGQVILPLAHTIENEEFMEVIKLESLGHYQEDMMMPADIFLLQMCSGVDENAVESCAELIFAPIDASFSDDAPIIPSGFRIIPLDSKSEGLSPNRTLDLASALDVGSRTAGDSCGSRGNSKSVMTIAFQLAFEMHMQENVASMARQYVRSVIASVQRVALALSPSSHQLSGLRPPPASPEAHTLARWISHSYRCYLGVDLLKPHGTDLLKSLWHHPDAVMCCSLKALSPVFTFANQAGLDMLETTLVALQDITLDKIFDNNNGKKTLSSEFPQIMQQGFMCMDGGICMSSMGRAVTYEKAVGWKVLNDDEDPHCICFMFLNWSFI

SEQ ID NO: 1995 - DNA, 1535 bp, Arabidopsis thaliana
  G425  Predicted polypeptide sequence is paralogous to G427
gaaaacagtcttctcttctccgatcccaaaaacgcaggaaaacaatgtcgtttaacagctcccacctccttcctccacaagaagaccttcctctccgacacttcaccgatcaatcacagcaacctccgccgcagcgtcacttctctgaaacaccttcgcttgtcaccgccagtttcctcaacctccctaccacccttaccactgcggattccgatctcgctcctccgcaccgcaacggagacaattccgttgctgatacaaacccacgctggctctcctttcattcggagatgcaaaatactggagaagtacgttctgaagttatcgacggagtcaacgccgatggtgaaacgatactcggcgttgtaggaggtgaagattggcggagtgctagctataaggcggcgattttaagacatccgatgtacgagcagcttcttgcggctcacgtggcttgccttagggttgcgactcccgttgaccagattccgaggatcgatgctcagctcagtcagttgcataccgtcgccgcgaaatactccactcttggtgtggttgttgacaacaaggaacttgatcatttcatgtcacattatgttgtcttgttatgttcatttaaagaacaactccaacaccacgtttgtgtccatgcaatggaagccattacggcttgttgggagattgaacaatcactgcaatccctaactggagtttctccaagtgaaagtaatggtaagacaatgtcggatgatgaagatgataatcaagtagagagcgaggtgaacatgtttgatggaagtttggacggttcagattgcttgatggggtttggtcctcttgttccaaccgagagagagagatctttgatggaacgtgtgaagaaagaactgaagcatgagcttaaacagggtttcaaagagaagattgtggacataagagaagagataatgaggaagagaagggcgggaaagttgccaggagatacgacttctgtactcaaagaatggtggcgaactcactcgaaatggccatacccaactgaggaagataaggcaaaactggttcaagaaaccggtttgcagttgaaacagatcaacaattggttcatcaaccagaggaaaagaaactggaacagcaactcttccacgtcatctactctcaccaagaacaaacgtaaacggaccgggaagtcgtaggtgacatagcggctaactagaggatggttctttgccatgtgaattcttgggaaccgtatatgaaagaaacgaatccggttctatgctcgtacagagtgtgttatttgtatagtggataccggttagcctatgaaaccggattctggagtccaaattgttgtttgtaacgacttagtagtttttggaagtgatctgtttcgttggtttgcgtcttgtaacgaacgcttaagcaagtgtgggttttttcttgtaaagtgtcaatatgttcgtttgtaatgaatgtatcaagcaatatttatcataattaaactagcttgaaatgtaaaaaaaaaaaaaaaa

SEQ ID NO: 1996 - protein, 383 aa, Arabidopsis thaliana
  G425  Paralogous to G427
MSFNSSHLLPPQEDLPLRHFTDQSQQPPPQRHFSETPSLVTASFLNLPTTLTTADSDLAPPHRNGDNSVADTNPRWLSFHSEMQNTGEVRSEVIDGVNADGETILGVVGGEDWRSASYKAAILRHPMYEQLLAAHVACLRVATPVDQIPRIDAQLSQLHTVAAKYSTLGVVVDNKELDHFMSHYVVLLCSFKEQLQHHVCVHAMEAITACWEIEQSLQSLTGVSPSESNGKTMSDDEDDNQVESEVNMFDGSLDGSDCLMGFGPLVPTERERSLMERVKKELKHELKQGFKEKIVDIREEIMRKRRAGKLPGDTTSVLKEWWRTHSKWPYPTEEDKAKLVQETGLQLKQINNWFINQRKRNWNSNSSTSSTLTKNKRKRTGKS

SEQ ID NO: 1997 - DNA, 1751 bp, Arabidopsis thaliana
  G426  Predicted polypeptide sequence is paralogous to G427
agagagagaactagtctgtgtcttttttttttttttttggtgataattgaaacatatgaaacaatcgtcgtcatagaagcagcagagattcaccttctttctttatctttccctctcagaaacaggaaacaaaattcaaaaagaacaaaaaaaaaaggtcaaaccaaaaacgatggcgtttcatcacaatcatctctctcaagacctctccttcaatcatttcaccgaccaacaccaacctccacctccgcaaccgcctcctcctcctccgcaacagcaacaacatttccaagaagcaccgcctcctaattggttaaacacagcgcttcttcgttcctcagataacaacaataacttcctcaacctccacacagccaccgctaacaccacaaccgcaagcagctccgattctccttcctccgccgccgccgccgccgctgctaaccagtggctatctcgctcctcctctttcctccaacgaaacaacaacaacaacgcttccatagtcggagatgggatcgatgatgtcaccggaggagcagacactatgattcagggagagatgaaaaccggcggtggagaaaacaaaaacgacggcggaggagctacggcggcggatggagtagtgagctggcagaatgcgagacacaaggcggagatcctttcgcatcctctttacgagcagcttttgtcggcgcacgttgcttgtttgagaatcgcgactccggttgatcagcttccgagaatcgatgctcagcttgctcagtctcaacacgtcgtcgctaaatactcagctttaggcgccgccgctcaaggtctcgtcggcgacgataaagaacttgaccagttcatgacacattatgtgttgctactgtgttcatttaaagagcaattgcaacaacatgtgcgtgttcatgcaatggaagctgtgatggcttgttgggagattgagcagtctcttcaaagcttaacaggagtgtctcctggagaagggatgggagcaacaatgtctgacgatgaagatgaacaagtagagagtgatgctaatatgttcgatgggggattagatgtgttgggttttggtcctttgattcctactgagagtgagaggtcgttgatggaaagagttagacaagaacttaaacatgaactcaaacagggttacaaggagaagatagtagacataagagaggagatattaaggaagagaagagctgggaagttaccaggagataccacctctgttctcaaagcttggtggcaatctcattccaaatggccttaccctactgaggaagataaggcgaggttggtgcaagagacaggtttgcagctaaaacagataaacaattggttcatcaatcagagaaagaggaactggcatagcaatccatcttcttccactgtattgaagaacaaacgcaaaagcaatgcaggtgacaatagcggaagagagcggttcgcgtagaaacaacaaacatatgatgtgaattggggaggtggaagatgggatttgaaagcagggttttagggatttaaagttgagaattttatggaggagtttgggttatacagagagaggggacagtattagaaagtaactttttgtgcaattacatagtaacgtagtttggttatgtgattatgcccatatattttattaagtagcacacaaaccaaaaagaaaatatgaaaactgaagatgcaggcttttgtttaatgttttttgtttgtttgtctgcaaaaaaaaa

SEQ ID NO: 1998 - protein, 431 aa, Arabidopsis thaliana
  G426  Paralogous to G427
MAFHHNHLSQDLSFNHFTDQHQPPPPQPPPPPPQQQQHFQEAPPPNWLNTALLRSSDNNNNFLNLHTATANTTTASSSDSPSSAAAAAAANQWLSRSSSFLQRNNNNNASIVGDGIDDVTGGADTMIQGEMKTGGGENKNDGGGATAADGVVSWQNARHKAEILSHPLYEQLLSAHVACLRIATPVDQLPRIDAQLAQSQHVVAKYSALGAAAQGLVGDDKELDQFMTHYVLLLCSFKEQLQQHVRVHAMEAVMACWEIEQSLQSLTGVSPGEGMGATMSDDEDEQVESDANMFDGGLDVLGFGPLIPTESERSLMERVRQELKHELKQGYKEKIVDIREEILRKRRAGKLPGDTTSVLKAWWQSHSKWPYPTEEDKARLVQETGLQLKQINNWFINQRKRNWHSNPSSSTVLKNKRKSNAGDNSGRERFA

SEQ ID NO: 1999 - DNA, 1507 bp, Arabidopsis thaliana
  G440  Predicted polypeptide sequence is paralogous to G1750
aaaaaatcactgtttcataacacgtttttctctctcacccaccaaaaaaaaatcttttgttcttgttaccaaaaaatctcgtgataaatctcttcaaactttgttttattttcttcttgattctctcgaaatctctctcaacaaacccagaaactttccttgattcgcaagcttttcttccttttatattcttcattttgatgcgaatatagagagagtccataaaagaaacagtaatggacgaatatattgatttccgaccattgaagtacacagagcacaagacttcaatgactaaatacaccaaaaagtcatcggaaaaactttccggtggtaagtcattgaaaaaggttagtatttgttatactgatcctgacgcaacagattcatcaagtgacgaagacgaagaagatttcttgtttcctcgccggagagtcaaaagattcgttaacgagatcactgttgagcctagctgtaacaacgtcgtcaccggagtttcgatgaaagatagaaagagactctcttcttcctccgatgaaactcaatctccggcgtcgagtcgtcaacgtcctaataacaaagtttcagtctccggtcagataaagaagttccgtggtgttagacaacggccatgggggaaatgggcggcggagattagagatccggagcaacgtcggaggatttggctcgggacttttgagacggcggaggaagctgccgtggtttatgataacgccgctataagactccgtggaccggacgctttaactaatttctccataccgcctcaagaagaggaagaagaagaagaaccggaaccggttattgaggagaaaccggttattatgacgacgccaacaccaacaacatcgagttctgaatcaactgaagaagatttacaacatctctcatctcctacttcggttctcaatcaccggtcagaagagattcaacaagtacaacaaccgtttaaatcagctaaacccgaaccgggggtttcaaatgcaccatggtggcataccgggtttaataccggtttaggtgaatcagacgattcatttcctttggatactccgtttcttgacaactatttcaatgaatcaccaccagagatgtcaatatttgaccaaccaatggatcaaattttctgtgaaaatgatgatatcttcaatgatatgttgttcttgggtggtgaaactatgaacattgaagatgagttaacaagttctagtatcaaagatatgggttcaacgtttagtgattttgatgattcattgatatcagatctattagttgcttaatatgatgatgagagtgaagaagaaaccatcaagcaaatatctatggtgtgactgaaaaattttggtgttacttttttttctttcataagttcatgagcttttttgtttcttttttttaataatttatttagttttgtcaggagcttgtaaaacagttttggagaaatagtggaaaaatagtttaattaaaaaaaaaaaaaaaaaaa

SEQ ID NO: 2000 - protein, 354 aa, Arabidopsis thaliana
  G440  Paralogous to G1750
MDEYIDFRPLKYTEHKTSMTKYTKKSSEKLSGGKSLKKVSICYTDPDATDSSSDEDEEDFLFPRRRVKRFVNEITVEPSCNNVVTGVSMKDRKRLSSSSDETQSPASSRQRPNNKVSVSGQIKKFRGVRQRPWGKWAAEIRDPEQRRRIWLGTFETAEEAAVVYDNAAIRLRGPDALTNFSIPPQEEEEEEEPEPVIEEKPVIMTTPTPTTSSSESTEEDLQHLSSPTSVLNHRSEEIQQVQQPFKSAKPEPGVSNAPWWHTGFNTGLGESDDSFPLDTPFLDNYFNESPPEMSIFDQPMDQIFCENDDIFNDMLFLGGETMNIEDELTSSSIKDMGSTFSDFDDSLISDLLVA

SEQ ID NO: 2001 - DNA, 971 bp, Arabidopsis thaliana
  G448  Predicted polypeptide sequence is paralogous to G450
tttccatcttcctcatcaccttcccaagaagaagaacaccaaagaagaagaaaggttaataatgatgggcagtgtcgagctgaatctgagggagactgagctgtgtcttggtcttcccggtggagatacagtggctccggtaaccggaaacaagagagggttctcagagacggttgatctgaagctaaatctgaataatgagcctgcaaacaaggaaggatctacgactcatgacgtcgtgacttttgattccaaggagaagagtgcttgtcctaaagatccagccaaacctccggccaaggcacaagttgtgggatggccaccggtgagatcataccggaagaacgtgatggtttcctgccaaaaatcaagcggtggcccggaggcggcggcgttcgtgaaggtatcaatggacggagcaccgtacttgaggaaaatcgatttgaggatgtataaaagctacgatgagctttctaatgctttgtccaacatgttcagctcttttaccatgggcaaacatggaggagaagaaggaatgatagacttcatgaatgagaggaaattgatggatttggtgaatagctgggactatgttccctcttatgaagacaaagacggtgattggatgctcgtcggcgacgttccttggccaatgttcgtcgatacatgcaagcgtttacgtctcatgaaaggatcggatgccattggtctcgctccgagggcgatggagaagtgcaagagcagagcttgaagtcaaattaaaaggataagtggtatcgattatatatttgattaacacattgattggtgttaattgctctttttttttcttacgatgaaatacattgttcagtttcttttgattgtctgtgttttgatctggatttggtatgtagatatagtttgtatgctattatgtgtaatgaacttaagttaaatatttgagacatttgtaatggaaaatgtgtaat

SEQ ID NO: 2002 - protein, 229 aa, Arabidopsis thaliana
  G448  Paralogous to G450
MMGSVELNLRETELCLGLPGGDTVAPVTGNKRGFSETVDLKLNLNNEPANKEGSTTHDVVTFDSKEKSACPKDPAKPPAKAQVVGWPPVRSYRKNVMVSCQKSSGGPEAAAFVKVSMDGAPYLRKIDLRMYKSYDELSNALSNMFSSFTMGKHGGEEGMIDFMNERKLMDLVNSWDYVPSYEDKDGDWMLVGDVPWPMFVDTCKRLRLMKGSDAIGLAPRAMEKCKSRA

SEQ ID NO: 2003 - DNA, 899 bp, Arabidopsis thaliana
  G455  Predicted polypeptide sequence is paralogous to G450
tttctaatctattacaagtaacatgatcggccaacttatgaacctcaaggccacggagctctgtctcggcctccccggcggcgctgaagcagttgagagtcctgccaaatcggcggtgggaagcaagagaggcttctccgaaaccgttgatctcatgctcaatcttcaatctaacaaagaaggctccgttgatctcaaaaacgtttctgctgttcccaaggagaagactacccttaaagatccttctaagcctcctgctaaagcacaagtggtgggatggccacctgtgaggaactacaggaagaacatgatgactcagcagaagaccagtagtggtgcggaggaggccagcagtgagaaggccgggaactttggtggaggagcagccggagccggcttggtgaaggtctccatggacggtgctccatatctgaggaaagttgacctcaagatgtacaaaagctaccaggatctttctgatgcattggccaaaatgttcagctcctttactatgggaaactatggagcacaaggaatgatagatttcatgaacgagagcaagctaatgaatctgctgaatagctctgagtatgtgccaagctacgaggacaaagatggtgactggatgctcgttggcgatgtcccatgggaaatgtttgtcgagtcttgcaaacgtttgcgcattatgaagggatctgaagcagttggacttgctccgagagcaatggagaagtactgcaagaacagatcttgaattaataataaaaaaaaagaagcatcaatgatcaacaatatgacgggttcttgattttatatgtatttttatgattgtatgtggctatcacctatatatgtgtgttgtaattttaaatacttgatgggtatatagggcagtattt

SEQ ID NO: 2004 - protein, 243 aa, Arabidopsis thaliana
  G455  Paralogous to G450
MIGQLMNLKATELCLGLPGGAEAVESPAKSAVGSKRGFSETVDLMLNLQSNKEGSVDLKNVSAVPKEKTTLKDPSKPPAKAQVVGWPPVRNYRKNMMTQQKTSSGAEEASSEKAGNFGGGAAGAGLVKVSMDGAPYLRKVDLKMYKSYQDLSDALAKMFSSFTMGNYGAQGMIDFMNESKLMNLLNSSEYVPSYEDKDGDWMLVGDVPWEMFVESCKRLRIMKGSEAVGLAPRAMEKYCKNRS

SEQ ID NO: 2005 - DNA, 1169 bp, Arabidopsis thaliana
  G456  Predicted polypeptide sequence is paralogous to G450
cacacatctcacatccccctatctctctctctcttcaaacgttttagttccccaaaaaaatatcaaaagaactaaaagaaaaaccctagaagccgaagaatctcctactcgttgtcgatcggatcacctaactaattactcgttgataatcattatatcgagaaatatgattaattttgaggccacggagctgagattagggctaccgggtgggaatcacggaggagaaatggctggaaaaaataatggtaaaagaggattttctgagactgttgatctcaaactgaatctttcatcgacggctatggattcagtttccaaagtcgatttagagaatatgaaggagaaggtcgtaaaaccaccagccaaggcacaagttgtgggatggccaccggtacgatctttccgcaagaacgtcatgtccggccaaaaaccgaccaccggagatgccaccgaaggaaacgataagacttctggcagcagtggagccacctcatccgcctccgcatgtgccaccgtggcttatgtgaaggttagcatggacggtgcaccgtacctacggaaaattgacttgaaactctacaaaacttaccaagatctctccaacgccttaagcaaaatgtttagctcttttaccataggcaactatggaccacaaggaatgaaagatttcatgaatgagagtaaattgatcgatcttctaaacggatcagattatgttccaacatatgaagataaagatggcgactggatgcttgtaggagacgtaccgtgggagatgtttgttgattcatgcaaacgtatacgaataatgaagggatcagaagcaatcggacttgctccaagggcattagaaaagtgcaagaacagaagttgagttctcgacgacatttcgtgttcttacctaaaaaaggaagaaagcctgtttcgatcggttggatatctcgaaccgagaaagctaaaccggctcgaaactattgttccgagcaaggagtttgcttataatattaattaataataatattaatattgtggtgtattacattttaaaaaattaaatcgtttttgttatatgtattatatacatatattaatatgtatatttaattaggttgcatctatttccgttaaaaccaacttttgtttttacgcaaaaaaaaagagttcac

SEQ ID NO: 2006 - protein, 236 aa, Arabidopsis thaliana
  G456  Paralogous to G450
MINFEATELRLGLPGGNHGGEMAGKNNGKRGFSETVDLKLNLSSTAMDSVSKVDLENMKEKVVKPPAKAQVVGWPPVRSFRKNVMSGQKPTTGDATEGNDKTSGSSGATSSASACATVAYVKVSMDGAPYLRKIDLKLYKTYQDLSNALSKMFSSFTIGNYGPQGMKDFMNESKLIDLLNGSDYVPTYEDKDGDWMLVGDVPWEMFVDSCKRIRIMKGSEAIGLAPRALEKCKNRS

SEQ ID NO: 2007 - DNA, 1262 bp, Arabidopsis thaliana
  G463  Predicted polypeptide sequence is paralogous to G464
ctcgagctacgtcaggggtctctttctgtttgtttgttttcttgtttccttctctctctctctttctttctttgtcttcctttcccaggttgtttttttttgctctctctgccttcttgactttcaaaagactctttctttcttttggattgattttggattctagggctctctttcttttagtgggtttttgttgttgttgttgtggtctctctgatgattactgaacttgagatggggaaaggtgagagtgagcttgagcttggtctagggctgagtcttggcggtggaacggcggccaagattggtaaatcaggtggtggtggcgcgtggggagagcgtggaaggcttttgacggctaaggattttccttctgttggttctaaacgtgctgctgattctgcttctcatgctggttcatctcctcctcgttcaagtcaagttgttggatggcctcctatagggtcacacaggatgaacagtttggttaataaccaagctacaaagtcagcaagagaagaagaagaagctggtaagaagaaagtgaaagatgatgaacctaaagatgtgacaaagaaagtgaatgggaaagtacaagttggatttattaaggtgaacatggatggagttgctataggaagaaaagtggatttgaatgctcattcttcttacgagaatttggcgcaaacattggaagatatgttctttcgcactaatccgggtactgtcgggttaaccagtcagttcactaaaccgttgaggcttttagatggatcgtctgagtttgtacttacttatgaagataaggaaggagattggatgcttgttggtgatgttccatggagaatgttcatcaactcggtgaaaaggctacgtgtgatgaaaacctctgaagctaatggactcgctgcacgaaatcaagaaccaaacgagagacagcgaaagcagccggtttagatctcttttcgacgttacggtgttacaggttttatattttggggttttgcaagtctgagatacttctgaagcaagcataagctagattgatcttatatccagtttgtgtattttcttggttcttataatggtttttactggttttctttagtttttttttttgctgtcttttaattttcggttgcgatttcactatatactatggatggaagagaatgctctttatatcttttactacactgtaaatatttgaagcttatctaatatcgtttttaagggttaaaaaaccctgacgtagcctcgag

SEQ ID NO: 2008 - protein, 246 aa, Arabidopsis thaliana
  G463  Paralogous to G464
MITELEMGKGESELELGLGLSLGGGTAAKIGKSGGGGAWGERGRLLTAKDFPSVGSKRAADSASHAGSSPPRSSQVVGWPPIGSHRMNSLVNNQATKSAREEEEAGKKKVKDDEPKDVTKKVNGKVQVGFIKVNMDGVAIGRKVDLNAHSSYENLAQTLEDMFFRTNPGTVGLTSQFTKPLRLLDGSSEFVLTYEDKEGDWMLVGDVPWRMFINSVKRLRVMKTSEANGLAARNQEPNERQRKQPV

SEQ ID NO: 2009 - DNA, 486 bp, Arabidopsis thaliana
  G485  Predicted polypeptide sequence is paralogous to G481, G482
atggcggattcggacaacgattcaggaggacacaaagacggtggaaatgcttcgacacgtgagcaagataggtttctaccgatcgctaacgttagcaggatcatgaagaaagcacttcctgcgaacgcaaaaatctctaaggatgctaaagaaacggttcaagagtgtgtatcggaattcataagtttcatcaccggtgaggcttctgacaagtgtcagagagagaagaggaagacaatcaacggtgacgatcttctttgggcgatgactacgctagggtttgaggactacgtggagcctctcaaggtttatctgcaaaagtatagggaggtggaaggagagaagactactacggcagggagacaaggcgataaggaaggtggaggaggaggcggtggagctggaagtggaagtggaggagctccgatgtacggtggtggcatggtgactacgatgggacatcaattttcccatcatttttcttaa

SEQ ID NO: 2010 - protein, 161 aa, Arabidopsis thaliana
  G485  Paralogous to G481, G482
MADSDNDSGGHKDGGNASTREQDRFLPIANVSRIMKKALPANAKISKDAKETVQECVSEFISFITGEASDKCQREKRKTINGDDLLWAMTTLGFEDYVEPLKVYLQKYREVEGEKTTTAGRQGDKEGGGGGGGAGSGSGGAPMYGGGMVTTMGHQFSHHFS

SEQ ID NO: 2011 - DNA, 1346 bp, Arabidopsis thaliana
  G501  Predicted polypeptide sequence is paralogous to G519
cttacgggtccctatccttcgcaagacccttcctctatataaggaagttcttttcatttggagaggtcacgctgacaagctgactctagcagatctggtaccgtcgacccacgcgtccgaaaaaatccagatccagctgaaattgaattttcaaccaacgaagaagagatttttccaagagcaacagacaagaagaagagaatgaagtcggagctaaatttaccagctgggttccgattccatccaacggacgaggagcttgtgaaattctacttgtgccggaaatgtgcttccgagcagatctcggctccggttatcgccgagattgatctctacaagttcaatccttgggagcttccagagatgtctctgtacggagagaaagagtggtacttcttctcacctagagatcggaaatacccaaacggttcgcgtcctaaccgggcagcaggaaccggttattggaaagctaccggagcagataaaccgattggtaaaccgaagacgttgggtatcaagaaagcactcgtcttctacgcagggaaagctccaaaagggattaagaccaattggataatgcatgagtatcgtctcgctaatgttgatagatcagcttctgttaacaaaaagaacaacctacgacttgatgattgggttttatgtcgaatatacaacaagaaaggaaccatggagaagtatttccccgcggatgagaagccgaggaccacgacaatggctgaacagtcatcatcaccttttgatacatcagactcgacttacccgacattgcaagaggatgattccagcagctcaggtggtcacggtcacgtggtgtcaccggatgttttggaggttcagagcgagcctaaatggggagagcttgaggatgctttggaagcttttgatacttcaatgtttggtagttccatggagttgttgcagcctgacgcttttgtccctcagttcttgtatcagtctgattatttcacttccttccaggatccgcctgagcagaaaccattcttgaattggagttttgctccacaggggtaaaaacggaagagaccaaaaaaggtgtttgctagtagtactgtgatgtgccagagagaagagtctcatctcaactcatccctggctcttagtagtaaaagaagattgtagaatgttaatagcttttagcatcaatgtctcattagcaggcacattcttgttctttcatgagaagtttatatgaaaactaaaaatttatattcaaattcttcaagatgttgcacttatgtagatactgatattaaataacaacctaacctttatgagaaaaaaaaaaaaaaaaaaaaaaaaaaaaa

SEQ ID NO: 2012 - protein, 283 aa, Arabidopsis thaliana
  G501  Paralogous to G519
MKSELNLPAGFRFHPTDEELVKFYLCRKCASEQISAPVIAEIDLYKFNPWELPEMSLYGEKEWYFFSPRDRKYPNGSRPNRAAGTGYWKATGADKPIGKPKTLGIKKALVFYAGKAPKGIKTNWIMHEYRLANVDRSASVNKKNNLRLDDWVLCRIYNKKGTMEKYFPADEKPRTTTMAEQSSSPFDTSDSTYPTLQEDDSSSSGGHGHVVSPDVLEVQSEPKWGELEDALEAFDTSMFGSSMELLQPDAFVPQFLYQSDYFTSFQDPPEQKPFLNWSFAPQG

SEQ ID NO: 2013 - DNA, 1409 bp, Arabidopsis thaliana
  G502  Predicted polypeptide sequence is paralogous to G519
ttgatgccgctcaatcccactatccttcgcaaggacccttcctctatataaggaagttcatttcatttggagaggacacgctgacaagctgactctagcagatctgggaccgtcgacccacgcgtccgaattgattaggataggatcaggatcatcctcaacaacctcctcctaattcctcctccattcatagtaacaataatattaagaaagagggtaaactatgtcagaattattacagttgcctccaggtttccgatttcaccctaccgatgaagagcttgtcatgcactatctctgccgcaaatgtgcctctcagtccatcgccgttccgatcatcgctgagatcgatctctacaaatacgatccatgggagcttcctggtttagccttgtatggtgagaaggaatggtacttcttctctcccagggacagaaaatatcccaacggttcgcgtcctaaccggtccgctggttctggttactggaaagctaccggagctgataaaccgatcggactacctaaaccggtcggaattaagaaagctcttgttttctacgccggcaaagctccaaagggagagaaaaccaattggatcatgcacgagtaccgtctcgccgacgttgaccggtccgttcgcaagaagaagaatagtctcaggctggatgattgggttctctgccggatttacaacaaaaaaggagctaccgagaggcggggaccaccgcctccggttgtttacggcgacgaaatcatggaggagaagccgaaggtgacggagatggttatgcctccgccgccgcaacagacaagtgagttcgcgtatttcgacacgtcggattcggtgccgaagctgcatactacggattcgagttgctcggagcaggtggtgtcgccggagttcacgagcgaggttcagagcgagcccaagtggaaagattggtcggccgtaagtaatgacaataacaatacccttgattttgggtttaattacattgatgccaccgtggataacgcgtttggaggaggagggagtagtaatcagatgtttccgctacaggatatgttcatgtacatgcagaagccttactagaagggaattcctttcctgccgccgaaacgcaacgcaaaacgaccctcgtttttgcgtttatggcaacacgagaccgttttatatggtcaatgagtgtgccgattcggccattagatttctgttcagtcttcgtttattctatagaccgtccgatttcagatcatccctaatcggacggtggtcgttggatgtatcagtagtgtattactgtgttaggtagaagaaaatccacttgttcttaaattggcataaaagtcagaagctaatatttatatgtgccgcaatcaatttaatattttctgtctaaaaaaaaaaa

SEQ ID NO: 2014 - protein, 289 aa, Arabidopsis thaliana
  G502  Paralogous to G519
MSELLQLPPGFRFHPTDEELVMHYLCRKCASQSIAVPIIAEIDLYKYDPWELPGLALYGEKEWYFFSPRDRKYPNGSRPNRSAGSGYWKATGADKPIGLPKPVGIKKALVFYAGKAPKGEKTNWIMHEYRLADVDRSVRKKKNSLRLDDWVLCRIYNKKGATERRGPPPPVVYGDEIMEEKPKVTEMVMPPPPQQTSEFAYFDTSDSVPKLHTTDSSCSEQVVSPEFTSEVQSEPKWKDWSAVSNDNNNTLDFGFNYIDATVDNAFGGGGSSNQMFPLQDMFMYMQKPY

SEQ ID NO: 2015 - DNA, 1285 bp, Arabidopsis thaliana
  G512  Predicted polypeptide sequence is paralogous to G1452
aaagctccctgagcaagtgagaagagaccacactgagaagaaaaatccttcaggttatcgaaaattcccggattttactctttgggcggtggccgatttcttacgcgctctttttgtggcgactgttgtatacgcgcgagccttcatggacacgaaggcggttggagtttctaaggatacggcggcgtcgatggaagcgtcgacggtgtttcctgggtttaaattctcgccgacggatgtggagttgatttcgtattacctgaagcggaagatggatggcttggagaggtccgttgaggttataccggaccttgagatttacaatttcgagccttgggatttacccgataagtcgattgtgaaatctgatagcgagtggttcttcttctgtgcgcgtgggaaaaagtatccacatggttcacagaacaggagagcaacgaagatgggatactggaaagcaactgggaaagagcgtgatgtgaagtctggttctgaggtcattggaacaaagaggacgcttgttttccatattggtcgtgcaccaaaaggcgaaagaactgactggattatgcacgagtactgcgtgaaaggagtatctctggatgatgctatggttgtttgccgggttaggaggaacaaagaatacaatagtggtacaagtcagaaggcaccaaagccaaattcatcagccgagaagcatgcgaaagtccaaaatggcgctacgagttcagggagcccgtctgattgggacaacttggttgatttttacctagcaggtgaatcaggggagaaactactcgctgagatggcagagtcatcagaaaatctacaggtggataatgacgaggatttctttgcggatatcctaagagacgaaatcatcaatctcgatgaagcggtgatgacagggaacacaccaaacgaagtgccaacactagaatcagcatcaatggagataagggtacttcctttaccaaacatgatagacaaacaaatgtcatcactgttagaggaaagaccatcacagaagaagaaaggaaaagacgccacggaatcattgtcgagctgcttcgtgggtttatactcgatcaaatcagtgaacaaggcacgatgggatgttattataggtgtagtggctctgatagcaatgttgttttatctagaataagaggcttatggaagtagcgaaaaacagtgtcctagctatgtttgtatcatcttttctcggacattgacaaggattatatgatgtttttgtgtaaaaaaaaaaaaaaaaaaaaaaaaa

SEQ ID NO: 2016 - protein, 340 aa, Arabidopsis thaliana
  G512  Paralogous to G1452
MDTKAVGVSKDTAASMEASTVFPGFKFSPTDVELISYYLKRKMDGLERSVEVIPDLEIYNFEPWDLPDKSIVKSDSEWFFFCARGKKYPHGSQNRRATKMGYWKATGKERDVKSGSEVIGTKRTLVFHIGRAPKGERTDWIMHEYCVKGVSLDDAMVVCRVRRNKEYNSGTSQKAPKPNSSAEKHAKVQNGATSSGSPSDWDNLVDFYLAGESGEKLLAEMAESSENLQVDNDEDFFADILRDEIINLDEAVMTGNTPNEVPTLESASMEIRVLPLPNMIDKQMSSLLEERPSQKKKGKDATESLSSCFVGLYSIKSVNKARWDVIIGVVALIAMLFYLE

SEQ ID NO: 2017 - DNA, 1339 bp, Arabidopsis thaliana
  G515  Predicted polypeptide sequence is paralogous to G2053
gtcgacaagaagggccgcataaatacaaaaccctatacgtctttcttctccatcattttaagttgcagaagaacatcaaccatggcgaaagctctccaatgcatatttttttgatcttttccttttcccttcttttttgatcgctgcagagaaatggaaactcctgtgggtttaagattctgtccgaccgacgaggagatcgtcgtcgattacctttggccgaaaaattccgatagagacacgagccatgtcgatcgattcattaacacagtccctgtctgtagactcgatccttgggagttaccttgccagtcaaggatcaaactgaaagatgtggcttggtgtttcttcagacctaaggagaacaaatatggcagaggtgatcagcagatgagaaaaacgaaatctgggttttggaagagtactggcagaccaaagcctatcatgcgtaatcgccaacagatcggtgagaaaaagattttgatgttttacacgagtaaggaatccaaatccgattgggttatacacgagtaccacggtttctctcataaccagatgatgatgacatacacactctgtaaagttatgtttaatggtggcatgagagagaagtcttcctcttctccttcttcttctggtgttagtggaattgagcagagtcgtcgtgactctttaatccctcagcttgtcaacaattctgagggatcctcacttcacagagaagatccaagtcagtttggtgatgtgctgcaagaagctccaatcgaggatgctaaactgaccgaggaattggtaaaatggctgatgaatgatgaggatgatgctcaaatcgaggatgctataccgattgaggaatgggaaacatggttgaatgatattgatgatgctaaggagaagagtatcatgtttatgcatgataatcgaagtgattacagacctccaaactcattaactggtgtcttcagtgatgatgttagcagtgatgataatgattctgatttgctaactccaaaaacaaactctattcaaacttcgagcacttgtgatagttttggtagctcaaatcatcgcatagaccagatcaaagacctgcaagaatctcctacctcaacaatcaacttagtgtcactaactcaagaggtgagcgcggccgctaataaccagtattgataccgccgagaagaagaagaatccttatgatgatgcacaagggactgagattggtgagcataaattgggtcaagagacgatcaagaagaaaagagctggtttctttcacaggatgatacaaaaattcgtcaagaaaattcacctatgttcttccatctcaagaacttga

SEQ ID NO: 2018 - protein, 338 aa, Arabidopsis thaliana
  G515  Paralogous to G2053
METPVGLRFCPTDEEIVVDYLWPKNSDRDTSHVDRFINTVPVCRLDPWELPCQSRIKLKDVAWCFFRPKENKYGRGDQQMRKTKSGFWKSTGRPKPIMRNRQQIGEKKILMFYTSKESKSDWVIHEYHGFSHNQMMMTYTLCKVMFNGGMREKSSSSPSSSGVSGIEQSRRDSLIPQLVNNSEGSSLHREDPSQFGDVLQEAPIEDAKLTEELVKWLMNDEDDAQIEDAIPIEEWETWLNDIDDAKEKSIMFMHDNRSDYRPPNSLTGVFSDDVSSDDNDSDLLTPKTNSIQTSSTCDSFGSSNHRIDQIKDLQESPTSTINLVSLTQEVSAAANNQY

SEQ ID NO: 2019 - DNA, 762 bp, Arabidopsis thaliana
  G516  Predicted polypeptide sequence is paralogous to G2053
atgtcgatgaagtcattagcacagttgatatttgtagcttcgacccttgggacttaccttgtaagtctttctaacgcgagtgtttgtttttctttggttcccaactgttgtatcatcccggtaatttctgatcatgttctgtctttcccagcccattctaggatgaaaacaagagatcaggtttggtatttcttcggccgtaaggagaacaaatatggtaaaggtgatcgacagataagaaaaaccaagtctggtttttggaagaaaactggcgttaccatggatataatgcgcaaaacgggagatcgtgagaagatcgttaagtttaagggtgaaaggagagaattttcagttgctactggtagtggaattaagcatactcactctttaatccctcctaccaacaattctggagttttgagtgtagagacagagggatcgttgtttcacagccaagaatcacagaatccaagtcagttttctggctttcttgatgtggatgcactagatagggacttctgcaatattttgagtgatgatttcaaaggcttctttaatgatgacgatgagcagagtaagattgtttctatgcaagatgatcgcaacaaccacacacctcaaaagccattgaccggtgtcttcagtgatcatagcaccgatggtagtgattctgatccgatttctgcaacaactgtaagcaaaattttcctattttacctttactatctcctctgttttcagttttttctcacaaagctatag

SEQ ID NO: 2020 - protein, 253 aa, Arabidopsis thaliana
  G516  Paralogous to G2053
MSMKSLAQLIFVASTLGTYLVSLSNASVCFSLVPNCCIIPVISDHVLSFPAHSRMKTRDQVWYFFGRKENKYGKGDRQIRKTKSGFWKKTGVTMDIMRKTGDREKIVKFKGERREFSVATGSGIKHTHSLIPPTNNSGVLSVETEGSLFHSQESQNPSQFSGFLDVDALDRDFCNILSDDFKGFFNDDDEQSKIVSMQDDRNNHTPQKPLTGVFSDHSTDGSDSDPISATTVSKIFLFYLYYLLCFQFFLTKL

SEQ ID NO: 2021 - DNA, 1080 bp, Arabidopsis thaliana
  G517  Predicted polypeptide sequence is paralogous to G2053
atgatgaatccggtgggtttcagattccgtccaaacgacgaggagatcgtcgaccattacctccggccaaaaaatctcgatagtgacactagccatgtcgatgaagtcattagcacagtcgatatctgtagcttcgagccttgggatttaccttccaagtcgatgatcaaatcgagagatggggtttggtatttctttagtgttaaggagatgaagtataacagaggtgatcaacagagaagaagaacaaactctgggttttggaagaaaactggaaaaacaatgactgtcatgcgcaaaagaggaaatcgtgagaagatcggtgagaaaagggttttggtttttaagaatcgagatggttcaaagaccgactgggttatgcacgagtatcacgctacgtccttgtttcctaatcagatgatgacgtatacagtctgcaaagttgagtttaagggtgaagagacagagatctcttcttcttctactggtagtgaaattgaacagattcactctttaatccctcttgtgaacagttctggaggatctgagggttcgtcgtttcacagccaagaattacagaattcaagtcagtctggtgtctttgctaatgtgcagggagaatctcaaatcgatgatgcaactacaccgattgaggaggaatggaaaacatggttgaataatgatggtgatgagcagaggaatatcatgtttatgcaagatcatcgcagcgattacacacctctaaagtcgttaactggtgtcttcagtgatgatagcagtgatgataatgattctgatttgatatctcctaaaacaaattctattggaacttcgagcacttgtgctagttttgctagctcaaatcatcagatagaccaaactcaacattctcctgactcaacagtccagctagtgtcattaactcaagaggtgagccaaggtccgggtcaagtgactgtgattcgagagcataaattgggtgaagagtctgtcaagaagaaaagagctagtttcgtttacaggatgatacacagattagtcaagaaaattcaccaatgttattctatctcaagaacatga

SEQ ID NO: 2022 - protein, 359 aa, Arabidopsis thaliana
  G517  Paralogous to G2053
MMNPVGFRFRPNDEEIVDHYLRPKNLDSDTSHVDEVISTVDICSFEPWDLPSKSMIKSRDGVWYFFSVKEMKYNRGDQQRRRTNSGFWKKTGKTMTVMRKRGNREKIGEKRVLVFKNRDGSKTDWVMHEYHATSLFPNQMMTYTVCKVEFKGEETEISSSSTGSEIEQIHSLIPLVNSSGGSEGSSFHSQELQNSSQSGVFANVQGESQIDDATTPIEEEWKTWLNNDGDEQRNIMFMQDHRSDYTPLKSLTGVFSDDSSDDNDSDLISPKTNSIGTSSTCASFASSNHQIDQTQHSPDSTVQLVSLTQEVSQGPGQVTVIREHKLGEESVKKKRASFVYRMIHRLVKKIHQCYSISRT

SEQ ID NO: 2023 - DNA, 1832 bp, Arabidopsis thaliana
  G554  Predicted polypeptide sequence is paralogous to G1198
ccttccaaacactattggggaaatggcttcttctcttttttccggtgtaggtttaaggttttagatttgaaggcggatggtgaggagtttgtgttgatgaaatgggtgatttgaagttaaatacctttaagttcttttagccttaagttcttttagcctgtcattacaatatatgtttcagttgtgatcttttggtgctctccaaggtcttagggaatctccgtgtcccctctggtttctttctttgtataaagtctctggaatttaaagatgattttgtcctgttttcttcgaagaatttggcgaagaaacatcaaaagttcactatttgctttacgtgttatgcttgtttgactttgtgtgatctaacttttggttgaaaactaatgctcatcttttgttctttggaatgtcttgatctgcttgattttgaatgctttgtcacattgtttaaacaatttgttctttgttttcagttgaggaaaacatgaattcgacatcgacacattttgtgccaccgagaagagttggtatatacgaacctgtccatcaattcggtatgtggggggagagtttcaaaagcaatattagcaatgggactatgaacacaccaaaccacataataataccgaataatcagaaactagacaacaacgtgtcagaggatacttcccatggaacagcaggaactcctcacatgttcgatcaagaagcttcaacgtctagacatcccgataagatacaaagacggcttgctcaaaaccgcgaggctgctaggaaaagtcgcttgcgcaagaaggcttatgttcagcaactggaaacaagcaggttgaagctaattcaattagagcaagaactcgatcgtgctagacaacagggattctatgtaggaaacggaatagatactaattctctcggtttttcggaaaccatgaatccagggattgctgcatttgaaatggaatatggacattgggttgaagaacagaacagacagatatgtgaactaagaacagttttacacggacacattaacgatatcgagcttcgttcgctagtcgaaaacgccatgaaacattactttgagcttttccggatgaaatcgtctgctgccaaagccgatgtcttcttcgtcatgtcagggatgtggagaacttcagcagaacgattcttcttatggattggcggatttcgaccctccgatcttctcaaggttcttttgccacattttgatgtcttgacggatcaacaacttctagatgtatgcaatctaaaacaatcgtgtcagcaagcagaagacgcgttgactcaaggtatggagaagctgcaacacaccttgcggaccgttgcagcgggacaactcggtgaaggaagttacattcctcaggtgaattctgctatggatagattagaagctttggtcagtttcgtaaatcaggctgatcacttgagacatgaaacattgcaacaaatgtatcggatattgacaacgcgacaagcggctcgaggattattagctcttggtgagtattttcaacggcttagagccttgagctcaagttgggcaactcgacatcgtgaaccaacgtaggtttgagttattttgtaacaaccaaatgaagaaaatggaaagacctcaaaaatgaagaatgagtgcatctgaaaacagaggactactctgaataaatagaggggttgctgctgatatttatttttactctgcggcggaattagaaaatttgaaaaacatcatgtattgataagttgtaaatatcagaaaaaggtgggggtgcaaaaatttgtactttttagcttttgaaagaggcaagttt

SEQ ID NO: 2024 - protein, 367 aa, Arabidopsis thaliana
  G554  Paralogous to G1198
MNSTSTHFVPPRRVGIYEPVHQFGMWGESFKSNISNGTMNTPNHIIIPNNQKLDNNVSEDTSHGTAGTPHMFDQEASTSRHPDKIQRRLAQNREAARKSRLRKKAYVQQLETSRLKLIQLEQELDRARQQGFYVGNGIDTNSLGFSETMNPGIAAFEMEYGHWVEEQNRQICELRTVLHGHINDIELRSLVENAMKHYFELFRMKSSAAKADVFFVMSGMWRTSAERFFLWIGGFRPSDLLKVLLPHFDVLTDQQLLDVCNLKQSCQQAEDALTQGMEKLQHTLRTVAAGQLGEGSYIPQVNSAMDRLEALVSFVNQADHLRHETLQQMYRILTTRQAARGLLALGEYFQRLRALSSSWATRHREPT

SEQ ID NO: 2025 - DNA, 1360 bp, Arabidopsis thaliana
  G555  Predicted polypeptide sequence is paralogous to G1198
caaaagtagtaacctttgttggtgattgatactatatctgttgtgggttttagacaaagaccacgtctttgcagttgtagattggaattttccggatctttctctaaatcgctttttctccgagcaacttttgtttggggttaagctcaaagaatccgttcttttcagtctttactccatctagggtaccacgattggatcggtttttatctgatgatttagtaacagagattttgaagaaaaagaaaaatgggagatactagtccaagaacatcagtctcaacagatggagacactgatcataataacctaatgttcgatgaagggcatttgggtatcggtgcttctgattctagtgaccgttcaaagagtaaaatggatcaaaagacgcttcgtaggctcgctcaaaaccgtgaggctgcaaggaaaagcagattgaggaagaaagcatatgttcagcagctagagaacagtcgattgaagctaacacaacttgagcaggagctacaaagagcacggcaacagggtgtctttatctcaagctctggagaccaagcccattctaccgctggagatggggcaatggcatttgatgtagaatacagacgatggcaggaagataaaaacagacagatgaaggagctgagttctgctatagattctcacgcgactgattctgagcttcggataattgtagatggagtaatagctcactatgaggagctttacaggataaaaggcaacgcagctaagagtgatgtcttccatttattatcagggatgtggaaaaccccagctgagagatgtttcttgtggctcggcggtttccgttcatcagaacttctcaagcttatagcgtgtcagttggagcccttgacagaacaacaatcgctagacataaataacttgcaacagtcaactcagcaagcagaagatgctttgtctcaagggatggacaacttacagcaatcactcgctgatactttatcgagtgggactctcggttcaagttcatcagggaatgtagctagctacatgggtcagatggccatggcgatggggaagttaggtacccttgaaggatttatccgccaggctgataacttaaggctacaaacatatcaacagatggtgagactattaacaacccgacaatcggctcgtgctctccttgcagtacacaattatacattgcggttacgtgctcttagctctctatggcttgccagaccaagagagtgaaccatgactctattatacttcaacgaaggtccagaaaatttgagattcttagcataagatttgacgactttagacacgtagctcgtatacaagattatgattatactgttttgtgttg

SEQ ID NO: 2026 - protein, 330 aa, Arabidopsis thaliana
  G555  Paralogous to G1198
MGDTSPRTSVSTDGDTDHNNLMFDEGHLGIGASDSSDRSKSKMDQKTLRRLAQNREAARKSRLRKKAYVQQLENSRLKLTQLEQELQRARQQGVFISSSGDQAHSTAGDGAMAFDVEYRRWQEDKNRQMKELSSAIDSHATDSELRIIVDGVIAHYEELYRIKGNAAKSDVFHLLSGMWKTPAERCFLWLGGFRSSELLKLIACQLEPLTEQQSLDINNLQQSTQQAEDALSQGMDNLQQSLADTLSSGTLGSSSSGNVASYMGQMAMAMGKLGTLEGFIRQADNLRLQTYQQMVRLLTTRQSARALLAVHNYTLRLRALSSLWLARPRE

SEQ ID NO: 2027 - DNA, 1457 bp, Arabidopsis thaliana
  G556  Predicted polypeptide sequence is paralogous to G1198
cttttttgaagcccttttgacacaaaagaccagaacaagttgaagaaatatgaatacaacctcgacacattttgttccaccgagaaggtttgaagtttacgagcctctcaaccaaatcggtatgtgggaagaaagtttcaagaacaatggagacatgtatacgcctggctctatcataatcccgactaacgaaaaaccagacagcttgtcagaggatacttctcatgggacagaaggaactcctcacaagtttgaccaagaggcttccacatctagacatcctgataagatacagagaaggctagcacagaatcgagaggcagctaggaaaagtcgtttgcgcaagaaagcttatgttcagcagctagagactagccggttaaagctaattcatttagagcaagaactcgatcgtgctagacaacagggtttctatgtggggaacggagtagataccaatgctcttagtttctcagataacatgagctcagggattgttgcatttgagatggaatatggacattgggtggaagaacagaacaggcaaatatgtgaactaagaacggttttacatggacaagttagtgatatagagcttcgttctctagtcgagaatgccatgaaacattactttcaactcttccgaatgaagtcagccgctgcaaaaatcgatgttttctatgtcatgtccggaatgtggaaaacttcagcagagcggtttttcttgtggataggcggatttagaccctcagagcttctcaaggttctgttaccgcattttgatcctttgacggatcaacaacttttggatgtatgtaatctgaggcaatcatgtcaacaatcagaagatgcgttatcccaaggtatggagaaactgcaacatacattagcagagagtgtagcagccgggaaacttggtgaaggaagttatattcctcaaatgacttgtgctatggagagattggaggctttggtcagctttgtaaatcaagctgatcatctgagacatgagacattgcaacagatgcatcggatcttaaccacgcgacaagcggctagaggtttgttagcattaggggagtatttccaaaggcttcgagctttgagttcgagttgggcggctaggcaacgtgaaccaacgtaattaaggtgtttagatgtcaagaaaggtttgagaccttaacaatcaagaatggagtttgctggtgagtggatttttgggtcaagaacaagagcaataacacaagctgctgtgtgatgatgaatcttgtcttgcggctaaaggaaatgtttgaggaaagttgtacatatgatcagcaacgtaaagtttatagctttttagaaaccaacttttcgatggttgttcttttttttttgtatgtaatattatagataagcttgtggtatatatgattttaatgtgacattacgaacttgatttataaccatggtaaaat

SEQ ID NO: 2028 - protein, 364 aa, Arabidopsis thaliana
  G556  Paralogous to G1198
MNTTSTHFVPPRRFEVYEPLNQIGMWEESFKNNGDMYTPGSIIIPTNEKPDSLSEDTSHGTEGTPHKFDQEASTSRHPDKIQRRLAQNREAARKSRLRKKAYVQQLETSRLKLIHLEQELDRARQQGFYVGNGVDTNALSFSDNMSSGIVAFEMEYGHWVEEQNRQICELRTVLHGQVSDIELRSLVENAMKHYFQLFRMKSAAAKIDVFYVMSGMWKTSAERFFLWIGGFRPSELLKVLLPHFDPLTDQQLLDVCNLRQSCQQSEDALSQGMEKLQHTLAESVAAGKLGEGSYIPQMTCAMERLEALVSFVNQADHLRHETLQQMHRILTTRQAARGLLALGEYFQRLRALSSSWAARQREPT

SEQ ID NO: 2029 - DNA, 1638 bp, Arabidopsis thaliana
  G558  Predicted polypeptide sequence is paralogous to G1198
ggaatttcggatcgtgtctctctctgtttctttgtttcaatccgatttcgaatcaagccctttacttgtgcaccttcaagatttcgttttttccagcgcccagaatgctccgggtgaccaacatttgttcctgattcatttcctattggttcgtattgtctgtgcacacaagagaaatttcaagaagttgttactaaaagagaggccacaagtggatattgtctttgttatcaagtgttagtacagaaaagtggtgagaaagtaatatggctgataccagtccgagaactgatgtctcaacagatgacgacacagatcatcctgatcttgggtcggagggagcactagtgaatactgctgcttctgattcgagtgaccgatcgaagggaaagatggatcaaaagactcttcgtaggcttgctcaaaaccgtgaggcagcaaggaaaagcagattgaggaagaaggcttatgttcagcagctagagaacagccgcttgaaactaacccagcttgagcaggagctgcaaagagcaagacagcagggcgtcttcatttcaggcacaggagaccaggcccattctactggtggaaatggtgctttggcgtttgatgctgaacattcacggtggttggaagaaaagaacaagcaaatgaacgagctgaggtctgctctgaatgcgcatgcaggtgattctgagcttcgaataatagtcgatggtgtgatggctcactatgaggagcttttcaggataaagagcaatgcagctaagaatgatgtctttcacttgctatctggcatgtggaaaacaccagctgagagatgtttcttgtggctcggtggatttcgttcatccgaacttctaaagcttctggcgaatcagttggagccaatgacagagagacagttgatgggcataaataacctgcaacagacatcgcagcaggctgaagatgctttgtctcaagggatggagagcttacaacagtcactagctgatactttatcgagcgggactcttggttcaagttcatcagggaatgtcgcaagctacatgggtcagatggccatggcaatgggaaagttaggtacactcgaaggatttatccgccaggctgataatttgagactacaaacattgcaacagatgataagagtattaacaacgagacagtcagcacgtgctctacttgcaatacacgattacttctcacggctacgagctctaagctccttatggcttgctcgacccagagagtgaaactgtattttggtcacatgtcagctgtacaaaatccatatggacacaaaaccaggagagactattaatcaacacttgtcagattcttcttaccaaatccatcaacaaataagcaaatttctgggaaacaaaagactctttgtatgtaggtttcttctacatggttgtggtaattcatgttgttttagttgtagtcatcagtttttaatttagcatttgaaaagttcaatgttgtttatatagcatcttcgattatcttagaaaggttattgaattttgtttttttttgttacttttgtgtgtggtaaaggtgttttaaccttgcaacttctgtactgtaatcatttaacaatattaagatgttctatttgagttttgt

SEQ ID NO: 2030 - protein, 330 aa, Arabidopsis thaliana
  G558  Paralogous to G1198
MADTSPRTDVSTDDDTDHPDLGSEGALVNTAASDSSDRSKGKMDQKTLRRLAQNREAARKSRLRKKAYVQQLENSRLKLTQLEQELQRARQQGVFISGTGDQAHSTGGNGALAFDAEHSRWLEEKNKQMNELRSALNAHAGDSELRIIVDGVMAHYEELFRIKSNAAKNDVFHLLSGMWKTPAERCFLWLGGFRSSELLKLLANQLEPMTERQLMGINNLQQTSQQAEDALSQGMESLQQSLADTLSSGTLGSSSSGNVASYMGQMAMAMGKLGTLEGFIRQADNLRLQTLQQMIRVLTTRQSARALLAIHDYFSRLRALSSLWLARPRE

SEQ ID NO: 2031 - DNA, 978 bp, Arabidopsis thaliana
  G578  Predicted polypeptide sequence is paralogous to G1198
atgcatagtttgaatgaaacagtaattcctgatgttgattacatgcagtctgatagagggcatatgcatgctgctgcctctgattccagtgatcgatcaaaggataagttggatcaaaagacccttcgtaggcttgctcaaaatcgtgaggcagcaagaaaaagcagattgaggaagaaggcgtatgttcagcagctggaagatagtcgattaaagctgactcaagttgagcaggagctgcaaagagcaagacagcagggagttttcatctcaagttcaggagaccaagctcattctactggtggcaatggtggggctttggcatttgatgcagaacactcacgatggcttgaagaaaagaacaggcaaatgaacgagctgagatctgccctgaatgctcatgcaggtgatactgagctccggataattgtggatggagtgatggctcactatgaggagcttttcaggattaagagcaatgcatctaagaatgatgtcttccacttgttatctggaatgtggaaaacaccagctgagcgatgtttcttgtggcttggcgggttcccgtcatccgaacttctcaagcttcttgcgaatcagctagagcccatgacagaacgacaggtaatgggcatcaatagcttgcagcagacgtcgcagcaggcagaagatgctttatctcaagggatggagagtttacagcaatccctagctgatactttatccagtggaactcttggttccagttcatcggataatgtcgcgagctacatgggtcagatggccatggcaatgggcaagttaggcaccctcgaaggattcatacgccaggctgataacttgaggctgcaaacactacaacagatgcttcgagtattaacaacacgtcagtcagctcgtgctcttcttgctatacacgattattcatctcgattacgtgctcttagttccttgtggcttgcccggccaagagagtga

SEQ ID NO: 2032 - protein, 325 aa, Arabidopsis thaliana
  G578  Paralogous to G1198
MHSLNETVIPDVDYMQSDRGHMHAAASDSSDRSKDKLDQKTLRRLAQNREAARKSRLRKKAYVQQLEDSRLKLTQVEQELQRARQQGVFISSSGDQAHSTGGNGGALAFDAEHSRWLEEKNRQMNELRSALNAHAGDTELRIIVDGVMAHYEELFRIKSNASKNDVFHLLSGMWKTPAERCFLWLGGFPSSELLKLLANQLEPMTERQVMGINSLQQTSQQAEDALSQGMESLQQSLADTLSSGTLGSSSSDNVASYMGQMAMAMGKLGTLEGFIRQADNLRLQTLQQMLRVLTTRQSARALLAIHDYSSRLRALSSLWLARPRE

SEQ ID NO: 2033 - DNA, 1054 bp, Arabidopsis thaliana
  G580  Predicted polypeptide sequence is paralogous to G568
ccaaaaaacaaagcattctatgctattctgttctgttctccaatgttgtcatcagcaaagcataataagatcaacaaccatagtgccttttcaatttcctcttcatcatcatcattatcaacatcatcctccctaggccataacaaatctcaagtcaccatggaagaagtatggaaagaaatcaaccttggttcacttcactaccatcggcaactaaacattggtcatgaaccaatgttaaagaaccaaaaccctaataactccatctttcaagatttcctcaacatgcctctgaatcaaccaccaccaccaccaccaccaccttcctcttccaccattgtcactgctctctatggctctctgcctcttccgcctcctgccactgtcctcagcttaaactccggtgttggattcgagtttcttgataccacagaaaatcttcttgcttctaaccctcgctcctttgaggaatctgcaaagtttggttgtcttggtaagaaaagaggccaagattctgatgatactagaggagacagaaggtataagcgtatgatcaagaacagagaatctgctgctcgttcaagggctaggaagcaggcatatacaaacgaacttgagcttgaaattgctcacttgcagacagagaatgcaagactcaagatacaacaagagcagctgaaaatagccgaagcaactcaaaaccaagtaaagaaaacactacaacggtcttccacagctccattttgagaaaaatctactatttctttttgggggagtttcaagtgtttcttatgaagatgagaaaaacagaaaaagtttgtacattttagctaagttaaatttgtggtggtaagtaatgtaaaagaaaagtgtgtgtagaagaaaagtgtctagaaaaagaaagcaactaactttcttcttcttctctggtttcctatcaactcttttgacttttgtactttttttcttctctacttaacctctattattgtaatgccaagtcaagtccttatctagctagtacatgagtttctgttttcactggttaagccat

SEQ ID NO: 2034 - protein, 234 aa, Arabidopsis thaliana
  G580  Paralogous to G568
MLSSAKHNKINNHSAFSISSSSSSLSTSSSLGHNKSQVTMEEVWKEINLGSLHYHRQLNIGHEPMLKNQNPNNSIFQDFLNMPLNQPPPPPPPPSSSTIVTALYGSLPLPPPATVLSLNSGVGFEFLDTTENLLASNPRSFEESAKFGCLGKKRGQDSDDTRGDRRYKRMIKNRESAARSRARKQAYTNELELEIAHLQTENARLKIQQEQLKIAEATQNQVKKTLQRSSTAPF

SEQ ID NO: 2035 - DNA, 2062 bp, Arabidopsis thaliana
  G586  Predicted polypeptide sequence is paralogous to G585
catgactagtcataacctttaaatcacttctgctttttttctgtttctcttttgatttattcaaagacaacaaagttttgtttttgacaaaaaatctgatctttgtttgttcgtttgtttgttacatggggatgaagaaacaatggcaaccggagaaaacagaacggtgccggacaatctaaagaaacagctcgcagtttcagttcgaaacattcaatggagttatggaatcttctggtctgtctctgcttctcaaccaggagtgttggagtggggagatggatattacaatggagacataaagacaaggaagacgattcaagcagcagaagtcaaaattgaccagttaggtcttgagagaagtgagcagcttagagagctttatgaatctctctccctcgctgaatcctcagcttccggtagctctcaggtcactagacgagcttccgccgccgctctctcaccggaggacctcaccgacaccgagtggtactacttagtatgcatgtctttcgtcttcaacatcggtgaaggaatccccggaggagcgttatccaatggagaaccaatatggctttgtaacgctgaaaccgccgatagcaaagtcttcactcgttctcttctagctaaaagtgcttcgcttcagacagtggtttgcttcccgtttcttggaggagtccttgagattggcacgaccgaacatattaaagaggacatgaacgtgatacaaagtgttaagacgttgttccttgaagctcctccatatactacaatatcgacaagatcagactatcaagaaatttttgatcccttaagtgacgataaatacactccggtgtttataaccgaagcttttccaacaacttctactagcgggtttgagtatgaacctgaggatcatgattcgttcatcaacgatggtggtgcgtctcaggtacaaagctggcagtttgtgggtgaagaaatcagtaactgcattcaccaatcgttaaattcaagcgattgcgtttcccaaacgtttgttggaacaaccgggagacttgcttgcgatccaaggaagagtaggattcaacggttaggtcagattcaagaacagagtaaccatgtaaatatggacgacgatgttcattaccaaggcgtgatatcgacgattttcaaaacaacgcatcagctaatactcggaccgcagtttcagaacttcgataagcggtctagcttcacaaggtggaagcgatcatcatctgtgaaaacattgggagagaaatcgcagaagatgataaagaagatactcttcgaggttcctttgatgaacaagaaagaagagttgttaccggacacaccagaggaaaccgggaaccatgccttgtccgagaagaaacgccgcgagaaattgaatgaacggtttatgacattgagatcaatcattccctcaattagtaagattgataaagtgtcgattcttgatgatacaattgagtatcttcaagatttacagaaacgggttcaagagttggaatcttgtagagaatctgctgatacagagacacggataacgatgatgaagaggaagaaaccggatgatgaggaggaaagagcatcagcgaattgtatgaacagcaaaaggaaggggagtgatgtgaatgtaggagaagatgaaccagctgatatcggttatgctggtctaacggataacttaaggatcagttcattaggtaacgaggtggttattgagcttagatgcgcttggagagaagggatattgcttgagataatggatgtgattagtgatctcaacttggattctcactcggttcagtcgtcaaccggagacggtttactctgcttaactgtcaattgcaagcataaagggacaaaaatagcaacaacaggaatgatccaagaggcacttcaaagggttgcatggatatgttaaggattcaaggtttagatttgacaaaattagctttttctctggtttggtttcccaattttcggtaatcagtgattctaaccgagtttttgtgattttggaaaaaaaaaaaaaaaaaaaaaaaaaaaaaaa

SEQ ID NO: 2036 - protein, 596 aa, Arabidopsis thaliana
  G586  Paralogous to G585
MATGENRTVPDNLKKQLAVSVRNIQWSYGIFWSVSASQPGVLEWGDGYYNGDIKTRKTIQAAEVKIDQLGLERSEQLRELYESLSLAESSASGSSQVTRRASAAALSPEDLTDTEWYYLVCMSFVFNIGEGIPGGALSNGEPIWLCNAETADSKVFTRSLLAKSASLQTVVCFPFLGGVLEIGTTEHIKEDMNVIQSVKTLFLEAPPYTTISTRSDYQEIFDPLSDDKYTPVFITEAFPTTSTSGFEYEPEDHDSFINDGGASQVQSWQFVGEEISNCIHQSLNSSDCVSQTFVGTTGRLACDPRKSRIQRLGQIQEQSNHVNMDDDVHYQGVISTIFKTTHQLILGPQFQNFDKRSSFTRWKRSSSVKTLGEKSQKMIKKILFEVPLMNKKEELLPDTPEETGNHALSEKKRREKLNERFMTLRSIIPSISKIDKVSILDDTIEYLQDLQKRVQELESCRESADTETRITMMKRKKPDDEEERASANCMNSKRKGSDVNVGEDEPADIGYAGLTDNLRISSLGNEVVIELRCAWREGILLEIMDVISDLNLDSHSVQSSTGDGLLCLTVNCKHKGTKIATTGMIQEALQRVAWIC

SEQ ID NO: 2037 - DNA, 1394 bp, Arabidopsis thaliana
  G596  Predicted polypeptide sequence is paralogous to G2789
taatttctctacttcagatttttttctccttagattaatttaattgagttattgtacatccctcaagctaagattctggttttgtgagttgagtggatgagaagaggagagattaactaaattagggtttcaattgtttactttttgtttgctttttatatcaagtaatggatcaggtctctcgctctcttcctccaccttttctctcaagagatctccatcttcacccacaccatcaattccagcatcagcagcagcagcagcaacagaatcacggccacgatatagaccagcaccgaatcggtgggctaaaacgtgaccgagatgctgatatcgatcccaacgagcactcttcagccggaaaagatcaaagtactcctggctccggtggagaaagcggcggcggaggaggaggagataatcacatcacgagaaggccacgtggcagaccagcgggatctaagaacaaaccaaaaccgccaatcatcatcactcgagacagcgcaaacgctctcaaatctcatgtcatggaagtagcaaacggatgtgacgtcatggaaagtgtcaccgtcttcgctcgccgtcgccaacgtggcatctgcgttttgagcggaaacggcgccgttaccaacgttaccataagacaaccagcttcagtacctggtggtggctcatctgtcgttaacttacacggacgtttcgagattctttctctctcgggatcattccttcctcctccggctccaccagctgcgtcaggtctaacgatttacttagccggtggtcagggacaggttgttggaggaagcgtggttggtccactcatggcttcaggacctgtagtgattatggcagcttcgtttggaaacgctgcgtatgagagactgccgttggaggaagacgatcaagaagagcaaacagctggagcggttgctaataatatcgatggaaacgcaacaatgggtggtggaacgcaaacgcaaactcagacgcagcagcaacagcaacaacagttgatgcaagatccgacgtcgtttatacaagggttgcctccgaatcttatgaattctgttcaattgccagctgaagcttattggggaactccgagaccatctttctaaatcgcgaagaaaaaacaagttagatacgttcgttgtttttaatttataatctctcttctgtcaagttttaattttctttttcttcttctttgttttctaaagataattgtagtctttgacgaagattcgtggtacgtatgaatcgaagagaatcgttttggtcatgggattgctcgatctattaggtttgagagggggtttgtgttttgcgttgactagcagattataaaattgttgattttcgagtttttattttcatgtgttggtgataaa

SEQ ID NO: 2038 - protein, 317 aa, Arabidopsis thaliana
  G596  Paralogous to G2789
MDQVSRSLPPPFLSRDLHLHPHHQFQHQQQQQQQNHGHDIDQHRIGGLKRDRDADIDPNEHSSAGKDQSTPGSGGESGGGGGGDNHITRRPRGRPAGSKNKPKPPIIITRDSANALKSHVMEVANGCDVMESVTVFARRRQRGICVLSGNGAVTNVTIRQPASVPGGGSSVVNLHGRFEILSLSGSFLPPPAPPAASGLTIYLAGGQGQVVGGSVVGPLMASGPVVIMAASFGNAAYERLPLEEDDQEEQTAGAVANNIDGNATMGGGTQTQTQTQQQQQQQLMQDPTSFIQGLPPNLMNSVQLPAEAYWGTPRPSF

SEQ ID NO: 2039 - DNA, 1263 bp, Arabidopsis thaliana
  G605  Predicted polypeptide sequence is paralogous to G1944
aattccatcctaataattttcaaagctttaattctaagaaataatatctacaagaaaatattatctcatgtatggagactaccggagaagttgttaaaacaaccaccgggagcgacggaggcgttacggtggtgagatccaacgcgccgtcagacttccacatggctccgaggtcagaaacttcaaacacacctcccaactccgtcgctcctcctcctcctccaccgccgcaaaactcctttactccgtcggcggctatggatggtttctcaagcggaccgataaagaagagacgtgggcgccctaggaagtacggacacgacggagcagcggtgacgctatctccgaatccgatatcatcagccgcaccaacgacttctcacgtcatcgatttctcgacgacatcggagaaacgtggcaaaatgaaaccagcaactccaactccaagctcattcatcaggccaaagtaccaggtcgagaatttaggtgaatggtctccttcctctgccgccgctaatttcacgccgcatattattacggtgaatgcaggcgaggacgttacgaagaggataatatcattttctcaacaagggtctctagctatttgcgttttatgcgcaaacggtgtcgtttcgagcgttacacttcgtcagcctgattcatctggtggtacattgacctatgagggtcggtttgagatattgtcactatctggaacattcatgcctagtgactcagacgggacacgaagcagaacaggcgggatgagcgtgtcgcttgctagccctgatggacgtgtagtaggtggtggtgttgctggcttgctggttgcagccactcctattcaagtggttgtaggaactttcttaggtggaacaaaccagcaagaacagacaccgaagccgcataaccacaacttcatgtcttctccattaatgccaacttcttcgaatgtagctgatcatcgaaccatccgtcccatgacatctagtctcccgatcagtacatggacaccgtcttttccttctgattcacgacacaagcattctcatgactttaatatcactttgacgtgatttcttccttgaagaactcgtagatcctctgtattttggtttccagtttagggctctacatgttagactctcaaagtctaggtgttatgttggtctgtcacttaggattgtcacttaggattgttagaccatctccatcaatggtttctcattgagaaactgttcaatataaaaataaaatataatc

SEQ ID NO: 2040 - protein, 334 aa, Arabidopsis thaliana
  G605  Paralogous to G1944
METTGEVVKTTTGSDGGVTVVRSNAPSDFHMAPRSETSNTPPNSVAPPPPPPPQNSFTPSAAMDGFSSGPIKKRRGRPRKYGHDGAAVTLSPNPISSAAPTTSHVIDFSTTSEKRGKMKPATPTPSSFIRPKYQVENLGEWSPSSAAANFTPHIITVNAGEDVTKRIISFSQQGSLAICVLCANGVVSSVTLRQPDSSGGTLTYEGRFEILSLSGTFMPSDSDGTRSRTGGMSVSLASPDGRVVGGGVAGLLVAATPIQVVVGTFLGGTNQQEQTPKPHNHNFMSSPLMPTSSNVADHRTIRPMTSSLPISTWTPSFPSDSRHKHSHDFNITLT

SEQ ID NO: 2041 - DNA, 2311 bp, Arabidopsis thaliana
  G610  Predicted polypeptide sequence is paralogous to G849
tcttaatcagagattcgtgagaggtaaaggtagcgtaattattcagtttgcgtgatctataatttaactggcgccagattgtgatccaggaatcgttggcttgttaggttgttgttttgttatgcataattgagagatggtggtcaaaaggaagttaaattgtggtggctctgatggttttgatttccccaatattcccaaggctcctcgttcaagcaggaggaaggtctcaggtaagagatctgatgatgaaagtgagatctgtgcaattgatttgctagcttctcttgctggaaagttgttggaagaaagtgaaagttcctcaacgtctacctatgcatctgaagctgataatcttgatcatttgggtggactgattaagcaagaacttgaagatggctatactactaagccttgtaaatccgagtttttcgatccaggaaaccctgcttcaaagtccactagtgaaaatactagcgtgacttgtttgccattttcgtctttcgaaaatgattgcattttggagcaaacaccggtttctgattgtaagagggcatctggtttgaagtccctggtagggagcatcactgaggagacatgtgttgttaatgaggatgccggatctgaacaaggtgctaatactttcagcttaaaggatccaagtcaattacattcgcagtctccagaatcggtccttctggatggcgatgtgaaattagcaccatgcacggatcaagtccctaatgattcttttaaaggatataggaatcattctaagttagtttgcagagatgatgacgaaaactattgtaagtattataaatttagtgacaaatgtaagtcatataggcctctctcccgggttggcaatagaagaataatgcagtcggtgagagcaatctccaagttgaagtgttttgaagacactagaacagatggtcgtttgaaggctctctaccgcaagagaaaattatgttatggttacaacccatggaagcgtgagaccattcataggaagagaagattgtctgacaaaggtttggtcgtaaattatgatggtgggctcagtagtgaaagtgtttccaattcacctgaaaagggagaatcagaaaatggtgatttctctgctgcaaaaataggtcttctttcgaaagactcccgtgtaaagttcagcatcaagtcccttaggattccggagcttgtaattgaagttccagaaacagcaacagtaggcttactgaagaggacggtgaaggaggcggttactgctttactcggtggtggaatacgtattggggtgttagtccaagggaaaaaagttagagatgacaacaacactctatcacagactggtctttcgtgtagagaaaatcttggcaaccttggcttcaccttagagcctggtttggaaacactgcctgtacctctttgttctgaaactcctgtcctttctctgccaactgactctacaaagttgtcagaaaggtccgcagcttctccagcgttagagactggaattcctctccctccccaagatgaagattacttgattaatttgggaaatagtgtggagaacaatgatgaattagtcccacatctgagtgacataccagctgatgaacaaccttcatcagattcaagagcgctggttccagttttggccttggagtccgacgctcttgcacttgttccagttaacgagaaacctaagcgtacagagctttcacaacgcagaaccaggagaccattctctgttacagaggtagaagctctagtaagcgcagttgaagaagttgggactggaagatggcgtgatgtgaagttgcgttcttttgagaatgcaagtcatcgaacctatgtggacttgaaggacaaatggaaaacgttggttcacacagcaagtatatcaccacagcaacgaagaggagaaccagtgcctcaagaactgctagacagagtcttaggagcacataggtactggacacagcaccaaatgaaacagaacgggaaacatcaggtggctacaacaatggtggttgaagcaggttcgtccatgtaaagaaggagaatggtaataacaataactttcacttgacgactaaggaaccaaagtgggcaactgtacaaagggaaacaacaaaatacagaaacatacttaatttctgaaaagaagagtctatatttttattttttttaaatcatagccggtagaaacaagacgttccttgacacttttggttacttttatggtaggtctgttcattccaaatttctaattgatttgattatgtaatttggtggtaggaccatg

SEQ ID NO: 2042 - protein, 640 aa, Arabidopsis thaliana
  G610  Paralogous to G849
MVVKRKLNCGGSDGFDFPNIPKAPRSSRRKVSGKRSDDESEICAIDLLASLAGKLLEESESSSTSTYASEADNLDHLGGLIKQELEDGYTTKPCKSEFFDPGNPASKSTSENTSVTCLPFSSFENDCILEQTPVSDCKRASGLKSLVGSITEETCVVNEDAGSEQGANTFSLKDPSQLHSQSPESVLLDGDVKLAPCTDQVPNDSFKGYRNHSKLVCRDDDENYCKYYKFSDKCKSYRPLSRVGNRRIMQSVRAISKLKCFEDTRTDGRLKALYRKRKLCYGYNPWKRETIHRKRRLSDKGLVVNYDGGLSSESVSNSPEKGESENGDFSAAKIGLLSKDSRVKFSIKSLRIPELVIEVPETATVGLLKRTVKEAVTALLGGGIRIGVLVQGKKVRDDNNTLSQTGLSCRENLGNLGFTLEPGLETLPVPLCSETPVLSLPTDSTKLSERSAASPALETGIPLPPQDEDYLINLGNSVENNDELVPHLSDIPADEQPSSDSRALVPVLALESDALALVPVNEKPKRTELSQRRTRRPFSVTEVEALVSAVEEVGTGRWRDVKLRSFENASHRTYVDLKDKWKTLVHTASISPQQRRGEPVPQELLDRVLGAHRYWTQHQMKQNGKHQVATTMVVEAGSSM

SEQ ID NO: 2043 - DNA, 1557 bp, Arabidopsis thaliana
  G629  Predicted polypeptide sequence is paralogous to G1198
cgaaatgaaaaaattctctgtattaccagaaacgtgtttcataagcatctttaactcttcagctctcaaattcttcatgaatatctctgcttatcggatcaagtgagagcaaatgcaatttttaagagccagctattggatctataactgaagaggatatatatagagatgatgagttcttcttctccaacacaacttgcatctttaagagacatgggaatctatgagccatttcaacaaattgtcggttggggaaatgttttcaaatctgatatcaatgatcatagtcccaatactgctacttcctctattattcaggttgatcctagaattgatgatcacaacaacaacatcaagataaattatgattcttctcataaccagatcgaagcagaacaaccttctagtaatgataatcaagatgatgatggcaggattcatgataagatgaaacggcgtttagcgcagaaccgagaagcggctcgcaaaagtcgtttgagaaagaaggcttatgttcagcagttagaggaaagccggttaaagttatcgcagttagagcaagaactcgaaaaggttaagcagcagggccatttaggaccatctgggagtattaacacagggattgcatcatttgagatggaatattcacactggctacaagaacaaagcagaagagttagcgaactacgaacagcgcttcaatctcatataagcgacatagaactcaagatgctagtagagagttgcttgaaccattacgctaatcttttccgaatgaaatccgatgcagcaaaagccgatgttttctacttgatatcgggaatgtggcgaacttcaaccgaaagattcttccaatggattggagggtttcgtccatccgaacttttaaacgttgtgatgccttatcttcaaccattaacggatcaacaaatcttggaagtgagaaacctccaacaatcatcacaacaagcagaggatgctctgtctcaagggattgataaacttcaacagagtttagctgaaagcattgtgattgatgcggttatcgagtccacgcattatcccactcacatggctgcagctatagagaatcttcaagcattagaaggatttgtgaatcaagcagatcatctgaggcaacaaactttgcaacaaatggcgaagatcttaacgacaagacaatcggctcgaggtttactagctttaggagagtatcttcatagacttcgtgctcttagttctctttgggcagctcgtccacaagaaccaacttaaaagaggaacttattaaaactttaaaaacaagaaacagcagaatcaaaagtcttgaagaagcatactcatcacaaagcttggaaggatgttttaaaaaagatctttgttaattaagtagagtgagattctcttgattagaactttatggtttttgctttatgaagtatctctccagagaagattgtaaatttgggttgaaactttgtaatatattaagatccaccaaataagtttgaaatctgagcaatttgataataaaaaaaaaaaaaaaaaaaaaaaaaa

SEQ ID NO: 2044 - protein, 368 aa, Arabidopsis thaliana
  G629  Paralogous to G1198
MMSSSSPTQLASLRDMGIYEPFQQIVGWGNVFKSDINDHSPNTATSSIIQVDPRIDDHNNNIKINYDSSHNQIEAEQPSSNDNQDDDGRIHDKMKRRLAQNREAARKSRLRKKAYVQQLEESRLKLSQLEQELEKVKQQGHLGPSGSINTGIASFEMEYSHWLQEQSRRVSELRTALQSHISDIELKMLVESCLNHYANLFRMKSDAAKADVFYLISGMWRTSTERFFQWIGGFRPSELLNVVMPYLQPLTDQQILEVRNLQQSSQQAEDALSQGIDKLQQSLAESIVIDAVIESTHYPTHMAAAIENLQALEGFVNQADHLRQQTLQQMAKILTTRQSARGLLALGEYLHRLRALSSLWAARPQEPT

SEQ ID NO: 2045 - DNA, 984 bp, Arabidopsis thaliana
  G659  Predicted polypeptide sequence is paralogous to G1323
atggggaagggaagagcaccttgttgtgacaagaccaaagtgaagagaggtccatggagcccagaagaagacattaaactcatctctttcattcaaaagtttggtcatgagaactggagatctctccccaaacaatctggtatgtcattgcttttgtcatcacaatcaaagcaaaagcctcttcaattgttttttcttttctttatgattctgaatgtatatatatgcaaaaatgaagggctattgaggtgtgggaagagttgtcgtctaaggtggattaactatcttaggccagatctgaagcgtggcaacttcacttcagaggaggaagaaacaatcattaagcttcaccacaactatgggaacaagtggtcgaaaatcgcttctcaacttccaggtagaacagataacgagatcaagaatgtgtggcacactcatctaaagaaaagactggctcagagctcaggaactgcagatgaaccggcctcgccttgttcgagtgattctgtttctcgtgggaaagatgataagtcatctcacgtagaagattctttgaacagagagactaatcataggaatgagttgtctacatctatgtcttctgggggttccaaccaacaagatgatccaaagatagacgaactcaggtttgagtatatagaagaagcttatagcgagtttaacgacattattattcaagaggtagacaaacccgatctgctggagataccatttgattcagatcctgacatttggagtttcttagatacttcaaactcatttcaacaatccactgcaaatgagaacagctcaggctcaagagcaacaacagaagaagagtctgatgaggatgaggttaagaaatggttcaagcacctagaaagcgaactcgggttagaagaagacgataatcaacaacaatacaaagaagaagaatcatcatcatcatcactcttgaagaactacgagctcatgatacattga

SEQ ID NO: 2046 - protein, 327 aa, Arabidopsis thaliana
  G659  Paralogous to G1323
MGKGRAPCCDKTKVKRGPWSPEEDIKLISFIQKFGHENWRSLPKQSGMSLLLSSQSKQKPLQLFFLFFMILNVYICKNEGLLRCGKSCRLRWINYLRPDLKRGNFTSEEEETIIKLHHNYGNKWSKIASQLPGRTDNEIKNVWHTHLKKRLAQSSGTADEPASPCSSDSVSRGKDDKSSHVEDSLNRETNHRNELSTSMSSGGSNQQDDPKIDELRFEYIEEAYSEFNDIIIQEVDKPDLLEIPFDSDPDIWSFLDTSNSFQQSTANENSSGSRATTEEESDEDEVKKWFKHLESELGLEEDDNQQQYKEEESSSSSLLKNYELMIH

SEQ ID NO: 2047 - DNA, 1310 bp, Arabidopsis thaliana
  G666  Predicted polypeptide sequence is paralogous to G256
attagatccatttcagagctaagcgtactaattagtgtactaagggtagtgtgactcattaccacctaaagtagtttcaattttcttctatttttcttggcaaagagttatagtgggaaacaaagggagtggttaataaagaattaattagttaattaagggagttcaagatcataatggtgaggcctccttgttgtgacaaaggaggagtgaagaaagggccatggactcctgaagaagatatcattttagtcacttacatccaagaacatggtcctggtaattggagagctgttcctaccaatactgggctgcttagatgcagtaagagttgtagacttagatggacaaactatttaaggccaggaatcaaaagaggcaatttcacagaacatgaagaaaagatgattgttcatctccaagccctcttaggaaatagatgggctgcaattgcgtcatatcttccacaaaggacagacaatgacattaagaactattggaacactcatttgaagaagaaactcaacaaagtcaatcaagattctcatcaagaacttgaccgttcctcgctctcatcttcaccatcgtcttcttctgctaattccaactcaaacatctcaagaggccaatgggaaaggcgacttcaaaccgatatccacttggcgaaaaaggctctctctgaggctttatctcctgccgttgcaccaatcattacatctacagtgacaacaacgtcttcctctgctgaatcaagacgctctacttcctcagctagcgggtttcttaggacgcaagaaacatctacaacttatgcctcaagcaccgaaaatatcgcgaaattgctcaaagggtgggtgaaaaactcgccgaagactcaaaactccgcggatcaaatcgcttctacagaggtaaaagaagtgatcaagagtgatgatgggaaggagtgtgcaggggcatttcagtcattttctgagtttgatcactcatatcaacaggctggtgtttcacctgatcatgagaccaaaccagacataactggatgctgcagtaaccaaagtcaatggtctttgtttgagaagtggttgtttgaggattctggtggacagattggtgatattctattggatgaaaacactaatttcttctgaagagtttgctttaatcacatggttctaattttaggatcctcatctctattttttttttgggttttccaaattaactcgcttagattatcgtgagataaatcagtaataattttatttattttccctctttaatttacaattaatgatggggttgcttttaaa

SEQ ID NO: 2048 - protein, 323 aa, Arabidopsis thaliana
  G666  Paralogous to G256
MVRPPCCDKGGVKKGPWTPEEDIILVTYIQEHGPGNWRAVPTNTGLLRCSKSCRLRWTNYLRPGIKRGNFTEHEEKMIVHLQALLGNRWAAIASYLPQRTDNDIKNYWNTHLKKKLNKVNQDSHQELDRSSLSSSPSSSSANSNSNISRGQWERRLQTDIHLAKKALSEALSPAVAPIITSTVTTTSSSAESRRSTSSASGFLRTQETSTTYASSTENIAKLLKGWVKNSPKTQNSADQIASTEVKEVIKSDDGKECAGAFQSFSEFDHSYQQAGVSPDHETKPDITGCCSNQSQWSLFEKWLFEDSGGQIGDILLDENTNFF

SEQ ID NO: 2049 - DNA, 1056 bp, Arabidopsis thaliana
  G668  Predicted polypeptide sequence is paralogous to G256
atgggaagaccaccttgctgtgaaaagattggagtgaagaaagggccatggacaccagaggaagacatcatcttggtttcttacatccaagaacatggtcctggaaactggagatctgtcccaacacacacaggtttaagatgtagcaagagctgcagattgagatggactaattatcttcgacccggtattaagcgtggaaattttactgagcatgaagagaagacaattgttcatcttcaagcccttttaggcaacagatgggcagccatagcatcataccttccagaaaggacagacaatgatataaagaactattggaacactcacttgaagaagaagctcaaaaagattaatgaatctggtgaagaagataatgatggtgtctcttcatcaaacactagttcacaaaagaaccatcaaagcactaacaaaggtcaatgggaaagaagacttcagacagacattaacatggcaaaacaagctctttgtgaggccttgtctttagacaaaccatcatccactctttcatcatcttcatcattaccgacaccagtaatcacacaacaaaacatccgtaacttctcatcagctttgcttgaccgttgttatgatccatcctcttcttcttcatctaccacaaccaccactacaagcaacactactaatccatacccatcaggggtatatgcgtcaagtgctgagaacatcgcccggttgcttcaagatttcatgaaagacacacccaaggctttaactttatcatcttcatctccggtttcagagactggaccactcactgctgcagtctcggaagaaggtggagaagggtttgaacaatctttcttcagcttcaattcaatggacgaaactcaaaacttgactcaggagacaagcttcttccatgatcaagtgatcaaaccggaaataacaatggaccaagatcatggtctaatatcacaagggtctctgtctttgtttgagaaatggttatttgatgagcaaagccacgagatggttggtatggcactagcaggacaagaagggatgttctag

SEQ ID NO: 2050 - protein, 351 aa, Arabidopsis thaliana
  G668  Paralogous to G256
MGRPPCCEKIGVKKGPWTPEEDIILVSYIQEHGPGNWRSVPTHTGLRCSKSCRLRWTNYLRPGIKRGNFTEHEEKTIVHLQALLGNRWAAIASYLPERTDNDIKNYWNTHLKKKLKKINESGEEDNDGVSSSNTSSQKNHQSTNKGQWERRLQTDINMAKQALCEALSLDKPSSTLSSSSSLPTPVITQQNIRNFSSALLDRCYDPSSSSSSTTTTTTSNTTNPYPSGVYASSAENIARLLQDFMKDTPKALTLSSSSPVSETGPLTAAVSEEGGEGFEQSFFSFNSMDETQNLTQETSFFHDQVIKPEITMDQDHGLISQGSLSLFEKWLFDEQSHEMVGMALAGQEGMF

SEQ ID NO: 2051 - DNA, 1384 bp, Arabidopsis thaliana
  G671  Predicted polypeptide sequence is paralogous to G2340
ttcacttgagaacaaccccctttgaactcgatcaagaaagctaagtttgaagaatcaagaatggtgcggacaccgtgttgcaaagccgaactagggttaaagaaaggagcttggactcccgaggaagatcagaagcttctctcttaccttaaccgccacggtgaaggtggatggcgaactctccccgaaaaagctggactcaagagatgcggcaaaagctgcagactgagatgggccaattatcttagacctgacatcaaaagaggagagttcactgaagacgaagaacgttcaatcatctctcttcacgcccttcacggcaacaaatggtctgctatagctcgtggactaccaggaagaaccgataacgagatcaagaactactggaacactcatatcaaaaaacgtttgatcaagaaaggtattgatccagttacacacaagggcataacctccggtaccgacaaatcagaaaacctcccggagaaacaaaatgttaatctgacaactagtgaccatgatcttgataatgacaaggcgaagaagaacaacaagaattttggattatcatcggctagtttcttgaacaaagtagctaataggttcggaaagagaatcaatcagagtgttctgtctgagattatcggaagtggaggcccacttgcttctactagtcacactactaatactacaactacaagtgtttccgttgactctgaatcagttaagtcaacgagttcttccttcgcaccaacctcgaatcttctctgccatgggaccgttgcaacaacaccagtttcatcgaactttgacgttgatggtaacgttaatctgacgtgttcttcgtccacgttctctgattcctccgttaacaatcctctaatgtactgcgataatttcgttggtaataacaacgttgatgatgaggatactatcgggttctccacatttctgaatgatgaagatttcatgatgttggaggagtcttgtgttgaaaacactgcgttcatgaaagaacttacgaggtttcttcacgaggatgaaaacgacgtcgttgatgtgacgccggtctatgaacgtcaagacttgtttgacgaaattgataactattttggatgagtgaaactcataatcgatgaatcccacgtgaccatgtcaatatgatgtctatggatatgttaccttgatgatgttgatggtaataataataaataatagatggtgatgatgaccatgcatgaatcatgaatgtagttcgtgttgtcacatatgcttgtgtttttgtgttttttttttttggtctgaagtgtgttgtttcgttgtaaatggattataaatggtgatgtaataattataatgttaaaaaaaaaaaaaaaaaaaaaaa

SEQ ID NO: 2052 - protein, 352 aa, Arabidopsis thaliana
  G671  Paralogous to G2340
MVRTPCCKAELGLKKGAWTPEEDQKLLSYLNRHGEGGWRTLPEKAGLKRCGKSCRLRWANYLRPDIKRGEFTEDEERSIISLHALHGNKWSAIARGLPGRTDNEIKNYWNTHIKKRLIKKGIDPVTHKGITSGTDKSENLPEKQNVNLTTSDHDLDNDKAKKNNKNFGLSSASFLNKVANRFGKRINQSVLSEIIGSGGPLASTSHTTNTTTTSVSVDSESVKSTSSSFAPTSNLLCHGTVATTPVSSNFDVDGNVNLTCSSSTFSDSSVNNPLMYCDNFVGNNNVDDEDTIGFSTFLNDEDFMMLEESCVENTAFMKELTRFLHEDENDVVDVTPVYERQDLFDEIDNYFG

SEQ ID NO: 2053 - DNA, 925 bp, Arabidopsis thaliana
  G714  Predicted polypeptide sequence is paralogous to G489
ccacgcgtccgcgtcaatctttgagtttggtagagaaatggatcaacaaggacaatcatcagctatgaactatggttcaaacccatatcaaaccaacgccatgaccactacaccaaccggttcagaccatccagcttaccatcagatccaccagcaacaacaacaacagctcactcaacagcttcaatctttctgggagactcaattcaaagagattgagaaaaccactgatttcaagaaccatagccttccattggcaagaatcaagaaaatcatgaaagctgatgaagatgtgcgtatgatctcggccgaggcgcctgttgtgttcgccagggcctgcgagatgtttattctggagcttacgttaaggtcttggaaccatactgaggagaacaagagaaggacgttgcagaagaatgatatcgcggctgcggtgactagaactgatatttttgattttcttgtggatattgttcctcgggaggatcttcgtgatgaagtcttgggtggtgttggtgctgaagctgctacagctgcgggttatccgtatggatacttgcctcctggaacagctccaattgggaacccgggaatggttatgggtaacccgggcgcgtatccgccgaaggcgtatatgggtcagccaatgtggcaacaaccaggacctgagcagcaggatcctgacaattagcttggcctaataaactagccgtctaattcgaagctctccccggtggatctactcaagaagaagaatgttaatagaaaactattgcgacataaaaagtttggtgtagtagaataatttctgttttatgatccatggatttatcaattgttattcagtttggtttatcttgtcatcaaactgttttcggtcaatgtaacaaattcataaattgagaattgaacttacaaaaggcta

SEQ ID NO: 2054 - protein, 217 aa, Arabidopsis thaliana
  G714  Paralogous to G489
MDQQGQSSAMNYGSNPYQTNAMTTTPTGSDHPAYHQIHQQQQQQLTQQLQSFWETQFKEIEKTTDFKNHSLPLARIKKIMKADEDVRMISAEAPVVFARACEMFILELTLRSWNHTEENKRRTLQKNDIAAAVTRTDIFDFLVDIVPREDLRDEVLGGVGAEAATAAGYPYGYLPPGTAPIGNPGMVMGNPGAYPPKAYMGQPMWQQPGPEQQDPDN

SEQ ID NO: 2055 - DNA, 1760 bp, Arabidopsis thaliana
  G729  Predicted polypeptide sequence is paralogous to G1040
aaaaaaaacaaaagaatagtcatcatcatcatcaccatcatcatccttatcatcatcaacaacttcagtggcagcaatagcaagagaaaggtttctttaattatgtctatggaaggtgtttttctagagaaaaccaaaacaaacacaacaactactctccctgatctatctctccacatcagtctcccagatattcatcaataccatcacaatgaatcttctaaagaatcttcaagaagatcctcccaactcgaaaacaacaaccgatcgtccaactttgaactctctttatctcatcataaccatccaacagcaagaatcttccattgtcctgatcgaagaacccttaatcttcctcatcagcagcattacaacaaccctatcatcaatggtgttcatcaaagggtcgatgaatccgagattagtaatctccaccgtccaattagaggcatcccggtctatcacaaccgttcattccctttccaccaacaaaactcttcattaccttctcttggaggaggagacatggatcaaatctcaatcttaaactcatcttccggctacaacaacgcttaccgatcattacaatcttccccgaggcttaaaggtgttcctttgcatcatcatcatcatcataatcagtatggagtcgttggatcttcagattcgtcttctcctcatcaccataaccatcatcatcatgggatgatcagatcaagattcttgcctaagatgccgacaaagcgaagcatgagagctccaaggatgcgttggactagtagcctccacgcgcggtttgttcacgctgttgagcttctaggcggccatgaaagagcaactccaaagtcggttcttgagctcatggatgtaaaagacttaactttagcacatgtgaagagccatttgcagatgtatcgaactgttaagaccactaacaagcctgctgcttcatcagatgggtcaggagaagaagaaatgggcataaatggaaacgaagttcatcatcaatcatcgacggatcaaagggcacaatctgatgatacttctcttcatcaagaaactgacatttcttccacacaacctcgttggagtaactcttcacgagagacatggccattaagtaataactgctcaagcgacatagatacaatgatcagaacttcatcaacatcaatgatctctcattatcaaagatccagcattcaaaatcaggagcaaaggtcgaatgatcaagcaaagaggtgtggaaatcttagttgtgaaaatccaagtttggagtttacattaggcagaccagattggcacgagaaatgactttcttgatcaatttggatttttatatatattggattttttatttttttgtttcatctttctctctctatatatactcagaaacatgtatgcagtatatatctttgtgacgatgaaattctcagcgtaaaagaaggagaacacgtagagagccaagctgctcaagagtgttgatttttgcacagagagagagaatatcactaccaaaatgaagaaatttggaggttcctcttctcaagttccattgatgatttgattataaagtggatgatcaatgtatgagtttttgtttttgggttttcgggtttttagttttttgaggttgatctggtggtgtgatcataagttatataattggaagatcatcaaaatgtggtgaaagtttggatatttttttgaaagcctcttggttggctagagggtttcaagttttttttttttttttt

SEQ ID NO: 2056 - protein, 403 aa, Arabidopsis thaliana
  G729  Paralogous to G1040
MSMEGVFLEKTKTNTTTTLPDLSLHISLPDIHQYHHNESSKESSRRSSQLENNNRSSNFELSLSHHNHPTARIFHCPDRRTLNLPHQQHYNNPIINGVHQRVDESEISNLHRPIRGIPVYHNRSFPFHQQNSSLPSLGGGDMDQISILNSSSGYNNAYRSLQSSPRLKGVPLHHHHHHNQYGVVGSSDSSSPHHHNHHHHGMIRSRFLPKMPTKRSMRAPRMRWTSSLHARFVHAVELLGGHERATPKSVLELMDVKDLTLAHVKSHLQMYRTVKTTNKPAASSDGSGEEEMGINGNEVHHQSSTDQRAQSDDTSLHQETDISSTQPRWSNSSRETWPLSNNCSSDIDTMIRTSSTSMISHYQRSSIQNQEQRSNDQAKRCGNLSCENPSLEFTLGRPDWHEK

SEQ ID NO: 2057 - DNA, 1182 bp, Arabidopsis thaliana
  G730  Predicted polypeptide sequence is paralogous to G1040
ctttttgaaataaataacattatacccctcctttttcccataaaattcatcaagattatctcaaaatcattcaccaattctctcttcttatggagcttttcccttcacaacctgacttgtacttgaagatcagccgaagaagagaagaagaacaagaaaaagaaagtcaagaactacaagaacaagaagtcgaaaggagattagggtttcagagtaaagcctcagatttagacaacaagtcttcaaataatctcatccacactctccagttcacttcaaacaatgaagccaccaagattaatagtaatcaagaacacaaggaatctctcgatcaagacttgagatctatttttatgatgagaccaataagaggaatccctctttaccagaatcaagtccttgaccactactactactcatctacctctcccaatcctttcttcttcagtgaagtcaacggtcaacatgctagtcgtcgcttaatcacaaaccctaattgtagttttaatctccacaaccgtcatcggcgtcaagctcaaccgcagccgccaagattcaccgccaaaagaggagtaagggctccaaggatgcggtggacgacgaccctccacgcccattttgtacacgctgttcaattattgggtggtcatgaaagagcaaccccaaaatcagtacttgagctgatggatgtgcaagatctcacattggctcatgttaaatcccatctacagatgtatcgaaccatcaagtctactgaaaaacctacaacgtcatcagggcagtcagattgtgagaatggatcacaagtaaacagtgagagagaagcaagaaatctcacgggtctatggaataactcctcaagtgaagctcggttccagttgaaggcaaaggcatcatcaggtgtagacatttcatccaatgagaatgaatggaagaatcgaagatgtccaagcaacgaacggttgtcgtcagattcgtcaagccttacagggacaagaccagagactgaaactcccaatcttgatttcactttagctacaccaaacctctctccctaattttcttatatatactaaaaatacatattatctgttaaaaattatataaatctcaaacttaaaagtttatgcttttgaaaaaatatatatgaaatgacgtttatttcttccttaaaaaaaaaaa

SEQ ID NO: 2058 - protein, 322 aa, Arabidopsis thaliana
  G730  Paralogous to G1040
MELFPSQPDLYLKISRRREEEQEKESQELQEQEVERRLGFQSKASDLDNKSSNNLIHTLQFTSNNEATKINSNQEHKESLDQDLRSIFMMRPIRGIPLYQNQVLDHYYYSSTSPNPFFFSEVNGQHASRRLITNPNCSFNLHNRHRRQAQPQPPRFTAKRGVRAPRMRWTTTLHAHFVHAVQLLGGHERATPKSVLELMDVQDLTLAHVKSHLQMYRTIKSTEKPTTSSGQSDCENGSQVNSEREARNLTGLWNNSSSEARFQLKAKASSGVDISSNENEWKNRRCPSNERLSSDSSSLTGTRPETETPNLDFTLATPNLSP

SEQ ID NO: 2059 - DNA, 905 bp, Arabidopsis thaliana
  G767  Predicted polypeptide sequence is paralogous to G519
cgaagtttcaactttcaaacatatctttacagttctttcttgctaaacaacaataaaggggaaaataggttaattatgatgaaatctggggctgatttgcaatttccaccaggatttagatttcatcctacggatgaggagctagtcctcatgtatctctgtcgtaaatgcgcgtcgcagccgatccctgctccgattatcaccgaactcgatttgtaccgatatgatccttgggaccttcccgacatggctttgtacggtgaaaaggagtggtattttttctcaccaagagatcgaaagtatccaaacggttcaagacccaaccgtgcagctggtactggatattggaaagctaccggagctgataaaccaataggtcgtcctaaaccggttggtattaagaaggctctagtgttttactcgggaaaacctccaaatggagagaaaaccaattggattatgcacgaataccggctcgctgacgttgaccggtcggttcgtaagaaaaacagtctaagattggacgattgggtattgtgtcgtatatataacaagaaaggtgtcatcgagaagcgacgaagcgatatcgaggacgggttaaagcctgtgactgacacgtgtccaccggaatctgtggcgagattgatctccggctcggagcaagcggtgtcaccggaattcacgtgtagcaacggtcggttgagtaatgcccttgattttccgtttaattacgtagatgccatcgccgataacgagattgtgtcacggctattgggcgggaatcagatgtggtcgacgacgcttgatccacttgtggttaggcagggaactttctgagttgtcacgtgcgattagagttagtggaaagtggaaactatcactgtctgttttcgcacgtgtcgggc

SEQ ID NO: 2060 - protein, 253 aa, Arabidopsis thaliana
  G767  Paralogous to G519
MMKSGADLQFPPGFRFHPTDEELVLMYLCRKCASQPIPAPIITELDLYRYDPWDLPDMALYGEKEWYFFSPRDRKYPNGSRPNRAAGTGYWKATGADKPIGRPKPVGIKKALVFYSGKPPNGEKTNWIMHEYRLADVDRSVRKKNSLRLDDWVLCRIYNKKGVIEKRRSDIEDGLKPVTDTCPPESVARLISGSEQAVSPEFTCSNGRLSNALDFPFNYVDAIADNEIVSRLLGGNQMWSTTLDPLVVRQGTF

SEQ ID NO: 2061 - DNA, 2353 bp, Arabidopsis thaliana
  G839  Predicted polypeptide sequence is paralogous to G1196
tctcaatttggttcttttgccttctctttgatcttatctcttacgattgtgcagatctcaatctctatatccttggttgtgtcagattctcttagggtttattttctctcccaattttgtttgattccttgtccaaagtttcttcctttccttttgacttttttttgtggtacattgaatcagaggtgtaagagtaatagtttcataactcaaatccccaagtgtacaaattttcctcttttggttctgggtttggttgattccttgttagaaatgtaaatttagggcttttgtatctgaaaccgatcttcagacttgtgtaatcttcttgatcttcatgcaagattgataattctacaagaagaagaagaagagaaaatggctactttgactgagccatcatcatctttgagtttcacatcttctcatttctcttatggttctattgggtccaatcacttctcatcaagctcagcttctaatcctgaagttgttagtctaaccaaactcagctccaatcttgagcagcttcttagtaattcagattgtgattacagtgatgcagagatcattgttgatggtgttccagttggtgttcatagatgcattttagctgcaagaagtaagtttttccaagatttgtttaagaaagaaaagaaaatttcgaaaactgagaaaccaaagtatcagttgagagagatgttaccttatggagctgttgctcatgaagctttcttgtatttcttgagttatatatatactgggagattaaagccttttccattggaggtttcgacttgtgttgatccagtttgttctcatgattgttgtcgacctgccattgattttgttgttcaattgatgtatgcttcctctgttctccaagtgcctgagctagtttcatcttttcagcggcggctttgtaactttgtggagaagacccttgttgagaatgttcttcccattcttatggttgctttcaattgtaagttgactcagcttcttgatcagtgtattgagagagtggcgaggtcagatctttacaggttctgtattgaaaaggaagttcctcccgaagtagcagagaagattaaacagcttcgacttatatccccgcaagacgaagaaaccagtcccaagatttcggagaaattgcttgaaagaatcggtaaaattctcaaggccttggattcagatgatgttgagcttgtgaagcttcttttgactgagtcagatatcactctagatcaagccaatggtctgcattattctgttgtgtatagtgatccgaaagttgttgccgagattcttgctctggatatgggtgatgtgaactacaggaattcccggggttacacggttcttcattttgctgcgatgcgtagagagccatcgatcattatatcgcttatcgataaaggcgccaatgcatctgagtttacatctgacggacgtagcgcagttaatatattaagaagactgacaaatccaaaggattatcataccaaaacagctaaagggcgtgaatctagtaaagccaggttatgcatcgatatcttggaaagagaaatcaggaagaaccccatggttctagatacaccaatgtgttccatttctatgcctgaagatctccagatgagactgttgtacctagaaaagagagtggggcttgctcagttgttctttccaacggaagctaaagttgctatggacattggtaacgtagaaggtacaagtgagttcacgggtttgtcacctccttcgagtgggttaaccggaaacttgagtcaggttgatttaaacgaaactcctcatatgcaaacccaaagacttcttactcgtatggtggctctaatgaaaacagttgagactggtcgaaggttttttccatatggttcagaggttctagataagtacatggctgagtatatagacgacgacatcctcgacgatttccattttgagaagggatctacacatgaaagaagattgaaaagaatgagatatagagagcttaaggatgatgtccaaaaggcatatagcaaagacaaagagtctaagattgcgcggtcttgtctttctgcttcatcttctccttcttcttcttccataagagatgacctgcacaacacaacatgaaactgcaccataagtcaaatgtaattagatatctttgttaaaagggttttttctttatggatgttactcagattttatacagatgctttaggttcagtttcaataaagagagatggatagatagatgtacaagattaggagtgctgattaacccaaaacgttctaactatacgcaatcttttgttttcaatacaaaaatctaatatttaggtta

SEQ ID NO: 2062 - protein, 586 aa, Arabidopsis thaliana
  G839  Paralogous to G1196
MATLTEPSSSLSFTSSHFSYGSIGSNHFSSSSASNPEVVSLTKLSSNLEQLLSNSDCDYSDAEIIVDGVPVGVHRCILAARSKFFQDLFKKEKKISKTEKPKYQLREMLPYGAVAHEAFLYFLSYIYTGRLKPFPLEVSTCVDPVCSHDCCRPAIDFVVQLMYASSVLQVPELVSSFQRRLCNFVEKTLVENVLPILMVAFNCKLTQLLDQCIERVARSDLYRFCIEKEVPPEVAEKIKQLRLISPQDEETSPKISEKLLERIGKILKALDSDDVELVKLLLTESDITLDQANGLHYSVVYSDPKVVAEILALDMGDVNYRNSRGYTVLHFAAMRREPSIIISLIDKGANASEFTSDGRSAVNILRRLTNPKDYHTKTAKGRESSKARLCIDILEREIRKNPMVLDTPMCSISMPEDLQMRLLYLEKRVGLAQLFFPTEAKVAMDIGNVEGTSEFTGLSPPSSGLTGNLSQVDLNETPHMQTQRLLTRMVALMKTVETGRRFFPYGSEVLDKYMAEYIDDDILDDFHFEKGSTHERRLKRMRYRELKDDVQKAYSKDKESKIARSCLSASSSPSSSSIRDDLHNTT

SEQ ID NO: 2063 - DNA, 1134 bp, Arabidopsis thaliana
  G861  Predicted polypeptide sequence is paralogous to G1140
cttcttcctcctcctccatctcttctctttactctctctttaatcatctctcattcttgaatcttgatccatcaaaatcaatcccgttctcgaaagatccattaaaatcaaaacctaagctctctctcttgcttctagggtttttttgttcgttgtgatggcgagagaaaagattcagatcaggaagatcgacaacgcaacggcgagacaagtgacgttttcgaaacgaagaagagggcttttcaagaaagctgaagaactctccgttctctgcgacgccgatgtcgctctcatcatcttctcttccaccggaaaactgttcgagttctgtagctccagcatgaaggaagtcctagagaggcataacttgcagtcaaagaacttggagaagcttgatcagccatctcttgagttacagctggttgagaacagtgatcacgcccgaatgagtaaagaaattgcggacaagagccaccgactaaggcaaatgagaggagaggaacttcaaggacttgacattgaagagcttcagcagctagagaaggcccttgaaactggtttgacgcgtgtgattgaaacaaagagtgacaagattatgagtgagatcagcgaacttcagaaaaagggaatgcaattgatggatgagaacaagcggttgaggcagcaaggaacgcaactaacggaagagaacgagcgacttggcatgcaaatatgtaacaatgtgcatgcacacggtggtgctgaatcggagaacgctgctgtgtacgaggaaggacagtcgtcggagtctattactaacgccggaaactctaccggagcgcctgttgactccgagagctccgacacttcccttaggctcggcttaccgtatggtggttagagatggaacaattcaaagaagttgatggagtgaggagagtaatgtaaatctttttaactcggtagtaacaagagacaatgtctaagtagtgaattctcaaatgtttgtgtaagtttctgcctatggaagaggctttcatttttatgattttcactatgtatgatctctcttcactgcatttctggttagtaacggcttgtcaccgataaactttctcgttatggaaagttagaataaaaaaaaaaaaaaaaaaa

SEQ ID NO: 2064 - protein, 240 aa, Arabidopsis thaliana
  G861  Paralogous to G1140
MAREKIQIRKIDNATARQVTFSKRRRGLFKKAEELSVLCDADVALIIFSSTGKLFEFCSSSMKEVLERHNLQSKNLEKLDQPSLELQLVENSDHARMSKEIADKSHRLRQMRGEELQGLDIEELQQLEKALETGLTRVIETKSDKIMSEISELQKKGMQLMDENKRLRQQGTQLTEENERLGMQICNNVHAHGGAESENAAVYEEGQSSESITNAGNSTGAPVDSESSDTSLRLGLPYGG

SEQ ID NO: 2065 - DNA, 1519 bp, Arabidopsis thaliana
  G932  Predicted polypeptide sequence is paralogous to G256
ccacgcgtccgaccacttgtacctctttgtcttaagtactctttaaccctacaatttcctaagctctcaagccacaaaaaaccacaaaccgttcttcaccaatatatatatctgatcatcatcaaagtccttctctctgctcataccacaaaccgttccattcttcccctaatcacaaagtgatatttacatagagaagatagagatgggaagaccaccatgctgtgacaagattggagtgaagaaaggaccatggacaccagaggaagatatcatcttggtttcttacatccaagaacatggtcctggaaactggagatctgtgcctactcacacaggtttgaggagatgtagcaaaagctgtagattgaggtggactaattatcttcgacctgggatcaagcgtggaaatttcaccgagcatgaagagaagatgattctccatcttcaagctcttttgggaaacaggtgggcagctatagcatcatatcttccagaaaggacagacaatgatataaagaactattggaacactcatttgaagaaaaagctcaagaagatgaatgattcttgtgatagtactatcaacaatggccttgataataaagacttctccatatcaaacaaaaacactacctcacatcaaagcagcaactccagtaaaggtcaatgggagagaaggcttcagacagatatcaacatggctaaacaagctctttgtgatgccttgtctattgacaaaccacaaaacccaactaatttttctattcccgatcttggttatggtccatcatcttcttcgtcctctaccaccaccaccaccaccaccaccaccacgagaaacactaatccatacccatctggggtctatgcttcaagtgctgagaacattgctcgtttgcttcagaattttatgaaagacacaccaaagacctcggtgcccttgccggttgcagccaccgagatggctatcaccacggcagcttcgagccctagcacaaccgaaggagacggagaagggattgaccattctttgttcagcttcaactccatagatgaagctgaagagaagcctaaactaatagaccatgacattaatggtctaattacacaaggctctctttctttgttcgagaaatggctctttgatgagcaaagccacgatatgatcatcaataacatgtcactagagggtcaggaagtgttgttctagaaagcattaaagtttgacgatttgcttgaggaaccacgaggcttagttataaacaatttgtataattaagtactctttagttttgttttcaatccttattatgatcatattgcagtaattagggattttagtctttagtagtaactcttaagttttaacacatttttctctatctttttagtagtaactctttattttttccttaaatctttgtcgacgtggagatgatatcttctatgtagtagaaactcaaaagtgtacatcatctttattaatgtaacgtctttttaaaaaaaaaaaaaaaaa

SEQ ID NO: 2066 - protein, 335 aa, Arabidopsis thaliana
  G932  Paralogous to G256
MGRPPCCDKIGVKKGPWTPEEDIILVSYIQEHGPGNWRSVPTHTGLRRCSKSCRLRWTNYLRPGIKRGNFTEHEEKMILHLQALLGNRWAAIASYLPERTDNDIKNYWNTHLKKKLKKMNDSCDSTINNGLDNKDFSISNKNTTSHQSSNSSKGQWERRLQTDINMAKQALCDALSIDKPQNPTNFSIPDLGYGPSSSSSSTTTTTTTTTTRNTNPYPSGVYASSAENIARLLQNFMKDTPKTSVPLPVAATEMAITTAASSPSTTEGDGEGIDHSLFSFNSIDEAEEKPKLIDHDINGLITQGSLSLFEKWLFDEQSHDMIINNMSLEGQEVLF

SEQ ID NO: 2067 - DNA, 1022 bp, Arabidopsis thaliana
  G986  Predicted polypeptide sequence is paralogous to G881
cattaaattggctcctgtgaacctaaatttatggactatgatcccaacaccaatccgttcgaccttcatttctccggtaaacttccgaaaagagaagtctcggcttcagcttctaaagttgtagagaagaaatggttagtgaaagatgagaagagaaatatgctacaagatgaaataaaccgggttaattcggagaacaagaagctaaccgaaatgttagcaagagtctgtgagaagtactatgctcttaataatcttatggaggagttgcagagtcgaaagagtcctgaaagtgttaactttcagaacaaacagctaacggggaaacgaaaacaagaacttgatgagtttgttagctccccaattggactcagtctcggaccaatcgagaacatcaccaacgataaagcgacggtttcaaccgcttactttgctgctgagaagtctgacacaagcttgactgtgaaagatggatatcaatggaggaaatacgggcaaaagattacgagagataatccatctcctagagcttacttcagatgctcgttttcaccgtcttgtctagtcaagaagaaggtgcaacgaagtgcagaagatccatctttcttggtagccacttacgaagggacacataaccacaccggaccacatgcaagtgtgtccaggacagtgaaacttgatctagttcaaggtgggcttgaaccagttgaggaaaagaaagagagagggacgattcaagaggttttggtgcaacaaatggcttcttcgttgaccaaagatcctaagttcactgcagctcttgcgactgctatttccgggagattgatagagcattcaagaacatgaaagttctctagaacatgtatatttctgttttgttctattttgttgctcattcctagtaaaaaggtaaagatttgtttgatcttgattaggaggcatagatgtcaattttaatgtgtgtgtatataattacatcaaatctaagtatccaaaaagggtcacccccattttatcttatg

SEQ ID NO: 2068 - protein, 271 aa, Arabidopsis thaliana
  G986  Paralogous to G881
MDYDPNTNPFDLHFSGKLPKREVSASASKVVEKKWLVKDEKRNMLQDEINRVNSENKKLTEMLARVCEKYYALNNLMEELQSRKSPESVNFQNKQLTGKRKQELDEFVSSPIGLSLGPIENITNDKATVSTAYFAAEKSDTSLTVKDGYQWRKYGQKITRDNPSPRAYFRCSFSPSCLVKKKVQRSAEDPSFLVATYEGTHNHTGPHASVSRTVKLDLVQGGLEPVEEKKERGTIQEVLVQQMASSLTKDPKFTAALATAISGRLIEHSRT

SEQ ID NO: 2069 - DNA, 3832 bp, Arabidopsis thaliana
  G990  Predicted polypeptide sequence is paralogous to G1451
gtaaaatttagcagagagaagaatgaaacaaataattatagcaccgtcacgtcgccgccgtatttcgttaccggaaaaaaaaaaatcattcttcaacataaaaataaaaacagtctctttctttctatctttgtctatctttgattattctctgtgtacccatgttctgcaacagttgagcaagtgcatgccccatatctctctgtttctcatttcccgatctttgcattaatcatatacttcgcctgagatctcgattaagccagcttatagaagaagaaacggcaccagcttctgtcgttttagttagctcgagatctgtgtttctttttttcttggcttctgagcttttggcggtggtgggtttttctggagaaacccaaacgactatcaaagttttgttttttacaattttaagtgggagttatgagtggggtggattaagtaagttacaagtatgaaggagttgaagattcgaagaagcggttttgaagtcggcgagaccaagattgcgagcttatttggctgatgatttatttcagggaagaagaaataaatctgttttttttagggtttttagatttggttggtgaatgggtgggaggtggagggaaacagttaaaaaagttatgcttttagtgtctcttcttcataattacatttgggcatcttgaaatctttggatctttgaagaaacaaagttgtgttttttttttgttctttgttgtttgctttttaagttagaataaaaaatgagattatcttcagctgggtttaatcctcaacctcatgaaggagagaaaagagttcttaattctgagctctggcatgcttgtgctggtcctcttgtctcactacctcctgttggaagcagagttgtgtattttcctcaaggtcacagtgaacaggttgctgcttcgaccaacaaagaagtagatgctcatataccaaattatccgagcttgcatccgcagcttatctgtcagcttcataatgttacaatgcatgctgatgtggagactgatgaagtctatgcacagatgactttgcaaccgttgaatgcgcaagagcaaaaagatccttaccttcccgcggaattaggtgtcccaagtagacagcctacaaactatttctgtaaaactctgactgctagtgatacaagcactcacggaggtttttctgtacctcgccgagctgctgagaaagttttccctcccttggattactcgcagcagccaccagctcaagagttaatggcgagggatctgcatgataatgaatggaagttcaggcatattttccgaggccaaccaaagagacatctccttaccacgggttggagcgtatttgtgagtgctaaaaggcttgttgctggtgactctgttcttttcatctggaacgataagaatcaattacttcttggtataagacgagccaaccgaccacaaactgtcatgccttcatctgttttgtcaagtgacagtatgcatttaggccttcttgctgcagcagctcatgctgccgctacaaacagccgattcaccatcttctataacccgagggcgagtccatcagagtttgttatacccctggctaagtatgtgaaagcggtttatcacactcgcgtctctgttggtatgcggtttaggatgctgtttgaaactgaagaatctagtgttcgtcggtacatgggtacaataactggcatttgtgatctagatcctactcgttgggctaattcgcattggcgatctgtcaaggttgggtgggacgaatctactgcaggagagagacagccaagggtttcattgtgggagattgagcctttaacaacattccctatgtatccatctccttttcctctcaggcttaaacggccgtggcctcctggtctcccatctttccatggccttaaagaagatgatatgggtatgagtatgagttcaccgcttatgtgggatcgaggactccaatctctaaactttcaaggtatgggagtaaacccgtggatgcagccgagacttgatacgtcgggcttgcttggtatgcaaaatgatgtgtaccaagcaatggctgcagctgcccttcaagacatgagaggcattgatcctgcaaaagctgctgcttcacttcttcagttccaaaattcgccggggttctcaatgcaatctccgtccttagtgcagccgcagatgctgcagcagcaactctctcagcagcagcaacaactctctcagcagcagcagcagcagcaacagctctcccaacagcagcagcaacagctctctcaacagcagcagcagcagctctctcaacagcagcagcaacaactctctcagcagcagcagcaacaggcgtatcttggcgttcctgaaacccaccagcctcagtctcaggctcaatcacagtcaaacaatcatctttctcagcagcagcagcaagtagtggataatcataatccgtctgcgtccagtgctgctgttgtttccgctatgtctcaatttggttctgcttctcagcccaacacgtcaccactccagtccatgacctctctgtgtcatcagcaaagcttctccgataccaacggaggaaacaatcctatttctccacttcacactcttctcagtaacttctctcaagacgaatcttctcaactgctccacctcactagaacaaactctgcaatgacttcatccggttggccatcaaagcgtcctgcagttgattcatcgttccagcactctggagccggtaataataacactcaatccgtattggagcaactgggacagtcccacacaagcaacgttcctccaaacgctgtctcgttgcctccatttcccggtggtagagagtgctcgatcgagcaagaaggaagcgcctcagacccgcatagccatcttctctttggagtcaatatagattcatcttctcttttgatgccgaacggaatgtcaaaccttagaagcattggtattgaaggtggtgactccacgactttacccttcacatcatctaatttcaacaatgatttctcgggtaatcttgcaatgacaacaccttctagttgcatagatgaatcgggttttctacaatcctcagaaaacctcggttccgagaacccacaatctaacacctttgtgaaggtgtacaagtcagggtcttttggaagatcgttagatatatcaaagtttagcagctaccacgagctgcgaagcgagcttgctcgcatgtttggcctcgaaggccaattagaagaccctgtgagatcaggctggcagcttgtatttgttgaccgagagaacgacgttcttctcctcggcgatgacccttggccggagtttgtgagcagcgtgtggtgcattaagatactgtcaccacaagaagtgcaacaaatgggaaaaagaggccttgagcttctcaactccgcgccatcttccaacaatgtcgataagctcccgagcaacgggaactgtgacgactttgggaaccggtcagacccgaggaatctcggtaacggtatcgcatcagttgggggttcattcaactactagaagtagatggaaacctccctttttattcaagttaagtttcaatcttataaattagtagtgagatcatcttagtttaattactagcaaaaatctctctttattacttataaaaaagggagatttgcctttgcctttgatggaaacaaaaactatataatccctctgtcgactcgtaatactgtaattataagatcttttggtctttttcttatatgaatatttttactgaactctatatatgtcactttccttaaaaaaaaaaaaaaaaaaaaaaaaaa

SEQ ID NO: 2070 - protein, 933 aa, Arabidopsis thaliana
  G990  Paralogous to G1451
MRLSSAGFNPQPHEGEKRVLNSELWHACAGPLVSLPPVGSRVVYFPQGHSEQVAASTNKEVDAHIPNYPSLHPQLICQLHNVTMHADVETDEVYAQMTLQPLNAQEQKDPYLPAELGVPSRQPTNYFCKTLTASDTSTHGGFSVPRRAAEKVFPPLDYSQQPPAQELMARDLHDNEWKFRHIFRGQPKRHLLTTGWSVFVSAKRLVAGDSVLFIWNDKNQLLLGIRRANRPQTVMPSSVLSSDSMHLGLLAAAAHAAATNSRFTIFYNPRASPSEFVIPLAKYVKAVYHTRVSVGMRFRMLFETEESSVRRYMGTITGICDLDPTRWANSHWRSVKVGWDESTAGERQPRVSLWEIEPLTTFPMYPSPFPLRLKRPWPPGLPSFHGLKEDDMGMSMSSPLMWDRGLQSLNFQGMGVNPWMQPRLDTSGLLGMQNDVYQAMAAAALQDMRGIDPAKAAASLLQFQNSPGFSMQSPSLVQPQMLQQQLSQQQQQLSQQQQQQQQLSQQQQQQLSQQQQQQLSQQQQQQLSQQQQQQAYLGVPETHQPQSQAQSQSNNHLSQQQQQVVDNHNPSASSAAVVSAMSQFGSASQPNTSPLQSMTSLCHQQSFSDTNGGNNPISPLHTLLSNFSQDESSQLLHLTRTNSAMTSSGWPSKRPAVDSSFQHSGAGNNNTQSVLEQLGQSHTSNVPPNAVSLPPFPGGRECSIEQEGSASDPHSHLLFGVNIDSSSLLMPNGMSNLRSIGIEGGDSTTLPFTSSNFNNDFSGNLAMTTPSSCIDESGFLQSSENLGSENPQSNTFVKVYKSGSFGRSLDISKFSSYHELRSELARMFGLEGQLEDPVRSGWQLVFVDRENDVLLLGDDPWPEFVSSVWCIKILSPQEVQQMGKRGLELLNSAPSSNNVDKLPSNGNCDDFGNRSDPRNLGNGIASVGGSFNY

SEQ ID NO: 2071 - DNA, 1239 bp, Arabidopsis thaliana
  G993  Predicted polypeptide sequence is paralogous to G867, G1930
caaatatggaatacagctgtgtagacgacagtagtacaacgtcagaatctctctccatctctactactccaaagccgacaacgacgacggagaagaaactctcttctccgccggcgacgtcgatgcgtctctacagaatgggaagcggcggaagcagcgtcgttttggattcagagaacggcgtcgagaccgagtcacgtaagcttccttcgtcgaaatataaaggcgttgtgcctcagcctaacggaagatggggagctcagatttacgagaagcatcagcgagtttggctcggtactttcaacgaggaagaagaagctgcgtcttcttacgacatcgccgtgaggagattccgcggccgcgacgccgtcactaacttcaaatctcaagttgatggaaacgacgccgaatcggcttttcttgacgctcattctaaagctgagatcgtggatatgttgaggaaacacacttacgccgatgagtttgagcagagtagacggaagtttgttaacggcgacggaaaacgctctgggttggagacggcgacgtacggaaacgacgctgttttgagagcgcgtgaggttttgttcgagaagactgttacgccgagcgacgtcgggaagctgaaccgtttagtgataccgaaacaacacgcggagaagcattttccgttaccggcgatgacgacggcgatggggatgaatccgtctccgacgaaaggcgttttgattaacttggaagatagaacagggaaagtgtggcggttccgttacagttactggaacagcagtcaaagttacgtgttgaccaagggctggagccggttcgttaaagagaagaatcttcgagccggtgatgtggtttgtttcgagagatcaaccggaccagaccggcaattgtatatccactggaaagtccggtctagtccggttcagactgtggttaggctattcggagtcaacattttcaatgtgagtaacgagaaaccaaacgacgtcgcagtagagtgtgttggcaagaagagatctcgggaagatgatttgttttcgttagggtgttccaagaagcaggcgattatcaacatcttgtgacaaattctttttttttggtttttttcttcaatttgtttctcctttttcaatattttgtattgaaatgacaagttgtaaattaggacaagacaagaaaaaatgacaactagacaaaatagtttttgtttaaaaaaaaaaaaaaaaaaaa

SEQ ID NO: 2072 - protein, 361 aa, Arabidopsis thaliana
  G993  Paralogous to G867, G1930
MEYSCVDDSSTTSESLSISTTPKPTTTTEKKLSSPPATSMRLYRMGSGGSSVVLDSENGVETESRKLPSSKYKGVVPQPNGRWGAQIYEKHQRVWLGTFNEEEEAASSYDIAVRRFRGRDAVTNFKSQVDGNDAESAFLDAHSKAEIVDMLRKHTYADEFEQSRRKFVNGDGKRSGLETATYGNDAVLRAREVLFEKTVTPSDVGKLNRLVIPKQHAEKHFPLPAMTTAMGMNPSPTKGVLINLEDRTGKVWRFRYSYWNSSQSYVLTKGWSRFVKEKNLRAGDVVCFERSTGPDRQLYIHWKVRSSPVQTVVRLFGVNIFNVSNEKPNDVAVECVGKKRSREDDLFSLGCSKKQAIINIL

SEQ ID NO: 2073 - DNA, 913 bp, Arabidopsis thaliana
  G1006  Predicted polypeptide sequence is paralogous to G28
gataaatcaatcaacaaaacaaaaaaaactctatagttagtttctctgaaaatgtacggacagtgcaatatagaatccgactacgctttgttggagtcgataacacgtcacttgctaggaggaggaggagagaacgagctgcgactcaatgagtcaacaccgagttcgtgtttcacagagagttggggaggtttgccattgaaagagaatgattcagaggacatgttggtgtacggactcctcaaagatgccttccattttgacacgtcatcatcggacttgagctgtctttttgattttccggcggttaaagtcgagccaactgagaactttacggcgatggaggagaaaccaaagaaagcgataccggttacggagacggcagtgaaggcgaagcattacagaggagtgaggcagagaccgtgggggaaattcgcggcggagatacgtgatccggcgaagaatggagctagggtttggttagggacgtttgagacggcggaagatgcggctttagcttacgatatagctgcttttaggatgcgtggttcccgcgctttattgaattttccgttgagggttaattccggtgaacctgacccggttcggatcacgtctaagagatcttcttcgtcgtcgtcgtcgtcgtcctcttctacgtcgtcgtctgaaaacgggaagttgaaacgaaggagaaaagcagagaatctgacgtcggaggtggtgcaggtgaagtgtgaggttggtgatgagacacgtgttgatgagttattggtttcataagtttgatcttgtgtgttttgtagttgaatagttttgctataaatgttgaggcaccaagtaaaagtgttcccgtgatgtaaattagttactaaacagagccatatatcttcaatcaaaaaaaaaaaaaaaa

SEQ ID NO: 2074 - protein, 243 aa, Arabidopsis thaliana
  G1006  Paralogous to G28
MYGQCNIESDYALLESITRHLLGGGGENELRLNESTPSSCFTESWGGLPLKENDSEDMLVYGLLKDAFHFDTSSSDLSCLFDFPAVKVEPTENFTAMEEKPKKAIPVTETAVKAKHYRGVRQRPWGKFAAEIRDPAKNGARVWLGTFETAEDAALAYDIAAFRMRGSRALLNFPLRVNSGEPDPVRITSKRSSSSSSSSSSSTSSSENGKLKRRRKAENLTSEVVQVKCEVGDETRVDELLVS

SEQ ID NO: 2075 - DNA, 1354 bp, Arabidopsis thaliana
  G1008  Predicted polypeptide sequence is paralogous to G2130
gcctttttgactcttctttctctcttctactttttttcaggctctctctctatatctctatcttcttctccggttaactaaaagagaaatgaaaagccgagtgagaaaatccaagtacacggttcaccggaaaatcacatccacaccgttcgacggtttcccgaagattgtcaaaatcatagtcactgacccatgcgctactgattcttccagcgatgaggaaaacgacaacaaatctgttgctccgagggtgaaacgttatgtggatgagatcaggttctgtgacgaagatgacgaacctaaaccggcgaggaaagcgaagaaaaagtccccggcggctgcggcggagaacggtggagatttggtaaagtctgtggtgaagtatagaggagtgagacaacgaccttggggaaaatttgcggcggagattcgtgatccttcgagtcgtactagactctggcttgggacttttgcgacggcggaggaagctgctataggttacgatagagccgcgattcgaatcaaaggtcataacgctcagacgaattttctcactcctcctcctagtccgacgactgaggtgttaccggaaactccggtgattgaccttgaaactgtctctggttgtgattcggcgagggaatcgcaaatcagtctgtgttctccgacttctgttctccggtttagtcacaacgacgaaacagagtacagaacagagccaacggaagaacaaaatccgtttttcttgcctgatttgtttcgctccggagattatttttgggattccgaaattacccctgaccctttgtttctcgacgaattccaccagtccttgttaccaaacatcaacaacaacaacacagtgtgtgataaggatacgaatctgtctgatagttttccgttgggagtgatcggagatttcagctcatgggatgttgatgagtttttccaagatcatttgttggataagtaatttgatgagttcttccccagaatttttctgggtttctctttttggttgtgtgagtgagatgagtggtttgatgacaacgacggggatgaatcttagccgtccgttttccatttcgtggacggctccgatcagcggaagaagcgcaacggagtttttatttatctgtttgagaattttataatttaatttgcgagtaaatatagtaattagtgttaagattgtgagagtttaagttaattagggaggggttttgaatattggggattttgggaggtttttgtttggtttctctccaagtctgtcactatgcaaggaagcagtataaagaccgtatatatattttattattaatattgataaaagtaaaaaaaaaaaaaaaaa

SEQ ID NO: 2076 - protein, 294 aa, Arabidopsis thaliana
  G1008  Paralogous to G2130
MKSRVRKSKYTVHRKITSTPFDGFPKIVKIIVTDPCATDSSSDEENDNKSVAPRVKRYVDEIRFCDEDDEPKPARKAKKKSPAAAAENGGDLVKSVVKYRGVRQRPWGKFAAEIRDPSSRTRLWLGTFATAEEAAIGYDRAAIRIKGHNAQTNFLTPPPSPTTEVLPETPVIDLETVSGCDSARESQISLCSPTSVLRFSHNDETEYRTEPTEEQNPFFLPDLFRSGDYFWDSEITPDPLFLDEFHQSLLPNINNNNTVCDKDTNLSDSFPLGVIGDFSSWDVDEFFQDHLLDK

SEQ ID NO: 2077 - DNA, 1473 bp, Arabidopsis thaliana
  G1067  Predicted polypeptide sequence is paralogous to G1073
tctcaagcttctctctcctttttttcccatagcacatcagaatcgctaaatacgactcctatgcaaagaagaagctacttctttctcttgccctaattaatctacctaactagggtttcctcttacctttcatgagagagatcatttaacataagtcaccttttttatatcttttgcttcgtctttaatttagttctgttcttggtctgtttctatattttgtcggcttgcgtaaccgatcacaccttaatgctttagctattgtttcctcaaaatcatgagttttgacttctcgatctgagttttctttttctctctttacgctcttcttcacctagctaccaatatatgaacgagcaggatcaagaatcgagaaattgatttgagctggcgaataagcagtggtgggatagggaattagtagatgcggcggcgatggaaggcggttacgagcaaggcggtggagcttctagatacttccataacctctttagaccggagattcaccaccaacagcttcaaccgcagggcgggatcaatcttatcgaccagcatcatcatcagcaccagcaacatcaacaacaacaacaaccgtcggatgattcaagagaatctgaccattcaaacaaagatcatcatcaacagggtcgacccgattcagacccgaatacatcaagctcagcaccgggaaaacgtccacgtggacgtccaccaggatctaagaacaaagccaagccaccgatcatagtaactcgtgatagccccaacgcgcttagatctcacgttcttgaagtatctcctggagctgacatagttgagagtgtttccacgtacgctaggaggagagggagaggcgtctccgttttaggaggaaacggcaccgtatctaacgtcactctccgtcagccagtcactcctggaaatggcggtggtgtgtccggaggaggaggagttgtgactttacatggaaggtttgagattctttcgctaacggggactgttttgccacctcctgcaccgcctggtgccggtggtttgtctatatttttagccggagggcaaggtcaggtggtcggaggaagcgttgtggctccccttattgcatcagctccggttatactaatggcggcttcgttctcaaatgcggttttcgagagactaccgattgaggaggaggaagaagaaggtggtggtggcggaggaggaggaggaggagggccaccgcagatgcaacaagctccatcagcatctccgccgtctggagtgaccggtcagggacagttaggaggtaatgtgggtggttatgggttttctggtgatcctcatttgcttggatggggagctggaacaccttcaagaccacctttttaattgaattttaatgtccggaaatttatgtgtttttatcatcttgaggagtcgtctttcctttgggatatttggtgtttaatgtttagttgatatgcatatttt

SEQ ID NO: 2078 - protein, 311 aa, Arabidopsis thaliana
  G1067  Paralogous to G1073
MEGGYEQGGGASRYFHNLFRPEIHHQQLQPQGGINLIDQHHHQHQQHQQQQQPSDDSRESDHSNKDHHQQGRPDSDPNTSSSAPGKRPRGRPPGSKNKAKPPIIVTRDSPNALRSHVLEVSPGADIVESVSTYARRRGRGVSVLGGNGTVSNVTLRQPVTPGNGGGVSGGGGVVTLHGRFEILSLTGTVLPPPAPPGAGGLSIFLAGGQGQVVGGSVVAPLIASAPVILMAASFSNAVFERLPIEEEEEEGGGGGGGGGGGPPQMQQAPSASPPSGVTGQGQLGGNVGGYGFSGDPHLLGWGAGTPSRPPF

SEQ ID NO: 2079 - DNA, 1342 bp, Arabidopsis thaliana
  G1076  Predicted polypeptide sequence is paralogous to G1075
attttagtcttcctataacttcttctcaatcctctctcatatcttttttcttagtttaaatttcaataaaatagaaaaaaacatatacaaatctacagagaagagaagctttattttaatcttgtgtgtgtgtgtgtgttttatataatttttattttttttcaaattaaaatctcttctttgcttttgatgtgggcatggctggtcttgatctaggcacagcttttcgttacgttaatcaccagctccatcgtcccgatctccaccttcaccacaattcctcctccgatgacgtcactcccggagccgggatgggtcatttcaccgtcgacgacgaagacaacaacaacaaccatcaaggtcttgacttagcctctggtggaggatcaggaagctctggaggaggaggaggtcacggcgggggaggagacgtcgttggtcgtcgtccacgtggcagaccaccgggatccaagaacaaaccgaaacctccggtaattatcacgcgcgagagcgcaaacactctaagagctcacattcttgaagtaacaaacggctgcgatgttttcgactgcgttgcgacttatgctcgtcggagacagcgagggatctgcgttctgagcggtagcggaacggtcacgaacgtcagcatacgtcagccatctgcggctggagcggttgtgacgctacaaggaacgttcgagattctttctctctccggatcgtttcttcctcctccggcacctcccggagcaacgagtttgacaattttcttagccggaggacaaggtcaggtggttggaggaagcgttgtgggtgagcttacggcggctggaccggtgattgtgattgcagcttcgtttactaatgttgcttatgagagacttcctttagaagaagatgagcagcagcaacagcttggaggaggatctaacggcggaggtaatttgtttccggaggtggcagctggaggaggaggaggacttccgttctttaatttaccgatgaatatgcaaccaaatgtgcaacttccggtggaaggttggccggggaattccggtggaagaggtcctttctgatgtgtatatattgataatcattatatatataccggcggagaagcttttccggcgaagaatttgcgagagtgaagaaaggttagaaaagcttttaatggactaatgaatttcaaattatcatcgtgatttcggacattgtcttgttcatcatgttaagcttaggtttattttttgtcgtttgtagaattttatgtttgaatccttttttttttctgtgaaactctattgtgttcgtctgcgaaggaaaaaaaaattctcaaaaaaaa

SEQ ID NO: 2080 - protein, 292 aa, Arabidopsis thaliana
  G1076  Paralogous to G1075
MAGLDLGTAFRYVNHQLHRPDLHLHHNSSSDDVTPGAGMGHFTVDDEDNNNNHQGLDLASGGGSGSSGGGGGHGGGGDVVGRRPRGRPPGSKNKPKPPVIITRESANTLRAHILEVTNGCDVFDCVATYARRRQRGICVLSGSGTVTNVSIRQPSAAGAVVTLQGTFEILSLSGSFLPPPAPPGATSLTIFLAGGQGQVVGGSVVGELTAAGPVIVIAASFTNVAYERLPLEEDEQQQQLGGGSNGGGNLFPEVAAGGGGGLPFFNLPMNMQPNVQLPVEGWPGNSGGRGPF

SEQ ID NO: 2081 - DNA, 2215 bp, Arabidopsis thaliana
  G1136  Predicted polypeptide sequence is paralogous to G584
caatcactaaacgccatttgcttagctttttccctcttttgatttttcctccctacacgtcacctctctcttcttctcaccggaaaaaagtcttcacctttcaccggaaaatatcaccttttcaaccggcgtatgttcacatgaacggcacaacatcatcaatcaacttcttgacctccgacgatgacgcgtcggcggcggctatggaagctttcattggaacaaaccaccactcatctctctttcctccaccaccacaacaaccacctcagcctcagttcaacgaagatactcttcaacaacgtctccaagctttaatagaatccgccggagaaaactggacttacgctatcttctggcagatctcacacgacttcgattcatccaccggagataacacagtgatcctcggctggggagatggttactacaaaggagaggaagataaagagaagaagaagaacaacaccaacacggcggagcaagagcatcggaaaagagtaatacgtgagcttaactcgttaatctccggcggaattggggtttccgatgaatcaaacgatgaagaagtaacagatactgaatggttcttcttagtttcgatgactcaaagcttcgttaacggtgttggtctccccggagaatctttcttaaactctcgtgtgatttggttatccgggtctggtgctttaaccgggtcgggttgtgaaagagcgggtcaaggtcagatttacgggttaaagacgatggtgtgtatcgcgactcaaaacggcgtcgttgagcttggttcgtcggaggttataagtcaaagctcagatctgatgcataaagttaacaacttgtttaatttcaacaacggtggtggaaacaatggtgttgaagcttcttcgtggggttttaatctgaatccagatcaaggagagaatgatccagctttgtggattagtgaaccgacgaacaccggaatcgaatctccggcgagggttaataatggtaataactcgaattctaattctaagtctgattctcatcaaatttctaagcttgagaagaatgatattagctctgtagagaatcagaatcgtcaaagttcgtgtcttgtcgagaaagatttgacctttcaaggtgggttgttgaaatctaatgagactttgagtttctgtggtaatgagagtagtaagaagagaacttcggtatctaaagggagtaataatgatgaagggatgctttcgtttagtactgtggttagatcagctgcgaatgattcggatcattctgatcttgaagcatctgttgttaaggaagcgattgttgttgagccaccggagaagaagccgaggaaacgggggaggaaaccggcgaatgggagagaagagccgttgaatcatgttgaagcagagaggcagagaagagagaagttaaaccagagattctactctttgagagctgttgttcctaacgtttcgaagatggataaagcttcgcttctcggagacgcgatttcgtatatcaatgagcttaagtcgaagctgcagcaagcggagtctgataaagaggagattcagaagaagctagatgggatgagtaaggaagggaataatgggaaaggttgcgggtcaagggcaaaagaacggaaaagttcgaatcaagattctacggcgagttctatagaaatggagattgatgttaagatcataggttgggatgtgatgatacgtgtacaatgcggcaagaaagatcatcccggtgctaggttcatggaagcacttaaggaattggatttggaagtgaatcatgcgagtttatccgttgtgaatgatttgatgattcaacaagctacggtgaagatggggagccaatttttcaatcatgaccagctcaaagttgctttgatgacgaaagtcggagaaaactattgaacaaagttggcatatcaaagaggggaaactagtgttttcatcgatgaaatgggatcgaatttagcgggtaatgtatggtcttttgtaaagtagtaagtactcattttgcatcactcgcttcatgttgttaaatgttgttgttcattaggagaacttgcttagttcttagcttagtgttatcataagccttaagtgagaaggaagttggagactagaagaccagagagagttagcgaaataataaaatctttggttgtacttgtatgtatatatatgtatggagtaagattaagtga

SEQ ID NO: 2082 - protein, 592 aa, Arabidopsis thaliana
  G1136  Paralogous to G584
MNGTTSSINFLTSDDDASAAAMEAFIGTNHHSSLFPPPPQQPPQPQFNEDTLQQRLQALIESAGENWTYAIFWQISHDFDSSTGDNTVILGWGDGYYKGEEDKEKKKNNTNTAEQEHRKRVIRELNSLISGGIGVSDESNDEEVTDTEWFFLVSMTQSFVNGVGLPGESFLNSRVIWLSGSGALTGSGCERAGQGQIYGLKTMVCIATQNGVVELGSSEVISQSSDLMHKVNNLFNFNNGGGNNGVEASSWGFNLNPDQGENDPALWISEPTNTGIESPARVNNGNNSNSNSKSDSHQISKLEKNDISSVENQNRQSSCLVEKDLTFQGGLLKSNETLSFCGNESSKKRTSVSKGSNNDEGMLSFSTVVRSAANDSDHSDLEASVVKEAIVVEPPEKKPRKRGRKPANGREEPLNHVEAERQRREKLNQRFYSLRAVVPNVSKMDKASLLGDAISYINELKSKLQQAESDKEEIQKKLDGMSKEGNNGKGCGSRAKERKSSNQDSTASSIEMEIDVKIIGWDVMIRVQCGKKDHPGARFMEALKELDLEVNHASLSVVNDLMIQQATVKMGSQFFNHDQLKVALMTKVGENY

SEQ ID NO: 2083 - DNA, 2910 bp, Arabidopsis thaliana
  G1149  Predicted polypeptide sequence is paralogous to G1146
atgtcaaatcgtggtggtggtggtcacggcggcgctagtcgtggtcgaggaggtggacgaaggtctgaccagagacaagatcagtcttctggtcaagttgcttggccgggtttacaacaaagctacggtggtcgtggtggttctgtttccgccggtagaggtcgtggaaacgtcggaagaggtgaaaatactggagatctgacggcgacgcaagttccggttgcttctgctgtttctggcgggagaggtcgtggtaacatcggagatccgacgttttctgttgcgtcttcgtctaagacggtgtctgttgcttcttcatctaaagaggaaagtaagaatacggaggtttctgagaccatgtcgaaccttcagattacttcgacggagacgaaacctgaaatgacgtcacttcctccggcgtcatctaaagcggttacgtttccggtacggccaggacgtggtactttggggaagaaagtcatggttcgtgcgaatcatttccttgttcaagttgctgatcgtgatctctaccattacgatgtttcgatcaatcctgaggttatatcaaagacagtgaacagaaacgtgatgaaacttctggttaagaattataaagactctcacttgggagggaagtcaccagcgtatgatggaaggaaaagcctctatactgctggtccattaccttttgactcgaaagagtttgttgtgaatctggcggagaaaagagctgacggttcctctgggaaggacagaccgtttaaagttgctgtaaagaatgtgacaagcactgatctttatcagttgcaacagttccttgatcgtaagcaaagagaggctccatatgatactatccaagtgcttgatgttgttcttagggataagccctctaatgattatgtctctgttgggaggtcttttttccacactagtttgggaaaggacgcaagagatggtaggggtgagcttggagatggtattgagtactggagaggttatttccaaagtctaaggctgactcagatgggtttgtctctgaacattgacgtttcagcaagatcattttatgaaccgattgttgtcactgactttattagcaagtttctgaatataagggacttaaacaggccacttagagactcagatcgacttaaggtgaagaaagttttgaggacactgaaagttaagttgcttcactggaacggcacaaaaagtgccaaaattagtgggatttctagtctacccatcagggagctaaggttcactctggaggacaaatcagagaagacggttgttcaatattttgctgaaaaatataattatagagtgaaataccaggctctacctgctattcaaacagggagtgacacaagacccgtctacctaccaatggagctctgccaaattgacgaagggcaaagatacaccaaaaggctcaatgagaagcaagtgactgcattgctaaaagctacctgccaacgaccccctgatagagagaactcgatcaaaaacttggttgtgaaaaataattacaatgatgatctgagcaaggagtttgggatgtcagtgactacccaactagcctcgattgaagctcgtgtacttcccccaccgatgttgaagtaccatgacagtggtaaagagaaaatggtaaatccaaggctaggacagtggaacatgattgacaagaaaatggttaatggagcaaaagtcacttcttggacttgcgaatttaagcctcaacctgctattccgttcatctcttgtccccctgaacatattgaggaagctcttctcgatatccacaaaagggcacctggtctccaactgttgattgtaatattgcctgatgtgactggatcatatggaaaaataaaaaggatctgtgaaacagaattggggattgtctctcagtgttgccaacctagacaagttaataaactcaacaagcagtacatggaaaatgttgccttgaagatcaatgtcaagactgggggaaggaacactgttcttaatgatgctattagaagaaacatacctcttattactgatcgtccaaccatcatcatgggtgctgatgtgactcacccacagcctggagaggactcaagtccttctattgctgctgttgtggcctctatggactggcctgagataaacaaataccgaggattggtttctgctcaagctcatagggaagaaattattcaggacctgtataagctggttcaggatccacaacgtgggctagtccactctggtttgataagggaacatttcatagcattcaggagagctacaggccagatacctcaaaggatcatcttctatcgtgacggagtaagcgaagggcagtttagtcaggttctgctacatgagatgactgctatccgcaaggcttgtaactctctccaagagaattatgttcctcgtgttactttcgtgattgtccagaaacgtcaccacacacgtttgttccctgagcaacacgggaatcgtgatatgactgataagagtggcaatattcaaccaggtactgtcgtggacactaaaatctgtcaccctaatgaattcgacttctatttgaacagccatgctggtattcagggaacaagcaggccggcacattaccatgtacttctcgatgagaacggtttcaccgctgatcagttgcaaatgctcacaaacaacctctgctacacgtatgcgaggtgtacaaaatctgtgtcaattgtgccaccagcctactacgctcacttggctgcattccgtgcccgctactacatggagagtgagatgtctgatggaggttcgagcaggtccaggagctcaacaacaggtgtgggtcaagtcatttcgcagctcccagcaataaaagataacgtcaaggaggttatgttttattgctaa

SEQ ID NO: 2084 - protein, 969 aa, Arabidopsis thaliana
  G1149  Paralogous to G1146
MSNRGGGGHGGASRGRGGGRRSDQRQDQSSGQVAWPGLQQSYGGRGGSVSAGRGRGNVGRGENTGDLTATQVPVASAVSGGRGRGNIGDPTFSVASSSKTVSVASSSKEESKNTEVSETMSNLQITSTETKPEMTSLPPASSKAVTFPVRPGRGTLGKKVMVRANHFLVQVADRDLYHYDVSINPEVISKTVNRNVMKLLVKNYKDSHLGGKSPAYDGRKSLYTAGPLPFDSKEFVVNLAEKRADGSSGKDRPFKVAVKNVTSTDLYQLQQFLDRKQREAPYDTIQVLDVVLRDKPSNDYVSVGRSFFHTSLGKDARDGRGELGDGIEYWRGYFQSLRLTQMGLSLNIDVSARSFYEPIVVTDFISKFLNIRDLNRPLRDSDRLKVKKVLRTLKVKLLHWNGTKSAKISGISSLPIRELRFTLEDKSEKTVVQYFAEKYNYRVKYQALPAIQTGSDTRPVYLPMELCQIDEGQRYTKRLNEKQVTALLKATCQRPPDRENSIKNLVVKNNYNDDLSKEFGMSVTTQLASIEARVLPPPMLKYHDSGKEKMVNPRLGQWNMIDKKMVNGAKVTSWTCEFKPQPAIPFISCPPEHIEEALLDIHKRAPGLQLLIVILPDVTGSYGKIKRICETELGIVSQCCQPRQVNKLNKQYMENVALKINVKTGGRNTVLNDAIRRNIPLITDRPTIIMGADVTHPQPGEDSSPSIAAVVASMDWPEINKYRGLVSAQAHREEIIQDLYKLVQDPQRGLVHSGLIREHFIAFRRATGQIPQRIIFYRDGVSEGQFSQVLLHEMTAIRKACNSLQENYVPRVTFVIVQKRHHTRLFPEQHGNRDMTDKSGNIQPGTVVDTKICHPNEFDFYLNSHAGIQGTSRPAHYHVLLDENGFTADQLQMLTNNLCYTYARCTKSVSIVPPAYYAHLAAFRARYYMESEMSDGGSSRSRSSTTGVGQVISQLPAIKDNVKEVMFYC

SEQ ID NO: 2085 - DNA, 3147 bp, Arabidopsis thaliana
  G1152  Predicted polypeptide sequence is paralogous to G1146
atggtgagaaagagaagaacggatgctccatctgaaggaggtgaaggctctgggtctcgtgaagctggtccagtctcaggtggtggacgtggttcacagcgaggtggtttccagcagggaggaggacaacaccaaggtggaaggggttatactcctcaacctcaacagggaggtcgtggtggtcgtggatatgggcaaccaccacaacagcaacaacagtatggaggaccacaagagtaccaaggaagaggaagaggaggacctcctcatcaaggaggtcgaggagggtatggcggtggccgtggaggtggaccttcttctggaccaccgcagagacaatcagttcccgagctgcatcaagctacctcacctacttatcaagcggtgtcttctcagcctacactgtctgaggtgagtcctacccaggtaccagaacctactgttctggctcagcaatttgaacaactctctgttgaacaaggagctcccagtcaggcaatccagcctataccttcttctagcaaggctttcaagtttccaatgaggcctggtaaaggacagagtggaaagcgttgcattgtgaaggctaaccatttctttgctgaactgcctgataaggatttgcaccattatgatgttaccattactccggaagttacatcaaggggtgtcaatcgtgctgtgatgaaacaacttgttgataattatcgtgattctcaccttggaagtcgtcttccagcgtatgatggtcgaaaaagtctttacactgctggtccacttccctttaactccaaggagttcagaatcaatcttcttgacgaagaagtaggggctggaggtcaaagacgagaaagggaatttaaagttgtgatcaagctagttgcacgtgctgatctgcatcacctaggaatgtttttggaggggaaacaatcagatgccccacaggaagctctgcaggttcttgacattgttcttcgtgagctgccgacctctaggtatattccggtgggccggtccttttattcccctgatataggaaaaaaacaatcattgggggatggcttggagagctggcgtggattctaccaaagcattcgtcctacacagatgggcttatcactcaatattgatatgtcatcgacagccttcatagaggcaaaccctgtgattcagtttgtctgtgatttgcttaaccgggatatttcttctcgacctttatctgatgctgatcgtgttaagataaaaaaggctcttagaggtgtcaaagttgaagtgactcatcgaggaaacatgcgccggaagtaccgcatttccggtttgactgctgtggccactcgggaattgacattcccagtagatgaaagaaatactcagaaatctgttgtagaatacttccacgaaacatatggttttcgcattcagcacactcaactaccatgcttgcaagttgggaattctaataggcctaattacttaccaatggaggtatgcaagattgttgaaggccagcggtattccaaaagattgaatgagagacagatcactgctttgctgaaggttacctgtcagcgcccgatagatcgagaaaaagatatcttacagacggtgcaactcaatgattatgctaaagataattatgctcaagagtttggcatcaaaataagtacttctctggcttctgttgaggctcgtatactgcctcctccatggcttaagtaccacgagtctggaagggaagggacttgtctgccacaagttggtcaatggaacatgatgaataagaaaatgatcaatggtggaacggtgaataattggatctgcatcaacttttctaggcaagtgcaggacaatctagcgcgtacattttgtcaggaacttgctcaaatgtgttacgtatctggcatggcatttaatccggaaccagtcctcccaccagtcagtgctcgccctgagcaagtagagaaggtcttgaagactagatatcatgatgccacatcaaaactctcccaaggaaaagaaattgatctgcttattgtcattctgcccgataataatggatcattatacggtgatttgaaacgcatatgtgagactgaactcggcatagtctctcaatgttgcctgacaaagcatgtctttaagatgagcaaacaatacatggctaatgttgcgctgaagattaatgtgaaggttggaggaagaaacacagtgcttgttgatgctctatctaggcggattcctctagtcagtgatcgacccaccattatatttggtgctgatgttacccaccctcaccctggagaggattcaagcccatctattgctgctgttgtggcatctcaggattggcctgaaatcactaaatatgctggattagtttgcgctcaagcgcataggcaggagctcattcaggatctgttcaaagagtggaaggatcctcagaaaggtgtggtgactggtggcatgataaaggagttgctcatagccttccgtagatcaactgggcataaaccactaaggatcatcttctacagggatggagtcagtgagggacaattttaccaagttttgctctatgaacttgatgccatccgcaaggcctgtgcttcgctggaagcaggttatcaaccaccagtgacatttgtggtggtgcagaagcgtcatcacacgaggctgtttgctcagaaccacaatgatcgccattcggtggacagaagtgggaatattttacctggcactgttgtggactctaaaatctgccaccctacagagtttgacttttacctctgtagtcatgctggtattcagggcacttctcgacctgctcattaccacgttctttgggatgagaacaactttactgcagatggacttcaatctctgaccaataacttatgttacacgtatgcaagatgcacacgctcagtttcaattgttccccctgcatattatgcacatctagcagcttttagggctcgattctacatggagccagagacatcagacagtggctcaatggctagtgggagcatggcacgtggaggtggaatggctggtagaagcacacgcgggcctaatgtcaatgctgcagtgaggccactcccagctctgaaagagaatgtgaagcgtgtcatgttctactgctga

SEQ ID NO: 2086 - protein, 1048 aa, Arabidopsis thaliana
  G1152  Paralogous to G1146
MVRKRRTDAPSEGGEGSGSREAGPVSGGGRGSQRGGFQQGGGQHQGGRGYTPQPQQGGRGGRGYGQPPQQQQQYGGPQEYQGRGRGGPPHQGGRGGYGGGRGGGPSSGPPQRQSVPELHQATSPTYQAVSSQPTLSEVSPTQVPEPTVLAQQFEQLSVEQGAPSQAIQPIPSSSKAFKFPMRPGKGQSGKRCIVKANHFFAELPDKDLHHYDVTITPEVTSRGVNRAVMKQLVDNYRDSHLGSRLPAYDGRKSLYTAGPLPFNSKEFRINLLDEEVGAGGQRREREFKVVIKLVARADLHHLGMFLEGKQSDAPQEALQVLDIVLRELPTSRYIPVGRSFYSPDIGKKQSLGDGLESWRGFYQSIRPTQMGLSLNIDMSSTAFIEANPVIQFVCDLLNRDISSRPLSDADRVKIKKALRGVKVEVTHRGNMRRKYRISGLTAVATRELTFPVDERNTQKSVVEYFHETYGFRIQHTQLPCLQVGNSNRPNYLPMEVCKIVEGQRYSKRLNERQITALLKVTCQRPIDREKDILQTVQLNDYAKDNYAQEFGIKISTSLASVEARILPPPWLKYHESGREGTCLPQVGQWNMMNKKMINGGTVNNWICINFSRQVQDNLARTFCQELAQMCYVSGMAFNPEPVLPPVSARPEQVEKVLKTRYHDATSKLSQGKEIDLLIVILPDNNGSLYGDLKRICETELGIVSQCCLTKHVFKMSKQYMANVALKINVKVGGRNTVLVDALSRRIPLVSDRPTIIFGADVTHPHPGEDSSPSIAAVVASQDWPEITKYAGLVCAQAHRQELIQDLFKEWKDPQKGVVTGGMIKELLIAFRRSTGHKPLRIIFYRDGVSEGQFYQVLLYELDAIRKACASLEAGYQPPVTFVVVQKRHHTRLFAQNHNDRHSVDRSGNILPGTVVDSKICHPTEFDFYLCSHAGIQGTSRPAHYHVLWDENNFTADGLQSLTNNLCYTYARCTRSVSIVPPAYYAHLAAFRARFYMEPETSDSGSMASGSMARGGGMAGRSTRGPNVNAAVRPLPALKENVKRVMFYC

SEQ ID NO: 2087 - DNA, 1374 bp, Arabidopsis thaliana
  G1211  Predicted polypeptide sequence is paralogous to G291
  misc_feature (1144)..(1144): n is a, c, g, or t
  misc_feature (1209)..(1209): n is a, c, g, or t
  misc_feature (1212)..(1212): n is a, c, g, or t
  misc_feature (1238)..(1238): n is a, c, g, or t
  misc_feature (1254)..(1254): n is a, c, g, or t
  misc_feature (1260)..(1261): n is a, c, g, or t
  misc_feature (1296)..(1296): n is a, c, g, or t
  misc_feature (1322)..(1322): n is a, c, g, or t
  misc_feature (1325)..(1325): n is a, c, g, or t
  misc_feature (1360)..(1360): n is a, c, g, or t
tgaaacctagatttctgcaactgaattcctaattcgaaaaagaatggagggttcgtcgtcgacgatagcaaggaagacatgggaactagagaacagcattctaacagtagactcacctgattcaacctccgacaacatcttctactacgacgatacttcacagactaggttccagcaagagaaaccgtgggagaatgatcctcactactttaaacgagtcaagatctcagcgctcgctcttcttaagatggtggttcacgctcgctctggtggtacaattgaaataatgggtcttatgcaaggtaagaccgatggtgatactatcattgttatggatgcttttgctttaccagtggaaggtactgagacaagggttaatgctcaggatgatgcttatgagtacatggttgagtattcacagaccaacaagctcgcggggcggctggagaatgttgttggatggtatcactctcaccctggatatggatgctggctctccggtattgatgtttctacgcagacgcttaaccaacagcatcaggagccatttttagctgttgttattgatcccacaaggactgtttcagctggtaaggttgagattggtgctttcagaacatactctaaaggatataagcctccagatgaacctgtttctgagtatcaaactattcctttaaataagattgaggactttggtgttcactgcaaacagtactattcattagatgtcacttatttcaagtcatctcttgattctcaccttctggatctactatggaacaagtactgggtgaacactctttcttcttctccactgctgggtaatggagactatgttgctggacaaatatcagacttagctgagaagcttgagcaagccgagagtcatctggttcagtctcgctttggaggagttgtgccatcatcccttcataagaaaaaagaagatgagtctcaactaactaagataactcgggatagcgcaaagataactgtggaacaggtccatggactaatgtcgcaggtcataaaagatgaattattcaactcaatgcgtcagtccaacaacaaatctcccactgactcgtcggatccagaccctatgattacatattgaagttgctcttcttttggtttctanttttggattgacccatcatttgttgtcctttcatttattttctgttgtgtaaagaattataatgncgncgcgaattcgcggccgctaaaaaaanacaggaaattgaaaanaattcnnccattccaacatctttatttaatattatctcctcnattatataatattcaaacatccctantancttcatttgaccgtccccctccctcccgtgttgcnttggtgctggcccc

SEQ ID NO: 2088 - protein, 358 aa, Arabidopsis thaliana
  G1211  Paralogous to G291
MEGSSSTIARKTWELENSILTVDSPDSTSDNIFYYDDTSQTRFQQEKPWENDPHYFKRVKISALALLKMVVHARSGGTIEIMGLMQGKTDGDTIIVMDAFALPVEGTETRVNAQDDAYEYMVEYSQTNKLAGRLENVVGWYHSHPGYGCWLSGIDVSTQTLNQQHQEPFLAVVIDPTRTVSAGKVEIGAFRTYSKGYKPPDEPVSEYQTIPLNKIEDFGVHCKQYYSLDVTYFKSSLDSHLLDLLWNKYWVNTLSSSPLLGNGDYVAGQISDLAEKLEQAESHLVQSRFGGVVPSSLHKKKEDESQLTKITRDSAKITVEQVHGLMSQVIKDELFNSMRQSNNKSPTDSSDPDPMITY

SEQ ID NO: 2089 - DNA, 911 bp, Arabidopsis thaliana
  G1277  Predicted polypeptide sequence is paralogous to G24
attctaaagtcctcctctcggaaagtaagagactcaacttccgagccgccatggacgccggagtagcagtaaaagctgacgtggcagtcaaaatgaagagagaaagaccattcaaagggatcagaatgagaaaatgggggaaatgggttgcggagattcgagaacccaacaagcgttcaagactttggctcggctcttactctactcccgaagcggcggcgcgtgcatacgacacggctgtcttttacctcagaggaccaactgctacgctcaacttcccggagcttctgccgtgtacctccgccgaggatatgtcagcggcaacgatcaggaaaaaggcgacggaggtgggagctcaagtagatgcgataggggcgacggtggtgcagaacaacaaacgccgccgcgtttttagtcaaaagcgtgactttggcggcgggttattagagcttgttgacttgaacaagttacctgacccggaaaatctcgatgatgatttggtgggaaaatagactgaaaaataataataaaatatcttacaatggtggctgtagctatcgtacgcggaatgcttgggcttgtgttatatgactacgtggttacggaaagattcctctgtttcgtcattgtattaaaatttaatcccacaagtcaaacatactgtacattattcttaatttagtattttcttattaatatctatcatttgtttggtgaacaccagaatattagactattaatgtaacgagtttttaatatttcgatcataataacaccaagctagttaaaggttaatatcttgttacgaagtcttgagtaagttcaattgtcatatatatgtaacggaagaggttcgttcgggtcccaagtgaagtggatcaaaggtgacttcacataaaaaataaaaaaaa

SEQ ID NO: 2090 - protein, 153 aa, Arabidopsis thaliana
  G1277  Paralogous to G24
MDAGVAVKADVAVKMKRERPFKGIRMRKWGKWVAEIREPNKRSRLWLGSYSTPEAAARAYDTAVFYLRGPTATLNFPELLPCTSAEDMSAATIRKKATEVGAQVDAIGATVVQNNKRRRVFSQKRDFGGGLLELVDLNKLPDPENLDDDLVGK

SEQ ID NO: 2091 - DNA, 2083 bp, Arabidopsis thaliana
  G1290  Predicted polypeptide sequence is paralogous to G278
aattccactgttattagactcttgactctgttttgtttcccgccgatctcgtgatgatggccaccaccaccaccaccaccaccgctagattctctgattcatacgagttcagcaacacaagcggcaatagcttcttcgccgccgagtcatctcttgattatccgacggaatttctcacgccaccggaggtatcagctcttaaacttctgtctaactgcctcgagtctgttttcgactcgccggagacgttctacagcgatgctaagctagttctcgccggcggccgggaagtttcttttcaccgttgtattctttccgcgagaattcctgtcttcaaaagcgctttagccaccgtgaaggaacaaaaatcctccaccaccgtgaagctccagctgaaagagatcgccagagattacgaagtcggctttgactcggttgtggcggttttggcgtatgtttacagcggcagagtgaggtccccgccgaagggagcttctgcttgcgtagacgacgattgttgccacgtggcttgccggtcaaaggtggatttcatggtggaggttctttatctgtctttcgttttccagattcaagaattagttactctgtatgagaggcagttcttggaaattgtagacaaagttgtagtcgaagacatcttggttatattcaagcttgatactctatgtggtacaacatacaagaagcttttggatagatgcatagaaattatcgtgaagtctgatatagaactagttagtcttgagaagtctttacctcaacacattttcaagcaaatcatagacatccgcgaagcgctctgtctagagccacctaaactagaaaggcatgtcaagaacatatacaaggcgctagactcagatgatgttgagcttgtcaagatgcttttgctagaaggacacaccaatctcgatgaggcgtatgctcttcattttgctatcgctcactgcgctgtgaagaccgcgtatgatctcctcgagcttgagcttgcggatgttaaccttagaaatccgaggggatacactgtgcttcatgttgctgcgatgcggaaggagccgaagttgataatatctttgttaatgaaaggggcaaatattttagacacaacattggatggtagaaccgctttagtgattgtaaaacgactcactaaagcggatgactacaaaactagtacggaggacggtacgccttctctgaaaggcggattatgcatagaggtacttgagcatgaacaaaaactagaatatttgtcgcctatagaggcttcactttctcttccagtaactccagaggagttgaggatgaggttgctctattatgaaaaccgagttgcacttgctcgacttctctttccagtggaaactgaaactgtacagggtattgccaaattggaggaaacatgcgagtttacagcttctagtctcgagcctgatcatcacattggtgaaaagcggacatcactagacctaaatatggcgccgttccaaatccatgagaagcatttgagtagactaagagcactttgtaaaaccgtggaactggggaaacgctacttcaaacgatgttcgcttgatcactttatggatactgaggacttgaatcatcttgctagcgtagaagaagatactcctgagaaacggctacaaaagaagcaaaggtacatggaactacaagagactctgatgaagacctttagtgaggacaaggaggaatgtggaaagtcttccacaccgaaaccaacctctgcggtgaggtctaatagaaaactctctcaccggcgcctaaaagtggacaaacgggattttttgaaacgaccttacgggaacggggattaaggaatgggaaatcatattccatttcactcccacaactaaaaatgatgtatgtcctatatcatgatgtttcgtgagtttcaaataaattgaaacgtacatatatcagtttttcatctacgtgactgcgttgtatagttttcgttcttcacttagcatcatgtgtattctagctccaagtgcgtttcaaacaaatatagttatttttagccaattatatatacggt

SEQ ID NO: 2092 - protein, 601 aa, Arabidopsis thaliana
  G1290  Paralogous to G278
MMATTTTTTTARFSDSYEFSNTSGNSFFAAESSLDYPTEFLTPPEVSALKLLSNCLESVFDSPETFYSDAKLVLAGGREVSFHRCILSARIPVFKSALATVKEQKSSTTVKLQLKEIARDYEVGFDSVVAVLAYVYSGRVRSPPKGASACVDDDCCHVACRSKVDFMVEVLYLSFVFQIQELVTLYERQFLEIVDKVVVEDILVIFKLDTLCGTTYKKLLDRCIEIIVKSDIELVSLEKSLPQHIFKQIIDIREALCLEPPKLERHVKNIYKALDSDDVELVKMLLLEGHTNLDEAYALHFAIAHCAVKTAYDLLELELADVNLRNPRGYTVLHVAAMRKEPKLIISLLMKGANILDTTLDGRTALVIVKRLTKADDYKTSTEDGTPSLKGGLCIEVLEHEQKLEYLSPIEASLSLPVTPEELRMRLLYYENRVALARLLFPVETETVQGIAKLEETCEFTASSLEPDHHIGEKRTSLDLNMAPFQIHEKHLSRLRALCKTVELGKRYFKRCSLDHFMDTEDLNHLASVEEDTPEKRLQKKQRYMELQETLMKTFSEDKEECGKSSTPKPTSAVRSNRKLSHRRLKVDKRDFLKRPYGNGD

SEQ ID NO: 2093 - DNA, 925 bp, Arabidopsis thaliana
  G1329  Predicted polypeptide sequence is paralogous to G663
ccacgcgtccgtaccttttacaatttgtttatatattttacgtatctatctttgttccatggagggttcgtccaaagggctgcgaaaaggtgcttggactactgaagaagatagtctcttgagacagtgcattaataagtatggagaaggcaaatggcaccaagttcctgtaagagctgggctaaaccggtgcaggaaaagttgtagattaagatggttgaactatttgaagccaagtatcaagagaggaaaacttagctctgatgaagtcgatcttcttcttcgccttcataggcttctagggaataggtggtctttaattgctggaagattacctggtcggaccgcaaatgacgtcaagaattactggaacactcatctgagtaagaaacatgaaccgtgttgtaagataaagatgaaaaagagagacattacgcccattcctacaacaccggcactaaaaaacaatgtttataagcctcgacctcgatccttcacagttaacaacgactgcaaccatctcaatgccccaccaaaagttgacgttaatcctccatgccttggacttaacatcaataatgtttgtgacaatagtatcatatacaacaaagataagaagaaagaccaactagtgaataatttgattgatggagataatatgtggttagagaaattcctaaggaaagccaagaggtagatattttggttcctgaagcgacgacaacagaaaagggggacaccttggcttttgacgttgatcaactttggagtcttttcgatggagagactgtgaaatttgattagtgtttcgaacatttgtttgcgtttgtgtataggtttgctttcaccttttaatttgtgtgttttgataaataagctaatagtttttagcattttaatgaaatatttcaagtttccgtgttac

SEQ ID NO: 2094 - protein, 212 aa, Arabidopsis thaliana
  G1329  Paralogous to G663
MEGSSKGLRKGAWTTEEDSLLRQCINKYGEGKWHQVPVRAGLNRCRKSCRLRWLNYLKPSIKRGKLSSDEVDLLLRLHRLLGNRWSLIAGRLPGRTANDVKNYWNTHLSKKHEPCCKIKMKKRDITPIPTTPALKNNVYKPRPRSFTVNNDCNHLNAPPKVDVNPPCLGLNINNVCDNSIIYNKDKKKDQLVNNLIDGDNMWLEKFLRKAKR

SEQ ID NO: 2095 - DNA, 965 bp, Arabidopsis thaliana
  G1335  Predicted polypeptide sequence is paralogous to G652
tttttttttaaaagatttagagagaaaagtgagttattaagagattccaatcaaaatgagcggagacaacggcggtggtgagaggcgcaaaggctccgtcaagtggtttgatacccagaagggtttcggcttcatcactcctgacgacggtggcgacgatctcttcgttcaccagtcctccatcagatctgagggtttccgtagcctcgctgccgaagaagccgtagagttcgaggttgagatcgacaacaacaaccgtcccaaggccatcgatgtttctggacccgacggcgctcccgtccaaggaaacagcggtggtggttcatctggcggacgcggcggtttcggtggaggaagaggaggtggacgcggatctggaggtggatacggcggtggcggtggtggatacggaggaagaggaggtggtggtcgaggaggcagcgactgctacaagtgtggtgagcccggtcacatggcgagagactgttctgaaggcggtggaggttacggaggaggcggcggtggctacggaggtggaggcggatacggcggaggaggtggtggttacggaggtggtggccgtggaggtggtggcggcgggggaagctgctacagctgtggcgagtcgggacatttcgccagggattgcaccagcggtggacgttaaaaccaacgccggttacgcggtggagaagagtgagttggttatctcacaagtgatcggttctttctcccgccgccttctatctctctattatccactttttgcttattatgatggatctctatctttgttagttggttttttcttgatggtttcggattaggactcttcttttggttttgctacttatggttggttttatttatggtacttgtgatatgggtgaaatgctctacttgttgctctgtttcaagtgttcataatatgcgaacaaatattctgggttttgtttcaaaaaaaa

SEQ ID NO: 2096 - protein, 203 aa, Arabidopsis thaliana
  G1335  Paralogous to G652
MSGDNGGGERRKGSVKWFDTQKGFGFITPDDGGDDLFVHQSSIRSEGFRSLAAEEAVEFEVEIDNNNRPKAIDVSGPDGAPVQGNSGGGSSGGRGGFGGGRGGGRGSGGGYGGGGGGYGGRGGGGRGGSDCYKCGEPGHMARDCSEGGGGYGGGGGGYGGGGGYGGGGGGYGGGGRGGGGGGGSCYSCGESGHFARDCTSGGR

SEQ ID NO: 2097 - DNA, 1230 bp, Arabidopsis thaliana
  G1349  Predicted polypeptide sequence is paralogous to G896
atggctagtcggagagaagtacggtgccggtgcggcagacggatgtgggttcaaccagacgcccgtaccgtccaatgctcaacctgccacaccgtcacgcagctctactcgctagtggacatagctcgcggtgcaaaccgcataattcatgggtttcaacagctacttagacaacaccaaccgcaacatcatgaacaacaacaacaacaaatgatggctcaaccgccaccacggctgcttgagcctcttccctcgccgtttgggaagaagagagcagttttatgcggcgtgaactataagggaaaaagttatagcttgaaaggttgcatcagtgatgctaagtccatgagatctttattggttcaacaaatgggtttccctattgactctattctcatgctcacagaagatgaagccagcccgcagagaataccgacgaagagaaacattaggaaggcgatgagatggttagttgaagggaacagagcaagggactcactagtgttccatttctctggtcatggatctcagcagaatgactacaacggagacgagatcgatggtcaagatgaagccttgtgccctttagaccatgaaacagaaggaaaaatcattgatgacgagattaaccggatactcgtgaggcctctcgtccatggagctaagcttcacgctgtcatcgacgcctgtaacagcgggactgtccttgatttacccttcatttgcaggatggagaggaatggttcttatgaatgggaagaccatagatcagtcagagcttacaaaggaacagatggtggagcagctttctgtttcagtgcttgtgacgatgatgaatccagtggttacactcctgtgttcacggggaagaacacaggagccatgacttatagcttcataaaggcggtgaagacagctggaccagcacccacgtatggccacctgcttaaccttatgtgttctgcaatacgagaggcccagtctcgcctcgcctttaacggggactacacaagctctgatgcatccgcggagccactgctaacatcatctgaggaatttgacgtgtacgcgacaaagtttgtactctgaatgctgtacatatgatgctgcaaatagctcggaaacgtttctatgtgtatgtatcatgtaatgattatgttgcatagcctctctcttcttacgagcaataagctatgaaataattgattcgctaagaaatttaaaatgaaa

SEQ ID NO: 2098 - protein, 362 aa, Arabidopsis thaliana
  G1349  Paralogous to G896
MASRREVRCRCGRRMWVQPDARTVQCSTCHTVTQLYSLVDIARGANRIIHGFQQLLRQHQPQHHEQQQQQMMAQPPPRLLEPLPSPFGKKRAVLCGVNYKGKSYSLKGCISDAKSMRSLLVQQMGFPIDSILMLTEDEASPQRIPTKRNIRKAMRWLVEGNRARDSLVFHFSGHGSQQNDYNGDEIDGQDEALCPLDHETEGKIIDDEINRILVRPLVHGAKLHAVIDACNSGTVLDLPFICRMERNGSYEWEDHRSVRAYKGTDGGAAFCFSACDDDESSGYTPVFTGKNTGAMTYSFIKAVKTAGPAPTYGHLLNLMCSAIREAQSRLAFNGDYTSSDASAEPLLTSSEEFDVYATKFVL

SEQ ID NO: 2099 - DNA, 1008 bp, Arabidopsis thaliana
  G1357  Predicted polypeptide sequence is paralogous to G1452
atggcagctgcaccaccgatcgagccggcggtgacgacgacgttccctggcttcaaattctccccgaccgacatcgaacttatatcttattacttgaagaggaagatggatggtttggagagatctgttgagattatacctgaggttgagatttacaacttcgagccttgggatttacctgataagtctatcgttaaatcggatagcgaatggttcttcttctgtgctcgcggtaagaagtatccccacggttcacagaacagaagagcaaccaagataggatattggaaagccacaggaaaagagcgtaatgtgaagtcaggttctgaggtcattggaacaaagagaacgcttgtattccacattggccgcgcgccaaaaggaggaagaacggaatggcttatgcatgagtactgcatgattggagtatcactggatgctctggttatttgccgacttaggaggaatactgaatttcaagggagtacaattcaaaagccaccacaaccaagtttaccactggataagcacgtaaacttgcggaatgaagctatttcagaaagtatttatggttgggaaactatggttgatttctacttatcaagtgagtcagggcaagaactacttagtgaaatagcagaatcttcacaatcttcacaaaatccacaggttcctagtgaagaagatttctatgccgatatactgagggatgaaatagtaaagctagatgatccggcggtatccggtaatacactgatcaatgtaccaaggcttcaaacagagtccaataccacaagagtactacctttacctgacatggtagacaaacaaatgcaatcgttgctacagaaactaccattacaaaatgacactggagaagagaacaacatatccatgtcaaattgctttatcggtatctactcgattaagtctataaaccgagcgcgatgggacgttgttgtttggttactcgttatgatagccgtgttggtgttttatttagtgtga

SEQ ID NO: 2100 - protein, 335 aa, Arabidopsis thaliana
  G1357  Paralogous to G1452
MAAAPPIEPAVTTTFPGFKFSPTDIELISYYLKRKMDGLERSVEIIPEVEIYNFEPWDLPDKSIVKSDSEWFFFCARGKKYPHGSQNRRATKIGYWKATGKERNVKSGSEVIGTKRTLVFHIGRAPKGGRTEWLMHEYCMIGVSLDALVICRLRRNTEFQGSTIQKPPQPSLPLDKHVNLRNEAISESIYGWETMVDFYLSSESGQELLSEIAESSQSSQNPQVPSEEDFYADILRDEIVKLDDPAVSGNTLINVPRLQTESNTTRVLPLPDMVDKQMQSLLQKLPLQNDTGEENNISMSNCFIGIYSIKSINRARWDVVVWLLVMIAVLVFYLV

SEQ ID NO: 2101 - DNA, 537 bp, Arabidopsis thaliana
  G1364  Predicted polypeptide sequence is paralogous to G481, G482
atggcggagtcgcaggccaagagtcccggaggctgtggaagccatgagagtggtggagatcaaagtcccaggtcgttacatgttcgtgagcaagataggtttcttccgattgctaacataagccgtatcatgaaaagaggtcttcctgctaatgggaaaatcgctaaagatgctaaggagattgtgcaggaatgtgtctctgaattcatcagtttcgtcaccagcgaagcgagtgataaatgtcaaagagagaaaaggaagactattaatggagatgatttgctttgggcaatggctactttaggatttgaagactacatggaacctctcaaggtttacctgatgagatatagagagggtgacacaaagggatcagcaaaaggtggggatccaaatgcaaagaaagatgggcaatcaagccaaaatggccagttctcgcagcttgctcaccaaggtccttatgggaactctcaagtaacttttcctctcttctcttcacactcaagcaatacgcatcattctcttctaatttgttaa

SEQ ID NO: 2102 - protein, 178 aa, Arabidopsis thaliana
  G1364  Paralogous to G481, G482
MAESQAKSPGGCGSHESGGDQSPRSLHVREQDRFLPIANISRIMKRGLPANGKIAKDAKEIVQECVSEFISFVTSEASDKCQREKRKTINGDDLLWAMATLGFEDYMEPLKVYLMRYREGDTKGSAKGGDPNAKKDGQSSQNGQFSQLAHQGPYGNSQVTFPLFSSHSSNTHHSLLIC

SEQ ID NO: 2103 - DNA, 839 bp, Arabidopsis thaliana
  G1379  Predicted polypeptide sequence is paralogous to G24
ctctgcctctctctctctctcaaaacccatctcgaaagtctttctctttcgagggtttagatcctccatggaaggcggcggagttgctgacgtggctgtccccggtacgaggaagagagacagaccttacaaaggaattaggatgaggaagtggggaaagtgggtggcggagattcgtgagcctaacaagcgctctaggttatggcttggctcttactctactcccgaggcggcggcgcgagcttacgacacggcggttttctatcttagaggacctacggcgaggcttaacttccctgagcttcttcctggggagaaattctccgacgaggatatgtcggctgcgaccatcaggaagaaagccacggaggtcggtgctcaggttgatgctttgggcacggcggtgcaaaataaccgccaccgtgtttttggtcagaatcgagatagtgatgtggataataagaattttcatcggaattatcaaaacggtgaacgagaagaagaagaagaagatgaggatgacaagagattgaggagtggcggccggttattggatcgggttgacttgaataaattacccgacccggaaagctccgatgaagaatgggaaagcaaacattaaaaatatatagtttggagcggtggctgttgctaacgtacgccaacggcttgcttctacgaatcattagcgccgtttatgatttttttttttttttttttcattatctgaaaatttagggctttttagttattaatttttgttttgtttttttcctttcttgcgagttttgcggtttatggaattttaggctattgcttaacgaaaaaaaaaaaaaaaa

SEQ ID NO: 2104 - protein, 184 aa, Arabidopsis thaliana
  G1379  Paralogous to G24
MEGGGVADVAVPGTRKRDRPYKGIRMRKWGKWVAEIREPNKRSRLWLGSYSTPEAAARAYDTAVFYLRGPTARLNFPELLPGEKFSDEDMSAATIRKKATEVGAQVDALGTAVQNNRHRVFGQNRDSDVDNKNFHRNYQNGEREEEEEDEDDKRLRSGGRLLDRVDLNKLPDPESSDEEWESKH

SEQ ID NO: 2105 - DNA, 844 bp, Arabidopsis thaliana
  G1387  Predicted polypeptide sequence is paralogous to G975, G2583
tctctctcccactctcactttctctcctattcttagttcgtgtcagaaacacacagagaaattaagaaccctaatttaaaacagaagaatggtacattcgaagaagttccgaggtgtccgccagcgtcagtggggttcttgggtttctgagattcgtcatcctctcttgaagagaagagtgtggctaggaacattcgacacggcggaaacagcggctagagcctacgaccaagccgcggttctaatgaacggccagagcgcgaagactaacttccccgtcatcaaatcgaacggttcaaattccttggagattaactctgcgttaaggtctcccaaatcattatcggaactattgaacgctaagctaaggaagaactgtaaagaccagacaccgtatctgacgtgtctccgcctcgacaacgacagctcacacatcggcgtctggcagaaacgcgccgggtcaaaaacgagtccaaactgggtcaagcttgttgaactaggtgacaaagttaacgcacgtcccggtggtgatattgagactaataagatgaaggtacgaaacgaagacgttcaggaagatgatcaaatggcgatgcagatgatcgaggagttgcttaactggacctgtcctggatctggatccattgcacaggtctaaaggagaatcattgaattatatgatcaagataataatatagttgagggttaataataatcgagggtaagtaatttacgtgtagctaataattaatataattttcgaacatatatatgaatatatgatagctctagaaatgagtacgtatatatacgtaaacatttttcctcaaatatagtatatgtg

SEQ ID NO: 2106 - protein, 189 aa, Arabidopsis thaliana
  G1387  Paralogous to G975, G2583
MVHSKKFRGVRQRQWGSWVSEIRHPLLKRRVWLGTFDTAETAARAYDQAAVLMNGQSAKTNFPVIKSNGSNSLEINSALRSPKSLSELLNAKLRKNCKDQTPYLTCLRLDNDSSHIGVWQKRAGSKTSPNWVKLVELGDKVNARPGGDIETNKMKVRNEDVQEDDQMAMQMIEELLNWTCPGSGSIAQV

SEQ ID NO: 2107 - DNA, 1164 bp, Arabidopsis thaliana
  G1425  Predicted polypeptide sequence is paralogous to G504
actctctcaaaccataaaaaatattctccgatcatcattttaatggagagtacagattcttccggtggtcctccgccgccgcaaccaaacctccctccaggattccggtttcatccaacagacgaagaacttgtaattcattacctcaaacgcaaagcagattctgttcctttaccagtcgcgatcatcgccgacgttgatctttacaaatttgatccatgggaacttcccgcgaaagcttcgtttggagaacaagaatggtattttttcagtccaagagatcggaaatatcccaacggagctagacctaaccgagctgcgacttccggttattggaaagcgactggtacagataaaccggtgatttcaaccggcggtggtggtagtaaaaaagtgggagttaaaaaggctctagtgttttacagtggtaaaccaccaaaaggagttaaatcagattggattatgcatgaatatcggttaactgataataaacctactcacatttgtgacttcggcaacaagaaaaactctctcaggcttgatgattgggtgttgtgtcgtatctacaagaaaaacaatagtacagcatctagacatcatcatcatcttcatcatattcatctagataatgatcatcatcgtcatgatatgatgattgatgatgatcgattccgtcatgttcctcctggtcttcacttcccggcgattttttctgacaataatgatccgacggctatatatgatggtggcggcggcggatacggaggtggaagttactcgatgaatcattgtttcgcatctggatcaaagcaggagcagttgtttccaccggtgatgatgatgactagtctaaatcaagattccggtattggatcgtcgtcgtcacctagcaagagatttaacggcggcggcgttggagattgttcgacttctatggcggcgacgccgttaatgcagaaccaaggtgggatttaccaattgcctggtttgaattggtattcttgaaaacaatttacgatgaagaatttttaaaatttgtgtatatatatacggtttgagtgattagggggcattgggggatttatttacggttgattattattgtagtgttatagaactaaggagattaaattaaatagattggaggaaaaaaaaaaaaaaaaa

SEQ ID NO: 2108 - protein, 320 aa, Arabidopsis thaliana
  G1425  Paralogous to G504
MESTDSSGGPPPPQPNLPPGFRFHPTDEELVIHYLKRKADSVPLPVAIIADVDLYKFDPWELPAKASFGEQEWYFFSPRDRKYPNGARPNRAATSGYWKATGTDKPVISTGGGGSKKVGVKKALVFYSGKPPKGVKSDWIMHEYRLTDNKPTHICDFGNKKNSLRLDDWVLCRIYKKNNSTASRHHHHLHHIHLDNDHHRHDMMIDDDRFRHVPPGLHFPAIFSDNNDPTAIYDGGGGGYGGGSYSMNHCFASGSKQEQLFPPVMMMTSLNQDSGIGSSSSPSKRFNGGGVGDCSTSMAATPLMQNQGGIYQLPGLNWYS

SEQ ID NO: 2109 - DNA, 1319 bp, Arabidopsis thaliana
  G1454  Predicted polypeptide sequence is paralogous to G504
ctagtagtgatgatatgatcgcttcttctcctacaatctcagaaacctccgatcacggttttagatatcttctacaacggatacaatggagagcaccgattcttccggtggtccaccaccgccacaacctaaccttcctccaggcttccggtttcaccctaccgacgaagagcttgttgttcactacctcaaacgcaaagcagcctctgctcctttacctgtcgccatcatcgccgaagtcgatctctataaatttgatccatgggaacttcccgctaaagcatcgtttggagaacaagaatggtacttctttagtccacgagatcggaagtatccaaacggagcaagaccaaacagagcggcgacttcaggttattggaaagcgaccggtacagataaaccggtacttgcttccgacggtaaccaaaaggtgggcgtgaagaaggcactagtcttctacagtggtaaaccaccaaaaggcgttaaaagtgattggatcatgcatgagtatcgtctcatcgaaaacaaaccaaacaatcgacctcctggctgtgatttcggcaacaaaaaaaactcactcagacttgatgattgggtgttatgtagaatctacaagaagaacaacgcaagtcgacatgttgataacgataaggatcatgatatgatcgattacattttcaggaagattcctccgtctttatcaatggcggctgcttctacaggacttcaccaacatcatcataatgtctcaagatcaatgaatttcttccctggcaaattctccggtggtggttacgggattttctctgacggtggtaacacgagtatatacgacggcggtggcatgatcaacaatattggtactgactcagtagatcacgacaataacgctgacgtcgttggtttaaatcatgcttcgtcgtcaggtcctatgatgatggcgaatttgaaacgaactctcccggtgccgtattggcctgtagcagatgaggagcaagatgcatctccgagcaaacggtttcacggtgtaggaggaggaggaggagattgttcgaacatgtcttcctccatgatggaagagactccaccattgatgcaacaacaaggtggtgtgttaggagatggattattcagaacgacatcgtaccaattacccggtttaaattggtactcttcttaatcaaatgtgtttcgccgccggtgtgaagaattttccggtgacagtgaagatttttttccgattggtggggtcatttgcatgcattatataatttgagatttgtgtatatgttttgggttaattaattggtcacaggggc

SEQ ID NO: 2110 - protein, 364 aa, Arabidopsis thaliana
  G1454  Paralogous to G504
MESTDSSGGPPPPQPNLPPGFRFHPTDEELVVHYLKRKAASAPLPVAIIAEVDLYKFDPWELPAKASFGEQEWYFFSPRDRKYPNGARPNRAATSGYWKATGTDKPVLASDGNQKVGVKKALVFYSGKPPKGVKSDWIMHEYRLIENKPNNRPPGCDFGNKKNSLRLDDWVLCRIYKKNNASRHVDNDKDHDMIDYIFRKIPPSLSMAAASTGLHQHHHNVSRSMNFFPGKFSGGGYGIFSDGGNTSIYDGGGMINNIGTDSVDHDNNADVVGLNHASSSGPMMMANLKRTLPVPYWPVADEEQDASPSKRFHGVGGGGGDCSNMSSSMMEETPPLMQQQGGVLGDGLFRTTSYQLPGLNWYSS

SEQ ID NO: 2111 - DNA, 1848 bp, Arabidopsis thaliana
  G1456  Predicted polypeptide sequence is paralogous to G1927
tttttttttgtgataacgagagagaaaaaagtgatggacttgtcggttgagaacggaggtttagctccaggttttaggtttcatccgacggacgaagaacttgtcgtctattatctcaaaagaaagatccgtcggaaaaaactcagagtcgaagcaatcggcgagactgatgtctataagtttgatcctgaggaattacctgagaaagcgttgtataagactagagatcgtcaatggttctttttcagcttaagggataggaaacatggaagtaggtcaagtagagctactgaacgtggctattggaaagcaacagggaaggatagagtcattcattgtgattcgagacccgttggagagaagaagactcttgttttccatagaggcagggcacctaatggcgaacggactaattgggtgatgcatgagtatacattgcacaaagaggagctcaagaggtgtggtggtgaagatgttaaggatgcttatgttctttacaagatttataagaaaagtgggtctggtcctaagaatggtgagcaatatggagctccttttattgaagaagaatgggctgaagatgatgatgatgatgttgatgagcctgctaatcagctcgttgtttcggctagtgttgataatagtttatgggggaaagggcttaaccaatctgaattggatgataatgatattgaagagctgatgagtcaggttagagatcagtctggtccaacattgcagcagaatggggtgtctggactgaactctcatgtagacacgtataatctggagaacctggaggaagatatgtatttggaaatcaatgatcttatggaacctgaacctgaaccaacttctgtggaagtcatggagaataactggaacgaggatggttctggtctcctgaatgatgatgatttcgttggtgctgattcatatttccttgatttgggagtgacaaatcctcagttagattttgttagtggtgatttgaaaaatgggtttgcacaaagtcttcaggtgaatacttctttaatgacttaccaggccaataataaccagttccagcagcaatcagggaagaaccaagctagtaactggccactccgtaacagctataccagacagataaacaatggatcatcgtgggtgcaggagctaaacaatgacggacttaccgttacccggtttggtgaggcgcctggtacaggtgattcatctgaattcctaaaccctgttccttctggtataagtacaactaatgaagatgacccgtcaaaagacgagtctagtaagtttgcttctagtgtatggactttcctggaatccattcctgcaaagccagcatatgcatcagagaatccatttgtgaagctgaaccttgttagaatgtcaaccagtggtggtcgtttcaggtttacttctaaaagcacaggtaataatgttgttgttatggatagtgactcagcagtgaagaggaacaagtctggaggaaacaacgataagaagaagaagaagaacaaaggtttcttttgcttatcgatcattggggctttatgtgctttgttttgggtgatcataggaacaatgggaggttcagggaggcctttgttatggtgagaaccgaaaaatccaagaggttaagagacataaaggcttggttttgtgtgaaccattagagagtcaagtcattgtaattattctcttggattattagattcagaagctgtttagtatcacagtttatgcttggaagttttctctggtattggtaaaaaagtaccaatagaaataagcaaaagaattttcttatcttttaaaaaaaaaaaaaaaaaaaaaaaaaaaaaa

SEQ ID NO: 2112 - protein, 528 aa, Arabidopsis thaliana
  G1456  Paralogous to G1927
MDLSVENGGLAPGFRFHPTDEELVVYYLKRKIRRKKLRVEAIGETDVYKFDPEELPEKALYKTRDRQWFFFSLRDRKHGSRSSRATERGYWKATGKDRVIHCDSRPVGEKKTLVFHRGRAPNGERTNWVMHEYTLHKEELKRCGGEDVKDAYVLYKIYKKSGSGPKNGEQYGAPFIEEEWAEDDDDDVDEPANQLVVSASVDNSLWGKGLNQSELDDNDIEELMSQVRDQSGPTLQQNGVSGLNSHVDTYNLENLEEDMYLEINDLMEPEPEPTSVEVMENNWNEDGSGLLNDDDFVGADSYFLDLGVTNPQLDFVSGDLKNGFAQSLQVNTSLMTYQANNNQFQQQSGKNQASNWPLRNSYTRQINNGSSWVQELNNDGLTVTRFGEAPGTGDSSEFLNPVPSGISTTNEDDPSKDESSKFASSVWTFLESIPAKPAYASENPFVKLNLVRMSTSGGRFRFTSKSTGNNVVVMDSDSAVKRNKSGGNNDKKKKKNKGFFCLSIIGALCALFWVIIGTMGGSGRPLLW

SEQ ID NO: 2113 - DNA, 1392 bp, Arabidopsis thaliana
  G1461  Predicted polypeptide sequence is paralogous to G1463
accgcccgcccgggcaggttaaacagtgaaaaaatatccgtggaagaagggtagttgagaaataaaaagagatcaacaagggtaaattaatcaatacgaaacttagatataacggttgccattaacttaaaagcacatttatgaacatgagtcttcttcgcttcatctccaagaaacaacactcatttttgcgtttaatctttctctctctcttgatcgatttagtttctttatgaggacgaaccaatgaaagttgaagacgaagcaacttatgagcttatcaaagacgaactgatgaaagcagaagacgaagcaacttattggctaatcaaagaagaactgatcaaagcagaagacgatgtaatcatctcacgttatctgaagcgtatgatcgttaacggggattcgtggcctgatcacttcatcgaagatgtagacgtgttcaacaagaatccaaatgaggagtttcattctcagagccctagattcgtgatcgttaaaccacgaacagagaattgtggtagaaccgatggatgtcaatctggttgctggaggatcattggtcgtgataaactgataaaatcgaaggagactgggaagattctagggttcaagaagattctcaagttctgcctaaagaagaaacctagagaatacaagagaagttgggtaatggaagagtacaggcttaacaataacttgaactgcaagcaagatcatgtgatttgcaagattcggtttatgttcgatgctgaaatcagtttcttgctagccaagcatttctcgtgtctctccactagatcaccgcttcctgcaaatcaattgttgccagcttatggagtctgtttcttcgattcagaagcggagggtgcattttatctggagacgataatcggttatgatggaaacacttggcctagctacgttaccaacgatgtgtaccgtttgcatccgttgacgcttgtggatcctcaagatgacaagtttaaagagttcggaacctgtatctttgctaacaggacaaagacttgtggtaaaaccgatgaatgtgatggtggtggttgctggaggatcgtagaaggtcatagagttatcaagtcaaaaggtaaggttcttggttacaggaggatttttcaattttcggaaaatgaggaaccaagaaatgtttgtgaaggagaagatccgaagaaaactgcttggttcatagaagagtataggcctgacgaaaataataagaaggataaagtgttatgcgttatcaagttcttaatcccactcaaccaaaggtaacaaggagattttactctggaagtcatactccgtagcacttcgatgtgttcttactgagactggtcacattagctgatagggtatatcaaaaaaaaaaaaaaa

SEQ ID NO: 2114 - protein, 347 aa, Arabidopsis thaliana
  G1461  Paralogous to G1463
MKVEDEATYELIKDELMKAEDEATYWLIKEELIKAEDDVIISRYLKRMIVNGDSWPDHFIEDVDVFNKNPNEEFHSQSPRFVIVKPRTENCGRTDGCQSGCWRIIGRDKLIKSKETGKILGFKKILKFCLKKKPREYKRSWVMEEYRLNNNLNCKQDHVICKIRFMFDAEISFLLAKHFSCLSTRSPLPANQLLPAYGVCFFDSEAEGAFYLETIIGYDGNTWPSYVTNDVYRLHPLTLVDPQDDKFKEFGTCIFANRTKTCGKTDECDGGGCWRIVEGHRVIKSKGKVLGYRRIFQFSENEEPRNVCEGEDPKKTAWFIEEYRPDENNKKDKVLCVIKFLIPLNQR

SEQ ID NO: 2115 - DNA, 1127 bp, Arabidopsis thaliana
  G1462  Predicted polypeptide sequence is paralogous to G1463
cgtcgaccattcttgcgattgatctttctctagataatttttttgatcgatttagtttcattatggaggacgacgacgcagcttatgatctaatcaaacacgaactgttatactcagaagacgaagtaataatctcacgttatctgaagggtatggtcgttaacggagattcttggccagatcacttcatcgaagacgcaaacgtgttcaccaagaatccagataaggtgttcaattctgagagacctagattcgtgatcgttaaaccacgaacagaggcttgtggtaaaaccgatggatgtgattcgggttgctggaggatcattggtcgtgataaactgataaagtcggaggagactgggaagattctagggttcaagaagatactcaagttttgcctaaagaggaaacctatagactacaagagaagttgggtaatggaagagtataggcttaccaataacttgaactggaagcaagatcatgtgatttgcaaaattcggtttatgtttgaagctgaaattagtttcttgctaagcaagcatttctacactacatcagaatcggttcttgaaaatgagctgttgccatcttatggatattatttatccaatacacaagaggaggatgaattttatctggacgcgataatgacttcggaaggaaacgagtggcctagctacgttaccaacaacgtgtactgtctgcatccattggagcttgtggatcttcaagatcggatgtttaatgattacggaacctgcatcttcgctaacaagacttgtggtgaaactgataaatgcgatggtggttactggaagatcctgcacggtgataagctgatcaagtcaaatttcggaaaggtcattggtttcaagaaggtatttgagttctatgaaacggtgagacaaatatatctttgtgatggagaagaagtgacggtaacttggactatacaagagtataggcttagcaaaaacgtgaagcagaataaagtgttgtgcgttatcaagttgacttatgatagataggatactttactttggtttttgtgatcatcttagtatcttacgaatattctagatacacacatctataggcgaccgctctagacaggcctcgtaccg

SEQ ID NO: 2116 - protein, 322 aa, Arabidopsis thaliana
  G1462  Paralogous to G1463
MEDDDAAYDLIKHELLYSEDEVIISRYLKGMVVNGDSWPDHFIEDANVFTKNPDKVFNSERPRFVIVKPRTEACGKTDGCDSGCWRIIGRDKLIKSEETGKILGFKKILKFCLKRKPIDYKRSWVMEEYRLTNNLNWKQDHVICKIRFMFEAEISFLLSKHFYTTSESVLENELLPSYGYYLSNTQEEDEFYLDAIMTSEGNEWPSYVTNNVYCLHPLELVDLQDRMFNDYGTCIFANKTCGETDKCDGGYWKILHGDKLIKSNFGKVIGFKKVFEFYETVRQIYLCDGEEVTVTWTIQEYRLSKNVKQNKVLCVIKLTYDR

SEQ ID NO: 2117 - DNA, 1195 bp, Arabidopsis thaliana
  G1464  Predicted polypeptide sequence is paralogous to G1463
ccatgagtctcacttcttcttcgctctccaagaaacaaaacactcgatcttgcgtttgatctttctctctctatagatctttttcttgatcgattttatctcattatggaagataacgacgcagcttatgatcaagtcaaatccgaactgttaaactcagaagacgaagtaataatctcacgttatctgaagcctatggtcgttaacggagattcttggccagatcacttcatcgaagacgcaaacgtgttcaccaagaatccaaatgaggtgttcaattctgagagacctagattcgttatcgttaaaccacgaacagaggcttgtggtaagaccgatggatgtgaatctggttgctggaggaccatgggtcgtgataaactgataaagtcggaggagactgggaagattctagggttcaagaagattctcaagttttgcataaagtggaaacctatagaatacaagagaagttgggtaatggaagagtataggcttaccaataacttgaactggaagcaagatcatgtgatttgcaagattcggcttttgtttgaagcagaaattagtttcttgctagccaagcatttctacactacgtcagaatcacttcttcgacatgagctattgccatcttatggatatttatccaatacacaagaggaggatgaattttatctgaagacgataatgacttcggaaggaaacgattggcctagctacgttaccaacaacgtgtactgtcttcatccattggagcttgtggatcttcaagatgtgatgtttcaaagttacggaacctgcatcttcgctaacgggacttgtggtgaatctgataaatgcgatggtggttactggaagatcctgcacggtgataagctgatcaagtcaaatttcgggatggtcactggtttcaagaaggaagaaacagagaggttaggtcatcaacgttgccaaggcttgttgttgccacaccgtcgtggccatgtacaaaccaagagttgcggtgtcgtcaccgtgaaggagaagaggagtttggtagagcaaccggaggagattgtcgctgcacctgagacaccacgccaaggaaaaagtgagcataatgatccactaaagcgaaagaaagcgattggttgcgtgggagagaaagctgagatgtaggcgagacgtcaccactacgaatggagatgcggcc

SEQ ID NO: 2118 - protein, 351 aa, Arabidopsis thaliana
  G1464  Paralogous to G1463
MEDNDAAYDQVKSELLNSEDEVIISRYLKPMVVNGDSWPDHFIEDANVFTKNPNEVFNSERPRFVIVKPRTEACGKTDGCESGCWRTMGRDKLIKSEETGKILGFKKILKFCIKWKPIEYKRSWVMEEYRLTNNLNWKQDHVICKIRLLFEAEISFLLAKHFYTTSESLLRHELLPSYGYLSNTQEEDEFYLKTIMTSEGNDWPSYVTNNVYCLHPLELVDLQDVMFQSYGTCIFANGTCGESDKCDGGYWKILHGDKLIKSNFGMVTGFKKEETERLGHQRCQGLLLPHRRGHVQTKSCGVVTVKEKRSLVEQPEEIVAAPETPRQGKSEHNDPLKRKKAIGCVGEKAEM

SEQ ID NO: 2119 - DNA, 1236 bp, Arabidopsis thaliana
  G1465  Predicted polypeptide sequence is paralogous to G1463
tatccttcgcaagacccttcctctatataaggaagttcatttcatttggagaggacacgctgacaagctgactctagcttatctggtaccgtcgacctcattcttgcgtttgatctttctttctctagatcccatatttttcttgatcaatttagtttcattatggaggaagatgcagcttttgatctactcaaagccgaactcttaaacgcagaagacgatgcaataatctcacgttatctgaagcgtatggtcgtcaacggagactcatggcctgatcacttcatcgaagacgcagacgtgttcaacaagaatccaaatgtggagttcgatgctgagagccctagcttcgtgatagttaaacctcgaacagaggcttgtggtaaaaccgatggatgtgaaactggttgctggaggatcatgggtcgtgataaaccgataaaatcgacggagactgtgaagattcaagggttcaagaagattctcaagttctgcctaaagaggaaacctagaggatacaagagaagttgggtaatggaagagtataggcttaccaataacttgaactggaagcaagatcatgtgatttgcaagattcggtttatgtttgaagctgaaatcagtttcttgctagccaagcatttctacactacatcagaatcacttcctcgaaatgagctgttgccagcttacggattcctttcatcagataagcaattggaggatgtatcttatccggtgacgataatgacttctgaaggaaacgattggcctagctacgttaccaacaatgtgtattgtctgcatccattggagctcgttgatcttcaagatcggatgtttaatgattacggaacctgcatcttcgctaacaagacttgtggtaaaaccgatagatgcattaatggtggttactggaaaattttgcaccgtgataggctgatcaagtcaaagtccgggatagttattggtttcaagaaggtgtttaagtttcatgaaacggagaaagaaagatacttctgtggtggagaagatgtgaaggtaacttggactctagaagagtataggcttagcgtgaagcagaataaattcttgtgcgttatcaagtttacttatgataactaagaatcttttctttggattttatgatcatcttagtatcgcgaccgctctagacaggcctcgtaccggatcctctagctagagctttcgttcgtatcatcggtttcgacaacg

SEQ ID NO: 2120 - protein, 320 aa, Arabidopsis thaliana
  G1465  Paralogous to G1463
MEEDAAFDLLKAELLNAEDDAIISRYLKRMVVNGDSWPDHFIEDADVFNKNPNVEFDAESPSFVIVKPRTEACGKTDGCETGCWRIMGRDKPIKSTETVKIQGFKKILKFCLKRKPRGYKRSWVMEEYRLTNNLNWKQDHVICKIRFMFEAEISFLLAKHFYTTSESLPRNELLPAYGFLSSDKQLEDVSYPVTIMTSEGNDWPSYVTNNVYCLHPLELVDLQDRMFNDYGTCIFANKTCGKTDRCINGGYWKILHRDRLIKSKSGIVIGFKKVFKFHETEKERYFCGGEDVKVTWTLEEYRLSVKQNKFLCVIKFTYDN

SEQ ID NO: 2121 - DNA, 1218 bp, Arabidopsis thaliana
  G1484  Predicted polypeptide sequence is paralogous to G1255
atgaaaagtttggctagtgcggttggagggaagacggcgagggcatgtgatagctgcgtgaagaggcgggcacgttggtattgcgcagctgatgatgcctttctttgccatgcttgtgacggttcggtccactcggcaaaccctcttgctcgtaggcacgagagagttcgcttgaaatcggctagcgccggaaagtatcgccatgcctcgccgcctcaccaagccacgtggcatcagggatttacacgtaaagctcggaccccacgtggaggcaagaagagccacacgatggtttttcatgatcttgtgccggagatgagcacggaggatcaagcggagagttacgaggtggaagagcagctcatatttgaggtgccggtgatgaactcgatggttgaggagcaatgctttaaccaatccctggagaaacagaatgagtttccaatgatgcccttaagtttcaagagtagtgacgaagaagatgacgacaacgctgagagttgtctgaatggtttgttcccaaccgacatggaactagctcagttcacagctgacgtggagactctactcggtggaggggatcgagagtttcattccatagaagaactagggttaggtgagatgttaaagatcgaaaaagaggaggtggaggaagagggagttgtgacaagagaagtgcatgatcaagatgaaggtgatgagacatccccatttgaaataagctttgactacgagtacacacacaagaccacattcgatgaaggagaagaagatgagaaagaagacgtgatgaagaatgtgatggagatgggagtgaatgagatgagtggtgggattaaagaagagaagaaggagaaggctcttatgcttagattggactatgaatcagtcatttccacttggggaggccaagggatcccatggaccgcccgggtgccatctgaaatagacctcgacatggtttgtttcccaacccataccatgggtgaaagtggagcagaggctcatcatcacaaccacttccgcggcctagggttacacctaggagatgctggggatggaggaagagaggctagggtttcaagataccgagagaaaaggaggacaaggttgttctccaagaagataaggtacgaggtacgtaaattgaatgcagagaaaaggcctcgcatgaaaggaaggttcgtcaagagatcttcaattggtgttgctcactaa

SEQ ID NO: 2122 - protein, 405 aa, Arabidopsis thaliana
  G1484  Paralogous to G1255
MKSLASAVGGKTARACDSCVKRRARWYCAADDAFLCHACDGSVHSANPLARRHERVRLKSASAGKYRHASPPHQATWHQGFTRKARTPRGGKKSHTMVFHDLVPEMSTEDQAESYEVEEQLIFEVPVMNSMVEEQCFNQSLEKQNEFPMMPLSFKSSDEEDDDNAESCLNGLFPTDMELAQFTADVETLLGGGDREFHSIEELGLGEMLKIEKEEVEEEGVVTREVHDQDEGDETSPFEISFDYEYTHKTTFDEGEEDEKEDVMKNVMEMGVNEMSGGIKEEKKEKALMLRLDYESVISTWGGQGIPWTARVPSEIDLDMVCFPTHTMGESGAEAHHHNHFRGLGLHLGDAGDGGREARVSRYREKRRTRLFSKKIRYEVRKLNAEKRPRMKGRFVKRSSIGVAH

SEQ ID NO: 2123 - DNA, 2511 bp, Arabidopsis thaliana
  G1548  Predicted polypeptide sequence is paralogous to G390, G391, G438
atggcaatgtcttgcaaggatggtaagttgggatgtttggataatgggaagtatgtgaggtatacacctgaacaagttgaagcacttgagaggctttatcatgactgtcctaaaccgagttctattcgccgtcagcagttgatcagagagtgtcctattctctctaacattgagcctaaacagatcaaagtgtggtttcagaaccgaagatgtagagagaaacaaaggaaagaggcttcacggcttcaagctgtgaatcggaagttgacggcaatgaacaagctcttgatggaggagaatgacaggttgcagaagcaagtgtcacagctggtccatgaaaacagctacttccgtcaacatactccaaatccttcactcccagctaaagacacaagctgtgaatcggtggtgacgagtggtcagcaccaattggcatctcaaaatcctcagagagatgctagtcctgcaggacttttgtccattgcagaagaaactttagcagagtttctttcaaaggcaactggaaccgctgttgagtgggttcagatgcctggaatgaagcctggtccggattccattggaatcatcgctatttctcatggttgcactggtgtggcagcacgcgcctgtggcctagtgggtcttgagcctacaagggttgcagagattgtcaaggatcgtccttcgtggttccgcgaatgtcgagctgttgaagttatgaacgtgttgccaactgccaatggtggaaccgttgagctgctttatatgcagctctatgcaccaactacattggccccaccacgcgatttctggctgttacgttacacctctgttttagaagatggcagccttgtggtgtgcgagagatctcttaagagcactcaaaatggtcctagtatgccactggttcagaattttgtgagagcagagatgctttccagtgggtacttgatacggccttgtgatggtggtggctcaatcatacacatagtggatcatatggatttggaggcttgtagcgtgcctgaggtcttgcgcccgctctatgagtcacccaaagtacttgcacagaagacaacaatggcggcactgcgtcagctcaagcaaatagctcaggaggttactcagactaatagtagtgttaatgggtggggacggcgtcctgctgccttaagagctctcagccagaggctaagcagaggcttcaatgaagctgtaaatggtttcactgatgaaggatggtcagtgataggagatagcatggatgatgtcacaatcactgtaaactcttctccagacaagctaatgggtctaaatcttacatttgccaatggctttgctcctgtaagcaatgttgttttatgcgcaaaagcatcaatgcttttacagaatgttcctccggcgatcctgcttcggtttctgagggagcataggtcagaatgggctgacaacaacattgatgcgtatctagcagcagcagttaaagtagggccttgtagtgcccgagttggaggatttggagggcaggttatacttccacttgctcatactattgagcatgaagagtttatggaagtcatcaaattggaaggtcttggtcattcccctgaagatgcaatcgttccaagagatatcttccttcttcaactttgtagcggaatggatgaaaatgctgtaggaacctgtgcggaacttatatttgctccaatcgatgcttcgtttgcggatgatgcacctctgcttccttctggttttcgtattatccctcttgattccgcaaaggaagtatctagcccaaaccgaaccttggatcttgcttcggcactggaaattggttcagctggaacaaaagcctcaactgatcaatcaggaaactccacatgtgcaagatctgtgatgacaatagcatttgagtttggtatcgagagccatatgcaagaacatgtagcatccatggctaggcagtatgttcgaggtatcatatcatcggtgcagagagtagcattggctctttctccttctcatatcagctcacaagttggtctacgcactcctttgggtactcctgaagcccaaacacttgctcgttggatttgccagagttacaggggctacatgggtgttgagctacttaaatcaaacagtgacggcaatgaatctattcttaagaatctttggcatcacactgatgctataatctgctgctcaatgaaggccttgcccgtcttcacatttgcaaaccaggcgggacttgacatgctggagactacattagttgctcttcaagacatctctttagagaagatatttgatgacaatggaagaaagactctttgctctgagttcccacagatcatgcaacagggcttcgcgtgccttcaaggcgggatatgtctctcaagcatggggagaccagtttcgtatgagagagcagttgcttggaaagtactcaatgaagaagaaaatgctcattgcatctgctttgtgttcatcaattggtcctttgtgtga

SEQ ID NO: 2124 - protein, 836 aa, Arabidopsis thaliana
  G1548  Paralogous to G390, G391, G438
MAMSCKDGKLGCLDNGKYVRYTPEQVEALERLYHDCPKPSSIRRQQLIRECPILSNIEPKQIKVWFQNRRCREKQRKEASRLQAVNRKLTAMNKLLMEENDRLQKQVSQLVHENSYFRQHTPNPSLPAKDTSCESVVTSGQHQLASQNPQRDASPAGLLSIAEETLAEFLSKATGTAVEWVQMPGMKPGPDSIGIIAISHGCTGVAARACGLVGLEPTRVAEIVKDRPSWFRECRAVEVMNVLPTANGGTVELLYMQLYAPTTLAPPRDFWLLRYTSVLEDGSLVVCERSLKSTQNGPSMPLVQNFVRAEMLSSGYLIRPCDGGGSIIHIVDHMDLEACSVPEVLRPLYESPKVLAQKTTMAALRQLKQIAQEVTQTNSSVNGWGRRPAALRALSQRLSRGFNEAVNGFTDEGWSVIGDSMDDVTITVNSSPDKLMGLNLTFANGFAPVSNVVLCAKASMLLQNVPPAILLRFLREHRSEWADNNIDAYLAAAVKVGPCSARVGGFGGQVILPLAHTIEHEEFMEVIKLEGLGHSPEDAIVPRDIFLLQLCSGMDENAVGTCAELIFAPIDASFADDAPLLPSGFRIIPLDSAKEVSSPNRTLDLASALEIGSAGTKASTDQSGNSTCARSVMTIAFEFGIESHMQEHVASMARQYVRGIISSVQRVALALSPSHISSQVGLRTPLGTPEAQTLARWICQSYRGYMGVELLKSNSDGNESILKNLWHHTDAIICCSMKALPVFTFANQAGLDMLETTLVALQDISLEKIFDDNGRKTLCSEFPQIMQQGFACLQGGICLSSMGRPVSYERAVAWKVLNEEENAHCICFVFINWSFV

SEQ ID NO: 2125 - DNA, 800 bp, Arabidopsis thaliana; identical to SEQ ID NO: 313
  G1646  Predicted polypeptide sequence is paralogous to G715

SEQ ID NO: 2126 - protein, 250 aa, Arabidopsis thaliana; identical to SEQ ID NO: 314
  G1646  Paralogous to G715

SEQ ID NO: 2127 - DNA, 1564 bp, Arabidopsis thaliana
  G1664  Predicted polypeptide sequence is paralogous to G1062
ctctctctctctctctactagtttgacatgaacagcgacggtgtttggcttgacggctccggtgaatctccggaagttaataacggtgaagctgcgtcttgggtcagaaacccagatgaagactggttcaataacccaccaccaccacaacacactaatcaaaacgacttcagattcaatggtggctttcctttaaacccctcagagaatctgcttcttcttcttcagcaatcgattgattcttcttcttcttcttctccgttattacatcctttcacactcgacgctgcttcacagcaacaacaacaacaacaacaacaacaggaacagtctttcttagctacgaaagcttgtatagtttctcttctcaacgtcccaaccatcaataacaacactttcgatgacttcggctttgactctggtttcttaggacaacaattccatggaaatcatcaatctccgaactcgatgaatttcactggcttaaaccactcagtaccggattttcttccagctccggaaaacagctcaggatcatgtggattgagtcctctgttctcaaacagagcaaaggttttaaaaccgttacaggtaatggcttcatctggctcgcagccaactctgtttcagaaacgagctgcaatgcgtcagagctcgagtagcaaaatgtgcaattctgagagttcttctgaaatgaggaaatcgagctacgagagagagattgacgatactagtaccggaatcatcgatatctctggattgaattacgaatctgatgaccataatactaataacaacaaaggtaagaagaaaggaatgcctgcaaagaatcttatggctgagagaagaagaaggaagaagcttaatgataggctttacatgcttagatcagttgttcccaagatcagcaaaatggatagagcatcaatacttggagatgctattgattacctcaaagagcttttacaaagaatcaacgatcttcacaccgaacttgaatctactccaccgagttcttcaagcttgcatccgttaacaccgactccacaaacgctgtcttaccgtgttaaggaagagttgtgtccatcttcctccttgccaagtcctaaaggccaacaaccaagagttgaggttagattaagagaaggaaaggcagtgaacatacacatgttctgtggacgtagaccaggtcttttactttccaccatgagagctttggataacttaggattggatgttcaacaagcggtgattagctgtttcaatggttttgctttggatgttttccgcgctgagcaatgtcaagaagaccatgacgtgttacctgaacaaatcaaagcagtgcttttagatacagcaggttacgctggtttggtttgattgcgaagcagaaggaagcatctgtgtggaacagagctagatctaagtccttgttctgttttagtcagcaattttcttacttagtttcatcaatttcaatcatgtatggaagatgataactgttttattttagctatgagaacatgtgtttggggaacaatagttgcaacctttgagcaaaaaa

SEQ ID NO: 2128 - protein, 450 aa, Arabidopsis thaliana
  G1664  Paralogous to G1062
MNSDGVWLDGSGESPEVNNGEAASWVRNPDEDWFNNPPPPQHTNQNDFRFNGGFPLNPSENLLLLLQQSIDSSSSSSPLLHPFTLDAASQQQQQQQQQQEQSFLATKACIVSLLNVPTINNNTFDDFGFDSGFLGQQFHGNHQSPNSMNFTGLNHSVPDFLPAPENSSGSCGLSPLFSNRAKVLKPLQVMASSGSQPTLFQKRAAMRQSSSSKMCNSESSSEMRKSSYEREIDDTSTGIIDISGLNYESDDHNTNNNKGKKKGMPAKNLMAERRRRKKLNDRLYMLRSVVPKISKMDRASILGDAIDYLKELLQRINDLHTELESTPPSSSSLHPLTPTPQTLSYRVKEELCPSSSLPSPKGQQPRVEVRLREGKAVNIHMFCGRRPGLLLSTMRALDNLGLDVQQAVISCFNGFALDVFRAEQCQEDHDVLPEQIKAVLLDTAGYAGLV

SEQ ID NO: 2129 - DNA, 943 bp, Arabidopsis thaliana
  G1759  Predicted polypeptide sequence is paralogous to G157, G859, G1842, G1843
cgagaaaaggaaaaaaaaaaatagaaagagaaaacgcttagtatctccggcgacttgaacccaaacctgaggatcaaattagggcacaaagccctctcggagagaagccatgggaagaaaaaaactagaaatcaagcgaattgagaacaaaagtagccgacaagtcaccttctccaaacgtcgcaacggtctcatcgagaaagctcgtcagctttctgttctctgtgacgcatccgtcgctcttctcgtcgtctccgcctccggcaagctctacagcttctcctccggcgataacctggtcaagatccttgatcgatatgggaaacagcatgctgatgatcttaaagccttggatcatcagtcaaaagctctgaactatggttcacactatgagctacttgaacttgtggatagcaagcttgtgggatcaaatgtcaaaaatgtgagtatcgatgctcttgttcaactggaggaacaccttgagactgccctctccgtgactagagccaagaagaccgaactcatgttgaagcttgttgagaatcttaaagaaaaggagaaaatgctgaaagaagagaaccaggttttggctagccagatggagaataatcatcatgtgggagcagaagctgagatggagatgtcacctgctggacaaatctccgacaatcttccggtgactctcccactacttaattagccaccttaaatcggcggttgaaatcaaaatccaaaacatatataattatgaagaaaaaaaaaataagatatgtaattattccgctgataagggcgagcgtttgtatatcttaatactctctctttggccaagagactttgtgtgtgatacttaagtagacggaactaagtcaatactatctgttttaagacaaaaggttgatgaactttgtaccttattcgtgtgagaaaaaaaaaaaaaaaa

SEQ ID NO: 2130 - protein, 196 aa, Arabidopsis thaliana
  G1759  Paralogous to G157, G859, G1842, G1843
MGRKKLEIKRIENKSSRQVTFSKRRNGLIEKARQLSVLCDASVALLVVSASGKLYSFSSGDNLVKILDRYGKQHADDLKALDHQSKALNYGSHYELLELVDSKLVGSNVKNVSIDALVQLEEHLETALSVTRAKKTELMLKLVENLKEKEKMLKEENQVLASQMENNHHVGAEAEMEMSPAGQISDNLPVTLPLLN

SEQ ID NO: 2131 - DNA, 927 bp, Arabidopsis thaliana
  G1782  Predicted polypeptide sequence is paralogous to G1363
atgcaagtgtttcaaaggaaagaagattcatcttggggaaactcaatgcctacaacaaattcaaatattcaaggatctgaatctttcagcttgactaaggatatgataatgtctacaacacaattacccgcgatgaaacattcgggtttgcagctgcaaaatcaagattcaacctcatcacaatctactgaagaagaatcaggcggcggtgaagttgcaagctttggagaatataagcgttatggatgcagcattgttaataacaatctctcaggttacatcgaaaacttgggaaagcctattgaaaattatactaagtcaattactacctcgtcgatggtgtctcaagactctgtgtttcctgctcctacttctggtcaaatatcttggtctcttcaatgtgctgaaacgtcacatttcaatggtttcttggctcctgaatatgcatcaacaccaacggcgctgccacatttagagatgatgggtttggtttcttcaagagtgccattgcctcatcacattcaagagaatgaaccaatatttgtcaatgcgaaacagtatcatgcgattctccgtcgcaggaagcaccgtgctaaactcgaagctcagaacaaactcatcaaatgccgtaaaccgtaccttcatgagtctcgccatcttcatgctttaaagagagctagaggctccggtggacgtttcctcaatacaaagaagcttcaagaatcatcaaactcactgtgttcttctcaaatggcaaatggacaaaatttctctatgagccctcacggtggtggaagcggaatcgggtctagttcgatctcaccgagctccaattcaaactgtatcaacatgttccaaaacccgcagttcagattctcaggttatccgtcaacacaccatgcctcagctctcatgtcagggacttga

SEQ ID NO: 2132 - protein, 308 aa, Arabidopsis thaliana
  G1782  Paralogous to G1363
MQVFQRKEDSSWGNSMPTTNSNIQGSESFSLTKDMIMSTTQLPAMKHSGLQLQNQDSTSSQSTEEESGGGEVASFGEYKRYGCSIVNNNLSGYIENLGKPIENYTKSITTSSMVSQDSVFPAPTSGQISWSLQCAETSHFNGFLAPEYASTPTALPHLEMMGLVSSRVPLPHHIQENEPIFVNAKQYHAILRRRKHRAKLEAQNKLIKCRKPYLHESRHLHALKRARGSGGRFLNTKKLQESSNSLCSSQMANGQNFSMSPHGGGSGIGSSSISPSSNSNCINMFQNPQFRFSGYPSTHHASALMSGT

SEQ ID NO: 2133 - DNA, 549 bp, Arabidopsis thaliana
  G1791  Predicted polypeptide sequence is paralogous to G1792
atgtacatgcaaaaacaaaaaccttaaaagctttcatggaacgtatagagtcttataacacgaatgagatgaaatacagaggcgtacgaaagcgtccatggggaaaatatgcggcggagattcgcgactcagctagacacggtgctcgtgtttggcttgggacgtttaacacagcggaagacgcggctcgggcttatgatagagcagctttcggcatgagaggccaaagggccattctcaattttcctcacgagtatcaaatgatgaaggacggtccaaatggcagccacgagaatgcagtggcttcctcgtcgtcgggatatagaggaggaggtggtggtgatgatgggagggaagttattgagttcgagtatttggatgatagtttattggaggagcttttagattatggtgagagatctaaccaagacaattgtaacgacgcaaaccgctagatcatcactacttacttacagtgtaatgtttttggagtaaagagtaataatcaatataatatactttagtttaggaaaaaaaaaaaaaaaaaaa

SEQ ID NO: 2134 - protein, 139 aa, Arabidopsis thaliana
  G1791  Paralogous to G1792
MERIESYNTNEMKYRGVRKRPWGKYAAEIRDSARHGARVWLGTFNTAEDAARAYDRAAFGMRGQRAILNFPHEYQMMKDGPNGSHENAVASSSSGYRGGGGGDDGREVIEFEYLDDSLLEELLDYGERSNQDNCNDANR

SEQ ID NO: 2135 - DNA, 450 bp, Arabidopsis thaliana
  G1795  Predicted polypeptide sequence is paralogous to G1792
acaaacacgcaaaaagtcattaatatatggatcaaggaggtcgaggtgtcggtgccgagcatggaaagtaccggggagttcggagacgaccttggggaaaatatgcagcagagatacgagattcgaggaagcacggtgaacgtgtgtggcttggaacgttcgatacggcagaggaagcggctagagcctatgaccaagctgcttactccatgagaggccaagcagcaatccttaacttccctcatgagtataacatggggagtggtgtctcttcttccaccgccatggctggatcttcctccgcctccgcctccgcttcttcttcttctaggcaagtttttgaatttgagtacttggatgatagtgttttggaggagctccttgaggaaggagagaaacctaacaagggcaagaagaaatgagcgagatataattcatgattatttctaa

SEQ ID NO: 2136 - protein, 131 aa, Arabidopsis thaliana
  G1795  Paralogous to G1792
MDQGGRGVGAEHGKYRGVRRRPWGKYAAEIRDSRKHGERVWLGTFDTAEEAARAYDQAAYSMRGQAAILNFPHEYNMGSGVSSSTAMAGSSSASASASSSSRQVFEFEYLDDSVLEELLEEGEKPNKGKKK

SEQ ID NO: 2137 - DNA, 1356 bp, Arabidopsis thaliana
  G1806  Predicted polypeptide sequence is paralogous to G1198
atgcagagcagcttcaaaaccgttcctttcactcctgatttctactctcaatcctcttacttcttcagaggagatagttgtcttgaggagtttcatcaaccagtcaatggttttcaccatgaagaagctatcgatttaagtccaaatgtcactattgcttcagctaacttacactacacgacgtttgatacggttatggattgtggtggtggtggtggtggcttgagggagagacttgaaggaggagaagaggagtgtttggacacagggcaattagtgtaccagaaagggacaagattagtaggaggaggagtaggagaagtgaacagcagttggtgtgattcggtttcagctatggctgataacagtcaacatactgacacttccacagatattgatactgatgacaagactcagttgaatggaggtcatcaagggatgctattggctacaaattgttcagatcaatccaatgtgaaatctagtgatcaaaggacacttcgtcgacttgctcagaaccgggaggctgctaggaaaagtcggttgaggaaaaaggcctatgttcagcaacttgagaatagtcgaatcaggcttgcacagctagaggaagagctcaaaagagctcgccaacagggatctttggttgaaagaggagtttcagcggatcacacgcatttggcagcaggaaatggtgtcttttcatttgaattggaatatacacgttggaaggaggaacatcaaagaatgatcaacgacttaagatcgggtgtgaattcgcagttaggtgacaacgatctacgcgttctagtggatgctgtgatgagtcactatgatgaaatattcaggctaaagggaattggcactaaagttgaagtctttcatatgctctcaggcatgtggaagacacctgccgagagatttttcatgtggttaggtggatttagatcatcagagttacttaagatattggggaaccatgtggatccattgacggaccagcagttgataggcatttgcaaccttcagcaatcgtctcaacaagcagaggatgcattgtcacaaggcatggaagctctacaacaatcacttctcgagacgctttcttctgcttctatgggtccaaactcttcagcaaatgttgcagattatatgggtcatatggctatggctatgggcaaacttggcactcttgaaaacttccttcgccaggctgatttattgaggcaacaaactctgcaacagcttcacagaattctcaccacacgacaagctgctcgcgcctttttggtcatccacgattatatttctcggcttagagcacttagctctctatggttagccagacctagagactaa

SEQ ID NO: 2138 - protein, 451 aa, Arabidopsis thaliana
  G1806  Paralogous to G1198
MQSSFKTVPFTPDFYSQSSYFFRGDSCLEEFHQPVNGFHHEEAIDLSPNVTIASANLHYTTFDTVMDCGGGGGGLRERLEGGEEECLDTGQLVYQKGTRLVGGGVGEVNSSWCDSVSAMADNSQHTDTSTDIDTDDKTQLNGGHQGMLLATNCSDQSNVKSSDQRTLRRLAQNREAARKSRLRKKAYVQQLENSRIRLAQLEEELKRARQQGSLVERGVSADHTHLAAGNGVFSFELEYTRWKEEHQRMINDLRSGVNSQLGDNDLRVLVDAVMSHYDEIFRLKGIGTKVEVFHMLSGMWKTPAERFFMWLGGFRSSELLKILGNHVDPLTDQQLIGICNLQQSSQQAEDALSQGMEALQQSLLETLSSASMGPNSSANVADYMGHMAMAMGKLGTLENFLRQADLLRQQTLQQLHRILTTRQAARAFLVIHDYISRLRALSSLWLARPRD

SEQ ID NO: 2139 - DNA, 977 bp, Arabidopsis thaliana
  G1808  Predicted polypeptide sequence is paralogous to G1047
aattcttcccttttccccttctaatttctctcatctctctattagaaaaattattagcaattatgttgtccactgcaccggccttttcattctccgaaccgggtttggttaatcaattctcgggtttccaaaccgggttcactccttgggaatgggattgctctgatctctttttcgtggaccaaatgtctcttgaaccggccatccctagtccttgttatggtgaatccgacactggttccgtcaaaattaattccggttctcatgacatgaaaaccggttctgacgaatcttgtgccggtttcgtcaaaattaatcctcgttgtgacgacgccgacatatcaaacgatctaccgtgctctcaagcagatgaaccggactcggacgacacaaaacaattgacagccatcacaaatttcggttcgggagagaataaccataaccggaaaaaaatgatccaaccggagatgaccgacgagcggaagaggaagaggatggagtcaaaccgggaatcagcgaaacggtcaagaatgcgtaaacaaagtcacattgataacttacgagagcaagtaaaccggttggatttagaaaaccgtgagctcgggaaccgactccggttagttttacaccagcttcaacgagtgaattccgacaataaccggctcgtgacagaacaagagatactccggctaagattgtcggagatgcgtcggattctgatcattagacaacttcaacaacagcaacaatgggaactacataaccggagaatgatcatgactgaacaaaaccaccctcatcttcaatgatagatcaaaatatttaagaagaaaaaatatcgaaaaacttagaacaataaccaaaaaaaaaaagcaaagcaaaaaagaaactctcgctatgtctctctatctctctatgtaaatgaaatgaaggttaggaagagaaaatgatagttttctaattttcctttccacttt

SEQ ID NO: 2140 - protein, 248 aa, Arabidopsis thaliana
  G1808  Paralogous to G1047
MLSTAPAFSFSEPGLVNQFSGFQTGFTPWEWDCSDLFFVDQMSLEPAIPSPCYGESDTGSVKINSGSHDMKTGSDESCAGFVKINPRCDDADISNDLPCSQADEPDSDDTKQLTAITNFGSGENNHNRKKMIQPEMTDERKRKRMESNRESAKRSRMRKQSHIDNLREQVNRLDLENRELGNRLRLVLHQLQRVNSDNNRLVTEQEILRLRLSEMRRILIIRQLQQQQQWELHNRRMIMTEQNHPHLQ

SEQ ID NO: 2141 - DNA, 318 bp, Arabidopsis thaliana
  G1816  Predicted polypeptide sequence is paralogous to G226, G682
atggataacactgaccgtcgtcgccgtcgtaagcaacacaaaatcgccctccatgactctgaagtgagcagtatcgaatgggagtttatcaacatgactgaacaagaagaagatctcatctttcgaatgtacagacttgtcggtgataggtgggatttgatagcaggaagagttcctggaagacaaccagaggagatagagagatattggataatgagaaacagtgaaggctttgctgataaacgacgccagcttcactcatcttcccacaaacataccaagcctcaccgtcctcgcttttctatctatccttcctag

SEQ ID NO: 2142 - protein, 105 aa, Arabidopsis thaliana
  G1816  Paralogous to G226, G682
MDNTDRRRRRKQHKIALHDSEVSSIEWEFINMTEQEEDLIFRMYRLVGDRWDLIAGRVPGRQPEEIERYWIMRNSEGFADKRRQLHSSSHKHTKPHRPRFSIYPS

SEQ ID NO: 2143 - DNA, 765 bp, Arabidopsis thaliana
  G1839  Predicted polypeptide sequence is paralogous to G1749
atcacagttatgtttccattcattggctataaaaaccatgctcactcccttttgttcttcacaccatttgcaggaaaaaatgaatagttgtcagtctaatcccaccaaaatggataattcagaaaatgttctatttaatgatcaaaacgaaaatttcacacttgttgcaccacacccttcttcttcgtacttgacaagagatcaagagcacgagatcatggtctctgctctgcgacaagtgatatctaactccggagctgacgacgcgtcatcatcaaacttgatcatcacaagcgttccgcctccagacgctggcccttgtcctctctgtggcgtcgccggttgctacggctgcacattacaacggccgcaccgagaggtaaagaaggagaagaaatacaaaggagtaaggaaaaaaccatcgggtaaatgggcggcggagatatgggatccgagatcgaaatcaaggaggtggcttggaacgtttcttacggcggagatggcggcacaatcttacaatgatgcggcggctgagtatcgagcaagacgtggtaaaacaaacggagaaggaattaaacggcggtggagatgactgagaaggacatggtcggtgatcatacacggcgaggtggaaatgttatatttactattgaaaactaaattatttattatagagggagatattactctttacgctttcattaagatttatttttataagttttaaagtattttattgttataaaaaaaaaaaaaaaaaaaaaa

SEQ ID NO: 2144 - protein, 184 aa, Arabidopsis thaliana
  G1839  Paralogous to G1749
MLTPFCSSHHLQEKMNSCQSNPTKMDNSENVLFNDQNENFTLVAPHPSSSYLTRDQEHEIMVSALRQVISNSGADDASSSNLIITSVPPPDAGPCPLCGVAGCYGCTLQRPHREVKKEKKYKGVRKKPSGKWAAEIWDPRSKSRRWLGTFLTAEMAAQSYNDAAAEYRARRGKTNGEGIKRRWR

SEQ ID NO: 2145 - DNA, 834 bp, Arabidopsis thaliana
  G1844  Predicted polypeptide sequence is paralogous to G157, G859, G1842, G1843
agaaattaggggattagatgtgtcggaagagtgaagccatgggaagaagaagagtagagatcaaacgaattgagaacaaaagcagtagacaagtcactttctgtaagagacgaaatggtctcatggagaaagctcgtcaactctcaattctctgtggatcctccgtcgctcttttcatcgtctcttccaccggcaaactctacaactcctcctccggcgacagcatggccaagatcatcagtcgttttaaaatacaacaagctgatgatcctgaaaccttggatcttgaagacaaaactcaggattatctttcacacaaggagttactagaaatagttcaaagaaagattgaagaagcaaaaggggataatgtaagtatagaatctctaatttccatggaagagcagctcaagagtgctctgtctgtaattagagctaggaagacagagttattgatggagcttgtgaagaaccttcaggataaggagaagttgctgaaagaaaagaacaaggttctagctagcgaggtggggaagctgaagaaaattttggaaacaggggatgaaagagcagtaatgtcaccggaaaatagctctggccacagcccaccggagactctcccgcttctcaagtaaccaccaatcatcaacggctgatttttcatcatcctgattcaaaaaaggtaaaaaaaattcatgtgtaaaaatcataaagaagctacatgttttaaaatcctcttctccccctgcatacggataaatttatagaccaaaaatataatgttttccctcaaataagatatcgacctttgtgttaccttggaagacaggatca

SEQ ID NO: 2146 - protein, 198 aa, Arabidopsis thaliana
  G1844  Paralogous to G157, G859, G1842, G1843
MGRRRVEIKRIENKSSRQVTFCKRRNGLMEKARQLSILCGSSVALFIVSSTGKLYNSSSGDSMAKIISRFKIQQADDPETLDLEDKTQDYLSHKELLEIVQRKIEEAKGDNVSIESLISMEEQLKSALSVIRARKTELLMELVKNLQDKEKLLKEKNKVLASEVGKLKKILETGDERAVMSPENSSGHSPPETLPLLK

SEQ ID NO: 2147 - DNA, 729 bp, Arabidopsis thaliana
  G1888  Predicted polypeptide sequence is paralogous to G1482
atgaagatttggtgtgctgtttgtgataaagaagaagcttcggtgttttgttgtgcggatgaagcagctctttgtaatggttgcgatcgccatgttcatttcgccaataaactagccgggaaacatctccggttctctctcacttctcctactttcaaagatgctcctctttgtgatatttgcggggagaggcgtgcattattattttgccaagaagacagagcaatactatgcagagaatgtgacattccaatacatcaagctaatgagcacactaagaaacacaatagattcctccttaccggcgttaagatctctgcctccccgtcagcctacccaagagcctccaattccaactctgctgctgcatttggtcgagccaaaacccgaccaaaatcagtatcgagcgaggtcccgagctcggcctccaatgaggtatttacgagctcttcttcgacgaccacgagcaattgctattatgggatagaagaaaactaccatcacgtgagcgattcggggtcgggatcgggttgtacaggtagtatatccgagtatttgatggagacattaccgggttggagagtggaggatttgcttgaacacccttcttgtgtctcctatgaggataacattattactaataacaataacagtgagtcttatagggtttatgatggttcttcacaattccatcatcaagggttttgggatcacaaacccttctcttga

SEQ ID NO: 2148 - protein, 242 aa, Arabidopsis thaliana
  G1888  Paralogous to G1482
MKIWCAVCDKEEASVFCCADEAALCNGCDRHVHFANKLAGKHLRFSLTSPTFKDAPLCDICGERRALLFCQEDRAILCRECDIPIHQANEHTKKHNRFLLTGVKISASPSAYPRASNSNSAAAFGRAKTRPKSVSSEVPSSASNEVFTSSSSTTTSNCYYGIEENYHHVSDSGSGSGCTGSISEYLMETLPGWRVEDLLEHPSCVSYEDNIITNNNNSESYRVYDGSSQFHHQGFWDHKPFS

SEQ ID NO: 2149 - DNA, 625 bp, Arabidopsis thaliana
  G1889  Predicted polypeptide sequence is paralogous to G353, G354
acacgatcaaaactcattattcaacaaagtcttcgtttcatttttcatttttcatttctcaaccaaaaaaaaaaagagtgattttttttttaatcatcagtcaaatggaaaggggaagatcagatatggagatgataaacaacatggcaaattgcttgattcttctatcaaaggcccatcaaaacgacaccaaaagccgtgttttcgcgtgcaagacatgcaacaaagagttcccgtcgttccaagccttgggaggtcaccgagccagccaccggcgatccgcagcgcttgaaggccacgcacctccttctcctaagagagtcaaaccggtgaaacacgagtgtcccatatgtggtgctgagttcgcggtagggcaggccttaggtggtcacatgaggaagcatagaggtggatcaggaggaggaggtggccggagtttggcgccggctacagcgccggtgacgatgaagaaatcaggcggtggtaatggaaaaagagttttgtgtttggacttgaacttgacgcctttagagaacgaagatttgaagttggagcttgggaggtttattttctgatttttgttcgtttttctttttagggtatacttgtgtagggtaagtttatt

SEQ ID NO: 2150 - protein, 156 aa, Arabidopsis thaliana
  G1889  Paralogous to G353, G354
MERGRSDMEMINNMANCLILLSKAHQNDTKSRVFACKTCNKEFPSFQALGGHRASHRRSAALEGHAPPSPKRVKPVKHECPICGAEFAVGQALGGHMRKHRGGSGGGGGRSLAPATAPVTMKKSGGGNGKRVLCLDLNLTPLENEDLKLELGRFIF

SEQ ID NO: 2151 - DNA, 366 bp, Arabidopsis thaliana
  G1929  Predicted polypeptide sequence is paralogous to G1478
atgtgtagaggcttgaataatgaagagagcagaagaagtgacggaggaggttgccggagtctctgcacgagaccgagtgttccggtaaggtgtgagctttgcgacggagacgcctccgtgttctgtgaagcggactcggcgttcctctgtagaaaatgtgaccggtgggttcatggagcgaattttctagcttggagacacgtaaggcgcgtgctatgcacttcttgtcagaaactcacgcgccggtgcctcgtcggagatcatgacttccacgttgttttaccgtcggtgacgacggtcggagaaaccaccgtggagaatagaagtgaacaagataatcatgaggttccgtttgtttttctctga

SEQ ID NO: 2152 - protein, 121 aa, Arabidopsis thaliana
  G1929  Paralogous to G1478
MCRGLNNEESRRSDGGGCRSLCTRPSVPVRCELCDGDASVFCEADSAFLCRKCDRWVHGANFLAWRHVRRVLCTSCQKLTRRCLVGDHDFHVVLPSVTTVGETTVENRSEQDNHEVPFVFL

SEQ ID NO: 2153 - DNA, 1130 bp, Arabidopsis thaliana
  G1945  Predicted polypeptide sequence is paralogous to G2155
atttcccaaagggatttacgaaaagtccctctcctctatcatctctttattcaccccataccaacaacctctacatcttcttcttcttcttcctcctcttttattttctttttaaatcatttacacaaaaatccaaagacaaatctgaaatctctaataaacaaatccataaaataagaaaaacaaagatgaaaggtgaatacagagagcaaaagagtaacgaaatgttttccaagcttcctcatcatcaacaacaacagcaacaacaacaacaacaacactctcttacctctcacttccacctctcctccaccgtaacccccaccgtcgatgactcctccatcgaagtggtccgacgtccacgtggcagaccaccaggttccaaaaacaaacctaaaccacccgtcttcgtcacacgtgacaccgaccctcctatgagtccttacatcctcgaagttccttcaggaaacgacgtcgtcgaagccatcaaccgtttctgccgccgtaaatccatcggagtctgcgtccttagtggctctggctctgtagctaacgtcactttacgtcagccatcaccggcagctcttggctctaccataactttccatggaaagtttgatctcctctccgtctccgcaacgtttctccctcctccgcctcgtacttccttgtctcctcccgtttctaacttcttcaccgtctctctcgctggacctcaaggacaaatcatcggagggttcgtcgctggtccacttatttcggcaggaacagtttacgtcatcgccgcaagtttcaacaacccttcttatcaccggttaccggcggaagaagagcaaaaacactcggcggggacaggggaaagagagggacaatctccgccggtctctggtggcggtgaagagtcaggacagatggcgggaagtggaggagagtcgtgtggggtatcaatgtacagttgccacatgggtggctctgatgttatttgggcccctacagccagagctccaccgccatactaaccaatccttctttcacaaatctctttctttctttttttgtttttttttgttttgggttaggatgaatcaagaaactagggttttttttttttttttttaaaaaaaaaaaaa

SEQ ID NO: 2154 - protein, 276 aa, Arabidopsis thaliana
  G1945  Paralogous to G2155
MKGEYREQKSNEMFSKLPHHQQQQQQQQQQHSLTSHFHLSSTVTPTVDDSSIEVVRRPRGRPPGSKNKPKPPVFVTRDTDPPMSPYILEVPSGNDVVEAINRFCRRKSIGVCVLSGSGSVANVTLRQPSPAALGSTITFHGKFDLLSVSATFLPPPPRTSLSPPVSNFFTVSLAGPQGQIIGGFVAGPLISAGTVYVIAASFNNPSYHRLPAEEEQKHSAGTGEREGQSPPVSGGGEESGQMAGSGGESCGVSMYSCHMGGSDVIWAPTARAPPPY

SEQ ID NO: 2155 - DNA, 513 bp, Arabidopsis thaliana
  G1974  Predicted polypeptide sequence is paralogous to G353, G354
atggttgctgaaagtgataatcgtgatctgacggtggatacggcggcgagctgtctgatgttgttatcaggaattggagaacacgacggaagaaagaaacgtgttttccgatgcaagacttgtgagagagacttcgattcgttccaagctttaggaggccaccgtgcaagccactcgaaactaaccaacagtgacgataaatcacttcctggatcaccaaagaagaagcctaaaactacgactacgacgacggctcatacttgtccgatttgtggcttggagtttccgatgggacaagctcttggtggtcacatgaggaaacataggaacgagaaagaacgagaaaaggcttctaacgtattggttacgcattctttcatgccggagacgacaacggtgacgactttgaagaaatcgagtagtgggaagagagtggcgtgtttggatttcgacttaacttcggtggagagctttgtcaacacggaattggagttgggaagaacgatgtactga

SEQ ID NO: 2156 - protein, 170 aa, Arabidopsis thaliana
  G1974  Paralogous to G353, G354
MVAESDNRDLTVDTAASCLMLLSGIGEHDGRKKRVFRCKTCERDFDSFQALGGHRASHSKLTNSDDKSLPGSPKKKPKTTTTTTAHTCPICGLEFPMGQALGGHMRKHRNEKEREKASNVLVTHSFMPETTTVTTLKKSSSGKRVACLDFDLTSVESFVNTELELGRTMY

SEQ ID NO: 2157 - DNA, 762 bp, Arabidopsis thaliana
  G1995  Predicted polypeptide sequence is paralogous to G361, G362
atggacgaggctaccggagaaacagaaactcaagatttcatgaacgtcgaatccttctctcagcttcctttcattcgccgtcctaaagataagaaccctaaacccattcgtgtcttcggaaaagatttcaccggcagagatttctctattactaccggtcaagaagactacaccgatccttaccagaccaaaaacaaagaagaagaagaggaagaagaccaaaccggagacaacagtacggacaataatagcatcagccacaacaggagattcgagtgtcactattgctttagaaattttcctacttcacaagccctaggtggacaccaaaacgctcacaaacgcgaacgtcagcttgccaaacgcggtgtttcctcttacttttatcatcctgacaataacccttacagttaccgtcattacccgtcgtggaccaatggtccgttaaccgcggctaggtcctatggaggattttcttctggtcctaagccgtcggggtattattcacgacccagctatgggagtcagttaggactatggcgtctaccgcctcgcgttcaaggcgtttataactcaaacgcagcgtttactagtaatggctcttcttcttcttctaattcgactttaccgttgttgacccgttctcaaactcaactatcatcgcaagtgggtggctccgctgctcagaacagaatgtcatcgtacggttacggattgagccctaacgtgcaagatcatgtgagtctcgatcttcatctttaa

SEQ ID NO: 2158 - protein, 253 aa, Arabidopsis thaliana
  G1995  Paralogous to G361, G362
MDEATGETETQDFMNVESFSQLPFIRRPKDKNPKPIRVFGKDFTGRDFSITTGQEDYTDPYQTKNKEEEEEEDQTGDNSTDNNSISHNRRFECHYCFRNFPTSQALGGHQNAHKRERQLAKRGVSSYFYHPDNNPYSYRHYPSWTNGPLTAARSYGGFSSGPKPSGYYSRPSYGSQLGLWRLPPRVQGVYNSNAAFTSNGSSSSSNSTLPLLTRSQTQLSSQVGGSAAQNRMSSYGYGLSPNVQDHVSLDLHL

SEQ ID NO: 2159 - DNA, 1014 bp, Arabidopsis thaliana
  G1998  Predicted polypeptide sequence is paralogous to G325
atggagccaaagtgtgaccattgtgcaacctcgcaagcattgatttactgcaaatccgatttggctaaactatgcctaaactgcgacgtccatgtacactctgcgaatcctctgtctcacaggcacatacgctctttgatctgcgagaaatgcttctcacagccagccgcaatccgctgtctcgacgagaaggtttcatactgccaaggatgtcattggcacgaaagcaactgttcggagttaggacacagagttcagagcttgaatcctttctctggttgtccttctcctacagattttaacagaatgtggtcttcaattcttgaacctcctgtctccggcttgcttagtccgttcgttggttcttttcccttgaatgatctcaacaataccatgttcgataccgcttattccatggtaccacacaacatcagttacactcagaatttcagtgataatttgtctttcttttccacggaatctaagggatatcctgatatggttcttaaacttgaagaaggagaagaagatctatgtgaagggcttaacttggatgatgcaccattaaactttgacgtaggagatgatattatcggatgttcatcagaagtacacatagaaccggaccatacggcatcgccaccaggtcagcaaatgaacatcaacactggacttcagcttcctctatcacctgtcttgttcggacaaatccatccatctcttaacatcactggtgaaaacaatgcagctgattaccaggattgtgggatgtctccagggtttataatgagtgaagcgccatgggaaacgaattttgaagttagttgtccacaagcaagaaacgaggctaagttgagatacaaggagaagaaattaaagcgctcttttgggaaacagattcgatatgcatctcgcaaagcaagagctgacacgaggaaaagagtgaaaggaagatttgtgaaagctggtgacagttatgattatgatccatcatcaccgacgacgaacaattga

SEQ ID NO: 2160 - protein, 337 aa, Arabidopsis thaliana
  G1998  Paralogous to G325
MEPKCDHCATSQALIYCKSDLAKLCLNCDVHVHSANPLSHRHIRSLICEKCFSQPAAIRCLDEKVSYCQGCHWHESNCSELGHRVQSLNPFSGCPSPTDFNRMWSSILEPPVSGLLSPFVGSFPLNDLNNTMFDTAYSMVPHNISYTQNFSDNLSFFSTESKGYPDMVLKLEEGEEDLCEGLNLDDAPLNFDVGDDIIGCSSEVHIEPDHTASPPGQQMNINTGLQLPLSPVLFGQIHPSLNITGENNAADYQDCGMSPGFIMSEAPWETNFEVSCPQARNEAKLRYKEKKLKRSFGKQIRYASRKARADTRKRVKGRFVKAGDSYDYDPSSPTTNN

SEQ ID NO: 2161 - DNA, 845 bp, Arabidopsis thaliana
  G2107  Predicted polypeptide sequence is paralogous to G912, G913
accacaaaacagagcaacacacaacacaaagcttcatttcaattctgtttcgagaaccctttgagaaccagatcggagatggaaaacgacgatatcaccgtggcggagatgaagccaaagaagcgtgctggacggaggattttcaaggagacacgtcacccaatctacagaggcgtgcggcgtagggacggcgacaaatgggtatgcgaagtccgtgaaccgattcatcagcgtcgagtctggctcggaacttatccgacggcagatatggccgcacgtgctcacgacgtggcggttcttgctctgcgcgggagatccgcgtgtttgaatttctccgattctgcttggaggttgccggtgccggcatccactgatccggacacgatcaggcgcacggcggccgaagcagcggagatgttcaggccgccggagtttagtacaggaattacggttttaccctcagccagtgagtttgacacgtcggatgaaggagtcgctggaatgatgatgaggctcgcggaggagccgttgatgtcgccgccaagatcgtacattgatatgaatacgagtgtgtacgtggacgaagaaatgtgttacgaagatttgtcactttggagttactaaaatacgtatgtgttaaaaaaccaaagatcgtatgtgtatgtatgcataataaatgggcttaatgatgggcatagatatgataggtccagcctatatgttaaatgtgttttattttttggtttatctagtttcctaggtatttaccaaattgtattagtataagttttattaagaaataatcaaaaatgttgttgccaaaaaaaaaaaaaaaaaaaaaaaaa

SEQ ID NO: 2162 - protein, 181 aa, Arabidopsis thaliana
  G2107  Paralogous to G912, G913
MENDDITVAEMKPKKRAGRRIFKETRHPIYRGVRRRDGDKWVCEVREPIHQRRVWLGTYPTADMAARAHDVAVLALRGRSACLNFSDSAWRLPVPASTDPDTIRRTAAEAAEMFRPPEFSTGITVLPSASEFDTSDEGVAGMMMRLAEEPLMSPPRSYIDMNTSVYVDEEMCYEDLSLWSY

SEQ ID NO: 2163 - DNA, 1065 bp, Arabidopsis thaliana
  G2131  Predicted polypeptide sequence is paralogous to G979
gtctctcattttcataattccattttcaggattgtctctcaatcttttattcttctcattcaccggtaatggcaaaagtctctgggaggagcaagaaaacaatcgttgacgatgaaatcagcgataaaacagcgtctgcgtctgagtctgcgtccattgccttaacatccaaacgcaaacgtaagtcgccgcctcgaaacgctcctcttcaacgcagctccccttacagaggcgtcacaaggcatagatggactgggagatacgaagcgcatttgtgggataagaacagctggaacgatacacagaccaagaaaggacgtcaagtttatctaggggcttacgacgaagaagaagcagcagcacgtgcctacgacttagcagcattgaagtactggggacgagacacactcttgaacttccctttgccgagttatgacgaagacgtcaaagaaatggaaggccaatccaaggaagagtatattggatcattgagaagaaaaagtagtggattttctcgcggtgtatcaaaatacagaggcgttgcaaggcatcaccataatgggagatgggaagctagaattggaagggtgtttggtaataaatatctatatcttggaacatacgccacgcaagaagaagcagcaatcgcctacgacatcgcggcaatagagtaccgtggacttaacgccgttaccaatttcgacgtcagccgttatctaaaccctaacgccgccgcggataaagccgattccgattctaagcccattcgaagccctagtcgcgagcccgaatcgtcggatgataacaaatctccgaaatcagaggaagtaatcgaaccatctacatcgccggaagtgattccaactcgccggagcttccccgacgatatccagacgtattttgggtgtcaagattccggcaagttagcgactgaggaagacgtaatattcgattgtttcaattcttatataaatcctggcttctataacgagtttgattatggaccttaatcgtattttctacaagttttgttttgattatctacacaatacatcaatatattct

SEQ ID NO: 2164 - protein, 313 aa, Arabidopsis thaliana
  G2131  Paralogous to G979
MAKVSGRSKKTIVDDEISDKTASASESASIALTSKRKRKSPPRNAPLQRSSPYRGVTRHRWTGRYEAHLWDKNSWNDTQTKKGRQVYLGAYDEEEAAARAYDLAALKYWGRDTLLNFPLPSYDEDVKEMEGQSKEEYIGSLRRKSSGFSRGVSKYRGVARHHHNGRWEARIGRVFGNKYLYLGTYATQEEAAIAYDIAAIEYRGLNAVTNFDVSRYLNPNAAADKADSDSKPIRSPSREPESSDDNKSPKSEEVIEPSTSPEVIPTRRSFPDDIQTYFGCQDSGKLATEEDVIFDCFNSYINPGFYNEFDYGP

SEQ ID NO: 2165 - DNA, 1361 bp, Arabidopsis thaliana
  G2156  Predicted polypeptide sequence is paralogous to G1073
ttttttttccctttcctcgttcaaaaaaagtacttgcagagtcactcactctcagtctcagcacatgaattaatttgaagcttccctagaattctttcacatcaattaatacgacaccgtctcgggtgaagaatctctcctctcttgccctaaagcgagttagggtttaacacacaaagcataccctttagatttgtgtctcttagctctgtttttgtcggcttgtgtaaccgatcaactcaagctattggctcctcacctcctgaaatttgacttctccaatggatctcaaagtttctcttatatgaattctatcttcaccctcacaatatctttatatatatgagccacaagaacaagaagagtcagtagatgcggctgccatggacggtggttacgatcaatccggaggagcttctagatactttcacaacctcttcaggcctgagcttcatcaccagcttcaacctcagcctcaacttcaccctttgcctcagcctcagcctcaacctcagcctcagcagcagaattcagatgatgaatctgactccaacaaggatccgggttccgacccagttacctctggttcaaccgggaaacgtccacgtggacgtcctccgggatccaagaacaagccgaagccaccggtgatagtgactagagatagccccaacgtgcttagatctcatgttcttgaagtctcatctggagccgacatagtcgagagcgttaccacttacgctcgcaggagaggaagaggagtctccattctcagtggtaacggcacggtggctaacgtcagtctccggcagccggcaacgacagcggctcatggggcaaatggtggaaccggaggtgttgtggctctacatggaaggtttgagatactttccctcacaggtacggtgttgccgccccctgcgccgccaggatccggtggtctttctatctttctttccggcgttcaaggtcaggtgattggaggaaacgtggtggctccgcttgtggcttcgggtccagtgatactaatggctgcatcgttctctaatgcaactttcgaaaggcttccccttgaagatgaaggaggagaaggtggagagggaggagaagttggagagggaggaggaggagaaggtggtccaccgccggccacgtcatcatcaccaccatctggagccggtcaaggacagttaagaggtaacatgagtggttatgatcagtttgccggtgatcctcatttgcttggttggggagccgcagccgcagccgcaccaccaagaccagccttttagaattgaaaattatgtccgtaacatagctgtaaccaaatttcatttctcaaaattaaaagaaaaaaaaaa

SEQ ID NO: 2166 - protein, 302 aa, Arabidopsis thaliana
  G2156  Paralogous to G1073
MDGGYDQSGGASRYFHNLFRPELHHQLQPQPQLHPLPQPQPQPQPQQQNSDDESDSNKDPGSDPVTSGSTGKRPRGRPPGSKNKPKPPVIVTRDSPNVLRSHVLEVSSGADIVESVTTYARRRGRGVSILSGNGTVANVSLRQPATTAAHGANGGTGGVVALHGRFEILSLTGTVLPPPAPPGSGGLSIFLSGVQGQVIGGNVVAPLVASGPVILMAASFSNATFERLPLEDEGGEGGEGGEVGEGGGGEGGPPPATSSSPPSGAGQGQLRGNMSGYDQFAGDPHLLGWGAAAAAAPPRPAF

SEQ ID NO: 2167 - DNA, 1674 bp, Arabidopsis thaliana
  G2184  Predicted polypeptide sequence is paralogous to G1927
atggcggattcttcacccgattcgtgtttcaaaggaggcaaatttagtgctccagggtttcgatttcatccaactgatgaagagcttgtgatgtattatttgaagaggaagatttgtaggaagaggcttagagttaatgttatcggtgttgttgatgtttacaaaatggatcctgaggaattgcctggtcaatcaatgttgaagacgggagatagacagtggttctatttcactccaaggagtaggaagtatccaaacgcagctaggtctaatagaggaactgaaaatgggtattggaaggctacagggaaggatcgagtcattgagtataattctagatcggtgggacttaaaaagactcttgttttctatagaggccgggctcctagtggtgagcggactgattgggtgatgcatgagtatacgatggatgaagatgaactagggagatgtaagaaccctcaggagtactatgctctttataagttgttcaagaaaagtggggctggtcctaagaatggtgaacagtatggtgctccgtttcaagaagaggaatgggttgatgatgataatgaagatgtgaatgctattgctgtagctgtgccagagcaacctgtggttcgttatgaggatgctcgtcgtgtggatgagaggagactttttaatcctgttattcttcagttagaggatatcgatgagcttctcaatggaatccctaatgcacctggtgttcctcaaagatgtattcctcaggtgaatagtgaagaagagctgcagagtacgttggtgaataattctgctagagagttcttgccaaacggtcagcaatacaacaggccctcaagttttgactcattagagaccgctgaggtcacctcagctcctctggtgtttgagaaggaagatttcattgaaatggatgatcttcttctgatccctgaattcggagcttcttcaactgagaaagccgcacagttctcgaaccatggtgaattcgacgattttaatgagtttgaccaattgttccatgacgtttccatgtctttggatatggaacctattgatcagggaacttctgcaaatctgtcttctctgagtgattctgctaactacacatcagaccaaaaacagcaactcctttatcaacagttccaggaccagactcccgagaaccagctgaacaacatcatggatcctagtacaactctcaatcaaatcactagcgatatttggttcgaggatgatcaggccattctatttgatcaacaacaatccttttctggagcatttgcttcaccctcatcaggtgtgatgcctgattccaccaatcctactatgagtgtgaatgcccaaggccatgaaatccaaaatggtggtggaacaacaagccagttctcatcggctttgtgggcattaatggactcaataccttcaacgccagcctctgcgtgtgagggtccccttaaccgaacctttgtacgtatgtctagcttcagccgtatgaggttcaatggaaaggctaatggaacgccagtgagtactaccatagcaaagaagggtattagaaacagaggttttcttctattatcaatcgtgggtgctttgtgtgccatcttctgggtgttggtagccacagttcgagtctcaggtagaagtcttctcttgaaagactag

SEQ ID NO: 2168 - protein, 557 aa, Arabidopsis thaliana
  G2184  Paralogous to G1927
MADSSPDSCFKGGKFSAPGFRFHPTDEELVMYYLKRKICRKRLRVNVIGVVDVYKMDPEELPGQSMLKTGDRQWFYFTPRSRKYPNAARSNRGTENGYWKATGKDRVIEYNSRSVGLKKTLVFYRGRAPSGERTDWVMHEYTMDEDELGRCKNPQEYYALYKLFKKSGAGPKNGEQYGAPFQEEEWVDDDNEDVNAIAVAVPEQPVVRYEDARRVDERRLFNPVILQLEDIDELLNGIPNAPGVPQRCIPQVNSEEELQSTLVNNSAREFLPNGQQYNRPSSFDSLETAEVTSAPLVFEKEDFIEMDDLLLIPEFGASSTEKAAQFSNHGEFDDFNEFDQLFHDVSMSLDMEPIDQGTSANLSSLSDSANYTSDQKQQLLYQQFQDQTPENQLNNIMDPSTTLNQITSDIWFEDDQAILFDQQQSFSGAFASPSSGVMPDSTNPTMSVNAQGHEIQNGGGTTSQFSSALWALMDSIPSTPASACEGPLNRTFVRMSSFSRMRFNGKANGTPVSTTIAKKGIRNRGFLLLSIVGALCAIFWVLVATVRVSGRSLLLKD

SEQ ID NO: 2169 - DNA, 4127 bp, Arabidopsis thaliana
  G2334  Predicted polypeptide sequence is paralogous to G1863
ttactctgctggctcagtgtttacatacctgttcgcgtaatctaaatactcctgcaagtaacaaacaatcaaacataaaaattatcaagaaggaaatacaagaacagattccattggtctttaaatgaatattagtaaccttacctgaagtataactactgcggctaacttgtccaacattgtcttctcttgaacaggatgcaaattcaagggcttcaacatcagttcaacggtctgttgacagtattacatgagattcaagggatattaaacttaacacctatctttactgtgacttacaagatctttaaatctgaaaaatatatacctttgatgataatcgctcgtcccaatatgtgtatttcacatccttgagtttttcggtcttacgaagttcctcaatgaaaagattcacagtgacaacctgttccaagtttaaaaatccttttcggttatatgagctaatgtagaggaaaagtacttcacaattcagtcgaaacaaaaaaaaaaacttacatcctctacattgttcagtttgccaaatggataaccaacgactaatcccgacacagaaaatgctttgacctgcataagacaacaaaaggcaaatgattgatgtaatcaaacagagttcataagtctacttgttgatagatctctactacgtcaaggacttaacagtaaacactaactgaataaaccttgatcctttaatcaccagtaaggcagtaatcacaaaaagccgagggtgaaagtagacactaatctactacactaacaaactttcttcttcattaccaaaacaaacgatagtttcttcattccttatcttagtaaacactaatctacactagcaaccttttttctttgttttaaaaaacactaagaaatgatagtttctccatttcttaacaagaactaaaatctgtgtatttgtttaaggtctcctttaaatctagagctaaaaagtaaaggaacgatcaaacttatagcacctaccaggttctggaaatctgtagccatcaggtcaatgtttgatttctttctgagcaaaacactgcaagagaagtaacaggttttcaatagcgatgatggtgacaaaattgatcagagaggatttgcatttttgaaaattactgttaaacaaatgttgtagcatgtagacactgaatcaaaggtacctcaatggagaagcaaccatatttgaaggatctgagatagctaatccaacatacttatcaccaacatctaaacccagaaaccgaccagggactgacactttggtcttcagcgcattacccaataagctcaatggcttcacatacttcatttcctgatcaaaagtaagtgaatcaaacttccaaaacacttgttcaaatcaagactaaaaattcacatatcaattgcataaatttgagaattattgtacaaaaaaaactttaatcagaccatcaaacaaacatttcgaaaaagggttttagaaattaatcagaaagtttaaatcttgacgtactttaaaggcggaaactttctggctccggagcacggaatctggcgagaggaaacgacaaatggttctgctaaatgtcttcgcgattgaagcaagcaagcacaaaccccaagattgtgaattagagatggaccggaaaaggtttattccggttaagttcgagacttcaccgtctaatcaatctatacgatgccggtgattatcagggttttggttttacattataccgggaaccggttaattcgaggtggtttaactggtttcccaaaattgattcggtttagcttaagtgaaaagctcaagtaaccacctctcctgtacttacttgcaggcagaggatcatattagtttcattgcttatacaaaattgtcaagctttaaacataaatataatagcagagtaaggaacaaaacaattccaaaagcagaactcacaattccaaaagaagacaaattcaaagattattttctgcagaaaataaagattcaaagagcacaaaccaaaaagattacaaacacttttctttaatgaaaaacttgagtagagattcccatctgatgaagaacacttgacgtcgaagaagctgacctcaaagcctcagctaatggtcctcccatattgttgtggtgattccctccattgctccaccaattcatttgctccctctcattgttgttatttctcatgttctcttcttcttcttcattgcctgtggaaagttttagagaaacatctgaggacgtgttgttaccgggcatggagattgaaagatgacaagtggatgagctcattggactggaggtagagtctgatgatcgtggccaatcgtcaaagaaatgcctcaagatgtgaccatcgtctgatcttccattgctgaatccactgttagcttcatatggcctcttgttgttgttgctttcttgtttcatctctgaagaacaactgtgacagagaggaataaacataaacataaacattgtcaacaaaaagatccaacatttgaacaataataagtagactgatcaattcaacaaaatggttagagaaataatttaatcagtcaaatgtgtgtgttaataagaggaagtggttgcagaatctgagagctttattttgtttggcttctatgcaggtttggtcagctttcactgaggtcctaccatgtcattatttcaaatacaacataagtatacatatctctttaactttctctctcttttctatttctatgattgaaaagtctcacccaactagtaaataaaattagattctatcaaatccaactgttatcattatctctcaacaaaagaaagaataatgtttttatcacaaagtatgtatgataagtctctcttgtcaccctattgccaacattacccctttcttcacagcattacttcacagtgaaatcactatttccctaacaacaatatttgtaattaaccaaatctactaatgactttaattaaacagagtgtttgtgtttttttattgtacctttgttgatgactaaggtggagaggttgagatgaaccagaggagaagaagtggttgttgtttggtccatgaccaagctcctcacctaagacaaaagaagatgcggttgttgtggctgtcgttgtgatggtggttgtggcggtttccacaggctttcttgaacggtttcttccacggtgaatgtggcggtcacaatacttgtggcccgctacaacatcccttgaacatctccatttcttgccgtcagttctcttacacctccctggctcaggatccattgctcctcttccccaataccctgttttttattaagtgtgtgttgttcattagtaacaacaaacataaatctcactcaagacattggttacgaaatgtacttgtctgattctatctatgttgctaatagatcttctagaaataggcttatcatacacatagggttttaactccttgcaaggttgcagagcagccttatacttattttagatcttggaaatataactccaacaccaaaacaaagggaatcttttttacaaagaaagactatttcaaggataagagaagcataaacaatagagaggagagagagactgacaagaaggttggtgatgaggaaaactatgttgaagaggatggtgaaggaaatgcataggagattgatggaggagacttttcttaataggtaagagaagctcttgaggaacagaagcaccagccaacatgtatctatagatcagtgcttgtagctcaagttcttgccactgtgcccagctgaagaagtttcccatctctacatatatatgtaacatagaaacgtcagattaaatatcagcaaaaacaacttcaacattagagtgaataagtcttgtccttttaaaacaacttactgaggaacctggaagaagaagaagaattagaagagtcaggagagaagcaagagaaagaagaggaagaagtgggttcagggacaaagagaggaagaggagccgcagcagcagaagtagcagtttgggactgaatctgatcaaagaaaaagtttgatatcttagttgcagcagagccttgttcttctgactcattctgctgctgacttctccattgtttcagttgcaagtccat

SEQ ID NO: 2170 - protein, 548 aa, Arabidopsis thaliana
  G2334  Paralogous to G1863
MDLQLKQWRSQQQNESEEQGSAATKISNFFFDQIQSQTATSAAAAPLPLFVPEPTSSSSFSCFSPDSSNSSSSSRFLKMGNFFSWAQWQELELQALIYRYMLAGASVPQELLLPIKKSLLHQSPMHFLHHPLQHSFPHHQPSWYWGRGAMDPEPGRCKRTDGKKWRCSRDVVAGHKYCDRHIHRGRNRSRKPVETATTTITTTATTTASSFVLGEELGHGPNNNHFFSSGSSQPLHLSHQQSCSSEMKQESNNNKRPYEANSGFSNGRSDDGHILRHFFDDWPRSSDSTSSPMSSSTCHLSISMPGNNTSSDVSLKLSTGNEEEEENMRNNNNEREQMNWWSNGGNHHNNMGGPLAEALRSASSTSSVLHQMGISTQEMKYVKPLSLLGNALKTKVSVPGRFLGLDVGDKYVGLAISDPSNMVASPLSVLLRKKSNIDLMATDFQNLVKAFSVSGLVVGYPFGKLNNVEDVVTVNLFIEELRKTEKLKDVKYTYWDERLSSKTVELMLKPLNLHPVQEKTMLDKLAAVVILQEYLDYANRYVNTEPAE

SEQ ID NO: 2171 - DNA, 687 bp, Arabidopsis thaliana
  G2345  Predicted polypeptide sequence is paralogous to G481, G482
atggccgaatcgcaaaccggtggtggtggtggtggaagccatgagagtggcggtgatcagagcccgaggtctttgaatgttcgtgagcaggacaggtttcttccgattgctaacataagccgtatcatgaagagaggtttacctctaaatggcaaaatcgctaaagatgctaaagagactatgcaggaatgtgtctctgaattcatcagcttcgtcaccagcgaggctagtgataagtgccaaagagagaaaaggaagaccatcaatggagatgatttgctttgggctatggccactttaggattcgaagattacatcgatcccctcaaggtttacctgatgcgatatagagagatggagggtgacactaaaggatcaggaaaaggcggggaatcgagtgcaaagagagatggtcaaccaagccaagtgtctcagttctcgcaggttcctcaacaaggctcattctcacagggtccttatggaaactctcaatctctgaggttcggcaatagcatcgagcatcttgaagtgttaatgagtagtactaggacactattcatcacaatcttccgagactcgactatgcctgttgtgtctgagaatctgagtgatccactttccatagatatggattgtgaagctatttatcaccacttcattggcctgttgattctttcatgcaagtga

SEQ ID NO: 2172 - protein, 228 aa, Arabidopsis thaliana
  G2345  Paralogous to G481, G482
MAESQTGGGGGGSHESGGDQSPRSLNVREQDRFLPIANISRIMKRGLPLNGKIAKDAKETMQECVSEFISFVTSEASDKCQREKRKTINGDDLLWAMATLGFEDYIDPLKVYLMRYREMEGDTKGSGKGGESSAKRDGQPSQVSQFSQVPQQGSFSQGPYGNSQSLRFGNSIEHLEVLMSSTRTLFITIFRDSTMPVVSENLSDPLSIDMDCEAIYHHFIGLLILSCK

SEQ ID NO: 2173 - DNA, 762 bp, Arabidopsis thaliana
  G2421  Predicted polypeptide sequence is paralogous to G663
atggagggttcgtccaaagggttgaggaaaggtgcatggactgctgaagaagatagtctcttgaggcagtgtattggtaagtatggagaaggcaaatggcatcaagttcctttaagagctgggctaaatcggtgcaggaaaagttgtagactaagatggttaaactatttgaagccaagtatcaagagaggaaaatttagttctgatgaagttgatcttcttcttcgtcttcataagcttctaggaaataggtggtccttgattgctggtcgattacctggtcggaccgctaatgatgtcaagaactactggaacacccatctgagtaagaagcatgaaccgtgttgtaaaactaagataaaaaggataaatattataacccctcctaatacaccggcccaaaaagtttgtgaaaatagtatcacatgtaacaaagatgatgagaaagatgattttgtggataattttatggttggagataatatatggttggagcgtttgctagacgagggccaagaggtagatgtgctggttacagaagcggcggcaacagaaaaggagggcactttggcgtttgacgttgagcaactttggaatttgttcgatggagagactgtgatctttgattagtgtttataaacgtttgtgttctcttgtttgtgaggtttctctatttaatttagtatctattttctaaattaactaatatcttatagtattttaggcaaaccttatgtttccgtttctgtgcggccgctctag

SEQ ID NO: 2174 - protein, 209 aa, Arabidopsis thaliana
  G2421  Paralogous to G663
MEGSSKGLRKGAWTAEEDSLLRQCIGKYGEGKWHQVPLRAGLNRCRKSCRLRWLNYLKPSIKRGKFSSDEVDLLLRLHKLLGNRWSLIAGRLPGRTANDVKNYWNTHLSKKHEPCCKTKIKRINIITPPNTPAQKVCENSITCNKDDEKDDFVDNFMVGDNIWLERLLDEGQEVDVLVTEAAATEKEGTLAFDVEQLWNLFDGETVIFD

SEQ ID NO: 2175 - DNA, 741 bp, Arabidopsis thaliana
  G2422  Predicted polypeptide sequence is paralogous to G663
atgggcgaatcacccaaagggttgagaaaaggtacatggactactgaagaagatattctcttgaggcaatgcattgataagtatggagaaggcaaatggcatcgagttcctttaagaactggtctcaatcggtgccgaaagagttgtagacttagatggttgaattatttgaagccaagtattaagagaggaaaactctgctccgatgaagttgatcttgttcttcgccttcataaacttctaggaaataggtggtccttgatcgctggtagattgcctggtcggactgctaatgatgtcaagaattactggaacactcatttgagtaagaagcacgatgaacgatgctgtaagacgaagatgataaacaaaaacattacttctcatcctacttcatcggcccaaaaaatcgatgttttaaagcctcggcctcgatccttctccgataaaaatagttgcaacgatgtcaatatcttgccaaaagttgacgttgttcctttacatcttggactcaacaacaattatgtttgtgaaagtagtattacatgtaacaaagatgagcaaaaagataagcttattaatattaatctattggatggagataatatgtggtgggaaagtttactggaggcagatgtgttgggtccagaagctacggaaacagcaaagggtgtgaccttaccgcttgactttgagcaaatttgggctcggtttgatgaagagactttagaactgaattag

SEQ ID NO: 2176 - protein, 246 aa, Arabidopsis thaliana
  G2422  Paralogous to G663
MGESPKGLRKGTWTTEEDILLRQCIDKYGEGKWHRVPLRTGLNRCRKSCRLRWLNYLKPSIKRGKLCSDEVDLVLRLHKLLGNRWSLIAGRLPGRTANDVKNYWNTHLSKKHDERCCKTKMINKNITSHPTSSAQKIDVLKPRPRSFSDKNSCNDVNILPKVDVVPLHLGLNNNYVCESSITCNKDEQKDKLININLLDGDNMWWESLLEADVLGPEATETAKGVTLPLDFEQIWARFDEETLELN

SEQ ID NO: 2177 - DNA, 972 bp, Arabidopsis thaliana
  G2423  Predicted polypeptide sequence is paralogous to G1330
atggatgaaaaaggaagaagcttgaagaacaacaacatggaagacgagatggacctaaagagaggtccgtggactgctgaagaagattttaagctcatgaattacattgctactaatggagaaggtcgctggaactctctttctcgttgcgccggcctccaacgcaccggtaaaagctgtagactaaggtggttaaactatctccgccctgacgtccgccgtggaaacattacacttgaagaacaactcttgatcctcgaacttcattcccgttggggaaatagatggtcaaaaatcgcacaatatttaccgggaagaacggacaacgagatcaagaactactggaggacgcgggtgcaaaagcatgcgaaacagttgaaatgtgatgtgaatagccaacaattcaaagacacaatgaagtacttgtggatgcctcgactagtcgagaggattcagtcagcctcggcctcatccgcagcagcagccaccaccacaaccaccaccaccacaggatcagccggcacgtcatcttgcatcacaacctctaacaatcaattcatgaattacgactacaacaacaacaacatgggacaacagtttggtgtaatgagcaacaatgattatatcacgcctgaaaattccagcgtggcagtgtctccggcgtcagacttaacggagtactacagcgctccaaaccctaacccggaatactattcgggtcaaatggggaatagttattatccagatcagaatttagtgagttcacaattattaccggataattatttcgactatagtggattattagacgaagatctaacggctatgcaagagcagagtaacctcagctggtttgaaaacattaatggtgctgcttcttcttcagacagtttatggaacattggagaaactgatgaagaattctggttcttacagcagcaacaacagttcaacaataatggtagcttctga

SEQ ID NO: 2178 - protein, 323 aa, Arabidopsis thaliana
  G2423  Paralogous to G1330
MDEKGRSLKNNNMEDEMDLKRGPWTAEEDFKLMNYIATNGEGRWNSLSRCAGLQRTGKSCRLRWLNYLRPDVRRGNITLEEQLLILELHSRWGNRWSKIAQYLPGRTDNEIKNYWRTRVQKHAKQLKCDVNSQQFKDTMKYLWMPRLVERIQSASASSAAAATTTTTTTTGSAGTSSCITTSNNQFMNYDYNNNNMGQQFGVMSNNDYITPENSSVAVSPASDLTEYYSAPNPNPEYYSGQMGNSYYPDQNLVSSQLLPDNYFDYSGLLDEDLTAMQEQSNLSWFENINGAASSSDSLWNIGETDEEFWFLQQQQQFNNNGSF

SEQ ID NO: 2179 - DNA, 999 bp, Arabidopsis thaliana
  G2424  Predicted polypeptide sequence is paralogous to G1645
atgaggatggagatggtgcatgctgacgtggcgtctctctccataacaccttgcttcccgtcttctttgtcttcgtcctcacatcatcactataaccaacaacaacattgtatcatgtcggaagatcaacaccattcgatggatcagaccacttcatcggactacttctctttaaatatcgacaatgctcaacatctccgtagctactacacaagtcatagagaagaagacatgaaccctaatctaagtgattacagtaattgcaacaagaaagacacaacagtctatagaagctgtggacactcgtcaaaagcttcggtgtctagaggacattggagaccagctgaagatactaagctcaaagaactagtcgccgtctacggtccacaaaactggaacctcatagctgagaagctccaaggaagatccgggaaaagctgtaggcttcgatggtttaaccaactagacccaaggataaatagaagagccttcactgaggaagaagaagagaggctaatgcaagctcataggctttatggtaacaaatgggcgatgatagcgaggcttttccctggtaggactgataattctgtgaagaaccattggcatgttataatggctcgcaagtttagggaacaatcttcttcttaccgtaggaggaagacgatggtttctcttaagccactcattaaccctaatcctcacattttcaatgattttgaccctacccggttagctttgacccaccttgctagtagtgaccataagcagcttatgttaccagttccttgcttcccaggttatgatcatgaaaatgagagtccattaatggtggatatgttcgaaacccaaatgatggttggcgattacattgcatggacacaagaggcaactacattcgatttcttaaaccaaaccgggaagagtgagatatttgaaagaatcaatgaggagaagaaaccaccatttttcgattttcttgggttggggacggtgtga

SEQ ID NO: 2180 - protein, 332 aa, Arabidopsis thaliana
  G2424  Paralogous to G1645
MRMEMVHADVASLSITPCFPSSLSSSSHHHYNQQQHCIMSEDQHHSMDQTTSSDYFSLNIDNAQHLRSYYTSHREEDMNPNLSDYSNCNKKDTTVYRSCGHSSKASVSRGHWRPAEDTKLKELVAVYGPQNWNLIAEKLQGRSGKSCRLRWFNQLDPRINRRAFTEEEEERLMQAHRLYGNKWAMIARLFPGRTDNSVKNHWHVIMARKFREQSSSYRRRKTMVSLKPLINPNPHIFNDFDPTRLALTHLASSDHKQLMLPVPCFPGYDHENESPLMVDMFETQMMVGDYIAWTQEATTFDFLNQTGKSEIFERINEEKKPPFFDFLGLGTV

SEQ ID NO: 2181 - DNA, 528 bp, Arabidopsis thaliana
  G2432  Predicted polypeptide sequence is paralogous to G736
atggcgacccaagattctcaagggattaaactctttggcaaaaccataacattcaacgccaacatcacacagacgataaaaaaagaagagcagcaacaacaacaacagccagagctacaagcaacaacagccgttagatcaccctcatcggatctgacggctgagaagcgtccagacaagatcataccatgtccgagatgcaagagcatggagactaagttttgttacttcaacaactacaacgttaatcaaccaagacacttctgcaaaggttgtcaacgttactggaccgccggtggagctctccggaatgttcccgtcggtgccggtcgtcggaagtcaaaacctcccggacgtgtcggtgggttcgctgagttgcttggagctgcgactggagctgttgatcaggtcgagctagatgctttgctagtggaagagtggagagctgctacggcgtctcacggtggtttccggcatgattttccggtgaagaggctccgttgttacaccgatggtcaatcttgttaa

SEQ ID NO: 2182 - protein, 175 aa, Arabidopsis thaliana
  G2432  Paralogous to G736
MATQDSQGIKLFGKTITFNANITQTIKKEEQQQQQQPELQATTAVRSPSSDLTAEKRPDKIIPCPRCKSMETKFCYFNNYNVNQPRHFCKGCQRYWTAGGALRNVPVGAGRRKSKPPGRVGGFAELLGAATGAVDQVELDALLVEEWRAATASHGGFRHDFPVKRLRCYTDGQSC

SEQ ID NO: 2183 - DNA, 841 bp, Arabidopsis thaliana
  G2513  Predicted polypeptide sequence is paralogous to G912, G913
tttcaacagtaatttaagttaaccggagtctctttttgttttccggcgaatttttggtactttgagttatgaataatgatgatattattctggcggagatgaggcctaagaagcgtgcgggaaggagagtgtttaaggagacacgtcacccagtttacagaggcataaggcggaggaacggtgacaaatgggtctgcgaagtcagagaaccgacgcaccaacgccgcatttggctcgggacttatcccacagcagatatggcagcgcgtgcacacgacgtggcggttttagctctgcgtgggagatccgcatgtttgaatttcgccgactccgcttggcggcttccggtgccggaatccaatgatccggatgtgataagaagagttgcggcggaagctgcggagatgtttaggccggtggatttagaaagtggaattacggttttgccttgtgcgggagatgatgtggatttgggttttggttcgggttccggctctggttcgggatcggaggagaggaattcttcttcgtatggatttggagactacgaagaagtctcaacgacgatgatgagactcgcggaggggccactaatgtcgccgccgcgatcgtatatggaagacatgactcctactaatgtttacacggaagaagagatgtgttatgaagatatgtcattgtggagttacagatattaagtgggactcacatatctactatacataatatttagcttttatgtaagaggtatttatgtgagttttaagattgtagatgtgtcccaggcgttagaagtttccttgatggtatggaatctttgtacctataaaattataaaatt

SEQ ID NO: 2184 - protein, 209 aa, Arabidopsis thaliana
  G2513  Paralogous to G912, G913
MNNDDIILAEMRPKKRAGRRVFKETRHPVYRGIRRRNGDKWVCEVREPTHQRRIWLGTYPTADMAARAHDVAVLALRGRSACLNFADSAWRLPVPESNDPDVIRRVAAEAAEMFRPVDLESGITVLPCAGDDVDLGFGSGSGSGSGSEERNSSSYGFGDYEEVSTTMMRLAEGPLMSPPRSYMEDMTPTNVYTEEEMCYEDMSLWSYRY

SEQ ID NO: 2185 - DNA, 1005 bp, Arabidopsis thaliana
  G2535  Predicted polypeptide sequence is paralogous to G961
atgaacatatcagtaaacggacagtcacaagtacctcctggctttaggtttcacccaaccgaggaagagctcttgaagtattacctccgcaagaaaatctctaacatcaagatcgatctcgatgttattcctgacattgatctcaacaagctcgagccttgggatattcaagagatgtgtaagattggaacgacgccgcaaaacgattggtacttttatagccataaggacaagaagtatcccaccgggactagaaccaacagagccaccacggtcggattttggaaagcgacgggacgtgacaagaccatatataccaatggtgatagaatcgggatgcgaaagacgcttgtcttctacaaaggtcgagcccctcatggtcagaaatccgattggatcatgcacgaatatagactcgacgagagtgtattaatctcctcgtgtggcgatcatgacgtcaacgtagaaacgtgtgatgtcataggaagtgacgaaggatgggtggtgtgtcgtgttttcaagaaaaataacctttgcaaaaacatgattagtagtagcccggcgagttcggtgaaaacgccgtcgttcaatgaggagactatcgagcaacttctcgaagttatggggcaatcttgtaaaggagagatagttttagaccctttcttaaaactccctaacctcgaatgccataacaacaccaccatcacgagttatcagtggttaatcgacgaccaagtcaacaactgccacgtcagcaaagttatggatcccagcttcatcactagctgggccgctttggatcggctcgttgcctcacagttaaatgggcccaactcgtattcaataccagccgttaatgagacttcacaatcaccgtatcatggactgaaccggtccggttgtaataccggtttaacaccagattactatataccggagattgatttatggaacgaggcagatttcgcgagaacgacatgccacttgttgaacggtagtggataa

SEQ ID NO: 2186 - protein, 334 aa, Arabidopsis thaliana
  G2535  Paralogous to G961
MNISVNGQSQVPPGFRFHPTEEELLKYYLRKKISNIKIDLDVIPDIDLNKLEPWDIQEMCKIGTTPQNDWYFYSHKDKKYPTGTRTNRATTVGFWKATGRDKTIYTNGDRIGMRKTLVFYKGRAPHGQKSDWIMHEYRLDESVLISSCGDHDVNVETCDVIGSDEGWVVCRVFKKNNLCKNMISSSPASSVKTPSFNEETIEQLLEVMGQSCKGEIVLDPFLKLPNLECHNNTTITSYQWLIDDQVNNCHVSKVMDPSFITSWAALDRLVASQLNGPNSYSIPAVNETSQSPYHGLNRSGCNTGLTPDYYIPEIDLWNEADFARTTCHLLNGSG

SEQ ID NO: 2187 - DNA, 876 bp, Arabidopsis thaliana
  G2545  Predicted polypeptide sequence is paralogous to G427
atgcaagaagcggcactaggtatgatgggagccaccgtaggcggagacggagacaccgcggtcgtggcggagcagaatagacagttgaaaggtgagatagcgacacatccgatgtatgagcaattattagccgcacacgtggcgtgtttaagagtagctactccaatagatcaacttccgatcattgaagctcagctttctcaatctcatcatcttctccgttcttacgcttccacggccgttggataccatcatgatcgtcacgagctcgataatttcttggcacaatatgtaatggtgttgtgtagcttcaaagaacagctgcaacagcacgtgagggttcatgccgtcgaagctgttatggcttgccgtgaaattgagaacaaccttcattctcttacaggagcaactttaggagaagggtcgggtgcgactatgtcggaggatgaggatgatcttccgatggatttctcgtcagataattccggcgttgattttagcggcggccacgatatgacgggatttggtccgttgctaccgactgaatcggaaagatcccttatggaaagagtcagacaagaactcaaactagaactcaaacagggttttaaatcgagaatcgaagatgtaagagaagagataatgaggaagagaagggctgggaaattgccaggagacacaactactgtcttgaaaaattggtggcaacaacattgcaaatggccttaccctacggaagatgacaaggcaaaattggtggaggagacaggattgcagttgaagcaaatcaacaattggttcattaaccaacgcaagaggaattggcacaacaactctcactccctcacttccttgaagtccaagcgcaaacactaa

SEQ ID NO: 2188 - protein, 291 aa, Arabidopsis thaliana
  G2545  Paralogous to G427
MQEAALGMMGATVGGDGDTAVVAEQNRQLKGEIATHPMYEQLLAAHVACLRVATPIDQLPIIEAQLSQSHHLLRSYASTAVGYHHDRHELDNFLAQYVMVLCSFKEQLQQHVRVHAVEAVMACREIENNLHSLTGATLGEGSGATMSEDEDDLPMDFSSDNSGVDFSGGHDMTGFGPLLPTESERSLMERVRQELKLELKQGFKSRIEDVREEIMRKRRAGKLPGDTTTVLKNWWQQHCKWPYPTEDDKAKLVEETGLQLKQINNWFINQRKRNWHNNSHSLTSLKSKRKH

SEQ ID NO: 2189 - DNA, 492 bp, Arabidopsis thaliana
  G2631  Predicted polypeptide sequence is paralogous to G484
atggatccgatggatatagttggaaaatcaaaggaagatgcttcgcttccgaaagctaccatgacgaaaattataaaggagatgttacccgcagatgttcgtgttgctagagatgctcaagatctattgattgagtgttgtgtagagttcataaatcttatatcgtcggagtcgaatgaagtgtgtaacaaagaggataaacgaacaatagcccctgagcacgtactcaaagctttacaggttcttggctttggggaatacgtagaagaagtttatgccgcgtatgagcaacataaatatgaaaccatgcaggattcgcagagaagtgtgaagatgaatagcggagcagagatgacggaagaagaggcggcagcggaacaacagaggatgtttgcagaagctcgagcaagaatgaatggaggtgttacagttcctcaaccagagcaactagaagaaccccaacaacaacaacaaacaagtctacaaagctaa

SEQ ID NO: 2190 - protein, 163 aa, Arabidopsis thaliana
  G2631  Paralogous to G484
MDPMDIVGKSKEDASLPKATMTKIIKEMLPADVRVARDAQDLLIECCVEFINLISSESNEVCNKEDKRTIAPEHVLKALQVLGFGEYVEEVYAAYEQHKYETMQDSQRSVKMNSGAEMTEEEAAAEQQRMFAEARARMNGGVTVPQPEQLEEPQQQQQTSLQS

SEQ ID NO: 2191 - DNA, 474 bp, Arabidopsis thaliana
  G2718  Predicted polypeptide sequence is paralogous to G226, G682
atgaatacgcagcgtaagtcgaagcatcttaagaccaatccaaccattgttgcctcttcttctgaaggtaacaactttctccgctatctcatgatctccatccactatacggtgtcgtttgattttactcttttttttttttgaaataataataaatgtgaaatttggatgatgacgtgggacagaagtgagcagtcttgagtgggaagaaatagcaatggctcaggaagaagaggatttgatttgcaggatgtataagcttgtcggtgaaaggtttttcatgttttctcttattccttaacattttttttggttaaatctttcaatatatgtgattttaataagggaattgaagattagtttgtttgtttgtaaaggtgggatttaatagctgggaggattccaggaagaacagcagaagagattgagaggttttgggtgatgaagaatcatcgaagatctcaattacgttga

SEQ ID NO: 2192 - protein, 83 aa, Arabidopsis thaliana
  G2718  Paralogous to G226, G682
MNTQRKSKHLKTNPTIVASSSEEVSSLEWEEIAMAQEEEDLICRMYKLVGERWDLIAGRIPGRTAEEIERFWVMKNHRRSQLR

SEQ ID NO: 2193 - DNA, 1144 bp, Arabidopsis thaliana
  G2776  Predicted polypeptide sequence is paralogous to G1652
actagttctccacaaatctctcttctctctctctcttctcctagaagctgattttcagaggcaacagcaatgagtatcttatccacaagatggttttctgagcaggaaatagaagaaaatagcataattcaacagtttcacatgaactcaatagtgggagaggtccaagaagctcaatacatttttccacactctttcacgaccaacaatgatccctcttatgatgatttgatcgaaatgaaaccaccaaagatccttgagacaacttacatatcaccttcttctcatcttcctccaaattcaaagccccatcatattcaccgtcattcttcctcaagaattctctctttcgaagattatggttcaaatgatatggaacacgagtactctcccacctacctaaactcaatctttagcccaaaattagaggctcaagtgcaaccacaccagaagagtgatgagtttaatcgaaaagggaccaagagggctcaaccgttttcaagaaaccaatccaatgctcaggatcacataatagccgaaagaaaacgtagagagaagcttactcaaagattcgtagctctttccgctctagttcctggccttaaaaagatggacaaggcttctgtgttgggagatgcattaaagcatataaagtatctccaagaaagagtgggagagttggaggaacagaagaaagaaagaagattggaatcaatggttcttgtgaagaagtctaagctgatcttggacgataataatcaatcattctcttcttcttgtgaagatggcttctcggacttggatcttcccgagatcgaggtaagattctcggatgaagatgttctaatcaagatcctttgcgagaagcaaaagggtcatcttgccaagattatggccgagattgagaaacttcatatcttgataactaattcaagtgtattgaattttggaccaactcttgatatcaccattatagctaagaaggagagtgatttcgacatgacactcatggatgttgtaaagagcttaaggtctgctttgtcgaatttcatatgattgtattaactttcatgcttctcgtcaatttctactgtgggagatcttgttgaacacatggacgaaacataagtggtttgccatgaaa

SEQ ID NO: 2194 - protein, 328 aa, Arabidopsis thaliana
  G2776  Paralogous to G1652
MSILSTRWFSEQEIEENSIIQQFHMNSIVGEVQEAQYIFPHSFTTNNDPSYDDLIEMKPPKILETTYISPSSHLPPNSKPHHIHRHSSSRILSFEDYGSNDMEHEYSPTYLNSIFSPKLEAQVQPHQKSDEFNRKGTKRAQPFSRNQSNAQDHIIAERKRREKLTQRFVALSALVPGLKKMDKASVLGDALKHIKYLQERVGELEEQKKERRLESMVLVKKSKLILDDNNQSFSSSCEDGFSDLDLPEIEVRFSDEDVLIKILCEKQKGHLAKIMAEIEKLHILITNSSVLNFGPTLDITIIAKKESDFDMTLMDVVKSLRSALSNFI

SEQ ID NO: 2195 - DNA, 735 bp, Arabidopsis thaliana
  G2826  Predicted polypeptide sequence is paralogous to G361, G362
atggaggagctggattttagttcaaaaacaacaacttctcgtctaaagctatttggatttagtgttgatggagaagaagatttctccgatcaatcagtcaaaactaacctatcttctgtatcaccggaacgtggcgagtttccggcaggatcttccggaagaagtggcggtggtgtacgaagccgaggcggaggaggaggaggaggagaacgtaagtatgagtgtcagtattgttgtagagagtttggtaactcacaagccttaggtggtcaccaaaacgctcacaagaaagagcgtcaacagcttaaacgtgctcagcttcaagctacacgaaacgcagccgcaaatttctcaaacgctggatcagcgtctcagtttttaaggaatcctatagtctctgcttttgctcctccgcctcatcttttatcatcatccgccgtgcctcagcctatgggaggtccttggatgtatcttccacgtgtttctccatctcaacttcacgtgtctcatggctgcgtcatccaagatggttcgggtggtgcgggtgctggtgggttctcgtacgagtatggggctcgtgattcagggtttggagtagttggggctcagatgagacatgttcaggcccatgggccgagaccatcggttaatgggttttcaagagaagtaggaactacttttgatgatggtttagggttggatttgcatctcagtcttgcacctgctggtcattga

SEQ ID NO: 2196 - protein, 244 aa, Arabidopsis thaliana
  G2826  Paralogous to G361, G362
MEELDFSSKTTTSRLKLFGFSVDGEEDFSDQSVKTNLSSVSPERGEFPAGSSGRSGGGVRSRGGGGGGGERKYECQYCCREFGNSQALGGHQNAHKKERQQLKRAQLQATRNAAANFSNAGSASQFLRNPIVSAFAPPPHLLSSSAVPQPMGGPWMYLPRVSPSQLHVSHGCVIQDGSGGAGAGGFSYEYGARDSGFGVVGAQMRHVQAHGPRPSVNGFSREVGTTFDDGLGLDLHLSLAPAGH

SEQ ID NO: 2197 - DNA, 998 bp, Arabidopsis thaliana
  G2838  Predicted polypeptide sequence is paralogous to G361, G362
cgggaattaaatgcaagaaacatagaggagaccgtacttcgaagttgcaaatttaacactaagttgaagaatctagaaatagaaagccaaaatcttcctttacttcaactctacaatttcaatcttttctctgtacttagccatccagagtcataaccaccactatattaaaatgaagacttatgatttcatgaacgtcaactctttctctcctaaggaaagacccattcgcctctttggcttcgagtttggagcttctcatgaagaatctgagtccaaagacaattacaacgagaacaatgaaagcatcaaagacgataacaaagaaaaaagattcaagtgccactattgtttccggaacttccctacttcacaagccctaggcggccatcaaaacgctcacaagagagaacgtcaacaaactaaacgcttcaacctccattcaaacgcagccgctttcttccaccgccaacaaaaccacattgctgcttctaggctctacgaggatcgctatagccttgaagctgttcaaatcaacgacgcgagattagggttatgtcgtatgtataactcatctgcgagttttaatcgtgaccgttcatcttattataatagatatattccttggttcatcggtgatcaccagactagaccaacgtatgtcggtggtggtagcagcagccatggtctgttttacgagtccaagaagaatgtaccggaccacgtgagtttggatctacgcctctagttccattcttttagtatctctctctagctagttcttaaaaaaaaaaaaagagagactagttttttttccttctttcaaatactttttattttattttagtctacttgattaattatgaatttatgatagtgtatccccgtagatatcatgttatattaacagttaaacaattttatggagatgaactttaacttcagatagtttctttctgagatttaaagtcttaaatattatcgacgcattccaatct

SEQ ID NO: 2198 - protein, 191 aa, Arabidopsis thaliana
  G2838  Paralogous to G361, G362
MKTYDFMNVNSFSPKERPIRLFGFEFGASHEESESKDNYNENNESIKDDNKEKRFKCHYCFRNFPTSQALGGHQNAHKRERQQTKRFNLHSNAAAFFHRQQNHIAASRLYEDRYSLEAVQINDARLGLCRMYNSSASFNRDRSSYYNRYIPWFIGDHQTRPTYVGGGSSSHGLFYESKKNVPDHVSLDLRL

SEQ ID NO: 2199 - DNA, 495 bp, Arabidopsis thaliana
  G2839  Predicted polypeptide sequence is paralogous to G353, G354
atggttgcgagaagtgaggaagttgagatagtggaagatacggcggcgaaatgtttgatgttgttatcaagagttggagaatgcggcggaggaggagagaaacgagttttccgatgcaagacttgtcttaaagagttttcgtcgtttcaagctttgggaggtcatcgtgcaagccacaagaaactcattaacagtagcgatccatcacttcttggatccttgtctaacaagaaaactaaaacggcgacgtctcatccttgtccgatatgtggcgtggagtttccgatggggcaagctcttggtggtcacatgaggagacataggagtgagaaagcctcaccaggcacgttggttacacgttcttttttaccggagacgacgacggtgacgactttgaaaaaatcgagtagtgggaagagagtggcttgtttggacttagattcgatggagagtttagtcaattggaagttggagttgggaagaacgatttcttga

SEQ ID NO: 2200 - protein, 164 aa, Arabidopsis thaliana
  G2839  Paralogous to G353, G354
MVARSEEVEIVEDTAAKCLMLLSRVGECGGGGEKRVFRCKTCLKEFSSFQALGGHRASHKKLINSSDPSLLGSLSNKKTKTATSHPCPICGVEFPMGQALGGHMRRHRSEKASPGTLVTRSFLPETTTVTTLKKSSSGKRVACLDLDSMESLVNWKLELGRTIS

SEQ ID NO: 2201 - DNA, 2693 bp, Arabidopsis thaliana
  G3010  Predicted polypeptide sequence is paralogous to G987
catcttctttctagtctctctctctctcttcaccgcgtacacagtaacacagaccctttttccctcttactcaaggttcttctttgtcatcttgttgccgaatccacaaagaggagaataaagattcgacctttattagatattaacgactctggatttttgggtttttggagttggatccacatgggttcttatccggatggattccctggatccatggacgagttggatttcaataaggactttgatttgcctccctcctcaaaccaaaccttaggtttagctaatgggttctatttagatgacttagatttctcatccttggatcctccagaggcatatccctcccagaacaacaacaacaacaacatcaacaacaaagctgtagcaggagatctgttatcatcttcatctgatgacgctgatttctctgattctgttttgaagtatataagccaagttcttatggaagaggatatggaagagaagccttgtatgtttcatgacgctttggctcttcaagctgctgagaaatctctctatgaggctcttggtgagaaatacccttcttcgtcttctgcttcttctgtggatcatcctgagagattggctagtgatagccctgacggttcttgttcaggtggtgcttttagtgattacgctagcaccactaccactacttcctctgattctcactggagtgttgatggtttggagaatagaccttcttggttacatacacctatgccgagtaattttgttttccagtctacttctaggtccaacagtgtcaccggtggtggtggtggtggtaatagtgcggtttacggttcaggttttggcgatgatttggtttcgaatatgtttaaagatgatgaattggctatgcagttcaagaaaggggttgaggaagctagtaagttccttcctaagtcttctcagctctttattgatgtggatagttacatccctatgaattctggttccaaggaaaatggttctgaggtttttgttaagacggagaagaaagatgagacagagcatcatcatcatcatagctatgctcctcctcccaacagattaactggtaagaaaagccattggcgcgacgaagatgaagatttcgttgaagaaagaagtaacaagcaatcagctgtttatgttgaggaaagcgagctttctgaaatgtttgataagatcttggtatgtggccctgggaaacctgtatgcattcttaaccagaactttcctacagaatccgctaaagtcgtgaccgcacagtcaaatggagcaaagattcgtgggaagaaatcaacttctactagtcatagtaacgattctaagaaagaaactgctgatttgaggactcttttggtgttatgtgcacaagctgtatcagtggatgatcgtagaaccgccaacgaaatgctaaggcagatacgagagcattcttcgcctctaggcaatggttcagagcggttggctcattattttgcaaatagtcttgaagcacgcttagctgggaccggtacacagatctacaccgctttatcttcgaagaaaacgtctgcagcagacatgttgaaggcttaccagacatacatgtcggtctgccctttcaagaaagctgctatcatatttgctaaccacagcatgatgcgtttcactgcaaacgccaacacgatccacataatagatttcggaatatcttacggttttcagtggcctgctctgattcatcgcctctcgctcagcagacctggtggttcgcctaagcttcgaattaccggtatagagcttcctcagcgcggttttagaccagcggaagagttcaggagacaggtcatcgcttggctcgatactgtcagcgacacaatgttccgtttgagtacaacgcaattgctcagaaatggggaaacgatccaagtcgaagacttaaagcttcgacaaggagagtatgtggttgtgaactctttgttccgtttcaggaaccttctagatgagaccgttctggtaaacagcccgagagatgcagttttgaagctgataagaaaaataaacccgaatgtcttcattccagcgatcttaagcgggaattacaacgcgccattctttgtcacgaggttcagagaagcgttgtttcattactcggctgtgtttgatatgtgtgactcgaagctagctagggaagacgagatgaggctgatgtatgagaaagagttttatgggagagagattgtgaatgttgtggcttgtgaaggaacagagagagtggagagaccagagacatataagcagtggcaggcgagactgatccgagccggatttagacagcttccgcttgagaaggaactgatgcagaatctgaagttgaaaatcgaaaacgggtacgataaaaacttcgatgttgatcaaaacggtaactggttacttcaagggtggaaaggtagaatcgtgtatgcttcatctctatgggttccttcgtcttcatagatgttgtttcttacgttctaagcgactgggatttatgtagggcttttctgttgatagtctctcgccaacacgagtggattaagttcagagttagggttcttgaacactagaatgttgttatattatgcttgtgacatagcgtgtgtaagagtgtagcctaagagatatagtactcattgcatgatcttttgctatatgtt

SEQ ID NO: 2202 - protein, 769 aa, Arabidopsis thaliana
  G3010  Paralogous to G987
MGSYPDGFPGSMDELDFNKDFDLPPSSNQTLGLANGFYLDDLDFSSLDPPEAYPSQNNNNNNINNKAVAGDLLSSSSDDADFSDSVLKYISQVLMEEDMEEKPCMFHDALALQAAEKSLYEALGEKYPSSSSASSVDHPERLASDSPDGSCSGGAFSDYASTTTTTSSDSHWSVDGLENRPSWLHTPMPSNFVFQSTSRSNSVTGGGGGGNSAVYGSGFGDDLVSNMFKDDELAMQFKKGVEEASKFLPKSSQLFIDVDSYIPMNSGSKENGSEVFVKTEKKDETEHHHHHSYAPPPNRLTGKKSHWRDEDEDFVEERSNKQSAVYVEESELSEMFDKILVCGPGKPVCILNQNFPTESAKVVTAQSNGAKIRGKKSTSTSHSNDSKKETADLRTLLVLCAQAVSVDDRRTANEMLRQIREHSSPLGNGSERLAHYFANSLEARLAGTGTQIYTALSSKKTSAADMLKAYQTYMSVCPFKKAAIIFANHSMMRFTANANTIHIIDFGISYGFQWPALIHRLSLSRPGGSPKLRITGIELPQRGFRPAEEFRRQVIAWLDTVSDTMFRLSTTQLLRNGETIQVEDLKLRQGEYVVVNSLFRFRNLLDETVLVNSPRDAVLKLIRKINPNVFIPAILSGNYNAPFFVTRFREALFHYSAVFDMCDSKLAREDEMRLMYEKEFYGREIVNVVACEGTERVERPETYKQWQARLIRAGFRQLPLEKELMQNLKLKIENGYDKNFDVDQNGNWLLQGWKGRIVYASSLWVPSSS

SEQ ID NO: 2203 - DNA, 632 bp, Brassica napus
  bnCBF1
cacccgatataccggggagttcgtctgagaaagtcaggtaagtgggtgtgtgaagtgagggaaccaaacaagaaatctagaatttggcttggaactttcaaaacagctgagatggcagctcgtgctcacgacgtcgctgccctagccctccgtggaagaggcgcctgcctcaattatgcggactcggcttggcggctccgcatcccggagacaacctgccacaaggatatccagaaggctgctgctgaagccgcattggcttttgaggctgagaaaagtgatgtgacgatgcaaaatggccagaacatggaggagacgacggcggtggcttctcaggctgaagtgaatgacacgacgacagaacatggcatgaacatggaggaggcaacggcagtggcttctcaggctgaggtgaatgacacgacgacggatcatggcgtagacatggaggagacaatggtggaggctgtttttactggggaacaaagtgaagggtttaacatggcgaaggagtcgacggtggaggctgctgttgttacggaggaaccgagcaaaggatcttacatggacgaggagtggatgctcgagatgccgaccttgttggctgatatggcagaagggatgctcctgcc

SEQ ID NO: 2204 - protein, 208 aa, Brassica napus
  bnCBF1
HPIYRGVRLRKSGKWVCEVREPNKKSRIWLGTFKTAEMAARAHDVAALALRGRGACLNYADSAWRLRIPETTCHKDIQKAAAEAALAFEAEKSDVTMQNGQNMEETTAVASQAEVNDTTTEHGMNMEEATAVASQAEVNDTTTDHGVDMEETMVEAVFTGEQSEGFNMAKESTVEAAVVTEEPSKGSYMDEEWMLEMPTLLADMAEGM

SEQ ID NO: 2205 - DNA, 20 bp, artificial sequence
  Mol 368 reverse primer
  Artificial sequence
  misc_feature (6)..(6): n is a, c, g, or t
  misc_feature (15)..(15): n is a, c, g, or t
  misc_feature (18)..(18): n is a, c, g, or t
cayccnathtaymgnggngt

SEQ ID NO: 2206 - DNA, 21 bp, artificial sequence
  Mol 378 forward primer
  Artificial sequence
  misc_feature (3)..(3): n is a, c, g, or t
  misc_feature (6)..(6): n is a, c, g, or t
  misc_feature (12)..(12): n is a, c, g, or t
  misc_feature (18)..(18): n is a, c, g, or t
ggnarnarcatnccytcngcc

SEQ ID NO: 2207 - DNA, 759 bp, Arabidopsis thaliana
  G3
gtttgtcttttatcaatggaaagagaacaagaagagtctacgatgagaaagagaaggcagccacctcaagaagaagtgcctaaccacgtggctacaaggaagccgtacagagggatacggaggaggaagtggggcaagtgggtggctgagattcgtgagcctaacaaacgctcacggctttggcttggctcttacacaaccgatatcgccgccgctagagcctacgacgtggccgtcttctacctccgtggcccctccgcacgtctcaacttccctgatcttctcttgcaagaagaggaccatctctcagccgccaccaccgctgacatgcccgcagctcttataagggaaaaagcggcggaggtcggcgccagagtcgacgctcttctagcttctgccgctccttcgatggctcactccactccgccggtaataaaacccgacttgaatcaaatacccgaatccggagatatatagtcaatttatatacatgtagtttgttttgtttgattagaagattacatttacatacaagatacacatagatactggaaaatataggtatgtatacattcataaattatcttatgtatcaaagaattttatagattctgattagctttttgtttttgtttttgataagaactctgattagttgtccggagacaaaaccggctaagagcaatccatgagaagctagcgagtgttttttagttcaagttgtaatataaatgcatattaattctttagtaattttgt

SEQ ID NO: 2208 - protein, 153 aa, Arabidopsis thaliana
  G3
MEREQEESTMRKRRQPPQEEVPNHVATRKPYRGIRRRKWGKWVAEIREPNKRSRLWLGSYTTDIAAARAYDVAVFYLRGPSARLNFPDLLLQEEDHLSAATTADMPAALIREKAAEVGARVDALLASAAPSMAHSTPPVIKPDLNQIPESGDI

SEQ ID NO: 2209 - DNA, 1650 bp, Arabidopsis thaliana
  G20
ctctcactctctttttctctctctttacttctactgtatcaagaagctccgttttgcttagccatagtgcgtctagggtttggttggtgggaagaaggttccgatcatggcgtcggtgtcgtcgtcggatcaaggacctaagacagaagcaggatgtagcggcggaggaggaggagagagctcggagacagtggcggcgagtgatcagatgttgttgtatagaggttttaagaaggcgaagaaggagagaggttgtacagctaaggagcgtattagtaaaatgcctccgtgcactgctgggaaaaggagttccatataccggggagtcaccagacatagatggacaggtcgttatgaagctcacctttgggataagagtacctggaaccaaaaccagaacaagaagggaaaacaagtttatctaggagcatatgatgatgaagaggctgctgctagagcttacgaccttgctgccttaaaatattggggtcctgggacacttataaattttccggtgactgattataccagggatttagaagaaatgcaaaatctctcaagggaagaataccttgcatctttacgtagatatccctttggcagaaaaagcagcggtttctctaggggaatagcgaaatatcgtggacttcaaagccgatgggacgcatcagccagtcgtatgcctggacctgaatacttcagtaacattcattacggggcaggtgatgatcgtggaacagaaggtgactttctaggtagcttttgtctggaaagaaagattgatctaacaggatacataaagtggtggggagccaacaagaaccgtcaaccagaatcttcatcaaaagcatcagaggatgcaaacgtcgaagatgctggtactgagcttaaaacactggaacacacatcccatgcaacagaaccatacaaggcgccaaaccttggcgtcctttgtggaactcagagaaaagaaaaagaaatatcatcaccatcaagctcttctgctttaagcatcttgtctcagtcgcctgccttcaagagcctagaggagaaagtgttgaagatccaagaaagctgcaataatgaaaacgatgagaatgcaaaccgtaacatcatcaatatggagaagaataacggcaaggcaatagagaaaccagttgtgagtcatggagttgctttaggcggtgctgctgctttgtctcttcagaaaagcatgtacccacttacctctctcttaacggctccattgctcaccaactacaatacattggatcctcttgcagaccctattctctggacaccatttcttccttcaggatcctctcttacttcagaggtgacaaagacagagaccagctgttccacgtacagctacctcccacaagagaaatgagccgttccctttagactttatgtatgtcagattctccttttttgagatgaattcgtcgacttgacatctctttgtctcttttatggagaaaaagttgggaaaagtgtgacaatggtctgaagcaggaatgtacaggttttgttagtggttgtgtttttttttttccagtgtggaatatagaatcatgatattttgtgtaaaacagaaaaaagttatcattatagtatagaagtttgctcttaaaaaaaaaaaaaaaa

SEQ ID NO: 2210 - protein, 428 aa, Arabidopsis thaliana
  G20
MASVSSSDQGPKTEAGCSGGGGGESSETVAASDQMLLYRGFKKAKKERGCTAKERISKMPPCTAGKRSSIYRGVTRHRWTGRYEAHLWDKSTWNQNQNKKGKQVYLGAYDDEEAAARAYDLAALKYWGPGTLINFPVTDYTRDLEEMQNLSREEYLASLRRYPFGRKSSGFSRGIAKYRGLQSRWDASASRMPGPEYFSNIHYGAGDDRGTEGDFLGSFCLERKIDLTGYIKWWGANKNRQPESSSKASEDANVEDAGTELKTLEHTSHATEPYKAPNLGVLCGTQRKEKEISSPSSSSALSILSQSPAFKSLEEKVLKIQESCNNENDENANRNIINMEKNNGKAIEKPVVSHGVALGGAAALSLQKSMYPLTSLLTAPLLTNYNTLDPLADPILWTPFLPSGSSLTSEVTKTETSCSTYSYLPQEK

SEQ ID NO: 2211 - DNA, 1003 bp, Arabidopsis thaliana
  G21
tgtggaggaatattaatacagcccacttcacatctatttttgtgcaaccatctctctaaagcttcttctctcataacaatggcaagacaaatcaacatagagagtagtgtttctcaagttacctttatctcctccgccatccccgccgtatcttcctcctcctccatcaccgcttccgcctcattgtcctcttcacctactacatcttcctcttcttcgtcatcaacaaattctaacttcattgaggaagacaactctaaaagaaaagcatctcgaagatcattgtcatcgttagtctccgttgaagacgatgatgatcaaaacggtggaggtgggaaacggcgaaagaccaacggtggagataaacatccgacgtatagaggagtgaggatgaggagttggggaaaatgggtgtcggagattagagagccgagaaagaaatcaagaatctggctcgggacttatccaacggctgagatggcagctcgagctcatgacgtagcggctttagccattaaaggtacaacggcttacctcaattttcccaagttagccggcgagcttcctcgtccagtcacaaattctcctaaagacattcaagccgccgcctctttagcggccgttaactggcaagattcggtcaacgatgtgagtaattctgaagtggctgaaatagttgaagccgagccgagtcgagccgtggtggctcagttgttttcttcggacacaagcacgacgacgacgactcagagtcaagagtattcggaagcttcgtgtgcttcgacttcggcgtgtacggacaaagacagtgaggaagagaagctgtttgatttgccggatttgtttaccgatgagaatgagatgatgatacgaaacgatgcgttttgctactactcgtccacgtggcagctttgtggagccgatgctgggtttcggcttgaagagccgttttttctatctgaatgactaaagtacccctctcgagagagctctcactaacact

SEQ ID NO: 2212 - protein, 295 aa, Arabidopsis thaliana
  G21
MARQINIESSVSQVTFISSAIPAVSSSSSITASASLSSSPTTSSSSSSSTNSNFIEEDNSKRKASRRSLSSLVSVEDDDDQNGGGGKRRKTNGGDKHPTYRGVRMRSWGKWVSEIREPRKKSRIWLGTYPTAEMAARAHDVAALAIKGTTAYLNFPKLAGELPRPVTNSPKDIQAAASLAAVNWQDSVNDVSNSEVAEIVEAEPSRAVVAQLFSSDTSTTTTTQSQEYSEASCASTSACTDKDSEEEKLFDLPDLFTDENEMMIRNDAFCYYSSTWQLCGADAGFRLEEPFFLSE

SEQ ID NO: 2213 - DNA, 970 bp, Arabidopsis thaliana
  G23
tatcaaacgagagtacaaaagatgacgtcactcaacagctctgcatcaccaacatcatcgtcatcagaccaatctgatgcaactactacaacaagcacccacttgtctgaagaagaagctccacccagaaacaacaacacaagaaagagaaggagagattcttcttctgcttcttcatcttcttcaatgcaacatcctgtttacagaggtgtgcggatgagaagttggggcaaatgggtctccgagatccgacaacctcgtaagaaaactcgtatttggctcggcacttttgtcaccgctgatatggctgctcgtgctcacgacgtcgctgctctcaccatcaaaggctcctccgccgtcttaaatttccctgagcttgcttctctcttccctcgtccggcgtcatcatcgccgcatgatatccagacagccgccgcagaagccgccgccatggtggtcgaagaaaaactgttagagaaggatgaggctccggaggccccaccttcgtcggaatcttcttacgtggcggcggagtcagaggatgaggagaggttggagaaaattgtggagctgcctaacattgaagaaggaagttatgacgagagtgtgacatcacgtgctgatctggcttattctgagccgttcgattgttgggtgtatcctccggttatggatttttatgaagaaatatcggagtttaatttcgtggaattgtggagctttaatcactaattaagttaggaaagtgcattatattgcaatattgcatcatagataacatttgtatttcttttctttttgtacggatacgtagcatatgctactatactagggctagtgtaccaaatattgtaaaatatacttattaatatttatgtaaatgtgtaatatatataacatacaattattgtaagtttggaaattggaaactatcgttacgcaatgttcttgtaaaaaaaaaaaaaaaaaa

SEQ ID NO: 2214 - protein, 236 aa, Arabidopsis thaliana
  G23
MTSLNSSASPTSSSSDQSDATTTTSTHLSEEEAPPRNNNTRKRRRDSSSASSSSSMQHPVYRGVRMRSWGKWVSEIRQPRKKTRIWLGTFVTADMAARAHDVAALTIKGSSAVLNFPELASLFPRPASSSPHDIQTAAAEAAAMVVEEKLLEKDEAPEAPPSSESSYVAAESEDEERLEKIVELPNIEEGSYDESVTSRADLAYSEPFDCWVYPPVMDFYEEISEFNFVELWSFNH

SEQ ID NO: 2215 - DNA, 1084 bp, Arabidopsis thaliana
  G26
ttggcttgtacccaaacccatctttgacttcaaaaataaaataaaaataatcataattgacatcatcggataatgcatagcgggaagagacctctatcaccagaatcaatggccggaaatagagaagagaaaaaagagttgtgttgttgctcaactttgtcggaatctgatgtgtctgattttgtctctgaactcactggtcaacccatcccatcatccattgatgatcaatcttcgtcgcttactcttcaagaaaaaagtaactcgaggcaacgaaactacagaggcgtgaggcaaagaccgtggggaaaatgggcggctgagattcgtgacccgaacaaggcagctcgtgtgtggcttgggacgttcgacactgcagaagaagccgccttagcgtatgataaagctgcatttgagtttagaggtcacaaggccaagcttaacttccccgagcatattcgtgtcaaccctactcaactctatccatcgcccgctacttcccatgatcgcattatcgtgacaccacctagtccacctccaccaattgctcctgacatacttcttgatcaatatggccactttcaatctcgaagtagtgattccagtgccaacttgtccatgaatatgctgtcttcttcgtcttcatctttgaatcatcaagggctaagaccaaatttggaggatggtgaaaacgtgaagaacattagtatccacaaacgacgaaaataacatgttaatggcataaatatctcttcgtccaagttatcaaacgcattgacctccggctttgatcattttaggcgcttaatctctttacgacttcattttggtagtctttaaagagtctatggagtggatttagctaggaatcaggccttatggatgaaaaatatataaattttgaacatgactatgcaagaatgggatgaagactacttagcttggaaaacgtcctgataggtcatgacgactatatccacagaagatgaccgacggagacaacaacatgcctcacctgatcgaccgatcaaatgagataatgtgttgaccggaccggtcggatcaggttgggtcgagtatatca

SEQ ID NO: 2216 - protein, 218 aa, Arabidopsis thaliana
  G26
MHSGKRPLSPESMAGNREEKKELCCCSTLSESDVSDFVSELTGQPIPSSIDDQSSSLTLQEKSNSRQRNYRGVRQRPWGKWAAEIRDPNKAARVWLGTFDTAEEAALAYDKAAFEFRGHKAKLNFPEHIRVNPTQLYPSPATSHDRIIVTPPSPPPPIAPDILLDQYGHFQSRSSDSSANLSMNMLSSSSSSLNHQGLRPNLEDGENVKNISIHKRRK

SEQ ID NO: 2217 - DNA, 881 bp, Arabidopsis thaliana
  G27
caaaataccaaaaacaaaacattttttttaatcttcccaccaatttttttctctttctctcgttacattaaattatctttagatgcaagactcttcctctcacgaatcgcaacgtaacctccggtcaccggtgccggagaaaaccggaaagagttctaagactaaaaatgagcaaaaaggtgtttctaaacaaccaaattttcgtggggtcagaatgagacaatggggaaaatgggtgtctgaaattagagaaccaagaaagaaatcaagaatatggctcggtactttctctacgccggagatggcggcgcgtgcacacgacgtggcggctttagccatcaaaggtggctctgcccaccttaatttcccggagctagcttaccatttgccgagaccggctagcgcggaccctaaagacattcaagaagccgccgccgcagcagctgccgttgactggaaagcaccggagtctccgtctagcaccgtgacgtcatctccagtcgccgacgacgctttctccgatcttcctgatcttttgcttgacgtgaatgatcacaacaaaaacgatggattctgggactcgtttccgtacgaagatcctttcttcttggaaaattactagaaggcaaattcttgccggcgaacggattttccggtggtttcccggtaaataagaagacgatgtcgttttgtaccttttttgtctacgatgggaaatttcttttttttttacgtgtgagtaaaagtttccgaatgtgtgatgtgtaagtaagtacaggttatttaatttcttttttttgtacaaatacgtacgtcattaccaaaaagttttcatttattgtgcttttatcttccaaattcattaaaaaaaaaaaaaaaaa

SEQ ID NO: 2218 - protein, 179 aa, Arabidopsis thaliana
  G27
MQDSSSHESQRNLRSPVPEKTGKSSKTKNEQKGVSKQPNFRGVRMRQWGKWVSEIREPRKKSRIWLGTFSTPEMAARAHDVAALAIKGGSAHLNFPELAYHLPRPASADPKDIQEAAAAAAAVDWKAPESPSSTVTSSPVADDAFSDLPDLLLDVNDHNKNDGFWDSFPYEDPFFLENY

SEQ ID NO: 2219 - DNA, 679 bp, Arabidopsis thaliana
  G31
cttttataagcaatggctccaagacaggcgaacggtagaagcattgccgtgagtgaaggcggcggagggaagacgatgacgatgacgacgatgcggaaggaagtgcactttagaggtgtgaggaagcgtccatggggtagatacgcggcggagatccgtgacccgggaaagaaaacccgggtttggctcgggacattcgacacggcggaggaagctgcaagagcttacgacaccgccgctagagagtttcgtggctccaaagcaaagactaatttccctcttcccggagagtctactacggttaacgacggtggcgagaacgattcttacgtcaaccgtacgacggtgacgacggcgcgtgagatgacgcgtcagagatttccgtttgcatgtcaccgggagcgtaaagtcgtcggtggttatgcttctgctggttttttcttcgatccgtcaagagctgcttcgttaagagcagagctttctcgggtttgtccggttcggtttgatccggttaatatcgagttgagtattggtattcgagaaaccgtaaaagttgaaccgagaagagaactaaacctggatcttaacctagctccaccggtggtggacgtttagatttttttcttcttttcataatttgtattttacattgccggaaaataattaatgttttctttag

SEQ ID NO: 2220 - protein, 200 aa, Arabidopsis thaliana
  G31
MAPRQANGRSIAVSEGGGGKTMTMTTMRKEVHFRGVRKRPWGRYAAEIRDPGKKTRVWLGTFDTAEEAARAYDTAAREFRGSKAKTNFPLPGESTTVNDGGENDSYVNRTTVTTAREMTRQRFPFACHRERKVVGGYASAGFFFDPSRAASLRAELSRVCPVRFDPVNIELSIGIRETVKVEPRRELNLDLNLAPPVVDV

SEQ ID NO: 2221 - DNA, 911 bp, Arabidopsis thaliana
  G32
aacacacattccctctcttccttcaactagaaaaaagatagatatatcggacatttattgatctgtgtatgcataaaggtatagtatcattattagaaagatgaacacaacatcatcaaagagcaagaagaagcaagacgatcaggttggtacaaggtttcttggggtgagaagaaggccttggggaagatacgcagctgagattagagacccaactacgaaggagcgtcactggcttggcactttcgatacggcggaagaagctgccttggcctacgatagagctgctcggtccatgcgtggcacacgtgccagaaccaactttgtttactcagacatgcctccttcctcatccgtcacctccattgtttctcctgacgatcctcctcctcctccacctcctcctgctcctcctagcaatgatcctgtcgattacatgatgatgtttaaccaatactcatccactgactcgccaatgcttcagcctcattgtgatcaagtggacagttacatgtttggtggctctcaatcttcgaattcttattgctattctaatgacagtagtaatgagctgcctcctctcccgagcgacttgtcgaattcgtgttatagccaaccacagtggacctggaccggtgacgactactcgtctgagtacgtacatagtccaatgttcagcagaatgcctccggtttctgactctttccctcaaggtttcaactactttggctcctaattctttctcatcgtccatatttaataccttcctcatttgtaccttttccttcttcttcttttttgggtttatctatgtttcgccgtccttgatctctgcctatgtgatcaaagtgactgtttgtcattagtttttcaataacaagttatcatttgtatcttgaaaaaaaaaaaaa

SEQ ID NO: 2222 - protein, 211 aa, Arabidopsis thaliana
  G32
MNTTSSKSKKKQDDQVGTRFLGVRRRPWGRYAAEIRDPTTKERHWLGTFDTAEEAALAYDRAARSMRGTRARTNFVYSDMPPSSSVTSIVSPDDPPPPPPPPAPPSNDPVDYMMMFNQYSSTDSPMLQPHCDQVDSYMFGGSQSSNSYCYSNDSSNELPPLPSDLSNSCYSQPQWTWTGDDYSSEYVHSPMFSRMPPVSDSFPQGFNYFGS

SEQ ID NO: 2223 - DNA, 933 bp, Arabidopsis thaliana
  G33
attctcccccaaccaaaatatgaccacagaaaaagagaatgtcactacggccgtggccgtgaaagacggcggagaaaagagtaaggaagtgagtgacaagggcgtaaagaagagaaagaatgtaactaaggccctggccgtgaatgacggcggagaaaagagtaaggaagtgcgttacaggggtgtaaggaggagaccatgggggagatatgctgcggagatccgtgatccggtaaagaaaaaacgggtctggctcgggtccttcaacacgggggaggaagccgccagagcctacgactccgctgccataaggtttcgaggatcgaaagctactactaacttccctctaatcggatactatgggatttcttcggcgacgccggtgaacaacaacctttccgagacggtgagtgatggaaatgccaacctccctctcgttggagacgatgggaatgctttggcttctccggtgaacaacaccctttccgaaacggcgcgtgatggaacacttccatcggattgtcacgacatgttatctccgggggtggctgaagcggttgctggatttttcttagatctgcctgaagttattgcgttgaaagaggagcttgatcgagtttgtcctgaccagtttgagtccattgatatggggttgactattggtcctcaaaccgccgtggaagagcctgagacttcctccgccgtggattgtaagctgcgaatggaaccggatcttgacctcaacgcaagtccctaaagattgatctgatgttgttgtccttgaataagtttgttatcttgtcgctcttctgattgtctgtacttctattggttgattcgtgcttttggaggacaaaacaaacatttttttatgtattaaaaaaaggtaattgaactattatcgaaaaaaaaaaaaaaaaaaaaaaaaaaaaa

SEQ ID NO: 2224 - protein, 245 aa, Arabidopsis thaliana
  G33
MTTEKENVTTAVAVKDGGEKSKEVSDKGVKKRKNVTKALAVNDGGEKSKEVRYRGVRRRPWGRYAAEIRDPVKKKRVWLGSFNTGEEAARAYDSAAIRFRGSKATTNFPLIGYYGISSATPVNNNLSETVSDGNANLPLVGDDGNALASPVNNTLSETARDGTLPSDCHDMLSPGVAEAVAGFFLDLPEVIALKEELDRVCPDQFESIDMGLTIGPQTAVEEPETSSAVDCKLRMEPDLDLNASP

SEQ ID NO: 2225 - DNA, 1440 bp, Arabidopsis thaliana
  G38
gaggaaaactcgaaaaagctacacacaagaagaagaagaaaagatacgagcaagaagactaaacacgaaagcgatttatcaactcgaaggaagagactttgattttcaaatttcgtcccctatagattgtgttgtttctgggaaggagatggcagtttatgatcagagtggagatagaaacagaacacaaattgatacatcgaggaaaaggaaatctagaagtagaggtgacggtactactgtggctgagagattaaagagatggaaagagtataacgagaccgtagaagaagtttctaccaagaagaggaaagtacctgcgaaagggtcgaagaagggttgtatgaaaggtaaaggaggaccagagaatagccgatgtagtttcagaggagttaggcaaaggatttggggtaaatgggttgctgagatcagagagcctaatcgaggtagcaggctttggcttggtactttccctactgctcaagaagctgcttctgcttatgatgaggctgctaaagctatgtatggtcctttggctcgtcttaatttccctcggtctgatgcgtctgaggttacgagtacctcaagtcagtctgaggtgtgtactgttgagactcctggttgtgttcatgtgaaaacagaggatccagattgtgaatctaaacccttctccggtggagtggagccgatgtattgtctggagaatggtgcggaagagatgaagagaggtgttaaagcggataagcattggctgagcgagtttgaacataactattggagtgatattctgaaagagaaagagaaacagaaggagcaagggattgtagaaacctgtcagcaacaacagcaggattcgctatctgttgcagactatggttggcccaatgatgtggatcagagtcacttggattcttcagacatgtttgatgtcgatgagcttctacgtgacctaaatggcgacgatgtgtttgcaggcttaaatcaggaccggtacccggggaacagtgttgccaacggttcatacaggcccgagagtcaacaaagtggttttgatccgctacaaagcctcaactacggaatacctccgtttcagctcgagggaaaggatggtaatggattcttcgacgacttgagttacttggatctggagaactaaacaaaacaatatgaagctttttggatttgatatttgccttaatcccacaacgactgttgattctctatccgagttttagtgatatagagaactacagaacacgttttttcttgttataaaggtgaactgtatatatcgaaacagtgatatgacaatagagaagacaactatagtttgttagtctgcttctcttaagttgttctttagatatgttttatgttttgtaacaacaggaatgaataatacacacttgtgaagcttttaaaaaaaaaaaaaaaaaaaaa

SEQ ID NO: 2226 - protein, 335 aa, Arabidopsis thaliana
  G38
MAVYDQSGDRNRTQIDTSRKRKSRSRGDGTTVAERLKRWKEYNETVEEVSTKKRKVPAKGSKKGCMKGKGGPENSRCSFRGVRQRIWGKWVAEIREPNRGSRLWLGTFPTAQEAASAYDEAAKAMYGPLARLNFPRSDASEVTSTSSQSEVCTVETPGCVHVKTEDPDCESKPFSGGVEPMYCLENGAEEMKRGVKADKHWLSEFEHNYWSDILKEKEKQKEQGIVETCQQQQQDSLSVADYGWPNDVDQSHLDSSDMFDVDELLRDLNGDDVFAGLNQDRYPGNSVANGSYRPESQQSGFDPLQSLNYGIPPFQLEGKDGNGFFDDLSYLDLEN

SEQ ID NO: 2227 - DNA, 754 bp, Arabidopsis thaliana
  G39
  misc_feature (677)..(677): n is a, c, g, or t
gtttccacagtccctgtacttgtgcataaaactgtaaaacactactctgaaaattttgcttctgttaggatataatgccaccctctcctcctaaatctccttttattagctcttcactcaaaggagctcatgaagatcgcaaatttaaatgctataggggtgtccgaaagaggtcttggggcaaatgggtgtctgaaatcagagttccaaagactggacgacgaatatggctaggttcatacgatgctccagagaaggcagctagagcctatgatgctgctttgttctgtattaggggtgagaagggagtttacaattttcccactgataaaaagccgcagcttccagaaggttctgtccggcctctgtccaagctcgacatacagacaatagcaacaaactatgcttcatcagttgtgcatgtaccttcccatgccaccacactcccggcaacaacccaggttccctctgaagttcctgcttcctctgatgtttctgcttctactgagattacagagatggtcgatgaatattatctcccaaccgatgcaactgcagaatcaatattctcagttgaagacttacaactggacagtttcctcatgatggacattgattggataaacaatctaatctgatgtgtaacgtcacttgcagtgacatttaatatggtttanctatcagttacctgtctgcttcttgtaagggtatacttggatccttgtctttgaacttgttttatttagcatgcaaa

SEQ ID NO: 2228 - protein, 187 aa, Arabidopsis thaliana
  G39
MPPSPPKSPFISSSLKGAHEDRKFKCYRGVRKRSWGKWVSEIRVPKTGRRIWLGSYDAPEKAARAYDAALFCIRGEKGVYNFPTDKKPQLPEGSVRPLSKLDIQTIATNYASSVVHVPSHATTLPATTQVPSEVPASSDVSASTEITEMVDEYYLPTDATAESIFSVEDLQLDSFLMMDIDWINNLI

SEQ ID NO: 2229 - DNA, 909 bp, Arabidopsis thaliana
  G43
ctcctgtcttgtctaaagaaaaaagagagaggaagaaatggagacttttgaggaaagctctgatttggatgttatacagaaacatctatttgaagacttgatgatccctgatggtttcattgaagattttgtctttgatgatactgcttttgtctccggactctggtctctagaaccctttaacccagttccgaaactggaacctagttcacctgttcttgatccagattcctatgtccaagagattctgcaaatggaagcagaatcatcatcatcatcatcaacaacaacgtcacctgaggttgagactgtctcaaaccggaaaaaaacaaagaggtttgaagaaacgagacattacagaggcgtgagaaggaggccatgggggaaatttgcagcagagattcgagatccggcaaagaaaggatccaggatttggttaggcacttttgagagtgatattgatgctgcaagggcttacgactatgcagcttttaagctcaggggaagaaaagctgttctcaactttcctttggatgccggaaagtatgatgctccggtcaattcatgccgaaaaaggaggagaaccgatgtaccacagcctcaaggaacaacaacaagtacttcatcatcgtcatcaaactaatgggggaatagtgatgtttaattagtatatataggttaatatcttaagtatgtgaagcatcatgtatagagccaagaacctgttagactagtgtactgaaaagaactcttgcaaaatatgtactaaagagttcctgtaacaatggaacttctgcgttttctcttgtcttaaagagcttaaggttctagaaacaaagttcttgtcctttcggtttaaaaaaaaaaaaaaaaaaaaaaaaaaaaaaaaaaaaaaaaaaaaaaaaaaaa

SEQ ID NO: 2230 - protein, 201 aa, Arabidopsis thaliana
  G43
METFEESSDLDVIQKHLFEDLMIPDGFIEDFVFDDTAFVSGLWSLEPFNPVPKLEPSSPVLDPDSYVQEILQMEAESSSSSSTTTSPEVETVSNRKKTKRFEETRHYRGVRRRPWGKFAAEIRDPAKKGSRIWLGTFESDIDAARAYDYAAFKLRGRKAVLNFPLDAGKYDAPVNSCRKRRRTDVPQPQGTTTSTSSSSSN

SEQ ID NO: 2231 - DNA, 914 bp, Arabidopsis thaliana
  G147
aaatcatcagatagaaggaaatattctgattgagagatggctcgtggaaagattcagcttaagaggattgagaacccggttcacagacaagtgactttttgcaagaggagaactggtcttctcaagaaggctaaggagctctctgtgctctgtgatgccgagatcggtgttgtgatcttctctcctcagggcaagctctttgagctcgctactaaaggaacaatggagggaatgattgataagtacatgaagtgtactggtggtggtcgtggttcttcttctgctacttttactgctcaagaacaacttcaaccaccaaatcttgatccgaaagatgagatcaacgtgcttaagcaagagattgagatgcttcagaaagggataagctatatgtttggaggaggagatggggctatgaatcttgaagaacttcttttgcttgagaagcatcttgagtattggatttctcagattcgctctgctaagatggatgttatgcttcaagaaattcagtcattgaggaacaaggaaggagtcctcaaaaacaccaacaagtatctcctcgacaagatagaggaaaacaacaatagcatattagatgctaacttcgcagtcatggagacaaactattcctatccgctaacaatgccaagtgaaatatttcagttctagaccatagggtatttgaagactatgtctcacgaatttaaataaccttggtaagtataatatagtgttgttaaatcacacataattaaaataaagcctgtggaacttcgctaggcagttgaaaatctatccgtatgttttatcctcttgttttacatttgttggtgtgaagatgaaatgactgcaagtgtggtgtgtacttataactctttctactttctatctatgttttgaatttatggatt

SEQ ID NO: 2232 - protein, 211 aa, Arabidopsis thaliana
  G147
MARGKIQLKRIENPVHRQVTFCKRRTGLLKKAKELSVLCDAEIGVVIFSPQGKLFELATKGTMEGMIDKYMKCTGGGRGSSSATFTAQEQLQPPNLDPKDEINVLKQEIEMLQKGISYMFGGGDGAMNLEELLLLEKHLEYWISQIRSAKMDVMLQEIQSLRNKEGVLKNTNKYLLDKIEENNNSILDANFAVMETNYSYPLTMPSEIFQF

SEQ ID NO: 2233 - DNA, 1414 bp, Arabidopsis thaliana
  G158
gatctgggtattatagattgcagattctggaaacgtattatgttaatgattcatttcaagttttgattttttgtgttggattgaagagaagaatagtttattgatgttttgtgaagaagaagaagaagagattttgattttggtttaatatatagttggggattaacaggatgggaagggtaaaattgaagataaagaagttagagaacacaaatggacgccaatctacatttgctaaaaggaaaaatgggatcttgaaaaaggctaatgagctatctattctttgtgacattgatattgttcttcttatgttctctcctactggcaaggctgcaatatgttgcggtacacgaagatgtttctctttcgaaagctcagaacttgaagaaaactttccaaaagttggatcacgatgtaaatatacgcgaatttatagcctcaaggacttgagtactcaagcaaggattctgcaggctcggatttctgagatacatggaagattaagttattggacggaaccagataagattaacaatgttgaacacttgggacagctcgaaatttcgattaggcaatcccttgatcaattgcgtgcacacaagatgcaagatgggattcagattcctttagaacaacagcttcaatctatgtcatggattcttaatagcaacaccaccaacattgtcaccgaggaacacaattcaatcccgcagagggaagtcgagtgctcagcgagttcttcattcgggagctatccaggctactttggaacagggaaatctcctgaaatgacaattccgggtcaagaaacaagctttcttgatgaactaaacaccggacagctgaaacaggacacaagctcgcagcagcagttcactaataataataatatcacagcatacaatcccaatcttcacaatgatatgaatcatcaccaaacgttgcctcctcctcctcttcctcttactcttccgcatgctcaggtgtatattccaatgaatcagagagagtatcatatgaatggattctttgaagcaccaccacctgattcttctgcttacaacgacaacaccaaccaaaccaggtttggttctagcagcagctccttgccttgctcaatctcaatgttcgacgaatacttgttttcccagatgcagcagccgaactgagagagatttgatgaatgatgataaaacatctcactgaagaaactcaaaccaatattttttttcagaaacagcaagaaagctaaaactctgccgatttctgaattggttccaagaagaaaaaaaccagtggtaatccctggtagattgtgcaaccaaaccacacacaatacgtgttcatttattttttctatatcttcaatagatgtcacttaattcttttctatacataatttctcagtcagaat

SEQ ID NO: 2234 - protein, 332 aa, Arabidopsis thaliana
  G158
MGRVKLKIKKLENTNGRQSTFAKRKNGILKKANELSILCDIDIVLLMFSPTGKAAICCGTRRCFSFESSELEENFPKVGSRCKYTRIYSLKDLSTQARILQARISEIHGRLSYWTEPDKINNVEHLGQLEISIRQSLDQLRAHKMQDGIQIPLEQQLQSMSWILNSNTTNIVTEEHNSIPQREVECSASSSFGSYPGYFGTGKSPEMTIPGQETSFLDELNTGQLKQDTSSQQQFTNNNNITAYNPNLHNDMNHHQTLPPPPLPLTLPHAQVYIPMNQREYHMNGFFEAPPPDSSAYNDNTNQTRFGSSSSSLPCSISMFDEYLFSQMQQPN

SEQ ID NO: 2235 - DNA, 991 bp, Arabidopsis thaliana
  G160
tcaaatttgtcatttgtttattcaaatttttgagaaaatggtgagaagtaccaaaggtcgtcagaaaatagagatgaaaaaaatggaaaacgaaagcaaccttcaggttactttctcaaaaagaagattcggtcttttcaaaaaagctagtgaactttgcacattaagtggtgcagagattctgttgattgtgttctctcctggtgggaaagtgttttcttttggccatccaagtgttcaagaactcattcatcgcttttcgaatcctaaccataattctgccattgtccatcatcagaacaacaatctccaacttgttgaaacccgtccggatagaaatatccaatatctcaacaatatactcactgaggtgctggcaaaccaggaaaaggagaaacagaagagaatggttttggacctattgaaagaatccagagaacaagtaggaaactggtatgaaaaagatgtgaaagatctcgacatgaatgaaaccaaccagctgatatctgctcttcaagatgtgaaaaagaaactggtaagagaaatgtctcaatattctcaagtaaatgtttcgcagaattactttggtcaaagttctggcgtgattggtggtggtaatgttggcattgatctttttgatcaaagaagaaatgcattcaactataatccaaacatggtgtttcccaatcatacaccaccaatgtttggatacaacaatgatggagttctcgttccgatatccaacatgaactacatgtcaagttacaacttcaaccagagctagagtctgaagctagaagaacatcctaatcaatatttgcgttattttggctatggttactgttaggattgttcttgtattgtgagacttaagtttgttttttcttttaatttgtttcagttggttggtttttcattttattcgtcgtttgttttcctttgtttttggatatttttgtatcccagaataaatttatttatcctttaaaaa

SEQ ID NO: 2236 - protein, 248 aa, Arabidopsis thaliana
  G160
MVRSTKGRQKIEMKKMENESNLQVTFSKRRFGLFKKASELCTLSGAEILLIVFSPGGKVFSFGHPSVQELIHRFSNPNHNSAIVHHQNNNLQLVETRPDRNIQYLNNILTEVLANQEKEKQKRMVLDLLKESREQVGNWYEKDVKDLDMNETNQLISALQDVKKKLVREMSQYSQVNVSQNYFGQSSGVIGGGNVGIDLFDQRRNAFNYNPNMVFPNHTPPMFGYNNDGVLVPISNMNYMSSYNFNQS

SEQ ID NO: 2237 - DNA, 784 bp, Arabidopsis thaliana
  G165
cttcaaaacatctaaaaaatggtgaaaaaaactcttggtcgtagaaaggtagagatagtgaaaatgactaaggaatcaaaccttcaagtcacattttccaagagaaaagctggtctttttaagaaggctagtgaattttgcacattatgtgatgcaaaaattgcgatgatcgtgttttcaccagctggaaaagtattttcttttggtcatccaaatgttgatgttctgcttgaccactttcgagggtgtgttgtaggacacaacaacacaaaccttgatgaaagctacacaaagcttcatgttcaaatgctcaacaaatcctacactgaggtgaaggcggaagtagaaaaagaacaaaagaataagcagtcgcgggctcaaaatgaaagagaaaacgaaaacgctgaggagtggtggagtaagtctccattagaactcaacttaagtcaatcaacctgtatgatacgtgttcttaaagatttgaagaagatagttgatgaaaaagcaattcaattaatccatcaaacaaacccaaacttctatgttggaagttctagcaatgctgctgctccagcaactgttagtggtggtaatatctccacaaaccaggggttctttgatcaaaacggaatgacgactaatcctactcaaacacttctgtttggatttgatattatgaatcgcacaccaggagtttaaataagtctatcctcattatgggtcttggtactataagttcatctctctcgttgttgactttttaagtctccaatagtttgttgtg

SEQ ID NO: 2238 - protein, 226 aa, Arabidopsis thaliana
  G165
MVKKTLGRRKVEIVKMTKESNLQVTFSKRKAGLFKKASEFCTLCDAKIAMIVFSPAGKVFSFGHPNVDVLLDHFRGCVVGHNNTNLDESYTKLHVQMLNKSYTEVKAEVEKEQKNKQSRAQNERENENAEEWWSKSPLELNLSQSTCMIRVLKDLKKIVDEKAIQLIHQTNPNFYVGSSSNAAAPATVSGGNISTNQGFFDQNGMTTNPTQTLLFGFDIMNRTPGV

SEQ ID NO: 2239 - DNA, 1107 bp, Arabidopsis thaliana
  G170
atggggatgaagaaggtgaagctatctttgatagctaatgaaagatcaaggaaaacatccttcataaagaggaaagacgggatttttaagaaactccacgagttgtcaactctgtgtggtgtccaagcttgtgctctcatctacagtccattcataccggttccagagtcatggccgtcaagggaaggtgctaaaaaggtggcttcaaggtttctggagatgccgccgacagcccgaaccaagaagatgatggatcaagagacttaccttatggagaggattaccaaagcaaaagagcaactaaagaacctggctgctgagaaccgagagttacaggttagacgatttatgtttgattgtgttgaaggcaaaatgtcccagtatcattatgatgcaaaagaccttcaagatttgcaatcttgtataaatctatatctcgatcagcttaacggaaggatcgagtccattaaagaaaatggtgagtcgttgttgtcttccgtctctccttttcctactagaattggtgttgacgaaattggtgatgagtcattttccgactctcctattcatgctacaactggggttgtagatactcttaatgctaccaatcctcatgttcttacgggcgatatgactccttttcttgatgcggacgcaactgcggtaactgcttccagtagattttttgatcatattccatatgaaaatatgaatatgagtcaaaatctgcatgaaccgtttcaacaccttgttcctactaacgtttgtgatttttttcaaaatcagaatatgaatcaggttcaataccaggctcctaataatctgtttaatcagattcaacgagaattctacaacataaatttgaatctgaatttgaatctgaattcgaatcagtatctgaatcaacaacaatcattcatgaatccgatggtggaacaacatatgaatcatgttggagggcgtgaaagcattcctttcgtggacggaaactgctacaactaccatcaactaccatccaatcaactaccagccgttgatcatgcttccaccagttacatgccttccaccaccggtgtctatgatccttacatcaacaataatctctaa

SEQ ID NO: 2240 - protein, 368 aa, Arabidopsis thaliana
  G170
MGMKKVKLSLIANERSRKTSFIKRKDGIFKKLHELSTLCGVQACALIYSPFIPVPESWPSREGAKKVASRFLEMPPTARTKKMMDQETYLMERITKAKEQLKNLAAENRELQVRRFMFDCVEGKMSQYHYDAKDLQDLQSCINLYLDQLNGRIESIKENGESLLSSVSPFPTRIGVDEIGDESFSDSPIHATTGVVDTLNATNPHVLTGDMTPFLDADATAVTASSRFFDHIPYENMNMSQNLHEPFQHLVPTNVCDFFQNQNMNQVQYQAPNNLFNQIQREFYNINLNLNLNLNSNQYLNQQQSFMNPMVEQHMNHVGGRESIPFVDGNCYNYHQLPSNQLPAVDHASTSYMPSTTGVYDPYINNNL

SEQ ID NO: 2241 - DNA, 1888 bp, Arabidopsis thaliana
  G174
cccaatttgagattgttcgatttcgatctacgagattcttacaagaacataagcagcttcggttttttgggattatcttatttggtcggatgatgatcttctcgatgtctgtgctaggctttgggaattagatatatttggggttaagctcgagtctctccggttttgagtttacttgagtttgttagtatttatggctgaggtgggaaaagttctggctagtgatatggagttagaccattcaaatgagactaaagcagtggatgatgttgttgccactactgataaagcggaggtcataccagtggctgtaactagaactgaaaccgttgttgaaagtttggaatctactgactgtaaggagcttgaaaaacttgttccacatacggtagcttcgcagtcggaagtagatgttgcttccccggtatccgagaaagcaccgaaggtttctgaaagtagcggtgcattatctttgcagtctggttcggaagggaatagtccttttattcgtgagaaggttatggaagacggatacaactggcggaaatatggacagaaacttgtgaaaggaaatgagtttgtaaggagctattacaggtgcactcaccctaactgcaaagcgaaaaaacagttggaacggtctgcgggtggacaagtcgtggataccgtttactttggggaacatgatcacccaaagcctcttgctggtgctgttcctatcaatcaggataagcgaagtgatgtcttcacagctgttagtaaagagaaaacatctggatccagtgttcagacacttcgtcaaaccgaaccaccaaagatccatggaggattacatgtttcagttattccaccagctgatgatgtgaaaactgatatttcacaatcaagtaggataacgggggacaacactcacaaggattataatagtcctaccgcaaagcgaaggaagaaaggagggaacattgagctgagtccagtggagaggtcaaccaatgattcacgcattgtggttcacactcagactctgtttgatattgtgaatgatgggtaccgatggcgtaaatatggtcagaaatcagtaaaaggcagcccatatccaaggagctactatagatgttcaagccctggatgccccgtcaagaaacacgtagagaggtcatctcatgacacaaagttgcttataacaacttacgagggaaaacacgaccacgatatgcctccaggaagagttgttactcataataacatgctggactcggaagttgatgataaagaaggagatgccaacaagactccacagagctcaactcttcaatccattacaaaagaccagcatgtcgaagatcacttaagaaagaaaacgaagactaatggctttgagaaaagtcttgatcaaggtccagttttggatgagaagctgaaggaggaaataaaagagagatcagatgcaaacaaagatcacgcagccaatcacgccaagccggaagcaaagtcagatgataaaaccactgtttgtcaagagaaggcagtaggaaccctggagagcgaggaacaaaaacccaagacagagcctgcccaaagctaagcattcagtgttgtaccgagtggtaatttatatggctgttttaacatagattagtacaggcgatatggttatagactgtacagttgttgttcaggcgggaccagatttagattagtgtttaatggaatagtatgctttaatacctttatgtaaccacttccatttggttcaaataagagttacaggaagagaaggtaacacaacaagagcccttctttgttgatggagcctgtgtaatagttgtagcatggggatgtatatgatttgattcaaccttattaatggttatgagacaaaactatc

SEQ ID NO: 2242 - protein, 463 aa, Arabidopsis thaliana
  G174
MAEVGKVLASDMELDHSNETKAVDDVVATTDKAEVIPVAVTRTETVVESLESTDCKELEKLVPHTVASQSEVDVASPVSEKAPKVSESSGALSLQSGSEGNSPFIREKVMEDGYNWRKYGQKLVKGNEFVRSYYRCTHPNCKAKKQLERSAGGQVVDTVYFGEHDHPKPLAGAVPINQDKRSDVFTAVSKEKTSGSSVQTLRQTEPPKIHGGLHVSVIPPADDVKTDISQSSRITGDNTHKDYNSPTAKRRKKGGNIELSPVERSTNDSRIVVHTQTLFDIVNDGYRWRKYGQKSVKGSPYPRSYYRCSSPGCPVKKHVERSSHDTKLLITTYEGKHDHDMPPGRVVTHNNMLDSEVDDKEGDANKTPQSSTLQSITKDQHVEDHLRKKTKTNGFEKSLDQGPVLDEKLKEEIKERSDANKDHAANHAKPEAKSDDKTTVCQEKAVGTLESEEQKPKTEPAQS

SEQ ID NO: 2243 - DNA, 1674 bp, Arabidopsis thaliana
  G176
agaagaagaagaagaagagtacctcatacgtaaaccattgatgggctcttttgatcgccaaagagctgttccgaaattcaaaacagcaacaccgtcaccgctccctctttctccttcgccttacttcactatgcctcctggccttactcccgccgactttctcgactctcctcttctcttcacttcctccaacattttgccgtctcctacgacaggcacatttccagcgcaatctctgaactataacaataacggtttgctcattgacaaaaatgaaatcaaatatgaagacacaactcctcccttgttcctaccatctatggtaactcagcctttacctcaactggatttattcaaatccgaaatcatgtcgagtaacaaaacctctgatgacggctacaattggcgcaaatacgggcagaagcaagtcaaaggaagcgaaaacccgaggagttacttcaaatgcacgtatccaaattgtctcacaaagaagaaagtagagacgtctcttgtgaagggtcagatgattgagattgtctataaaggaagccacaatcatcccaagccccaatccacgaagcgatcatcttccaccgctatagcagcacatcagaacagcagtaatggagacggtaaagacattggtgaagatgaaacagaggccaagagatggaaaagagaagagaatgtgaaggagccaagagtggtggttcagacaacaagtgatatagacattcttgacgatggctacagatggagaaagtatggtcagaaagtcgtcaagggtaatccaaatccaaggagctattacaagtgcacatttacaggatgttttgtaaggaaacacgttgaaagagcatttcaagatcccaagtcagtgatcacaacttacgaaggaaaacacaaacaccaaatcccgaccccaagaagaggtccagttttaagatctgctgcaatggcttctcctcttctcccaacttcgactactcctgatcaacttcccggcggcgatccacagttgctgagctctctacgcgtcctcttgtcccgcgttctagccaccgtccgtcacgcttctgcagatgccagaccctgggcagagctcgttgaccggtcagcgttttcccggccaccatcgctctcggaggcaacgtcacgagtaaggaagaacttttcctatttccgagccaattacataaccttagtggcaatcttactcgccgcgtctctgctcacgcaccctttcgctctcttcctcctcgcatcgctggccgcttcttggcttttcctctactttttccgtccggcggatcagccgttggtcattggaggacgcacgttctccgatcttgagacgctagggatactctgcctgtccactgtggtggtgatgttcatgaccagcgttggatcgctcttgatgtccactctagcagttgggatcatgggcgtggccatccacggagcgtttcgtgctcccgaagacctgtttcttgaagaacaagaagccattggatctggacttttcgcattcttcaacaacaatgcctctaatgcagctgccgctgccatagccacctcagcaatgtcacgcgttcgagtctgagattgttgaagagactacattcctacaccgcatttccaaagtgtgatatttattcatattgaattgtt

SEQ ID NO: 2244 - protein, 521 aa, Arabidopsis thaliana
  G176
MGSFDRQRAVPKFKTATPSPLPLSPSPYFTMPPGLTPADFLDSPLLFTSSNILPSPTTGTFPAQSLNYNNNGLLIDKNEIKYEDTTPPLFLPSMVTQPLPQLDLFKSEIMSSNKTSDDGYNWRKYGQKQVKGSENPRSYFKCTYPNCLTKKKVETSLVKGQMIEIVYKGSHNHPKPQSTKRSSSTAIAAHQNSSNGDGKDIGEDETEAKRWKREENVKEPRVVVQTTSDIDILDDGYRWRKYGQKVVKGNPNPRSYYKCTFTGCFVRKHVERAFQDPKSVITTYEGKHKHQIPTPRRGPVLRSAAMASPLLPTSTTPDQLPGGDPQLLSSLRVLLSRVLATVRHASADARPWAELVDRSAFSRPPSLSEATSRVRKNFSYFRANYITLVAILLAASLLTHPFALFLLASLAASWLFLYFFRPADQPLVIGGRTFSDLETLGILCLSTVVVMFMTSVGSLLMSTLAVGIMGVAIHGAFRAPEDLFLEEQEAIGSGLFAFFNNNASNAAAAAIATSAMSRVRV

SEQ ID NO: 2245 - DNA, 1974 bp, Arabidopsis thaliana
  G184
tgaattctagcctttttgtaggcgaatcatctggaccggtaagagactctctcatcgataataaccacataatttaatcaaactctttctctctctttctaagatcttttgctttgctcttttcctttttgatcttcctatatatggagaagcaccaaaacggtacttactatacgatactgtacggatccatcaaactggattaattatcaaaacgtacatttttatcttacctggcaagttacattcctagggttttggagaatccaatcaacaacaaagaaaataatcatcgttacaataatcagtatcacgcacagacttagatgttccggtttccagtgagtctaggcggttcacgtgacgaagaccgtcacgatcagatcacaccgttggatgaccatcgtgtggtggttgatgaggttgacttcttctcagagaagagagatagggtttcacgtgagaacatcaacgacgacgacgacgaaggcaataaggttctcatcaaaatggagggttcacgagttgaagaaaacgatcgttccagagatgtcaatatcggtctgaatcttctgaccgcgaatacgggaagcgatgagtcaacggtggatgatggactatcaatggatatggaagataaacgtgcaaagattgagaacgcacaactacaagaagagctcaagaagatgaaaatagagaatcaaaggctaagagatatgttgagccaagcgacgaccaacttcaatgccttacaaatgcaacttgttgccgtcatgaggcaacaagaacaacgtaactcttcacaagatcatctcctggagagcaaagcagaaggaaggaaacggcaggaactgcaaatcatggtgccaaggcagttcatggaccttgggccgtcgtctggagcagcagagcatggagccgaagtgtcatctgaagagaggacaacggttcgttcaggttctcctccttcgcttctagaaagttccaatccccgagagaacggaaagaggttgcttggaagagaagaaagctcagaggaatcagagtctaacgcctggggaaaccctaacaaagtccccaaacataatccatcctctagcaatagcaatggaaacagaaacggaaatgttattgatcagtcggccgcagaagccaccatgcggaaagcccgtgtctcagttcgtgcccgatctgaagctgccatgataagcgatggatgtcaatggagaaagtacggacaaaaaatggctaaaggaaacccgtgtccgcgggcttattatcgttgcacaatggccggtggatgtccagttcgcaagcaagtgcagcgttgcgcagaagacagatctattctcataaccacctacgaaggaaaccacaaccatccactcccaccagccgctacggccatggcctcaacaaccaccgcagctgcaagcatgctcctctcgggctcaatgtcgagtcaagacggtttaatgaacccaacaaacctcctagctcgagctatcttgccttgctcctcaagcatggctacaatctcagcctccgcaccattcccaaccatcacattggacctcaccaattcacccaacggtaacaaccctaatatgaccactaataacccgttgatgcagttcgctcaacggcccggtttcaacccggcagttttgcctcaagtggttggtcaagctatgtacaataaccaacaacagtccaagttttctggtttacagttaccggctcagccactgcagatcgcggccacttcctcggtggccgagagcgttagtgctgccagtgcagcaattgcgtccgatccaaactttgcggcggctctagcggcagcgatcacgtccattatgaacggttccagtcatcaaaataataacaccaataataataatgtggctacgagcaacaatgacagtaggcaataagagttttcattttgatggtcgatttttttttttgggg

SEQ ID NO: 2246 - protein, 536 aa, Arabidopsis thaliana
  G184
MFRFPVSLGGSRDEDRHDQITPLDDHRVVVDEVDFFSEKRDRVSRENINDDDDEGNKVLIKMEGSRVEENDRSRDVNIGLNLLTANTGSDESTVDDGLSMDMEDKRAKIENAQLQEELKKMKIENQRLRDMLSQATTNFNALQMQLVAVMRQQEQRNSSQDHLLESKAEGRKRQELQIMVPRQFMDLGPSSGAAEHGAEVSSEERTTVRSGSPPSLLESSNPRENGKRLLGREESSEESESNAWGNPNKVPKHNPSSSNSNGNRNGNVIDQSAAEATMRKARVSVRARSEAAMISDGCQWRKYGQKMAKGNPCPRAYYRCTMAGGCPVRKQVQRCAEDRSILITTYEGNHNHPLPPAATAMASTTTAAASMLLSGSMSSQDGLMNPTNLLARAILPCSSSMATISASAPFPTITLDLTNSPNGNNPNMTTNNPLMQFAQRPGFNPAVLPQVVGQAMYNNQQQSKFSGLQLPAQPLQIAATSSVAESVSAASAAIASDPNFAAALAAAITSIMNGSSHQNNNTNNNNVATSNNDSRQ

SEQ ID NO: 2247 - DNA, 1205 bp, Arabidopsis thaliana
  G185
atgcaaaaataaacatagtaacaatactttaaactatttacaccactttaatcttattctccactctttgaacgtaatggagaagaaccatagtagtggagagtgggagaagatgaagaacgagatcaacgagctaatgatagaaggaagagactatgcacaccagtttggatcagcttcatctcaagaaacacgtgaacatttagccaaaaagattcttcaatcttaccacaagtctctcaccatcatgaactactccggcgaacttgaccaagtttctcagggtggaggaagccccaagagcgatgattccgatcaagaaccacttgtcatcaagagttcgaagaagtcaatgccaaggtggagttcaaaagtcagaattgcccctggagctggtgttgatagaacgctggacgatggattcagttggagaaagtacggccagaaggatattctcggagccaaatttccaagaggatactatagatgcacgtatagaaagtctcaaggatgtgaagccactaaacaagtccaaagatctgatgaaaatcagatgctccttgagatcagttaccgaggaatacattcttgctctcaagctgcaaatgtcggtacaacaatgccgatacaaaacctcgaaccgaaccagacccaagaacacggaaatcttgacatggtaaaggaaagtgtagacaactacaatcaccaagcacatttgcatcacaaccttcactatccattgtcatctaccccaaatctagagaataacaatgcctatatgcttcaaatgcgagatcaaaacatcgaatattttggatctacgagcttctctagtgatctaggaactagtatcaactacaattttccagcatctggctcggcttctcactcagcatcaaactctccgtccaccgtccctttggaatccccgtttgaaagctatgatccaaatcatccatatggaggatttggtgggttctattcttagttatctacttaagggagggacggaactttttacatgacctcttgattaaagagagagttttcataatagctaatcaatttcctattcaaatatccgagttttttttctaatcatgtttatcaattgtcttattacagaaggcttattttcaggtctatgttgaaataaatggatttgtactcgtaggtatgatccttgttatctaaaaaaaaaaaaa

SEQ ID NO: 2248 - protein, 303 aa, Arabidopsis thaliana
  G185
MEKNHSSGEWEKMKNEINELMIEGRDYAHQFGSASSQETREHLAKKILQSYHKSLTIMNYSGELDQVSQGGGSPKSDDSDQEPLVIKSSKKSMPRWSSKVRIAPGAGVDRTLDDGFSWRKYGQKDILGAKFPRGYYRCTYRKSQGCEATKQVQRSDENQMLLEISYRGIHSCSQAANVGTTMPIQNLEPNQTQEHGNLDMVKESVDNYNHQAHLHHNLHYPLSSTPNLENNNAYMLQMRDQNIEYFGSTSFSSDLGTSINYNFPASGSASHSASNSPSTVPLESPFESYDPNHPYGGFGGFYS

SEQ ID NO: 2249 - DNA, 1136 bp, Arabidopsis thaliana
  G187
tagacctcttaggaaaaaaacctaaaaacctaatccccaaacctaaaaggcttatctcatctcttcttctttgtcttctttactctttttttacctctctcttcattgttcttcaccatgtctaatgaaaccagagatctctacaactaccaatacccttcatcgttttcgttgcacgaaatgatgaatctgcctacttcaaatccatcttcttatggaaacctcccatcacaaaacggttttaatccatctacttattccttcaccgattgtctccaaagttctccagcagcgtatgaatctctacttcagaaaacttttggtctttctccctcttcctcagaggttttcaattcttcgatcgatcaagaaccgaaccgtgatgttactaatgacgtaatcaatggtggtgcatgcaacgagactgaaactagggtttctccttctaattcttcctctagtgaggctgatcaccccggtgaagattccggtaagagccggaggaaacgagagttagtcggtgaagaagatcaaatttccaaaaaagttgggaaaacgaaaaagactgaggtgaagaaacaaagagagccacgagtctcgtttatgactaaaagtgaagttgatcatcttgaagatggttatagatggagaaaatacggccaaaaggctgtaaaaaatagcccttatccaaggagttactatagatgtacaacacaaaagtgcaacgtgaagaaacgagtggagagatcgttccaagatccaacggttgtgattacaacttacgagggtcaacacaaccacccgattccgactaatcttcgaggaagttctgccgcggctgctatgttctccgcagacctcatgactccaagaagctttgcacatgatatgtttaggacggcagcttatactaacggcggttctgtggcggcggctttggattatggatatggacaaagtggttatggtagtgtgaattcaaaccctagttctcaccaagtgtatcatcaagggggtgagtatgagctcttgagggagatttttccttcaattttctttaagcaagagccttgatcgatcattgttataactacatatattatatatattgagagagagaggtagagaaaaaaaaa

SEQ ID NO: 2250 - protein, 318 aa, Arabidopsis thaliana
  G187
MSNETRDLYNYQYPSSFSLHEMMNLPTSNPSSYGNLPSQNGFNPSTYSFTDCLQSSPAAYESLLQKTFGLSPSSSEVFNSSIDQEPNRDVTNDVINGGACNETETRVSPSNSSSSEADHPGEDSGKSRRKRELVGEEDQISKKVGKTKKTEVKKQREPRVSFMTKSEVDHLEDGYRWRKYGQKAVKNSPYPRSYYRCTTQKCNVKKRVERSFQDPTVVITTYEGQHNHPIPTNLRGSSAAAAMFSADLMTPRSFAHDMFRTAAYTNGGSVAAALDYGYGQSGYGSVNSNPSSHQVYHQGGEYELLREIFPSIFFKQEP

SEQ ID NO: 2251 - DNA, 1418 bp, Arabidopsis thaliana
  G194
tctttcttctctctctatctctcctctttgaaccctaaaaactctttctttacaaggattgatctttttgtatttttgattttgacatttgctttgtgttcgatctctgttttgatgcgatttctctgtttttaaagccatttgatagattgtttccggtaaagctcagcgagagaagaagaagaacaacaatggagtttacagatttctcaaagacgagtttttactacccgtcgtcacaaagcgtttgggatttcggagatttagcggcggcggagaggcattctttagggttcatggagttattaagttctcagcagcatcaagactttgctactgtttctcctcattccttccttctccaaacgtctcaaccgcaaacgcaaacgcaaccatcggcgaagctgtcttcaagtatcattcaagctccaccgtcagagcaattagtgacgtcaaaggtggagtctttgtgttcggatcatttgttgataaacccaccggcgactcctaactcgtcatcgatttcgtctgcttcaagcgaggctctaaatgaagagaaaccgaaaacagaagacaatgaagaagaaggaggtgaagatcaacaagagaagagtcatactaagaaacagttgaaagcaaagaagaataatcagaagagacagagagaggcaagagtcgcattcatgacaaagagtgaagttgatcatctcgaagatggttatcgctggcgaaaatatggtcaaaaagctgtcaaaaacagtccttttcccaggagttactaccgttgcacaacggcttcatgtaacgtgaagaagagagtggagagatcattcagagatccaagcactgtggttacaacctacgaaggtcaacacactcacattagtccactcacgtctcgtcctatttccactggaggtttcttcggatcgtcaggagctgcttcgagtctcggtaatggttgctttgggtttcctattgatggctccacgttaatctctcctcagttccaacagcttgtccaataccatcaccaacagcagcaacaagaactcatgtcttgttttggaggagtcaacgagtaccttaatagccacgctaatgagtatggtgatgataatcgtgtgaagaagagtcgagttttggttaaagataatggacttctgcaagatgttgttccgtctcatatgttgaaggaagagtagtagtatatatatagtcttatagttttaatctagtttttttttgtataattgtctaaaagaaacggatcttttgttctgatgaagaagatgttttcttatggttctgaaatcgtaaggtaatgatgattgtaccaagccgagaaagtacttgtgattttcaccattgaatcactataaatgtaatttttatttactgtgaaaaaaaaaaaaaaa

SEQ ID NO: 2252 - protein, 337 aa, Arabidopsis thaliana
  G194
MEFTDFSKTSFYYPSSQSVWDFGDLAAAERHSLGFMELLSSQQHQDFATVSPHSFLLQTSQPQTQTQPSAKLSSSIIQAPPSEQLVTSKVESLCSDHLLINPPATPNSSSISSASSEALNEEKPKTEDNEEEGGEDQQEKSHTKKQLKAKKNNQKRQREARVAFMTKSEVDHLEDGYRWRKYGQKAVKNSPFPRSYYRCTTASCNVKKRVERSFRDPSTVVTTYEGQHTHISPLTSRPISTGGFFGSSGAASSLGNGCFGFPIDGSTLISPQFQQLVQYHHQQQQQELMSCFGGVNEYLNSHANEYGDDNRVKKSRVLVKDNGLLQDVVPSHMLKEE

SEQ ID NO: 2253 - DNA, 1269 bp, Arabidopsis thaliana
  G195
  misc_feature (1239)..(1239): n is a, c, g, or t
  misc_feature (1242)..(1242): n is a, c, g, or t
  misc_feature (1244)..(1244): n is a, c, g, or t
  misc_feature (1261)..(1263): n is a, c, g, or t
  misc_feature (1266)..(1267): n is a, c, g, or t
ttttctttttctttctttttggtttaagttttttctctttgttcttcgtcatgtctcatgaaatcaaagatcttaacaactatcactacacttcatcgtataatcattacaatatcaacaaccaaaatatgattaatctcccttacgtttctggtccatctgcttataatgcaaacatgatctcatcatcacaagtaggttttgatctaccctcgaagaacttgagtcctcaaggagccttcgagttgggtttcgagctttctccatcttcttctgacttttttaatccttccctcgatcaagagaacggtttgtataatgcttataattataatagtagtcaaaagagtcatgaagttgtcggtgatggttgtgcaaccattaagagtgaagttagggtttcagcatctccttcttcaagtgaggccgatcatcatccaggagaagattccggcaagatccggaagaaaagagaagttcgcgatggaggagaagatgatcaacgctctcagaaagtagttaaaacaaagaagaaagaggagaagaaaaaagagccacgagtctcgttcatgactaagaccgaagttgatcatctcgaagacggctatcgttggagaaagtatggccaaaaagcagtcaaaaacagtccttatccgaggagttactatagatgcacgactcagaagtgcaacgtgaagaagagagtggagagatcttaccaagacccaacggtcgtcatcacaacctacgagagtcaacacaaccatccgatcccgaccaatcgtcggacagcaatgttctctggaaccaccgcatctgattataacccatcatcgtctccaatattctccgatctcatcatcaatactccaagaagcttctcaaatgatgatctcttccgtgtgccatacgctagtgtgaacgtgaaccctagttatcatcaacagcaacatggatttcatcaacaggagagtgagttcgagctcttgaaggagatgtttccttcggttttcttcaaacaagagccttgatgatataatataatatagaaacaattttttttctgctaagaaatatagaacaaaacttggatgcataataagtgatgatagtgttatttattttttgcatgtatatattatacatgttttgttaactagctataggatatactggtagtaattaagcataaatatggagcccttcgacttattacaataatttttggtatggaaaaanttngntacatgcctgccttttnnnttnngg

SEQ ID NO: 2254 - protein, 326 aa, Arabidopsis thaliana
  G195
MSHEIKDLNNYHYTSSYNHYNINNQNMINLPYVSGPSAYNANMISSSQVGFDLPSKNLSPQGAFELGFELSPSSSDFFNPSLDQENGLYNAYNYNSSQKSHEVVGDGCATIKSEVRVSASPSSSEADHHPGEDSGKIRKKREVRDGGEDDQRSQKVVKTKKKEEKKKEPRVSFMTKTEVDHLEDGYRWRKYGQKAVKNSPYPRSYYRCTTQKCNVKKRVERSYQDPTVVITTYESQHNHPIPTNRRTAMFSGTTASDYNPSSSPIFSDLIINTPRSFSNDDLFRVPYASVNVNPSYHQQQHGFHQQESEFELLKEMFPSVFFKQEP

SEQ ID NO: 2255 - DNA, 1107 bp, Arabidopsis thaliana
  G207
aaaagatctgtttcaatggcggatcgtgttaaaggtccatggagtcaagaagaagatgagcagctacgaaggatggttgagaaatacggaccgaggaattggtctgcgattagcaaatcgattccaggtcgatctggtaaatcgtgtagattacgttggtgtaatcagttatctccggaggttgagcatcgtcctttctcgccggaggaagatgagactattgtaaccgcccgtgctcagtttggtaacaagtgggcgacgattgctcgtcttcttaacggtcgtacggataacgccgttaaaaatcactggaactctacgcttaagaggaaatgcagcggaggtgtggcggttacgacggtgacggagacggaggaagatcaggatcggccgaagaagaggagatctgttagctttgatcctgcttttgctccggtggatactggattgtacatgagtcctgagagtcctaacggaatcgatgttagtgattctagcacgattccgtcaccgtcgtctcctgttgctcagctgtttaaaccaatgccgatttccggcggttttacggtggttccgcagccgttaccggttgaaatgtcttcgtcttcggaggatccacctacttcgttgagtttgtcactacctggagctgagaacacgagttcgagccataacaataacaacaacgcgttgatgtttccgagatttgagagtcagatgaagattaatgtagaggagagaggaggaggaggagaaggacgtagaggtgagtttatgacggtggtgcaggagatgataaaagctgaagtgaggagttacatggcggaaatgcagaaaacaagtggtggattcgtcgtcggaggtttatacgaatccggcggcaatggtggttttagggattgtggagtaataacacctaaggttgagtagttttggtttagggttaaaacttgaatcgattggggattttcaagagcattcatttttggggtttatggtaaaattaaaaacaaaaacaaaatgtacagaggaattaaaatttctatggaataatcttaaatctcaaatatttgttacttgttttggtgattcataaccaaaatcaaa

SEQ ID NO: 2256 - protein, 304 aa, Arabidopsis thaliana
  G207
MADRVKGPWSQEEDEQLRRMVEKYGPRNWSAISKSIPGRSGKSCRLRWCNQLSPEVEHRPFSPEEDETIVTARAQFGNKWATIARLLNGRTDNAVKNHWNSTLKRKCSGGVAVTTVTETEEDQDRPKKRRSVSFDPAFAPVDTGLYMSPESPNGIDVSDSSTIPSPSSPVAQLFKPMPISGGFTVVPQPLPVEMSSSSEDPPTSLSLSLPGAENTSSSHNNNNNALMFPRFESQMKINVEERGGGGEGRRGEFMTVVQEMIKAEVRSYMAEMQKTSGGFVVGGLYESGGNGGFRDCGVITPKVE

SEQ ID NO: 2257 - DNA, 1110 bp, Arabidopsis thaliana
  G215
atgactcgtcggtgttcgcattgtagcaacaatgggcacaattcacgcacgtgtccaacgcgtgggtctggttcctcctccgccgtgaagttatttggtgtgaggttaacggatggctcgattattaaaaagagtgcgagtatgggtaatctctcggcattggctgttgcggcggcggcggcaacgcaccaccgtttatctccgtcgtctcctctggcgacgtcaaatcttaatgattcgccgttatcggatcatgcccgatactctaatttgcatcataatgaagggtatttatctgatgatcctgctcatggttctgggtctagtcaccgtcgtggtgagaggaagagaggtgttccttggactgaagaggaacatagactattcttagtcggtcttcagaaactcgggaaaggagattggcgcggtatttcgagaaactatgtaacgtcaagaactcctacacaagtggctagtcatgctcaaaagtattttattcgacatactagttcaagccgcaggaaaagacggtctagcctcttcgacatggttacagatgagatggtaaccgattcatcgccaacacaggaagagcagaccttaaacggttcctctccaagcaaggaacctgaaaagaaaagctaccttccttcacttgagctctcactcaataataccacagaagctgaagaggtcgtagccacggcgccacgacaggaaaaatctcaagaagctatagaaccatcaaatggtgtttcaccaatgctagtcccgggtggcttctttcctccttgttttccagtgacttacacgatttggctccctgcgtcacttcacggaacagaacatgccttaaacgctgagacttcttctcagcagcatcaggtcctaaaaccaaaacctggatttgctaaagaacgtgtgaacatggacgagttggtcggtatgtctcagcttagcataggaatggcgacaagacacgaaaccgaaacttccccttccccgctatctttgagactagagccctcaaggccatcagcgtttcactcgaatggctcggttaatggtgcagatttgagtaaaggcaacagcgcgattcaggctatctaa

SEQ ID NO: 2258 - protein, 369 aa, Arabidopsis thaliana
  G215
MTRRCSHCSNNGHNSRTCPTRGSGSSSAVKLFGVRLTDGSIIKKSASMGNLSALAVAAAAATHHRLSPSSPLATSNLNDSPLSDHARYSNLHHNEGYLSDDPAHGSGSSHRRGERKRGVPWTEEEHRLFLVGLQKLGKGDWRGISRNYVTSRTPTQVASHAQKYFIRHTSSSRRKRRSSLFDMVTDEMVTDSSPTQEEQTLNGSSPSKEPEKKSYLPSLELSLNNTTEAEEVVATAPRQEKSQEAIEPSNGVSPMLVPGGFFPPCFPVTYTIWLPASLHGTEHALNAETSSQQHQVLKPKPGFAKERVNMDELVGMSQLSIGMATRHETETSPSPLSLRLEPSRPSAFHSNGSVNGADLSKGNSAIQAI

SEQ ID NO: 2259 - DNA, 2807 bp, Arabidopsis thaliana
  G217
cttcgttcttaccgagttccacgagcattagcttcagagaccttgaattggagtgcggttggatcaaaaacagttgagcgaagatgaggattatgattaagggaggtgtttggaagaacaccgaagatgagattctcaaagccgccgtgatgaagtatggtaagaaccaatgggctcggatctcgtctcttctcgttcgtaagtctgctaaacagtgtaaagctcgctggtacgagtggctcgatccatctatcaaaaagactgaatggaccagagaagaagatgagaagcttctacatcttgctaaacttctgcctactcaatggagaactattgctcctattgtgggtcgtacaccatctcaatgtcttgagaggtatgagaagctccttgatgcagcatgcactaaggatgaaaattatgatgcagcggatgatccacgaaaattacgtcctggtgagattgatccgaacccagaagcaaagcctgctcgtcctgatccggtagacatggacgaagatgagaaagaaatgctttctgaagcaagagctagattggctaacacgaggggaaagaaggctaaaagaaaagctagagaaaaacaacttgaggaagctagaaggcttgcttctctgcaaaaaagaagagaactaaaagcagctgggattgatggaaggcataggaaaagaaagagaaagggaatcgactataatgcagaaattccttttgaaaagagggcacctgcgggattttatgatactgcggatgaagatcgtcctgctgatcaagtaaaatttccaactaccattgaagaacttgaaggaaaaagaagagctgatgtagaagcacatttacgcaaacaagatgttgcaaggaataaaattgctcagagacaggatgctccagcagctatattgcaagcaaacaagctgaatgatccggaagttgttaggaagaggtcaaagctgatgttaccaccaccgcagatttcagaccacgagctagaagaaattgctaagatgggctatgccagtgaccttcttgccgagaatgaggagctaacagaaggcagtgctgctactcgtgcacttttggcaaattactcacaaacaccaaggcaaggaatgacacccatgaggacacctcaaagaactcctgctggtaaaggtgatgctattatgatggaagcagaaaacctggccagattaagagactctcagacacctttgctaggaggagaaaatcctgagttgcacccttctgacttcactggggtcactccgagaaagaaggagattcaaacgcctaatccaatgttgaccccttcaatgactcctggtggtgctggtcttactccaagaattggcttgacgccatcaagggatgggtcttctttttctatgacacccaaagggactcccttcagggatgaacttcacattaacgaagacatggacatgcagcaaagtgcaaaacttgagaggcagagacgagaggaagctagaaggagtttacgctctggtttgactgggcttcctcagccaaagaacgagtaccaaatagttgcacaacctcctcctgaggaaagtgaagagccagaagagaaaattgaggaagacatgtcagacaggatagcgagggaaaaggcggaggaagaagcaagacaacaggcattgcttaagaagagatccaaggtcttgcagagagatcttcctagacccccagctgcttcattggcagtaattaggaactcgttgctttcagctgatggagacaaaagttctgttgttcctcctactccgattgaggttgcagataaaatggtaagagaggagcttctacagttgctggagcatgataatgcaaagtatccgcttgatgacaaagctgagaagaagaaaggagccaagaaccgtaccaaccgttctgcttctcaagttcttgcaattgacgattttgatgaaaatgagctccaagaggctgacaaaatgataaaggaggaggggaagtttctgtgtgtgtcaatgggacatgagaacaagacacttgatgattttgtagaagctcacaacacatgcgtgaatgatctcatgtatttccccactcgaagcgcttacgagctctcaagtgttgctgggaacgcggacaaagttgcagcttttcaggaggagatggagaatgtgagaaaaaagatggaggaggatgagaagaaggcagaacacatgaaggccaagtacaaaacttatacaaagggtcatgagaggagggcagagaccgtgtggacccaaatagaggcgacattgaagcaggctgagattggtggaacagaagtagagtgctttaaagcattgaagaggcaagaagagatggctgcatcttttaggaaaaagaatttgcaagaggaagtgataaagcaaaaggaaacagagagtaaactgcagactcgctatgggaatatgttggcaatggttgaaaaagcagaggagataatggtcggtttccgagcacaggcattgaagaaacaagaggatgttgaagattctcacaaactgaaagaagctaagctagccactggagaggaagaggacatagccatagccatggaagcttctgcataaaaacttgagttttgtattgcttacaagttttaaggagacgtagcttgactttgtattggtaagtttttttaatatgagtcatgactttgtaaaaaggttatgatatattctctgtttgtatgctttgcaagagtcaagaaatttgaatgcttcaggatcaaaaaaaaaaaaaaaaaaaaaaaaaaaaaa

SEQ ID NO: 2260 - protein, 844 aa, Arabidopsis thaliana
  G217
MRIMIKGGVWKNTEDEILKAAVMKYGKNQWARISSLLVRKSAKQCKARWYEWLDPSIKKTEWTREEDEKLLHLAKLLPTQWRTIAPIVGRTPSQCLERYEKLLDAACTKDENYDAADDPRKLRPGEIDPNPEAKPARPDPVDMDEDEKEMLSEARARLANTRGKKAKRKAREKQLEEARRLASLQKRRELKAAGIDGRHRKRKRKGIDYNAEIPFEKRAPAGFYDTADEDRPADQVKFPTTIEELEGKRRADVEAHLRKQDVARNKIAQRQDAPAAILQANKLNDPEVVRKRSKLMLPPPQISDHELEEIAKMGYASDLLAENEELTEGSAATRALLANYSQTPRQGMTPMRTPQRTPAGKGDAIMMEAENLARLRDSQTPLLGGENPELHPSDFTGVTPRKKEIQTPNPMLTPSMTPGGAGLTPRIGLTPSRDGSSFSMTPKGTPFRDELHINEDMDMQQSAKLERQRREEARRSLRSGLTGLPQPKNEYQIVAQPPPEESEEPEEKIEEDMSDRIAREKAEEEARQQALLKKRSKVLQRDLPRPPAASLAVIRNSLLSADGDKSSVVPPTPIEVADKMVREELLQLLEHDNAKYPLDDKAEKKKGAKNRTNRSASQVLAIDDFDENELQEADKMIKEEGKFLCVSMGHENKTLDDFVEAHNTCVNDLMYFPTRSAYELSSVAGNADKVAAFQEEMENVRKKMEEDEKKAEHMKAKYKTYTKGHERRAETVWTQIEATLKQAEIGGTEVECFKALKRQEEMAASFRKKNLQEEVIKQKETESKLQTRYGNMLAMVEKAEEIMVGFRAQALKKQEDVEDSHKLKEAKLATGEEEDIAIAMEASA

SEQ ID NO: 2261 - DNA, 1182 bp, Arabidopsis thaliana
  G218
atggaggcagagatcgtgagacgatcggaggtaacgggattaagaagggaggtggaagaatcgtcaattggtagaggagattgcgatggtgatggcggcgatgtgggagaagatgcggcagggttcgttgggacgagcgggagaggaagaagagatcgagttaaagggccgtggtcgaaggaggaggatgatgtgttgagtgagctcgttaagaggttgggagcgaggaattggagttttatcgctcggagtattcctggtcgttcaggcaagtcttgtcgtcttcgttggtgtaatcagctcaatccaaatcttatacgcaattcatttactgaggtagaggatcaggctatcatcgcagcacatgccatccacggaaacaaatgggctgttatcgcgaagctcctccccggaagaacagataatgctatcaagaaccactggaactctgctttaagacgtcgattcatagactttgaaaaggccaagaatataggaactggaagcttggtcgtggatgattctggatttgacagaacgacaacagtagcctcatcagaagaaactttatcttcaggcggtggttgccatgtaactactccaattgtatctccagaaggcaaagaagctaccacctccatggaaatgtctgaagaacaatgcgtagagaaaacaaacggagaaggtatttctaggcaagatgataaggatcctccaacgcttttccgcccagtgcctcggctcagttcttttaatgcttgcaatcacatggaaggatcaccctctccacatatacaagaccaaaatcagctccaatcatctaaacaagacgcagcaatgctaagattgcttgaaggagcttacagcgaacggtttgtgcctcaaacatgtggaggtggttgttgcagcaacaatcccgatggcagttttcagcaagaatcattgttgggtccagagtttgtggattacttagactcaccaacgtttccgagttccgaactagctgctatagcaacggaaataggcagcctcgcttggctgagaagcggtttagagagtagcagcgtgagggtgatggaagacgcagttggtcggttaaggcctcaaggctccaggggtcatcgagatcattatcttgtatctgaacaggggacgaacataaccaatgtcctgtccacataa

SEQ ID NO: 2262 - protein, 393 aa, Arabidopsis thaliana
  G218
MEAEIVRRSEVTGLRREVEESSIGRGDCDGDGGDVGEDAAGFVGTSGRGRRDRVKGPWSKEEDDVLSELVKRLGARNWSFIARSIPGRSGKSCRLRWCNQLNPNLIRNSFTEVEDQAIIAAHAIHGNKWAVIAKLLPGRTDNAIKNHWNSALRRRFIDFEKAKNIGTGSLVVDDSGFDRTTTVASSEETLSSGGGCHVTTPIVSPEGKEATTSMEMSEEQCVEKTNGEGISRQDDKDPPTLFRPVPRLSSFNACNHMEGSPSPHIQDQNQLQSSKQDAAMLRLLEGAYSERFVPQTCGGGCCSNNPDGSFQQESLLGPEFVDYLDSPTFPSSELAAIATEIGSLAWLRSGLESSSVRVMEDAVGRLRPQGSRGHRDHYLVSEQGTNITNVLST

SEQ ID NO: 2263 - DNA, 989 bp, Arabidopsis thaliana
  G227
gtaccgtcgacgatccggcgatgtcaaacccgacccgtaagaatatggagaggattaaaggtccatggagtccagaagaagatgatctgttgcagaggcttgttcagaaacatggtccgaggaactggtctttgattagcaaatcaatccctggacgttccggcaaatcttgtcgtctccggtggtgtaaccagctatctccggaggtagagcaccgtgctttttcgcaggaagaagacgagacgattattcgagctcacgctcggtttggtaacaagtgggctacgatctctcgtcttctcaatggacgaaccgataacgctatcaagaatcattggaactcgacgctgaagcgaaaatgcagcgtcgaagggcaaagttgtgattttggtggtaatggagggtatgatggtaatttaggagaagagcaaccgttgaaacgtacggcgagtggtggtggtggtgtctcgactggcttgtatatgagtcccggaagtccatcgggatctgacgtcagcgagcaatctagtggtggtgcacacgtgtttaaaccaacggttagatctgaggttacagcgtcatcgtctggtgaagatcctccaacttatcttagtttgtctcttccttggactgacgagacggttcgagtcaacgagccggttcaacttaaccagaatacggttatggacggtggttatacggcggagctgtttccggttagaaaggaagagcaagtggaagtagaagaagaagaagcgaaggggatatctggtggattcggtggtgagttcatgacggtggttcaggagatgataaggacggaggtgaggagttacatggcggatttacagcgaggaaacgtcggtggtagtagttctggcggcggaggtggcggttcgtgtatgccacaaagtgtaaacagccgtcgtgttgggtttagagagtttatagtgaaccaaatcggaattgggaagatggagtaggcggcc

SEQ ID NO: 2264 - protein, 320 aa, Arabidopsis thaliana
  G227
MSNPTRKNMERIKGPWSPEEDDLLQRLVQKHGPRNWSLISKSIPGRSGKSCRLRWCNQLSPEVEHRAFSQEEDETIIRAHARFGNKWATISRLLNGRTDNAIKNHWNSTLKRKCSVEGQSCDFGGNGGYDGNLGEEQPLKRTASGGGGVSTGLYMSPGSPSGSDVSEQSSGGAHVFKPTVRSEVTASSSGEDPPTYLSLSLPWTDETVRVNEPVQLNQNTVMDGGYTAELFPVRKEEQVEVEEEEAKGISGGFGGEFMTVVQEMIRTEVRSYMADLQRGNVGGSSSGGGGGGSCMPQSVNSRRVGFREFIVNQIGIGKME

SEQ ID NO: 2265 - DNA, 1209 bp, Arabidopsis thaliana
  G229
ttgtggtcagtggaataaacacatataaccgccggagaaaatgggaagagcgccatgttgcgagaaggtcggtatcaagagagggcggtggacggcggaggaggaccagattctctccaactacattcaatccaatggtgaaggttcttggagatctctccccaaaaatgccggattaaaaaggtgtggaaagagctgtagattgagatggataaactatctaagatcagacctcaagcgtggaaacataactccagaagaagaagaactcgttgttaaattgcattccactttgggaaacaggtggtcactaatcgcgggtcatctaccagggagaacagacaacgaaataaaaaattattggaactctcatctcagccgtaaactccacaacttcattaggaagccatccatctctcaagacgtctccgccgtaatcatggcgaacgcttcttcagcgccaccgccgccgcaggcaaaacgcagacttgggagaacgagtaggtccgctatgaaaccaaaaatccgcagaacaaaaactcgtaaaacgaagaaaacgtctgcaccaccggagcctaacgccgatgtagctggggctgataaagaagcattaatggtggagtcaagtggagccgaggctgagctaggacgaccatgtgactactatggagatgattgtaacaaaaatctcatgagcattaatggcgataatggagttttaacgtttgatgatgatatcatcgatcttttgttggacgagtcagatcctggccacttgtacacaaacacaacgtgcggtggtggtggggagttgcataacataagagactctgaaggagccagagggttctcggatacttggaaccaagggaatctcgactgtcttcttcagtcttgtccatctgtggagtcgtttctcaactacgaccaccaagttaacgacgcgtcgacggatgagtttatcgattgggattgtgtttggcaagaaggtagtgataataatctttggcatgagaaagagaatcccgactcaatggtctcgtggcttttagacggtgatgatgaggccacgatcgggaatagtaattgtgagaactttggagaaccgttagatcatgacgacgaaagcgctttggtcgcttggcttctgtcatgatgatattgattgatccgttatgtaatcttttttgtgcattcacagtttgaatc

SEQ ID NO: 2266 - protein, 371 aa, Arabidopsis thaliana
  G229
MGRAPCCEKVGIKRGRWTAEEDQILSNYIQSNGEGSWRSLPKNAGLKRCGKSCRLRWINYLRSDLKRGNITPEEEELVVKLHSTLGNRWSLIAGHLPGRTDNEIKNYWNSHLSRKLHNFIRKPSISQDVSAVIMANASSAPPPPQAKRRLGRTSRSAMKPKIRRTKTRKTKKTSAPPEPNADVAGADKEALMVESSGAEAELGRPCDYYGDDCNKNLMSINGDNGVLTFDDDIIDLLLDESDPGHLYTNTTCGGGGELHNIRDSEGARGFSDTWNQGNLDCLLQSCPSVESFLNYDHQVNDASTDEFIDWDCVWQEGSDNNLWHEKENPDSMVSWLLDGDDEATIGNSNCENFGEPLDHDDESALVAWLLS

SEQ ID NO: 2267 - DNA, 1139 bp, Arabidopsis thaliana
  G234
cacaacatcatacccaccaacatatataatcttgatcatagagagataaacagaggccgctatcaagaacaagactaagaacaagacttcactaggagtacaagtatgggaagagcaccgtgttgtgacaaagcaaacgtgaagaaagggccttggtctcctgaggaagatgcaaaactcaaatcttacattgaaaatagtggcaccggaggcaattggatcgctttgcctcaaaagattggtttaaagagatgtggaaagagttgcaggctgaggtggcttaactatcttagaccaaacatcaaacatggtggcttctctgaggaagaagaaaacatcatttgtagcctttaccttacaattggtagcaggtggtctataatcgctgctcaattgccgggacgaacagacaacgatataaaaaactattggaacacgaggctcaagaagaaactcattaacaaacaacgcaaggagcttcaagaagcttgtatggagcagcaagagatgatggtgatgatgaagagacaacaccaacaacaacaaatccaaacttcttttatgatgagacaagaccaaacaatgttcacatggccactacatcatcataatgttcaagttccagctcttttcagaatcaaaccaactcgttttgcgaccaagaagatgttaagccagtgctcatcaagaacatggtcaagatcgaagatcaagaactggagaaaacaaacctcatcatcatcaagattcaatgacaacgcttttgatcatctctctttctctcaactcttgttagatcctaatcataaccacttaggatcaggagagggtttctccatgaactctatcttgagcgccaacacaaactctccattgcttaacacaagtaatgataatcagtggttcgggaatttccaggccgaaaccgtaaacttgttctcaggagcctccacaagtacttcggcagatcaaagcactataagttgggaagacataagctctcttgtttattctgattcaaagcaatttttttaattataataatatattattcttaagatgaaacgtacatcattattattaattgggggtacgtaacgtatatatggaataacgatctagtttgtttaaatttaaaa

SEQ ID NO: 2268 - protein, 309 aa, Arabidopsis thaliana
  G234
MGRAPCCDKANVKKGPWSPEEDAKLKSYIENSGTGGNWIALPQKIGLKRCGKSCRLRWLNYLRPNIKHGGFSEEEENIICSLYLTIGSRWSIIAAQLPGRTDNDIKNYWNTRLKKKLINKQRKELQEACMEQQEMMVMMKRQHQQQQIQTSFMMRQDQTMFTWPLHHHNVQVPALFRIKPTRFATKKMLSQCSSRTWSRSKIKNWRKQTSSSSRFNDNAFDHLSFSQLLLDPNHNHLGSGEGFSMNSILSANTNSPLLNTSNDNQWFGNFQAETVNLFSGASTSTSADQSTISWEDISSLVYSDSKQFF

SEQ ID NO: 2269 - DNA, 920 bp, Arabidopsis thaliana
  G237
atggcgaagacgaaatatggagagagacataggaaagggttatggtcacctgaagaagacgagaagctaaggagcttcatcctctcttatggccattcttgctggaccactgttcccatcaaagctgggttacaaaggaatgggaagagctgcagattaagatggattaattacctaagaccagggttaaagagggatatgattagtgcagaagaagaagagactatcttgacgtttcattctcccttgggtaacaagtggtcgcaaatagctaaattcttaccgggaagaacagacaatgagataaagaactattggcactctcatttgaaaaagaaatggctcaagtctcagagcttacaagatgcaaaatctatttcccctccttcgtcttcatcatcatcacttgttgcttgtggagaaagaaatccggaaaccttgatctcgaatcacgtgttctccctccagagacttctagagaacaaatcttcatctccctcacaagaaagcaacggaaataacagccatcaatgttcttctgctcctgagattccaaggcttttcttctctgaatggctttcttcttcatatccccacaccgattattcctctgagtttaccgactctaagcacagtcaagctccaaatgtcgaagagactctctcagcttatgaagaaatgggtgatgttgatcagttccattacaacgaaatgatgatcaacaacagcaactggactcttaacgacattgtgtttggttccaaatgtaagaagcaggagcatcatatttatagagaggcttcagattgtaattcttctgctgaattcttttctccaccaacaacgacgtaaattgcgtttattgtaatgtaaatcaaatttctaaggcaaaaccggaaaaaaaaaaaaaaaaaaaaaaa

SEQ ID NO: 2270 - protein, 283 aa, Arabidopsis thaliana
  G237
MAKTKYGERHRKGLWSPEEDEKLRSFILSYGHSCWTTVPIKAGLQRNGKSCRLRWINYLRPGLKRDMISAEEEETILTFHSPLGNKWSQIAKFLPGRTDNEIKNYWHSHLKKKWLKSQSLQDAKSISPPSSSSSSLVACGERNPETLISNHVFSLQRLLENKSSSPSQESNGNNSHQCSSAPEIPRLFFSEWLSSSYPHTDYSSEFTDSKHSQAPNVEETLSAYEEMGDVDQFHYNEMMINNSNWTLNDIVFGSKCKKQEHHIYREASDCNSSAEFFSPPTTT

SEQ ID NO: 2271 - DNA, 1195 bp, Arabidopsis thaliana
  G242
ctctcaaaaccaaaatcactaaagaggagaagattgctaaagtttgataaaacattccaaaatcaatggctgataggatcaaaggtccatggagtcctgaagaagacgagcagcttcgtaggcttgttgttaaatacggtccaagaaactggacagtgattagcaaatctattcccggtagatcggggaaatcgtgtcgtttacggtggtgcaaccagctttcgccgcaagttgagcatcggccgttttcggctgaggaagacgagacgatcgcacgtgctcacgctcagttcgggaataaatgggcgacgattgctcgtcttctcaacggtcgtacggacaacgccgtgaagaatcactggaactcgacgctcaagaggaaatgcggcggttacgaccatcggggttacgatggttcggaggatcatcggccggttaagagatcggtgagtgcgggatctccacctgttgttactgggctttacatgagcccaggaagcccaactggatctgatgtcagtgattcaagtactatcccgatattaccttccgttgagcttttcaagcctgtgcctagacctggtgctgttgtgctaccgcttcctatcgaaacgtcgtctttttccgatgatccaccgacttcgttaagcttgtcacttcctggtgccgacgtaagcgaggagtcaaaccgtagccacgagtcaacgaatatcaacaacaccacttcgagccgccacaaccacaacaatacggtgtcgtttatgccgtttagtggtgggtttagaggtgcgattgaggaaatggggaagtcttttcccggtaacggaggcgagtttatggcggtggtgcaagagatgattaaggcggaagtgaggagttacatgacggagatgcaacggaacaatggtggcggattcgtcggaggattcattgataatggcatgattccgatgagtcaaattggagttgggagaatcgagtagacaaagtgagattattaggaaactgtttaaattggagaagaagaaaaatgctctgtttttttctcctttggattaggcttaagaattttgggttttaaggaaatgtatagaggaaatcgagtgaacaaagctcgagagctggggacgtagtgacgaagacgaagatcaaatttctcttaagctattcaggaaaataaaataaatttttattt

SEQ ID NO: 2272 - protein, 305 aa, Arabidopsis thaliana
  G242
MADRIKGPWSPEEDEQLRRLVVKYGPRNWTVISKSIPGRSGKSCRLRWCNQLSPQVEHRPFSAEEDETIARAHAQFGNKWATIARLLNGRTDNAVKNHWNSTLKRKCGGYDHRGYDGSEDHRPVKRSVSAGSPPVVTGLYMSPGSPTGSDVSDSSTIPILPSVELFKPVPRPGAVVLPLPIETSSFSDDPPTSLSLSLPGADVSEESNRSHESTNINNTTSSRHNHNNTVSFMPFSGGFRGAIEEMGKSFPGNGGEFMAVVQEMIKAEVRSYMTEMQRNNGGGFVGGFIDNGMIPMSQIGVGRIE

SEQ ID NO: 2273 - DNA, 998 bp, Arabidopsis thaliana
  G258
agtgaccaccctgctggttaatcaacaccaagagaccttgtaatatataagttaggaagatgagagagaagtgggaaatgaaaagagatgaaatgggacatcgatgttgtggaaaacacaaagtgaagagaggtctttggtctccagaggaagacgagaagcttcttcgttatatcaccactcatggtcatcctagttggagttccgttccaaagcttgccgggttgcagagatgtgggaagagttgcagattaaggtggataaactatctaaggcctgatctgaggagaggttcgtttaatgaggaagaagagcagattatcatcgacgtacatcgtattcttggtaacaaatgggctcagattgctaagcacttacctggacgcactgataatgaagtcaagaacttttggaactcatgcattaagaagaaacttctttctcaaggcttagatccttctacacataatcttatgccttcacacaaaagatcttcttcttcaaacaataataatatccccaagccaaacaaaacgacgtccatcatgaagaaccctactgatcttgatcaatcaaccactgctttttcaatcacaaacatcaatccacccacttccactaaaccaaacaaacttaaatctcctaaccagactacaatcccatctcaaaccgtgatccctatcaatgataacatgtcaagtactcaaaccatgatccctatcaatgatcccatgtcaagtcttttagatgatgagaatatgattcctcactggtcagatgttgatggaatggcgatccacgaagctccgatgttgcctagtgataaggcagtagtgggagtggatgatgatgatctcaacatggacattttgtttaacactccttcttcttctgcttttgatcctgattttgcttccattttctcctctgcaatgtctatcgatttcaatcccatggatgatcttggcagctggaccttttagcttttactctacagc

SEQ ID NO: 2274 - protein, 307 aa, Arabidopsis thaliana
  G258
MREKWEMKRDEMGHRCCGKHKVKRGLWSPEEDEKLLRYITTHGHPSWSSVPKLAGLQRCGKSCRLRWINYLRPDLRRGSFNEEEEQIIIDVHRILGNKWAQIAKHLPGRTDNEVKNFWNSCIKKKLLSQGLDPSTHNLMPSHKRSSSSNNNNIPKPNKTTSIMKNPTDLDQSTTAFSITNINPPTSTKPNKLKSPNQTTIPSQTVIPINDNMSSTQTMIPINDPMSSLLDDENMIPHWSDVDGMAIHEAPMLPSDKAVVGVDDDDLNMDILFNTPSSSAFDPDFASIFSSAMSIDFNPMDDLGSWTF

SEQ ID NO: 2275 - DNA, 896 bp, Arabidopsis thaliana
  G259
gagatcttctactacttgttttcttcaagaataataattttcgttttatatatggaagatgctggtgaacatttacggtgtaacgataacgttaacgacgaggagcgtttgccattggagtttatgatcggaaactcaacatccacggcggagctacagccgcctccaccgttcttggtaaagacatacaaagtggtggaggatccgacgacggacggggttatatcttggaacgaatacggaactggtttcgtcgtgtggcagccggcagaattcgctagagatctgttaccaacacttttcaagcattgcaacttctctagcttcgttcgccagctcaatacttacggttttcgaaaagtaacgacgataagatgggaatttagtaatgagatgtttcgaaaggggcaaagagagcttatgagcaatatccgaagaaggaagagccaacattggtcacacaacaagtctaatcaccaggttgtaccaacaacaacgatggtgaatcaagaaggtcatcaacggattgggattgatcatcaccatgaggatcaacagtcttccgccacttcatcctctttcgtatacactgcattactcgacgaaaacaaatgcttgaagaatgaaaacgagttattaagctgcgaacttgggaaaaccaagaagaaatgcaagcagcttatggagttggtggagagatacagaggagaagacgaagatgcaactgatgaaagtgatgatgaagaagatgaagggcttaagttgttcggagtaaaacttgaatgaaactagattgctagattgatattcgtaatataccagtttcttcatattcttagaagttttgcataactatatatagtactcttttaagacatgcaagatcagaacatatg

SEQ ID NO: 2276 - protein, 244 aa, Arabidopsis thaliana
  G259
MEDAGEHLRCNDNVNDEERLPLEFMIGNSTSTAELQPPPPFLVKTYKVVEDPTTDGVISWNEYGTGFVVWQPAEFARDLLPTLFKHCNFSSFVRQLNTYGFRKVTTIRWEFSNEMFRKGQRELMSNIRRRKSQHWSHNKSNHQVVPTTTMVNQEGHQRIGIDHHHEDQQSSATSSSFVYTALLDENKCLKNENELLSCELGKTKKKCKQLMELVERYRGEDEDATDESDDEEDEGLKLFGVKLE

SEQ ID NO: 2277 - DNA, 1104 bp, Arabidopsis thaliana
  G263
tttttagttttatttttctgtggtaaaataaaaaaagttcgccggagatgacggctgtgacggcggcgcaaagatcagttccggcgccgtttttaagcaaaacgtatcagctagttgatgatcatagcacagacgacgtcgtttcatggaacgaagaaggaacagcttttgtcgtgtggaaaacagcagagtttgctaaagatcttcttcctcaatacttcaagcataataatttctcaagcttcattcgtcagctcaacacttacggatttcgtaaaactgtaccggataaatgggaatttgcaaacgattatttccggagaggcggggaggatctgttgacggacatacgacggcgtaaatcggtgattgcttcaacggcggggaaatgtgttgttgttggttcgccttctgagtctaattctggtggtggtgatgatcacggttcaagctccacgtcatcacccggttcgtcgaagaatcctggttcggtggagaacatggttgctgatttatcaggagagaacgagaagcttaaacgtgaaaacaataacttgagctcggagctcgcggcggcgaagaagcagcgcgatgagctagtgacgttcttgacgggtcatctgaaagtaagaccggaacaaatcgataaaatgatcaaaggagggaaatttaaaccggtggagtctgacgaagagagtgagtgcgaaggttgcgacggcggcggaggagcagaggagggggtaggtgaaggattgaaattgtttggggtgtggttgaaaggagagagaaaaaagagggaccgggatgaaaagaattatgtggtgagtgggtcccgtatgacggaaataaagaacgtggactttcacgcgccgttgtggaaaagcagcaaagtctgcaactaaaaaaagagtagaagactgttcaaaccagcgtgtgacacgtcatcgacgacgacgaaaaaaatgatttaaaaaactatttttttccgtaaggaagaaaagttatttttatgttttaaaaaggtgaagaaggtccagaaggatcaacgcaaatatataaatggattttcatgtattatataatttaattagtgtattaagaaaa

SEQ ID NO: 2278 - protein, 284 aa, Arabidopsis thaliana
  G263
MTAVTAAQRSVPAPFLSKTYQLVDDHSTDDVVSWNEEGTAFVVWKTAEFAKDLLPQYFKHNNFSSFIRQLNTYGFRKTVPDKWEFANDYFRRGGEDLLTDIRRRKSVIASTAGKCVVVGSPSESNSGGGDDHGSSSTSSPGSSKNPGSVENMVADLSGENEKLKRENNNLSSELAAAKKQRDELVTFLTGHLKVRPEQIDKMIKGGKFKPVESDEESECEGCDGGGGAEEGVGEGLKLFGVWLKGERKKRDRDEKNYVVSGSRMTEIKNVDFHAPLWKSSKVCN

SEQ ID NO: 2279 - DNA, 1613 bp, Arabidopsis thaliana
  G264
cttgtaccagtttctgattagattcaacaatgaacggcgcattaggtaactcctccgcctccgttagcggcggagaaggagccggaggaccagcgcctttcttggtgaaaacctacgagatggtcgacgattcatcaacggaccagatcgtatcgtggagcgctaacaacaacagcttcatcgtttggaatcatgccgaattttcacgcctccttcttccaacctacttcaaacacaataacttctcttccttcattcgtcagctcaatacctatgggtttaggaagattgatccagagaggtgggagtttttgaatgatgattttattaaggatcagaagcatcttctcaagaatatacatagaaggaaacctatacacagccacagtcatccacctgcttcgtcgactgatcaagaaagagcagtgttgcaagagcaaatggacaagctttcacgtgagaaagctgcaattgaagctaagcttttaaagttcaaacaacagaaggttgtagcaaagcatcagtttgaagaaatgactgagcatgttgatgatatggagaataggcagaagaagctgctgaattttttggaaactgcgattcggaatcctacttttgttaagaattttggtaagaaagtcgagcagttggatatttcagcttacaacaaaaagcgaaggctccctgaagttgagcaatcaaagccaccttcagaagattctcatctggataatagtagtggtagctcgagacgcgagtctggaaacatttttcatcaaaatttctctaataaattgcgactagagctttctccagctgattcagatatgaacatggtttcacacagtatacaaagttccaatgaagaaggtgcgagtcccaaagggatactgtcaggaggtgatccaaatactacactaacaaaaagagaaggcctaccatttgcacctgaagctctagagcttgcggataccgggacatgcccgaggagattactgttaaatgataatacaagggtggagaccttgcagcagaggctaacttcttcagaggagactgatggtagcttttcatgtcatttaaatctaaccctggcttctgctccgttaccggacaaaacagcttcacagatagctaagacgactcttaaaagtcaggagttaaactttaactcaatagaaacaagtgcaagtgagaaaaatcggggtagacaagagattgcagttggaggtagccaagcaaatgcagctcctccagcaagagtgaatgatgtattctgggaacagttcctaacagaaaggccagggtcttcagataatgaggaggcaagttcgacttatagaggtaacccatacgaagagcaagaggagaaaagaaacgggagtatgatgttacgtaatacaaagaatatcgagcagctgaccttataaactatttggacggttacatcaacgagagtacgaactgaggttttggtaagaagtatgggtgagtaagtaatgaaacattggactgaaaaagcgtaagtagctttgttgtaaacacttgcgtctctgtctacacaagtaatttgactgtaaatgtaagtgtacaggatttaaattgaataagca

SEQ ID NO: 2280 - protein, 466 aa, Arabidopsis thaliana
  G264
MNGALGNSSASVSGGEGAGGPAPFLVKTYEMVDDSSTDQIVSWSANNNSFIVWNHAEFSRLLLPTYFKHNNFSSFIRQLNTYGFRKIDPERWEFLNDDFIKDQKHLLKNIHRRKPIHSHSHPPASSTDQERAVLQEQMDKLSREKAAIEAKLLKFKQQKVVAKHQFEEMTEHVDDMENRQKKLLNFLETAIRNPTFVKNFGKKVEQLDISAYNKKRRLPEVEQSKPPSEDSHLDNSSGSSRRESGNIFHQNFSNKLRLELSPADSDMNMVSHSIQSSNEEGASPKGILSGGDPNTTLTKREGLPFAPEALELADTGTCPRRLLLNDNTRVETLQQRLTSSEETDGSFSCHLNLTLASAPLPDKTASQIAKTTLKSQELNFNSIETSASEKNRGRQEIAVGGSQANAAPPARVNDVFWEQFLTERPGSSDNEEASSTYRGNPYEEQEEKRNGSMMLRNTKNIEQLTL

SEQ ID NO: 2281 - DNA, 1470 bp, Arabidopsis thaliana
  G265
ctttggtcttggaagccaaatcaaacctttccttcaatcctcaaattttcgaaaattttctcttttgctttacgttctctcaattcttatttgtaagaaagtttgttcctttaatcaatcaaatcaaagagacttttgaagattgtttcccaatttgcgtcaatcgggatcgagtcaaatctgaaatcttctccactcatcatctgactataagacttaatcaagggactttttgttcgggtttggttttaaacgtcttggattcgaagtggttaaggtatggatgaaaataatggaggttcaagctcacttccacctttccttactaaaacatatgaaatggttgatgattcttcttctgactcggtcgttgcttggagcgaaaacaacaaaagcttcatcgtcaagaatccagcagagttttcaagagaccttcttccgagattcttcaagcataagaatttctcaagtttcatccgtcagcttaatacatatggttttcgaaaagtagatcctgagaaatgggaattcttgaatgatgattttgttagaggtcgaccttaccttatgaagaacattcatagacgaaaaccggttcatagccactcgttagtgaatctacaagcgcaaaatcctttgacggaatcagaaagacggagcatggaggatcagatagaaagactgaaaaatgagaaagaaggccttcttgcggagttacagaaccaagagcaagaacggaaagagtttgagctgcaagtaacgacattgaaagatcggttacaacatatggaacaacatcagaaatcaatagtggcatatgtttcacaggttttgggaaaaccaggactttcactaaacctcgaaaaccatgagagaagaaaaagaagatttcaagagaactctcttcctccaagcagttcacacatagaacaggtcgaaaagttagaatcttcgctaacgttttgggagaatcttgtatcggaatcatgcgagaagagcggtttgcagtcatcaagcatggatcatgatgcagctgagtcaagtctaagtattggcgatacacgacccaaatcatcgaagattgatatgaactcagagccgcccgttaccgttactgcgcctgctccaaaaacaggcgttaacgatgacttttgggaacaatgtttgacagagaaccctggatcaaccgagcaacaagaagttcagtcagagagaagagatgtcggtaatgataataatggtaataagattggaaatcaaaggacgtattggtggaattcagggaatgtaaataacattacagagaaagcttcttgacatgaatgaggtttttgtaaaatagttttcttttggttccactgagattattgtatgtgttcattatttattactctgtttctgtaaaaacaaatctctctattgtttgaggcaggagtgacataaatgcatatgcagaattggtttcaaaaa

SEQ ID NO: 2282 - protein, 345 aa, Arabidopsis thaliana
  G265
MDENNGGSSSLPPFLTKTYEMVDDSSSDSVVAWSENNKSFIVKNPAEFSRDLLPRFFKHKNFSSFIRQLNTYGFRKVDPEKWEFLNDDFVRGRPYLMKNIHRRKPVHSHSLVNLQAQNPLTESERRSMEDQIERLKNEKEGLLAELQNQEQERKEFELQVTTLKDRLQHMEQHQKSIVAYVSQVLGKPGLSLNLENHERRKRRFQENSLPPSSSHIEQVEKLESSLTFWENLVSESCEKSGLQSSSMDHDAAESSLSIGDTRPKSSKIDMNSEPPVTVTAPAPKTGVNDDFWEQCLTENPGSTEQQEVQSERRDVGNDNNGNKIGNQRTYWWNSGNVNNITEKAS

SEQ ID NO: 2283 - DNA, 2330 bp, Arabidopsis thaliana
  G274
agctttatactttctggctactgcaagctcatcagtgaaaagagcttaaaccagagagatctgataagagaaattttagagtctctctgcttcaacaagatctacatcgaccaggagattagaaagaatcatgggttctaagcataacccaccagggaataacagatcgagaagtacactatctctactcgttgtggttggtttatgttgtttcttctatcttcttggagcatggcaaaagagtgggtttggtaaaggagatagcatagctatggagattacaaagcaagcgcagtgtactgacattgtcactgatcttgattttgaacctcatcacaacacagtgaagatcccacataaagctgatcccaaacctgtttctttcaaaccgtgtgatgtgaagctcaaggattacacgccttgtcaagagcaagaccgagctatgaagttcccgagagagaacatgatttacagagagagacattgtcctcctgataatgagaagctgcgttgtcttgttccagctcctaaagggtatatgactcctttcccttggcctaaaagcagagattatgttcactatgctaatgctcctttcaagagcttgactgtcgaaaaagctggacagaattgggttcagtttcaagggaatgtgtttaaattccctggtggaggaactatgtttcctcaaggtgctgatgcgtatattgaagagctagcttctgttatccctatcaaagatggctctgttagaaccgcattggacactggatgtggggttgctagttggggtgcttatatgcttaagaggaatgttttgactatgtcgtttgcgccaagggataaccacgaagcacaagtccagtttgcgcttgagagaggtgttccagcgattatcgctgttcttggatcaatccttcttccttaccctgcaagagcctttgacatggctcaatgctctcgatgcttgataccatggaccgcaaacgagggaacatacttaatggaagtagatagagtcttgagacctggaggttactgggtcttatcgggtcctccaatcaactggaagacatggcacaagacgtggaaccgaactaaagcagagctaaatgccgagcaaaagagaatagagggaatcgcagagtccttatgctgggagaagaagtatgagaagggagacattgcaattttcagaaagaaaataaacgatagatcatgcgatagatcaacaccggttgacacctgcaaaagaaaggacactgacgatgtctggtacaaggagatagaaacgtgtgtaacaccattccctaaagtatcaaacgaagaagaagttgctggaggaaagctaaagaagttccccgagaggctattcgcagtgcctccaagtatctctaaaggtttgattaatggcgtcgacgaggaatcataccaagaagacatcaatctatggaagaagcgagtgaccggatacaagagaattaacagactgataggttccaccagataccgtaatgtgatggatatgaacgccggtcttggtggattcgctgctgcgcttgaatcgcctaaatcgtgggttatgaatgtgattccaaccattaacaagaacacattgagtgttgtttatgagagaggtctcattggtatctatcatgactggtgtgaaggcttttcaacttatccaagaacatacgatttcattcacgctagtggtgtcttcagcttgtatcagcacagctgcaaacttgaggatattcttcttgaaactgatcggattttacgaccggaagggattgtgattttccgggatgaggttgatgttttgaatgatgtgaggaagatcgttgatggaatgagatgggatactaagttaatggatcatgaagacggtcctctcgtgccggagaagattcttgtcgccacgaagcagtattgggtagccggcgacgatggaaacaattctccgtcgtcttctaatagtgaagaagaataaaacaaaaacaaaaaactcctcaggttactaagcttgaagtgtagatctattttacaacatctggaaaattcttatcaaaaaaggaaggaatcagaatttccattaaagaaaggtgtcaaaaaaaagttgtaaaactatatagtagtgatcaagacgaatatgtgcatttatgttttatttttgttccctagtttttaattttatttttttgaaggaagaaaaaattagttccatgtgtttttgcaagatagttgaaaccttggacgcttgttatgtatgatgcgatcttgacattttttaataacagttattttaaataaatttatgatataaa

SEQ ID NO: 2284 - protein, 621 aa, Arabidopsis thaliana
  G274
MGSKHNPPGNNRSRSTLSLLVVVGLCCFFYLLGAWQKSGFGKGDSIAMEITKQAQCTDIVTDLDFEPHHNTVKIPHKADPKPVSFKPCDVKLKDYTPCQEQDRAMKFPRENMIYRERHCPPDNEKLRCLVPAPKGYMTPFPWPKSRDYVHYANAPFKSLTVEKAGQNWVQFQGNVFKFPGGGTMFPQGADAYIEELASVIPIKDGSVRTALDTGCGVASWGAYMLKRNVLTMSFAPRDNHEAQVQFALERGVPAIIAVLGSILLPYPARAFDMAQCSRCLIPWTANEGTYLMEVDRVLRPGGYWVLSGPPINWKTWHKTWNRTKAELNAEQKRIEGIAESLCWEKKYEKGDIAIFRKKINDRSCDRSTPVDTCKRKDTDDVWYKEIETCVTPFPKVSNEEEVAGGKLKKFPERLFAVPPSISKGLINGVDEESYQEDINLWKKRVTGYKRINRLIGSTRYRNVMDMNAGLGGFAAALESPKSWVMNVIPTINKNTLSVVYERGLIGIYHDWCEGFSTYPRTYDFIHASGVFSLYQHSCKLEDILLETDRILRPEGIVIFRDEVDVLNDVRKIVDGMRWDTKLMDHEDGPLVPEKILVATKQYWVAGDDGNNSPSSSNSEEE

SEQ ID NO: 2285 - DNA, 983 bp, Arabidopsis thaliana
  G280
aagttaatatgagaataatgagaaaaccactttcccaaattgctttttaaaatccctcctcacacagattccttccttcatcacctcacacactctctacgcttgacatggccttcgatctccaccatggctcagcttcagatacgcattcatcagaacttccgtcgttttctctcccaccttatcctcagatgataatggaagcgattgagtccttgaacgataagaacggctgcaacaaaacgacgattgctaagcacatcgagtcgactcaacaaactctaccgccgtcacacatgacgctgctcagctaccatctcaaccagatgaagaaaaccggtcagctaatcatggtgaagaacaattatatgaaaccagatccagatgctcctcctaagcgtggtcgtggccgtcctccgaagcagaagactcaggccgaatctgacgccgctgctgctgctgttgttgctgccaccgtcgtctctacagatccgcctagatctcgtggccgtccaccgaagccgaaagatccatcggagcctccccaggagaaggtcattaccggatctggaaggccacgaggacgaccaccgaagagaccgagaacagattcggagacggttgctgcgccggaaccggcagctcaggcgacaggtgagcgtaggggacgtgggagacctccgaaggtgaagccgacggtggttgctccggttgggtgctgaattaatcggtacttatgcaatttcggaatctttagttactgaaaaatggaatctcttagagagtaagagagtgctttaatttagcttaattagatttatttggatttctttcagtatttggattgtaaactttagaatttgtgtgtgtgttgttgcttagtcctgagataagatataacattagcgactgtgtattattattattactgcattgtgttatgtgaaactttgttctcttgttgaaaaaaaaaaaaaaaaaaa

SEQ ID NO: 2286 - protein, 204 aa, Arabidopsis thaliana
  G280
MAFDLHHGSASDTHSSELPSFSLPPYPQMIMEAIESLNDKNGCNKTTIAKHIESTQQTLPPSHMTLLSYHLNQMKKTGQLIMVKNNYMKPDPDAPPKRGRGRPPKQKTQAESDAAAAAVVAATVVSTDPPRSRGRPPKPKDPSEPPQEKVITGSGRPRGRPPKRPRTDSETVAAPEPAAQATGERRGRGRPPKVKPTVVAPVGC

SEQ ID NO: 2287 - DNA, 2956 bp, Arabidopsis thaliana
  G286
tgcaatttctctcgaccaaaaccctaatttcaggtttggggttttccttctttcactgtcaattttgatgaaacttgtgattcagtgattagaatgaatgctaatgagcaaactcgatccgccaatggcattggcaatggcaatggtgagtctattcccgggattccagatgacttacggtgcaagagatcggatggtaaacagtggagatgcactgcaatgtccatggctgataagactgtttgtgagaagcactacatccaagcaaagaagcgggcggctaattctgctttcagggcgaaccagaagaaagcgaaaaggcgatcatcgttaggcgaaacagatacgtattcggaagggaagatggatgatttcgagttaccagtcaccagcattgaccactataataacggtcttgcctctgcttccaagagtaatggtagactagagaagagacataataaaagcctgatgcggtactcgcccgagacaccgatgatgaggagtttctctccacgtgttgcagtggatttgaatgatgacttgggtagagatgttgtaatgtttgaagagggctacagatcttataggacaccaccatctgttgctgttatggatccgacacgaaacagatcacaccaaagcaccagtcctatggaatactcagcagcaagcacagatgtgtctgcagagtctttgggggaaatctgccatcaatgccagagaaaagatagagagagaatcatttcttgcctcaaatgcaatcaaagagccttctgccacaattgtctatcggcaaggtactcggagatatcacttgaagaagtcgagaaagtttgccctgcatgtcgtggcttgtgtgattgcaaatcttgcctgcgttcagataatacaataaaggttcggatccgggaaatacccgttttggacaagttgcagtatctttatcgtctattatcagctgtcctaccagtcataaagcagatccatcttgaacaatgtatggaagttgaactagagaagaggcttcttgaagttgagattgatcttgtcagggcaagattgaaagcagatgagcagatgtgctgcaacgtgtgtcggataccagttgttgactactaccgtcactgtccgaactgctcatatgacctttgcctgagatgctgtcaagatctacgggaagagtcttcagtgacgattagtgggactaaccaaaacgtacaagatagaaaaggagctcccaaactaaaactaaacttttcatacaagtttcctgagtgggaagccaacggtgatgggagcatcccttgccctcctaaggagtatggaggctgcggttcacattctttgaatcttgcccgcattttcaagatgaattgggttgcaaagcttgtgaaaaatgctgaggagattgttagtggctgcaaattatctgatcttctgaaccctgatatgtgtgattcaagattctgcaaatttgctgagagagaagagagcggtgacaactacgtgtacagcccgtcgcttgaaacgattaaaactgatggagtagctaagtttgagcaacaatgggcagagggtcggcttgttactgtgaaaatggtacttgatgactcatcttgctctagatgggatcctgagactatttggagggatatagacgagctttcggacgagaaactgagagaacatgatccattcttgaaggccattaattgcttggatggtttagaggttgatgtaagacttggggagtttacaagagcatataaagatggaaagaaccaagagacaggtcttccgctattgtggaagttaaaggactggccgagcccaagtgcttccgaggagttcattttctaccaaagacctgagtttatcagaagttttccgtttctcgagtacattcatccccggttaggccttctgaatgttgcagccaagttacctcattactcgctccaaaacgattcaggtccaaagatttatgtgtcttgtgggacgtaccaagaaatcagtgctggcgattcattgactggtattcactacaacatgcgtgacatggtatacctattggtgcacacgtctgaagaaacaacattcgaaagggtgagaaaaacaaaacctgttccagaggaacctgaccagaagatgagcgaaaatgagtcacttcttagccctgagcagaaattaagggacggagagttacatgatctatcacttggtgaagccagtatggagaagaatgaacctgagttggcgttgactgtgaatccagagaacttaacggaaaacggtgacaacatggaatcttcttgcacatcttcatgtgcaggaggagcccagtgggatgtctttcgacgccaagacgtcccaaagttgtccgggtatttgcagagaacattccagaagcctgataatatccagactgattttgtaagccgtacctgctaattcaaataaatgaagtgtgtaaagtcttgtatgtggaatgattgagtttcctagtttgtttactctggtttcaggtgtcacgcccgttgtatgaaggattgtctttaaatgaacaccacaagagacaactaagagacgagtttggagttgagccatggacatttgagcaacatcgtggtgaggctatcttcattccggctggatgtccgttccaaatcactaatcttcagtcgaatattcaggtggcacttgacttcttgtgccctgaaagcgttggagagtcagcaagactagctgaagaaatccggtgtttaccaaacgaccacgaggcaaaacttcagattctagagattggaaagatatcattatacgcagctagctcagccattaaagaggttcagaaactggtcttggatccaaagtttggagcagagcttggatttgaagactctaacttaaccaaagcagtctctcacaacttagacgaggcaaccaagcggcc

SEQ ID NO: 2288 - protein, 786 aa, Arabidopsis thaliana
  G286
MNANEQTRSANGIGNGNGESIPGIPDDLRCKRSDGKQWRCTAMSMADKTVCEKHYIQAKKRAANSAFRANQKKAKRRSSLGETDTYSEGKMDDFELPVTSIDHYNNGLASASKSNGRLEKRHNKSLMRYSPETPMMRSFSPRVAVDLNDDLGRDVVMFEEGYRSYRTPPSVAVMDPTRNRSHQSTSPMEYSAASTDVSAESLGEICHQCQRKDRERIISCLKCNQRAFCHNCLSARYSEISLEEVEKVCPACRGLCDCKSCLRSDNTIKVRIREIPVLDKLQYLYRLLSAVLPVIKQIHLEQCMEVELEKRLLEVEIDLVRARLKADEQMCCNVCRIPVVDYYRHCPNCSYDLCLRCCQDLREESSVTISGTNQNVQDRKGAPKLKLNFSYKFPEWEANGDGSIPCPPKEYGGCGSHSLNLARIFKMNWVAKLVKNAEEIVSGCKLSDLLNPDMCDSRFCKFAEREESGDNYVYSPSLETIKTDGVAKFEQQWAEGRLVTVKMVLDDSSCSRWDPETIWRDIDELSDEKLREHDPFLKAINCLDGLEVDVRLGEFTRAYKDGKNQETGLPLLWKLKDWPSPSASEEFIFYQRPEFIRSFPFLEYIHPRLGLLNVAAKLPHYSLQNDSGPKIYVSCGTYQEISAGDSLTGIHYNMRDMVYLLVHTSEETTFERVRKTKPVPEEPDQKMSENESLLSPEQKLRDGELHDLSLGEASMEKNEPELALTVNPENLTENGDNMESSCTSSCAGGAQWDVFRRQDVPKLSGYLQRTFQKPDNIQTDFVSRTC

SEQ ID NO: 2289 - DNA, 1951 bp, Arabidopsis thaliana
  G308
agtaatttagttttttttttttttttttacaatttattttgttattagaagtggtagtggagtgaaaaaacaaatcctaagcagtcctaaccgatccccgaagctaaagattcttcaccttcccaaataaagcaaaacctagatccgacattgaaggaaaaaccttttagatccatctctgaaaaaaacccaaccatgaagagagatcatcatcatcatcatcaagataagaagactatgatgatgaatgaagaagacgacggtaacggcatggatgagcttctagctgttcttggttacaaggttaggtcatcggaaatggctgatgttgctcagaaactcgagcagcttgaagttatgatgtctaatgttcaagaagacgatctttctcaactcgctactgagactgttcactataatccggcggagctttacacgtggcttgattctatgctcaccgaccttaatcctccgtcgtctaacgccgagtacgatcttaaagctattcccggtgacgcgattctcaatcagttcgctatcgattcggcttcttcgtctaaccaaggcggcggaggagatacgtatactacaaacaagcggttgaaatgctcaaacggcgtcgtggaaaccaccacagcgacggctgagtcaactcggcatgttgtcctggttgactcgcaggagaacggtgtgcgtctcgttcacgcgcttttggcttgcgctgaagctgttcagaaggagaatctgactgtggcggaagctctggtgaagcaaatcggattcttagctgtttctcaaatcggagctatgagacaagtcgctacttacttcgccgaagctctcgcgcggcggatttaccgtctctctccgtcgcagagtccaatcgaccactctctctccgatactcttcagatgcacttctacgagacttgtccttatctcaagttcgctcacttcacggcgaatcaagcgattctcgaagcttttcaagggaagaaaagagttcatgtcattgatttctctatgagtcaaggtcttcaatggccggcgcttatgcaggctcttgcgcttcgacctggtggtcctcctgttttccggttaaccggaattggtccaccggcaccggataatttcgattatcttcatgaagttgggtgtaagctggctcatttagctgaggcgattcacgttgagtttgagtacagaggatttgtggctaacactttagctgatcttgatgcttcgatgcttgagcttagaccaagtgagattgaatctgttgcggttaactctgttttcgagcttcacaagctcttgggacgacctggtgcgatcgataaggttcttggtgtggtgaatcagattaaaccggagattttcactgtggttgagcaggaatcgaaccataatagtccgattttcttagatcggtttactgagtcgttgcattattactcgacgttgtttgactcgttggaaggtgtaccgagtggtcaagacaaggtcatgtcggaggtttacttgggtaaacagatctgcaacgttgtggcttgtgatggacctgaccgagttgagcgtcatgaaacgttgagtcagtggaggaaccggttcgggtctgctgggtttgcggctgcacatattggttcgaatgcgtttaagcaagcgagtatgcttttggctctgttcaacggcggtgagggttatcgggtggaggagagtgacggctgtctcatgttgggttggcacacacgaccgctcatagccacctcggcttggaaactctccaccaattagatggtggctcaatgaattgatctgttgaaccggttatgatgatagatttccgaccgaagccaaactaaatcctactgtttttccctttgtcacttgttaagatcttatctttcattatattaggtaattgaaaaattttaatctcgcctaaattact

SEQ ID NO: 2290 - protein, 532 aa, Arabidopsis thaliana
  G308
MKRDHHHHHQDKKTMMMNEEDDGNGMDELLAVLGYKVRSSEMADVAQKLEQLEVMMSNVQEDDLSQLATETVHYNPAELYTWLDSMLTDLNPPSSNAEYDLKAIPGDAILNQFAIDSASSSNQGGGGDTYTTNKRLKCSNGVVETTTATAESTRHVVLVDSQENGVRLVHALLACAEAVQKENLTVAEALVKQIGFLAVSQIGAMRQVATYFAEALARRIYRLSPSQSPIDHSLSDTLQMHFYETCPYLKFAHFTANQAILEAFQGKKRVHVIDFSMSQGLQWPALMQALALRPGGPPVFRLTGIGPPAPDNFDYLHEVGCKLAHLAEAIHVEFEYRGFVANTLADLDASMLELRPSEIESVAVNSVFELHKLLGRPGAIDKVLGVVNQIKPEIFTVVEQESNHNSPIFLDRFTESLHYYSTLFDSLEGVPSGQDKVMSEVYLGKQICNVVACDGPDRVERHETLSQWRNRFGSAGFAAAHIGSNAFKQASMLLALFNGGEGYRVEESDGCLMLGWHTRPLIATSAWKLSTN

SEQ ID NO: 2291 - DNA, 871 bp, Arabidopsis thaliana
  G323
ctgctcatatcagccattgacacagttgctttgggtttccctcaaacggcgccgattgtctggattttgaccactgatggccttagatcaatcttttgaagatgctgctttacttggagaactctatggagaaggtgcattttgtttcaagagcaagaaacctgaacccattacagtctcggttccttctgatgatactgatgattcgaattttgactgcaatatttgcttagactcggtgcaagaacctgttgtgactctctgtggtcacctcttttgctggccttgtattcacaaatggcttgatgtacagagcttctcaacaagtgatgaataccaaagacatagacagtgtcctgtttgtaaatctaaagtttctcattctactttggttcctttgtatggtagaggccgttgtactactcaggaggaaggtaaaaacagtgtgcctaaaagacccgtaggaccggtttatcggcttgaaatgccgaattcaccttatgcaagtactgatctgcggttatcacaacgggttcatttcaatagcccacaggaaggttactaccctgtctcaggggtgatgagctcgaacagtttatcatactctgctgttttggatccggtgatggtgatggttggagaaatggtagctacgaggttgtttggaacacgagtgatggatagatttgcgtatccggacacttacaatctcgcagggactagcgggccgaggatgagaaggcggataatgcaggcagataaatcgctgggaagaatcttcttcttctttatgtgttgtgttgttctgtgtcttctcttgttttaggttttcatagctagcttggttctgctactgttcagtttcttcagg

SEQ ID NO: 2292 - protein, 249 aa, Arabidopsis thaliana
  G323
MALDQSFEDAALLGELYGEGAFCFKSKKPEPITVSVPSDDTDDSNFDCNICLDSVQEPVVTLCGHLFCWPCIHKWLDVQSFSTSDEYQRHRQCPVCKSKVSHSTLVPLYGRGRCTTQEEGKNSVPKRPVGPVYRLEMPNSPYASTDLRLSQRVHFNSPQEGYYPVSGVMSSNSLSYSAVLDPVMVMVGEMVATRLFGTRVMDRFAYPDTYNLAGTSGPRMRRRIMQADKSLGRIFFFFMCCVVLCLLLF

SEQ ID NO: 2293 - DNA, 1038 bp, Arabidopsis thaliana
  G340
atgaaatctctgtagtttttttttgttcctttcttaaatttcgaaagaaagacatttattaaaccaaaataactctttagatcattgcaaggaaaaatgttgaaaagtgcaagtccaatggcattctacgatatcggagagcagcaatactctactttcgggtacattttaagcaaacctgggaacgcaggagcttacgagattgacccttcgatcccaaacatcgacgatgcgatctacggctcagatgagttccgtatgtacgcttacaaaatcaaacggtgtcctcgtactcgtagccacgactggacggagtgtccctacgctcaccgtggcgagaaagccacacgccgtgatcctcgccgttacacttactgtgcagtcgcatgcccggctttccgaaatggcgcatgccaccgtggcgactcatgcgaattcgcacatggcgtattcgagtactggctccacccggcgcgttaccgaacacgcgcatgtaacgccgggaacttgtgtcagaggaaagtgtgtttctttgcccacgcgccggagcagctaaggcagtctgaaggaaagcacaggtgcaggtacgcatataggccggtgagggctagaggtggtggaaacggcgatggagtgacgatgagaatggacgacgagggttacgacacgtcacggtctccggtgagaagcgggaaagatgatttagatagtaacgaggagaaggtgttgttgaagtgttggagtcggatgagcattgtggatgatcattatgagccgtccgatttggatttggatttgtcacactttgattggatctcagagttggtcgattaaatttgggaaatcaaagcagagaacaaaagaaacccgataaataaagtggattttgttaaaatccacaagatcaagattcaagatgagagatcttgtcatgtatatggtaaatttaattgtaatgatttattgcaatgtcgcaaaagaagttacttctctttgcatgtaaacagattcttgatcttctataagtctttgtattaa

SEQ ID NO: 2294 - protein, 245 aa, Arabidopsis thaliana
  G340
MLKSASPMAFYDIGEQQYSTFGYILSKPGNAGAYEIDPSIPNIDDAIYGSDEFRMYAYKIKRCPRTRSHDWTECPYAHRGEKATRRDPRRYTYCAVACPAFRNGACHRGDSCEFAHGVFEYWLHPARYRTRACNAGNLCQRKVCFFAHAPEQLRQSEGKHRCRYAYRPVRARGGGNGDGVTMRMDDEGYDTSRSPVRSGKDDLDSNEEKVLLKCWSRMSIVDDHYEPSDLDLDLSHFDWISELVD

SEQ ID NO: 2295 - DNA, 570 bp, Arabidopsis thaliana
  G347
atgaaagtagcagatatgcaggaccagctggtgtgtcatggttgtaggaatttattgatgtatcctagaggagcatctaatgtgcgttgtgcgttatgtaacactatcaacatggttcctcctcctcctccacctcacgacatggcacacattatatgtggtggttgtagaacaatgcttatgtatacgcgtggggctagtagcgtaagatgctcttgctgtcaaactacgaaccttgtgccagcgcactccaatcaggttgcccatgctccttccagtcaggttgcgcagatcaattgtgggcattgtcggacgaccctcatgtatccttacggtgcatcatccgtcaaatgcgctgtttgtcaattcgtaactaacgttaatatgagcaatggaagggtacctctcccaactaaccggccaaatggaacagcttgtcccccctctacatcaacttcaacaccaccctctcagacccaaaccgttgttgtagaaaaccccatgtccgttgatgaaagcggaaagttggtgagcaatgttgttgttggagtgacaactgacaaaaagtaa

SEQ ID NO: 2296 - protein, 189 aa, Arabidopsis thaliana
  G347
MKVADMQDQLVCHGCRNLLMYPRGASNVRCALCNTINMVPPPPPPHDMAHIICGGCRTMLMYTRGASSVRCSCCQTTNLVPAHSNQVAHAPSSQVAQINCGHCRTTLMYPYGASSVKCAVCQFVTNVNMSNGRVPLPTNRPNGTACPPSTSTSTPPSQTQTVVVENPMSVDESGKLVSNVVVGVTTDKK

SEQ ID NO: 2297 - DNA, 817 bp, Arabidopsis thaliana
  G352
aatacaccacacacttcactctttcttcatcttcttcttcttaaatagctcgaaatcacatctcacagaattaaatcttatggctctcgagactctcaattctccaacagctaccaccaccgctcggcctcttctccggtatcgtgaagaaatggagcctgagaatctcgagcaatgggctaaaagaaaacgaacaaaacgtcaacgttttgatcacggtcatcagaatcaagaaacgaacaagaaccttccttctgaagaagagtatctcgctctttgtctcctcatgctcgctcgtggctccgccgtacaatctcctcctcttcctcctctaccgtcacgtgcgtcaccgtccgatcaccgagattacaagtgtacggtctgtgggaagtccttttcgtcataccaagccttaggtggacacaagacgagtcaccggaaaccgacgaacactagtatcacttccggtaaccaagaactgtctaataacagtcacagtaacagcggttccgttgttattaacgttaccgtgaacactggtaacggtgttagtcaaagcggaaagattcacacttgctcaatctgtttcaagtcgtttgcgtctggtcaagccttaggtggacacaaacggtgtcactatgacggtggcaacaacggtaacggtaacggaagtagcagcaacagcgtagaactcgtcgctggtagtgacgtcagcgatgttgataatgagagatggtccgaagaaagtgcgatcggtggccaccgtggatttgacctaaacttaccggctgatcaagtctcagtgacgacttcttaa

SEQ ID NO: 2298 - protein, 245 aa, Arabidopsis thaliana
  G352
MALETLNSPTATTTARPLLRYREEMEPENLEQWAKRKRTKRQRFDHGHQNQETNKNLPSEEEYLALCLLMLARGSAVQSPPLPPLPSRASPSDHRDYKCTVCGKSFSSYQALGGHKTSHRKPTNTSITSGNQELSNNSHSNSGSVVINVTVNTGNGVSQSGKIHTCSICFKSFASGQALGGHKRCHYDGGNNGNGNGSSSNSVELVAGSDVSDVDNERWSEESAIGGHRGFDLNLPADQVSVTTS

SEQ ID NO: 2299 - DNA, 615 bp, Arabidopsis thaliana
  G357
atgcagaacaaacacaaatgcaagctctgttccaagagtttctgtaatggcagagcacttggtggtcacatgaagtctcacttggtctcatctcagtcttcagctcggaagaaactaggtgactcggtctattcttcttcttcctcttcctccgatggtaaagcgctcgcctacgggttacgagagaacccgaggaagagtttccgggtctttaatccggatcctgagtcatccacaatttacaacagtgagacagagaccgaacctgaatccggagacccggttaagaaacgggtcagaggagatgtttcaaagaagaagaagaagaaggcaaagagtaagagagtgtttgagaactcgaagaagcaaaagacaattcacgagtcaccagaaccagcgagttctgtctctgatggttctcctgaacaagatttagctatgtgcttgatgatgctgtcaagagattcaagggagctcgagattaaactgaaaaaaccggaggaagagaggaagccggaaaaaagacatttccctgagctccgtcgctgtatgatagatctgaatcttcctccgccgcaagaagctgaagctgtcaccgtcgtttcagccatataa

SEQ ID NO: 2300 - protein, 204 aa, Arabidopsis thaliana
  G357
MQNKHKCKLCSKSFCNGRALGGHMKSHLVSSQSSARKKLGDSVYSSSSSSSDGKALAYGLRENPRKSFRVFNPDPESSTIYNSETETEPESGDPVKKRVRGDVSKKKKKKAKSKRVFENSKKQKTIHESPEPASSVSDGSPEQDLAMCLMMLSRDSRELEIKLKKPEEERKPEKRHFPELRRCMIDLNLPPPQEAEAVTVVSAI

SEQ ID NO: 2301 - DNA, 855 bp, Arabidopsis thaliana
  G358
atgggtcaagatgaggttgggagtgatcagacgcaaatcataaaagggaaacgtacgaagcgacaaagatcgtcttcgacgtttgtggtgacggcggcgacaacagtgacttcaacaagttcatcggccggtggaagtggaggagaaagagctgtttcagatgaatacaactcggcggtttcgtctccggtgactactgattgtacgcaagaagaagaagacatggcgatttgtctcatcatgttagctcgtgggacagttcttccatcgccggatctcaagaactcgagaaaaattcatcagaagatttcgtcggagaattctagtttctatgtgtacgagtgtaaaacgtgtaaccggacgttttcgtcgttccaagcacttggtggacacagagcgagccacaagaagccgaggacgtcgactgaggaaaagactagactacccctgacgcaacccaagtctagtgcatcagaagaagggcaaaacagtcatttcaaagtttccggctcagccctagcttcacaggcaagtaacatcatcaacaaggcaaacaaagtacacgagtgttccatctgcggttctgagttcacttccgggcaagctctcggtggtcacatgaggcggcacaggacagccgtaaccacgattagccccgttgcagccaccgcagaagtaagcagaaacagtacagaggaagagattgagatcaatataggccgttcgatggaacagcagaggaaatatctaccgttggatcttaatctaccagcaccagaagatgatctaagagagtcaaagtttcaagggatagtattctcagcaacaccagcgttaatagattgtcattactag

SEQ ID NO: 2302 - protein, 284 aa, Arabidopsis thaliana
  G358
MGQDEVGSDQTQIIKGKRTKRQRSSSTFVVTAATTVTSTSSSAGGSGGERAVSDEYNSAVSSPVTTDCTQEEEDMAICLIMLARGTVLPSPDLKNSRKIHQKISSENSSFYVYECKTCNRTFSSFQALGGHRASHKKPRTSTEEKTRLPLTQPKSSASEEGQNSHFKVSGSALASQASNIINKANKVHECSICGSEFTSGQALGGHMRRHRTAVTTISPVAATAEVSRNSTEEEIEINIGRSMEQQRKYLPLDLNLPAPEDDLRESKFQGIVFSATPALIDCHY

SEQ ID NO: 2303 - DNA, 543 bp, Arabidopsis thaliana
  G360
atgtggaaccctaacaaaattgaagaattggaggatgatgatgaatcttgggaagtcaaagcctttgagcaagacactaaaggcaacatctctggtaccacttggcctccaagatcttacacttgcaatttctgccgccgtgagttccgttctgctcaagccttaggcggtcacatgaatgtccaccgccgtgaccgcgcctcatctagggctcatcaaggttccaccgttgcggctgcggctagaagcggccacggggggatgttactcaattcttgtgctccgccgttgcctacaacgacacttataatacaatccacggcgagtaacattgaaggtttgtcccatttctaccaactgcaaaaccctagtggcatttttggtaattctggtgacatggtgaatctttatgtagaagttcctcctcggcttattgaatattcgacaggagatgatgagagcattggctcgatgaaagaagcgacaggaacatcagtggatgagcttgatcttgaacttcggctagggcaccatccaccgtga

SEQ ID NO: 2304 - protein, 180 aa, Arabidopsis thaliana
  G360
MWNPNKIEELEDDDESWEVKAFEQDTKGNISGTTWPPRSYTCNFCRREFRSAQALGGHMNVHRRDRASSRAHQGSTVAAAARSGHGGMLLNSCAPPLPTTTLIIQSTASNIEGLSHFYQLQNPSGIFGNSGDMVNLYVEVPPRLIEYSTGDDESIGSMKEATGTSVDELDLELRLGHHPP

SEQ ID NO: 2305 - DNA, 780 bp, Arabidopsis thaliana
  G363
atgagaccaatattagacctcgaaattgaagcttcatcgggcagtagtagcagccaagtggcctcaaacttgtctccggttggggaagattacaaaccaatctcgctgaatcttagcctcagtttcaacaacaacaacaacaataatctggatcttgaatcatcgtctttgacgctgccactttcgagcacgagtgagagtagtaacccggagcagcagcagcaacaacaaccatctgtatcaaagagagtcttctcttgtaactactgccaaaggaagttctatagctctcaagcgctaggtggtcaccaaaacgctcacaaacgtgagagaacactcgccaaacgcgctatgctatgggtcttgctggggtcttccccggtagaggatcaagtagcaattatgcggctgctgccacagcagccgctctcgtgtttgccgcttcacggaagcggaaacgggaacatgacatcgttcaggactttgggaatccgggcacattcctcggcgcacgacgtcagcatgacaaggcagacaccagaaacacttattagaaacattgccaggttcaaccaggggtatttcggtaattgtatacctttttacgtggaggacgacgaggccgagatgctctggccggggagtttccggcaagctacgaatgcggttgcggttgaagcgggtaatgataatttaggtgaaagaaaaatggatttcttggacgtcaagcaagcgatggatatggaaagttctcttccagatctaaccttgaagctttga

SEQ ID NO: 2306 - protein, 259 aa, Arabidopsis thaliana
  G363
MRPILDLEIEASSGSSSSQVASNLSPVGEDYKPISLNLSLSFNNNNNNNLDLESSSLTLPLSSTSESSNPEQQQQQQPSVSKRVFSCNYCQRKFYSSQALGGHQNAHKRERTLAKRAMLWVLLGSSPVEDQVAIMRLLPQQPLSCLPLHGSGNGNMTSFRTLGIRAHSSAHDVSMTRQTPETLIRNIARFNQGYFGNCIPFYVEDDEAEMLWPGSFRQATNAVAVEAGNDNLGERKMDFLDVKQAMDMESSLPDLTLKL

SEQ ID NO: 2307 - DNA, 728 bp, Arabidopsis thaliana
  G364
aagcttgatatcgcctctctctaatctctctttctctctctatctctaagaatatataaaggtatggactaccagccaaacacatccctacgtctaagcctaccaagttacaagaaccaccaactaaacctagaacttgttctcgagccttcttccatgtcttcttcttcatcttcttccacgaactcatcatcatgtttggagcagcctagggtattctcatgtaactattgtcaaagaaagttttacagctctcaagctcttggtggtcatcaaaacgctcataagcttgagagaaccttagccaagaagagtcgagaactctttagatcctcaaacactgttgattctgatcagccttacccgttctccggtcgctttgagctttacggccgtggctaccaaggatttctcgaaagtggcggctcgagggacttctccgcccgccgtgtgccggagagtggtcttgatcaggatcaggagaagagtcaccttgacttatccttaaggctctaaaagaatcttatattttgttagtctatatattatcatatcaattgttaatcttaaaattgattgttttacttattagtcatttcctattatctgaaagttttctttgtaagttgtaactatggtcctaaattcaaatccaaatttgattttggaagatggtacctaatgcagtagttaaataagttaaaaaaatgaaggatctataattctct

SEQ ID NO: 2308 - protein, 150 aa, Arabidopsis thaliana
  G364
MDYQPNTSLRLSLPSYKNHQLNLELVLEPSSMSSSSSSSTNSSSCLEQPRVFSCNYCQRKFYSSQALGGHQNAHKLERTLAKKSRELFRSSNTVDSDQPYPFSGRFELYGRGYQGFLESGGSRDFSARRVPESGLDQDQEKSHLDLSLRL

SEQ ID NO: 2309 - DNA, 925 bp, Arabidopsis thaliana
  G365
caattcttttactttcattctctttatatattctctctacgctataatatatattacacagaatatacatggaaccgtccatcaaaggagatcaagaaatgttaaaaatcaagaaacaaggtcatcaagatcttgagttggggttgacccttttgtcacgtggaaccgcgacctcatcagagctcaatctcatcgattctttcaaaaccagctcatcatcgacttctcatcatcagcaccagcaagaacaattggcagatccgagagtgttctcgtgtaattattgtcaaagaaagttctatagttcacaagcgctaggcggtcaccaaaacgctcataaacgtgagcgcaccttagccaaacgtggacagtattacaagatgactctctcctccttgccttcttcagcgtttgcgtttggccacggttcagtcagcagattcgcaagcatggcatcgttaccattacatggctcggtgaataacaggtcaacgttagggattcaagctcattcaacgatccataagcccagcttcttaggaagacaaacgacgagtttaagtcatgttttcaaacagagcattcaccagaaaccgaccataggaaagatgttgccggagaaatttcaccttgaagtcgccggaaataataacagtaacatggttgctgctaagttggagagaattggacatttcaagagcaaccaagaagatcataatcagtttaagaaaattgacttgactcttaagctatgagctctgccatcttctttttagtcttcattataactttttttattctcatctttgtttgatataatgattgacggcagggtgtgttagagtttcactaatgatcaagttgtactttttatatatttcattgataccttgttgatgtaattcaatattttaggtctgttttt

SEQ ID NO: 2310 - protein, 228 aa, Arabidopsis thaliana
  G365
MEPSIKGDQEMLKIKKQGHQDLELGLTLLSRGTATSSELNLIDSFKTSSSSTSHHQHQQEQLADPRVFSCNYCQRKFYSSQALGGHQNAHKRERTLAKRGQYYKMTLSSLPSSAFAFGHGSVSRFASMASLPLHGSVNNRSTLGIQAHSTIHKPSFLGRQTTSLSHVFKQSIHQKPTIGKMLPEKFHLEVAGNNNSNMVAAKLERIGHFKSNQEDHNQFKKIDLTLKL

SEQ ID NO: 2311 - DNA, 708 bp, Arabidopsis thaliana
  G367
atggacgcttcaatagtttcctcatccactgcttttccatatcaagattctctaaaccagagcatcgaagacgaagaaagagacgttcataattctagtcacgaactcaatctcatcgactgcatagacgacacaacgagtatcgttaacgaatctacaacatccacagaacaaaagcttttctcatgcaactattgtcaaagaactttctatagctcacaagcacttggtggtcaccaaaacgcacacaagagagagagaacgttggcgaagagaggacaacgtatggcagcgtcagcctcagcttttggacatccttacggtttctctccacttcctttccacggacagtacaacaaccataggtctttagggatccaagcgcattcgataagccacaagctaagttcttataacgggtttggtggtcactatggtcagatcaactggtcaagacttccatttgatcaacaaccagccataggtaaatttccctcaatggataattttcatcatcatcatcatcagatgatgatgatggctccttcagtaaattcacggtccaataacatcgatagcccaagcaacacaggacgggttctagaagggtcaccgactcttgaacaatggcacggagacaaaggattgttgttaagtacaagtcatcatgaagagcagcagaaacttgacttgtccctcaagctttga

SEQ ID NO: 2312 - protein, 235 aa, Arabidopsis thaliana
  G367
MDASIVSSSTAFPYQDSLNQSIEDEERDVHNSSHELNLIDCIDDTTSIVNESTTSTEQKLFSCNYCQRTFYSSQALGGHQNAHKRERTLAKRGQRMAASASAFGHPYGFSPLPFHGQYNNHRSLGIQAHSISHKLSSYNGFGGHYGQINWSRLPFDQQPAIGKFPSMDNFHHHHHQMMMMAPSVNSRSNNIDSPSNTGRVLEGSPTLEQWHGDKGLLLSTSHHEEQQKLDLSLKL

SEQ ID NO: 2313 - DNA, 1854 bp, Arabidopsis thaliana
  G373
atggcgattgaaactcagcttccttgcgacggtgacggtgtgtgtatgcggtgtcaggtgaatcctccgtcagaagagactctcacttgtggcacgtgcgtcactccatggcacgtgccgtgtctcctccccgaatcactcgcttcttccactggagagtgggagtgtcccgattgctccggcgttgtcgttccctccgccgctccgggtaccggaaacgctcgacctgaatcttccggttcagttctcgttgctgcgatccgtgcgattcaggctgatgagactttaaccgaagctgagaaagccaaaaaaaggcagaaactgatgagtgggggtggtgacgatggtgtcgatgaagaagagaagaagaagttagaaatcttttgttctatttgcattcaattgccagaaagacctatcacgacaccgtgtgggcacaatttctgtttgaaatgtttcgagaaatgggcagtaggtcaagggaagctaacttgtatgatatgccgaagcaaaattccgagacatgtggcaaaaaatcctcgcatcaacttagctctagtttctgctattcgtttagcaaatgttaccaaatgttctgttgaggcaactgcagccaaggttcatcatattatccgcaaccaagaccgtcctgagaaagcatttactaccgagcgggcagtaaaaactgggaaagctaatgctgctagcggtaagttttttgtgacaatacctcgtgatcattttggtcccataccagctgagaatgatgtcactagaaagcaaggtgttttggttggagaatcttgggaggacaggcaagagtgtaggcagtggggagctcatttcccgcatattgctggcattgccgggcaatcagcggttggagctcagtctgtggccctctctggaggttatgacgatgatgaggatcatggtgaatggtttctctacacaggaagtggtggaagggatctcagtggaaacaaaagaattaacaagaaacagtcgtctgaccaggcgtttaaaaacatgaatgaatctctaagacttagttgcaaaatgggctatcctgtccgagttgtcaggtcttggaaggagaagcgttctgcatatgcccctgctgaaggtgtgagatatgatggggtctatcgaattgagaagtgctggagtaatgttggagtacagggttcttttaaggtctgtcgttacctgtttgttagatgtgacaatgagccagctccatggaccagtgatgagcatggcgatcgtccaagaccgttgcctaatgttccggagcttgagactgctgctgacctgtttgtgagaaaggagagtccatcatgggatttcgatgaagctgagggtcgttggaaatggatgaagtctcctcctgttagcagaatggctttggatcctgaggagaggaagaagaataagagagcaaaaaatactatgaaggccagacttctgaaagaatttagttgccaaatctgtcgggaagtgctgagtcttccagtgacgacgccttgtgcacacaacttctgcaaagcatgcttagaagcgaagtttgctgggataactcaactgagagagagaagcaatggcggacgtaaactacgtgcaaagaagaacatcatgacctgcccttgctgcacgacggatctctccgagtttctccaaaacccgcaggtgaacagagagatgatggagataatagagaattttaagaagagtgaggaagaggctgatgcatccatttctgaagaagaagaagaagaatccgaacctccaactaagaagattaagatggataacaactctgttggtggtagtggtacaagtctctcagcttaa

SEQ ID NO: 2314 - protein, 617 aa, Arabidopsis thaliana
  G373
MAIETQLPCDGDGVCMRCQVNPPSEETLTCGTCVTPWHVPCLLPESLASSTGEWECPDCSGVVVPSAAPGTGNARPESSGSVLVAAIRAIQADETLTEAEKAKKRQKLMSGGGDDGVDEEEKKKLEIFCSICIQLPERPITTPCGHNFCLKCFEKWAVGQGKLTCMICRSKIPRHVAKNPRINLALVSAIRLANVTKCSVEATAAKVHHIIRNQDRPEKAFTTERAVKTGKANAASGKFFVTIPRDHFGPIPAENDVTRKQGVLVGESWEDRQECRQWGAHFPHIAGIAGQSAVGAQSVALSGGYDDDEDHGEWFLYTGSGGRDLSGNKRINKKQSSDQAFKNMNESLRLSCKMGYPVRVVRSWKEKRSAYAPAEGVRYDGVYRIEKCWSNVGVQGSFKVCRYLFVRCDNEPAPWTSDEHGDRPRPLPNVPELETAADLFVRKESPSWDFDEAEGRWKWMKSPPVSRMALDPEERKKNKRAKNTMKARLLKEFSCQICREVLSLPVTTPCAHNFCKACLEAKFAGITQLRERSNGGRKLRAKKNIMTCPCCTTDLSEFLQNPQVNREMMEIIENFKKSEEEADASISEEEEEESEPPTKKIKMDNNSVGGSGTSLSA

SEQ ID NO: 2315 - DNA, 1805 bp, Arabidopsis thaliana
  G374
attccctctcttcgatttttaattccttgctcctctgctcgtttctctaccggcgacgtaacctctctgtctctgttctgttccttgcctgctcgaggtgtgcatcttcttggaatcagctgactttgcggtcaatcggatttcttgggattgtttggagaaactttggaggtgatggacaacaaaaatgatcaggatattgatgttagatcagtggttgaagctgtttccgccgatctttcctttggtgctcccctctatgtggttgagagcatgtgcatgcgctgccaagaaaatggaacaaccagatttctattgaccttaattcctcacttcagaaaggtcttaatatctgcatttgaatgtccgcattgcggggaaaggaataatgaagttcagttcgcaggcgagattcaaccccgtggatgctgttacaatctagaggttctagctggtgatgtgaagatatttgaccggcaagttgtgaaatctgaatcagccactattaagattcctgaactggattttgagattccaccagaggcccaacgtggaagtttgtctactgtggaagggatattagcacgggctgctgatgaactgagtgcccttcaagaagaacgcaagaaagttgatcctaaaactgctgaagcaatagaccaattcttgtccaaactgagagcttgtgctaaagcagagacatccttcaccttcattttggatgatcctgctggaaacagtttcattgagaacccacatgctccatcaccagatccctctctaaccatcaaattctatgagcgaacaccagagcaacaagcaacacttggatatgttgctaacccatctcaggctggacaatcagaaggaagccttggcgcaccttctactaaaacagcttatgtacctaatggaacaatcggagcaactgctggtcatcgcgcgattgctcagagtaatagcactgatatttccgacaacttgttcagatactctgcgcctgaagaggtgatgactttcccttcaacttgcggagcatgtacggagccgtgtgagacacggatgttcgtgactaaaatcccgtactttcaggaagttattgtcatggcatctacatgtgacagttgtggctatcgtaattctgagttgaagcctggtggtgcaattcctgaaaagggaaagaagattactctctctgtgaggaacattacagaccttagccgagatgttatcaagtcggacactgcaggagtgataatcccagaacttgatctggagctagctggtggtacacttggtggaatggtaacaacagttgaagggttggttacacagatcagagaaagcctagcgagagttcacggattcacttttggtgatagtatggaagagagtaagttgaacaaatggagagaatttggagccaggctcactaagctcctaagctttgaacagccgtggacattgattcttgatgatgaattagcaaattcctttattgcaccagtaacagatgatatcaaagatgaccatcagctcacatttgaagagtacgagaggtcatgggatcaaaacgaggagttgggtctcaacgacatagatacttcttcagctgatgctgcttatgaatccacagagacgactaaattaccttaagattagttggtcttacatgatttaattttagatggtgatgatcagactgatggatccatatgttgttgtattgtaacaattaaagaatcaaagaacaaattcctctttttaatctattaaaaaaaaaacttttgagccaaaaaaaaaac

SEQ ID NO: 2316 - protein, 493 aa, Arabidopsis thaliana
  G374
MDNKNDQDIDVRSVVEAVSADLSFGAPLYVVESMCMRCQENGTTRFLLTLIPHFRKVLISAFECPHCGERNNEVQFAGEIQPRGCCYNLEVLAGDVKIFDRQVVKSESATIKIPELDFEIPPEAQRGSLSTVEGILARAADELSALQEERKKVDPKTAEAIDQFLSKLRACAKAETSFTFILDDPAGNSFIENPHAPSPDPSLTIKFYERTPEQQATLGYVANPSQAGQSEGSLGAPSTKTAYVPNGTIGATAGHRAIAQSNSTDISDNLFRYSAPEEVMTFPSTCGACTEPCETRMFVTKIPYFQEVIVMASTCDSCGYRNSELKPGGAIPEKGKKITLSVRNITDLSRDVIKSDTAGVIIPELDLELAGGTLGGMVTTVEGLVTQIRESLARVHGFTFGDSMEESKLNKWREFGARLTKLLSFEQPWTLILDDELANSFIAPVTDDIKDDHQLTFEEYERSWDQNEELGLNDIDTSSADAAYESTETTKLP

SEQ ID NO: 2317 - DNA, 1290 bp, Arabidopsis thaliana
  G375
tcgacaaaaactctcactctccctcaaactaaacaaacatacagaacacaaaatgggtctcacttctcttcaagtttgcatggattctgattggctccaggaatccgagtcatcaggaggaagcatgttagactcttcaacgaattctccgtcagcagccgacatactagcagcttgcagcactagaccacaagcctcggccgtggctgtagccgctgcagctctgatggacggtggaaggaggctgcgtccacctcacgaccatcctcaaaagtgtcctcgttgcgagtcaacacatactaagttctgttactacaataactacagcctctctcagcctcgttacttctgcaagacttgtcgccgttactggacaaaaggcggaactctaaggaatattccggttggtggtggatgccgtaaaaacaagaaaccatcttcctctaattcctcctcctccacttcttccggcaaaaaaccatccaacatcgttaccgccaatacctctgatcttatggctttagcacattctcatcaaaattaccaacattctcctctagggttttcacattttggtgggatgatggggtcttactcaactccggagcatggtaacgttggtttcttggagagcaagtatggcggtttgctttcgcagagccctagacctattgatttcttggacagtaagtttgatctcatgggagtgaacaatgacaacctggtcatggttaatcatggaagtaacggagatcatcatcatcatcataatcatcacatgggtctgaatcacggtgtaggtcttaacaacaacaacaacaatggtggatttaatgggatttctacgggaggcaatggaaatggtggtggtctcatggatatatcgacatgccaaagacttatgctatctaattatgatcatcaccattacaatcatcaagaagatcatcaaagggtagcaacaataatggatgtgaagccaaatccgaagttgttatcgcttgattggcagcaagatcaatgctactccaatggtggtggtagcggaggcgcaggaaaatccgacggtggtggatacggcaatggtggttatatcaacggtttaggttcgtcgtggaatggtttgatgaatggctatggaacgtccactaaaacaaactccttggtttgataagttaatcagaacttcttttttcttgtcgtcatcaactagtagtagtagtaatagtagttggagactagagaagcacttcaaattatttatgggtttgtttgctaagccagttttac

SEQ ID NO: 2318 - protein, 372 aa, Arabidopsis thaliana
  G375
MGLTSLQVCMDSDWLQESESSGGSMLDSSTNSPSAADILAACSTRPQASAVAVAAAALMDGGRRLRPPHDHPQKCPRCESTHTKFCYYNNYSLSQPRYFCKTCRRYWTKGGTLRNIPVGGGCRKNKKPSSSNSSSSTSSGKKPSNIVTANTSDLMALAHSHQNYQHSPLGFSHFGGMMGSYSTPEHGNVGFLESKYGGLLSQSPRPIDFLDSKFDLMGVNNDNLVMVNHGSNGDHHHHHNHHMGLNHGVGLNNNNNNGGFNGISTGGNGNGGGLMDISTCQRLMLSNYDHHHYNHQEDHQRVATIMDVKPNPKLLSLDWQQDQCYSNGGGSGGAGKSDGGGYGNGGYINGLGSSWNGLMNGYGTSTKTNSLV

SEQ ID NO: 2319 - DNA, 396 bp, Arabidopsis thaliana
  G377
atgggtctctcgcattttccaacagcgtcagaaggagtactaccacttctggtgatgaacacggttgtttcaatcactctgttgaagaacatggtgaggtctgtttttcaaattgttgcatccgagactgaatcttccatggagatagacgacgagcctgaagatgattttgttactagaagaatctcgataacacagttcaagtctctatgtgagaacatagaagaggaagaagaagagaaaggtgtggagtgttgtgtgtgcctttgtgggtttaaagaggaagaggaagtgagtgagttggtttcttgcaagcatttcttccacagagcttgtctagacaactggtttggtaataaccacaccacatgccctctttgcaggtccattctctag

SEQ ID NO: 2320 - protein, 131 aa, Arabidopsis thaliana
  G377
MGLSHFPTASEGVLPLLVMNTVVSITLLKNMVRSVFQIVASETESSMEIDDEPEDDFVTRRISITQFKSLCENIEEEEEEKGVECCVCLCGFKEEEEVSELVSCKHFFHRACLDNWFGNNHTTCPLCRSIL

SEQ ID NO: 2321 - DNA, 726 bp, Arabidopsis thaliana
  G378
atggcctcgtcatcatcatcatcttatagattccaatctgggtcttaccctctttcgtcaagtccttctcttgggaatttcgtcgaacgcattaaagacgcttgtcatttccttgtctctgctgttttgggtaccattatctccgcgatcttgaccttcttcttcgcactagtgggcacattgctaggggcacttacaggagctttgataggtcaagaaactgagagtggtttcattagaggagcagcaattggagccatttcgggagctgttttctctatcgaggtctttgaatcatctctggatctctggaaatccgatgagtcgggtttcggatgttttctctacttgattgatgtcattgttagtcttctaagcgggagacttgtacgagagcgcattggtcctgcaatgctaagtgcagtgcaaagtcaaatgggagctgtggatacagcttttgatgatcacacaagcctttttgatacaggaggctcaaaaggattgacaggagaccttgttgagaaaatcccaaagatgacaatcactggcaacaataacactgatgcttctgagaacacagactcatgttctgtttgtcttcaggatttccagctcggtgaaacagttagaagcttgcctcattgtcatcacatgtttcacttaccttgcatagacaattggctccttagacacggttcttgcccgatgtgtagacgtgatatttaa

SEQ ID NO: 2322 - protein, 241 aa, Arabidopsis thaliana
  G378
MASSSSSSYRFQSGSYPLSSSPSLGNFVERIKDACHFLVSAVLGTIISAILTFFFALVGTLLGALTGALIGQETESGFIRGAAIGAISGAVFSIEVFESSLDLWKSDESGFGCFLYLIDVIVSLLSGRLVRERIGPAMLSAVQSQMGAVDTAFDDHTSLFDTGGSKGLTGDLVEKIPKMTITGNNNTDASENTDSCSVCLQDFQLGETVRSLPHCHHMFHLPCIDNWLLRHGSCPMCRRDI

SEQ ID NO: 2323 - DNA, 2217 bp, Arabidopsis thaliana
  G385
tagggtttgctttcagtttccggagtataagaaaagatgttcgagccaaatatgctgcttgcggctatgaacaacgcagacagcaataaccacaactacaaccacgaagacaacaataatgaaggatttcttcgggacgatgaattcgacagtccgaatactaaatcgggaagtgagaatcaagaaggaggatcaggaaacgaccaagatcctcttcatcctaacaagaagaaacgatatcatcgacacacccaacttcagatccaggagatggaagcgttcttcaaagagtgtcctcacccagatgacaagcaaaggaaacagctaagccgtgaattgaatttggaacctcttcaggtcaaattctggttccaaaacaaacgtacccaaatgaagaatcatcacgagcggcatgagaactcacatcttcgggcggagaacgaaaagcttcgaaacgacaacctaagatatcgagaggctcttgcaaatgcttcgtgtcctaattgtggtggtccaacagctatcggagaaatgtcattcgacgaacaccaactccgtctcgaaaatgctcgattaagggaagagatcgaccgtatatccgcaatcgcagctaaatacgtaggcaagccagtctcaaactatccacttatgtctcctcctcctcttcctccacgtccactagaactcgccatgggaaatattggaggagaagcttatggaaacaatccaaacgatctccttaagtccatcactgcaccaacagaatctgacaaacctgtcatcatcgacttatccgtggctgcaatggaagagctcatgaggatggttcaagtagacgagcctctgtggaagagtttggctttagacgaagaagaatatgcaaggacctttcctagagggatcggacctagaccggctggatatagatcagaagcttcgcgagaaagcgcggttgtgatcatgaatcatgttaacatcgttgagattctcatggatgtgaatcaatggtcgacgattttcgcggggatggtttctagagcaatgacattagcggttttatcgacaggagttgcaggaaactataatggagctcttcaagtgatgagcgcagagtttcaagttccatctccattagtcccaacacgtgaaacctatttcgcacgttactgtaaacaacaaggagatggttcgtgggcggttgtcgatatttcgttggatagtctccaaccaaatcccccggctagatgcaggcggcgagcttcaggatgtttgattcaagaattgccaaatggatattctaaggtgacttgggtggagcatgtggaagttgatgacagaggagttcataacttatacaaacacatggttagtactggtcatgccttcggtgctaaacgctgggtagccattcttgaccgccaatgcgagcggttagctagtgtcatggctacaaacatttcctctggagaagttggcgtgataaccaaccaagaagggaggaggagtatgctgaaattggcagagcggatggttataagcttttgtgcaggagtgagtgcttcaaccgctcacacgtggactacattgtccggtacaggagctgaagatgttagagtgatgactaggaagagtgtggatgatccaggaaggtctcctggtattgttcttagtgcagccacttctttttggatccctgttcctccaaagcgagtctttgacttcctcagagacgagaattcaagaaatgagtgggatattctgtctaatggaggagttgtgcaagaaatggcacatattgctaacgggagggataccggaaactgtgtttctcttcttcgggtaaatagtgcaaactctagccagagcaatatgctgatcctacaagagagctgcattgatcctacagcttcctttgtgatctatgctccagtcgatattgtagctatgaacatagtgcttaatggaggtgatccagactatgtggctctgcttccatcaggttttgctattcttcctgatggtaatgccaatagtggagcccctggaggagatggagggtcgctcttgactgttgcttttcagattctggttgactcagttcctacggctaagctgtctcttggctctgttgcaactgtcaataatctaatagcttgcactgttgagagaatcaaagcttcaatgtcttgtgagactgcttgaaaaccatccattagc

SEQ ID NO: 2324 - protein, 721 aa, Arabidopsis thaliana
  G385
MFEPNMLLAAMNNADSNNHNYNHEDNNNEGFLRDDEFDSPNTKSGSENQEGGSGNDQDPLHPNKKKRYHRHTQLQIQEMEAFFKECPHPDDKQRKQLSRELNLEPLQVKFWFQNKRTQMKNHHERHENSHLRAENEKLRNDNLRYREALANASCPNCGGPTAIGEMSFDEHQLRLENARLREEIDRISAIAAKYVGKPVSNYPLMSPPPLPPRPLELAMGNIGGEAYGNNPNDLLKSITAPTESDKPVIIDLSVAAMEELMRMVQVDEPLWKSLALDEEEYARTFPRGIGPRPAGYRSEASRESAVVIMNHVNIVEILMDVNQWSTIFAGMVSRAMTLAVLSTGVAGNYNGALQVMSAEFQVPSPLVPTRETYFARYCKQQGDGSWAVVDISLDSLQPNPPARCRRRASGCLIQELPNGYSKVTWVEHVEVDDRGVHNLYKHMVSTGHAFGAKRWVAILDRQCERLASVMATNISSGEVGVITNQEGRRSMLKLAERMVISFCAGVSASTAHTWTTLSGTGAEDVRVMTRKSVDDPGRSPGIVLSAATSFWIPVPPKRVFDFLRDENSRNEWDILSNGGVVQEMAHIANGRDTGNCVSLLRVNSANSSQSNMLILQESCIDPTASFVIYAPVDIVAMNIVLNGGDPDYVALLPSGFAILPDGNANSGAPGGDGGSLLTVAFQILVDSVPTAKLSLGSVATVNNLIACTVERIKASMSCETA

SEQ ID NO: 2325 - DNA, 1249 bp, Arabidopsis thaliana
  G394
gaaattcttaacaaacaattttcttcataatattaattctcaagatcttaaagattatattaatacgaagagaaaattcaaatgggtcttgatgattcatgcaacacaggtcttgttcttggtttaggcctctcaccaacgcctaataattacaatcatgccatcaagaaatcttcctccactgtggaccatcgtttcatcaggctcgatccgtcgttgactctaagcctatccggtgagagctacaagatcaagactggtgccggcgccggcgaccaaatttgccggcagacctcgtcccacagcggcatctcatctttctcgagcggaagggtaaagagagaaagagaaatctccggcggcgatggagaagaagaggcggaggagacgacggagagagtggtgtgttcgagagtgagtgatgatcatgacgatgaagaaggtgttagtgctcgtaaaaagcttagactcactaaacaacaatctgctcttctcgaagataacttcaaacttcatagcacccttaatcccaagcaaaaacaagctcttgcgagacagctgaatctaaggcctagacaagttgaagtgtggttccaaaacaggagagctagaacaaaactaaagcaaacagaagtggattgtgagtttttgaagaaatgttgcgagactttaacggatgagaatagaaggcttcaaaaagagcttcaagaccttaaggctttaaaattgtctcaaccgttttacatgcacatgccggcggcgactttgactatgtgcccttcttgtgagagactcggcggtggtggtgtcggaggagatacgacggcggttgatgaagaaacggcgaaaggagctttctccatcgtcacaaagcctcgtttctataaccctttcactaatccttctgcagcatgttagttacttattagttatttaattctttttgttggttttttttttgtttcttaaatcaaattaggaattagttagaagataaatcccagggaaaaaatattacgttgaaattggggggaaatggggtatagtctttatagataagactcttcaacgattccactttatttttcggtgggattgttggttgatgaagaaaaaaaaatagtttgtaattacaggtttaaatatgtagagaaaaaatgacgaatatgtattatcttgtttttttttccttcgaatatgtattacggtaatataaatttgcttgtaaaaataataaatatattatttg

SEQ ID NO: 2326 - protein, 278 aa, Arabidopsis thaliana
  G394
MGLDDSCNTGLVLGLGLSPTPNNYNHAIKKSSSTVDHRFIRLDPSLTLSLSGESYKIKTGAGAGDQICRQTSSHSGISSFSSGRVKREREISGGDGEEEAEETTERVVCSRVSDDHDDEEGVSARKKLRLTKQQSALLEDNFKLHSTLNPKQKQALARQLNLRPRQVEVWFQNRRARTKLKQTEVDCEFLKKCCETLTDENRRLQKELQDLKALKLSQPFYMHMPAATLTMCPSCERLGGGGVGGDTTAVDEETAKGAFSIVTKPRFYNPFTNPSAAC

SEQ ID NO: 2327 - DNA, 957 bp, Arabidopsis thaliana
  G396
atgggggaaagagatgatgggttgggtttgagtctaagcttgggaaatagtcaacaaaaagaaccatctctgaggttgaatcttatgccgttgacaacttcttcttcttcttcttcgtttcaacacatgcacaatcagaataacaatagccatccccagaagattcataacatctcttggactcatctgtttcaatcttctgggattaaacgtacaactgcagagagaaactccgacgccgggtcatttctaagaggtttcaacgtgaacagagctcagtcttcggtggcggtagtggacttggaagaagaagccgccgtcgtctcgtctccaaacagcgccgtttcgagtctgagtggaaataaaagggatcttgcggtggcgagaggaggagatgaaaacgaggcggagagagcttcttgctcacgcggagggggaagcggtggtagcgacgatgaagacggcggaaacggcgacggatcaaggaagaaactacggttatcgaaggatcaagctcttgttctcgaggagacttttaaagaacatagcactcttaatccgaagcaaaagctggctctagcaaaacagttgaatctaagggcaagacaagttgaagtgtggtttcagaaccgtagggcaaggacgaagctgaaacaaacggaggttgattgtgagtatttaaagagatgttgcgataatctgaccgaggagaatcgacggctgcagaaagaagtgtcggagctgagggcgttgaagttgtctccacatctctacatgcacatgactcctcctactactctcaccatgtgcccttcttgcgaacgtgtctcctcctctgccgccactgtgaccgctgctccttccactactactactcctacggtggtggggcggccaagtccacagcgattaactccttggactgctatttctctccagcaaaaatcaggtcgctag

SEQ ID NO: 2328 - protein, 318 aa, Arabidopsis thaliana
  G396
MGERDDGLGLSLSLGNSQQKEPSLRLNLMPLTTSSSSSSFQHMHNQNNNSHPQKIHNISWTHLFQSSGIKRTTAERNSDAGSFLRGFNVNRAQSSVAVVDLEEEAAVVSSPNSAVSSLSGNKRDLAVARGGDENEAERASCSRGGGSGGSDDEDGGNGDGSRKKLRLSKDQALVLEETFKEHSTLNPKQKLALAKQLNLRARQVEVWFQNRRARTKLKQTEVDCEYLKRCCDNLTEENRRLQKEVSELRALKLSPHLYMHMTPPTTLTMCPSCERVSSSAATVTAAPSTTTTPTVVGRPSPQRLTPWTAISLQQKSGR

SEQ ID NO: 2329 - DNA, 2545 bp, Arabidopsis thaliana
  G418
acatatgttttaaattctttgtctgaatcttacaggatccgagagagagagctctggaacgatattaacatatatcatgaagaaaaagattgaagtattgatatgggaataactaaaacttctcctaatactacaattctcttgaagacttttcacaataattctatgtcccaagattatcatcatcatcatcatcataatcaacaccaaggaggtatcttcaacttctctaatggattcgaccgatcagattctcccaatttaacaactcagcagaagcaagagcatcaaagggtagagatggacgaggaatcttcagtcgccggaggtaggattccggtctacgaatcagccggtatgttatccgaaatgtttaatttccccggaagcagcggtggaggaagagatctcgacctcggccaatctttccggtcaaataggcagttgcttgaggagcaacatcagaatattccggctatgaatgctacggattcagccaccgccaccgcagccgccatgcagttattcttgatgaatccaccgccaccgcaacaaccaccgtctccgtcatccacaacttccccaaggagccaccacaattcttcaactcttcacatgttacttccaagtccatccaccaacacaactcaccatcagaactacactaatcatatgtctatgcatcagcttccacatcagcatcaccaacagatatcgacgtggcagtcttctcccgatcatcatcatcatcatcacaacagccaaacggagattgggaccgtccacgtggaaaacagcggaggacacggaggacaaggcttgtccttatctctctcatcgtctttagaggctgcagcaaaagcggaagagtatagaaacatttactacggagccaattcttctaacgcatcacctcatcatcaatacaatcaattcaagactcttcttgctaattcttctcaacatcaccatcaagtattaaaccaattccgatcatctccggctgcttcttcctcttccatggcagcggtcaatatcttaagaaactcgaggtacacaacggccgcgcaagagttgttggaagagttttgtagtgttggaagaggatttttgaagaagaacaaacttgggaacagctcaaaccctaatacttgcggtggtgatggtggtggcagctctccttcgtcggccggagcaaacaaggagcatcctcctttatcggcgtctgatcggattgagcatcaaagaaggaaagtgaaactactcaccatgcttgaagaggtggaccgacggtacaaccattactgcgagcaaatgcagatggttgtgaactctttcgacatagtaatgggccacggtgcggcattaccgtacaccgcattggctcaaaaagctatgtcaagacattttagatgccttaaagatgcagttgcggctcagcttaagcagagttgcgaacttcttggggacaaagatgcagcgggaatctcttcttccgggttaacaaaaggtgaaactccgcgtttgcgtttgctagagcaaagtttgcgtcagcaacgtgcgtttcatcaaatgggtatgatggaacaagaagcttggcggccacaacgcggtttgcctgaacgctccgtcaatatacttagagcttggctcttcgaacatttccttcacccgtatccaagtgatgcagataaacacctattggctcgacagactggtttatccagaaatcaggtatcaaattggttcataaatgctagggttcgtttatggaaaccaatggtggaagaaatgtaccaacaagaatcaaaagaaagagaaagagaagaggaattagaagagaacgaagaagatcaagaaacaaaaaacagcaacgacgacaagagcacaaaatccaacaacaatgaaagcaacttcactgccgttcggaccacttcacaaactccaacgacaaccgcaccagacgcatcagacgcagacgcagcagtagcgacaggccaccgtctaagatccaacattaatgcttacgaaaacgacgcttcatcacttctactcccttcctcttattccaacgccgccgctcctgccgctgtttctgacgacttgaattctcgttacggtggctcagacgcgttttccgccgttgccacgtgtcaacaaagtgtaggtgggttcgatgatgctgacatggatggtgttaacgttataaggtttgggacaaaccctactggtgacgtgtctctcacgcttggtttacgccacgctggaaacatgcctgacaaagacgcttctttctgcgttagagagtttgggggtttttagtttgcttttgtcactccatttaattaattaattatagttttccattcttacttattttaattgaaaatctatttttgtctcttaaaagtccaaacaatacattagtctagccctcctctgcttttttttttctatctcgtgaagagaagaaaacgatacgtaaatcccttcgaaaactaatgtacgttgtacgacttattgttttcataaaaaaaaaaaaaaa

SEQ ID NO: 2330 - protein, 739 aa, Arabidopsis thaliana
  G418
MGITKTSPNTTILLKTFHNNSMSQDYHHHHHHNQHQGGIFNFSNGFDRSDSPNLTTQQKQEHQRVEMDEESSVAGGRIPVYESAGMLSEMFNFPGSSGGGRDLDLGQSFRSNRQLLEEQHQNIPAMNATDSATATAAAMQLFLMNPPPPQQPPSPSSTTSPRSHHNSSTLHMLLPSPSTNTTHHQNYTNHMSMHQLPHQHHQQISTWQSSPDHHHHHHNSQTEIGTVHVENSGGHGGQGLSLSLSSSLEAAAKAEEYRNIYYGANSSNASPHHQYNQFKTLLANSSQHHHQVLNQFRSSPAASSSSMAAVNILRNSRYTTAAQELLEEFCSVGRGFLKKNKLGNSSNPNTCGGDGGGSSPSSAGANKEHPPLSASDRIEHQRRKVKLLTMLEEVDRRYNHYCEQMQMVVNSFDIVMGHGAALPYTALAQKAMSRHFRCLKDAVAAQLKQSCELLGDKDAAGISSSGLTKGETPRLRLLEQSLRQQRAFHQMGMMEQEAWRPQRGLPERSVNILRAWLFEHFLHPYPSDADKHLLARQTGLSRNQVSNWFINARVRLWKPMVEEMYQQESKEREREEELEENEEDQETKNSNDDKSTKSNNNESNFTAVRTTSQTPTTTAPDASDADAAVATGHRLRSNINAYENDASSLLLPSSYSNAAAPAAVSDDLNSRYGGSDAFSAVATCQQSVGGFDDADMDGVNVIRFGTNPTGDVSLTLGLRHAGNMPDKDASFCVREFGGF

SEQ ID NO: 2331 - DNA, 2405 bp, Arabidopsis thaliana
  G419
aagccacacaatctcttttcttctctctctctctgttatatctcttctgtttaattcttttattcttcttcgtctatcttctcctataatctcttctctctccctcttcacctaaagaataagaagaaaaataattcacatctttatgcaaactactttcttgtagggttttaggagctatctctattgtcttggttctgatacaaagttttgtaattttcatggtatgagaagatttgcctttctattttgtttattggttctttttaactttttcttggagatgggttcttgtagatcttaatgaaacttctgtttttgtcccaaaaagagttttcttttttcttctcttctttttgggttttcaattcttgagagacatggcaagagatcagttctatggtcacaataaccatcatcatcaagagcaacaacatcaaatgattaatcagatccaagggtttgatgagacaaaccaaaacccaaccgatcatcatcattacaatcatcagatctttggctcaaactccaacatgggtatgatgatagacttctctaagcaacaacagattaggatgacaagtggttcggatcatcatcatcatcatcatcagacaagtggtggtactgatcagaatcagcttctggaagattcttcatctgccatgagactatgcaatgttaataatgatttcccaagtgaagtaaatgatgagagaccaccacaaagaccaagccaaggtctttccctttctctctcctcttcaaatcctacaagcatcagtctccaatctttcgaactcagaccccaacaacaacaacaagggtattccggtaataaatcaacacaacatcagaatctccaacacacgcagatgatgatgatgatgatgaatagtcaccaccaaaacaacaacaataacaatcatcagcatcataatcatcatcagtttcagattgggagttccaagtatttgagtccagctcaagagctactgagtgagttttgcagtcttggagtaaaggaaagcgatgaagaagtgatgatgatgaagcataagaagaagcaaaagggtaaacaacaagaagagtgggacacaagtcaccacagcaacaatgatcaacatgaccaatctgcgactacttcttcaaagaaacatgttccaccacttcactctcttgagttcatggaacttcagaaaagaaaagccaagttgctctccatgctcgaagagcttaaaagaagatatggacattaccgagagcaaatgagagttgcggcggcagcctttgaagcggcggttggactaggaggggcagagatatacactgcgttagcgtcaagggcaatgtcaagacactttcggtgtttaaaagacggacttgtgggacagattcaagcaacaagtcaagctttgggagagagagaagaggataatcgtgcggtttctattgcagcacgtggagaaactccacggttgagattgctcgatcaagctttgcggcaacagaaatcgtatcgccaaatgactcttgttgacgctcatccttggcgtccacaacgcggcttgcctgaacgcgcagtcacaacgttgagagcttggctctttgaacactttcttcacccatatccgagcgatgttgataagcatatattggcccgacaaactggtttatcaagaagtcaggtatcaaattggtttattaatgcaagagttaggctatggaaaccaatgattgaagaaatgtactgtgaagaaacaagaagtgaacaaatggagattacaaacccgatgatgatcgatactaaaccggacccggaccagttgatccgtgtcgaaccggaatctttatcctcaatagtgacaaaccctacatccaaatccggtcacaactcaacccatggaacgatgtcgttagggtcaacgtttgacttttccttgtacggtaaccaagctgtgacatacgctggtgaaggagggccacgtggtgacgtttccttgacgcttgggttacaacgtaacgatggtaacggtggtgtgagtttagcgttgtctccagtgacggctcaaggtggccaacttttctacggtagagaccacattgaagaaggaccggttcaatattcagcgtcgatgttagatgatgatcaagttcagaatttgccttataggaatttgatgggagctcaattacttcatgatattgtttgagattaaaagattaggaccaaagttatcgatacatattttccaaaaccgattcggttatgtaacggtttagttagataaaaaccaaattagatatttatatataccgttgtctgattggattggaggattggtggacaaggagatattattaatgtatgagttagttggttcgtcaaaaaaaaaaaaaaaaaa

SEQ ID NO: 2332 - protein, 610 aa, Arabidopsis thaliana
  G419
MARDQFYGHNNHHHQEQQHQMINQIQGFDETNQNPTDHHHYNHQIFGSNSNMGMMIDFSKQQQIRMTSGSDHHHHHHQTSGGTDQNQLLEDSSSAMRLCNVNNDFPSEVNDERPPQRPSQGLSLSLSSSNPTSISLQSFELRPQQQQQGYSGNKSTQHQNLQHTQMMMMMMNSHHQNNNNNNHQHHNHHQFQIGSSKYLSPAQELLSEFCSLGVKESDEEVMMMKHKKKQKGKQQEEWDTSHHSNNDQHDQSATTSSKKHVPPLHSLEFMELQKRKAKLLSMLEELKRRYGHYREQMRVAAAAFEAAVGLGGAEIYTALASRAMSRHFRCLKDGLVGQIQATSQALGEREEDNRAVSIAARGETPRLRLLDQALRQQKSYRQMTLVDAHPWRPQRGLPERAVTTLRAWLFEHFLHPYPSDVDKHILARQTGLSRSQVSNWFINARVRLWKPMIEEMYCEETRSEQMEITNPMMIDTKPDPDQLIRVEPESLSSIVTNPTSKSGHNSTHGTMSLGSTFDFSLYGNQAVTYAGEGGPRGDVSLTLGLQRNDGNGGVSLALSPVTAQGGQLFYGRDHIEEGPVQYSASMLDDDQVQNLPYRNLMGAQLLHDIV

SEQ ID NO: 2333 - DNA, 1379 bp, Arabidopsis thaliana
  G428
ttacttttgtgtttcttcatattcttcagaagcaagcacaaggctagggatcgaagaagcggcgatcactgatcgtatctcactacgatcacattaatggatagaatgtgtggtttccgctcgacggaagactattcggagaaagcgacgttgatgatgccgtccgattatcagtctttgatttgttcaaccaccggagacaatcaaagactgtttggatccgacgaactcgctaccgctttgtcctcggagttgcttccgcgtattcgaaaagctgaggataatttctctcttagtgtcatcaaatccaaaatcgcttctcatcctttgtatcctcgcttactccaaacctacatcgattgccaaaaggtgggagcgcctatggaaatagcgtgtatattggaagagattcagcgagagaaccatgtgtacaagagagatgttgctccattatcttgctttggagctgatcctgagcttgatgaattcatggaaacctactgtgatatattggttaaatacaaaaccgatcttgcgaggccgttcgacgaggctacaactttcataaacaagattgaaatgcagcttcagaacttgtgcactggtccagcgtctgctacagctctttcagatgatggtgcggtttcatctgacgaggaactgagagaagatgatgacatagcagcggatgacagccaacaaagaagcaatgaccgcgatctgaaggaccagctactacgcaaatttggtagccatatcagttcattgaaactcgagttctctaaaaagaagaagaaagggaagctaccaagagaagcaagacaagcgttgctcgattggtggaatgttcataataaatggccttaccctactgaaggcgacaaaatagctctggctgaagaaacaggtttggatcaaaaacaaatcaacaattggtttataaaccaaaggaaacgccattggaagccttcggagaacatgccgtttgatatgatggacgattctaatgaaacattctttaccgaggaatgaaaagagagacatgggattgtgcattgtataatttttacactgttttcccaagaaaagaaaacagtaaaaagcttttggtaaatgggacatcatcgcgaatgaatggaaccagttagccaaaacggtcaagggcgtggcgtaacgagacattgtattggaaatagtggcaatattatgtcactaatcttccaatggtccaaaatgatagatttcttatttgtattgaaccttacttagatagctgatgtgtcaactaaataatttattttcatccttatactacttgtatcaatgtctctaattgatcaattgttgcttgctattcaaaaaaaaaaaaaaaaaaaaaa

SEQ ID NO: 2334 - protein, 311 aa, Arabidopsis thaliana
  G428
MDRMCGFRSTEDYSEKATLMMPSDYQSLICSTTGDNQRLFGSDELATALSSELLPRIRKAEDNFSLSVIKSKIASHPLYPRLLQTYIDCQKVGAPMEIACILEEIQRENHVYKRDVAPLSCFGADPELDEFMETYCDILVKYKTDLARPFDEATTFINKIEMQLQNLCTGPASATALSDDGAVSSDEELREDDDIAADDSQQRSNDRDLKDQLLRKFGSHISSLKLEFSKKKKKGKLPREARQALLDWWNVHNKWPYPTEGDKIALAEETGLDQKQINNWFINQRKRHWKPSENMPFDMMDDSNETFFTEE

SEQ ID NO: 2335 - DNA, 1149 bp, Arabidopsis thaliana
  G431
atggagagtggttccaacagcacttcttgtccaatggcttttgccggggataatagtgatggtccgatgtgtcctatgatgatgatgatgccgcccatcatgacatcacatcaacatcatggtcatgatcatcaacatcaacaacaagaacatgatggttatgcatatcagtcacaccaccaacaaagtagttccctttttcttcaatcactagctcctccccaaggaactaagaacaaagttgcttcttcttcttctccttcctcttgtgctcctgcctattctctaatggagatccatcataacgaaatcgttgcaggaggaatcaacccttgctcctctttctcttcttcagcctctgtcaaggccaagatcatggctcatcctcactaccaccgcctcttggccgcttatgtcaattgtcagaaggttggagcaccaccggaggttgtggcgaggctggaggaggcatgctcgtctgccgcagccgcagccgcatctatggggccaacagggtgtcttggtgaagatccagggcttgatcaattcatggaagcttactgtgaaatgctcgttaagtatgagcaagagctctccaaacctttcaaggaagctatggtcttccttcaacgtgtcgagtgtcaattcaaatccctctctctatcctcaccttcctctttctccggttatggagagacagcaattgataggaacaataatgggtcatccgaggaagaagtcgatatgaacaatgaatttgtagatccacaagctgaggatagagagcttaaaggacagctcttgcgcaagtacagtggttacttagggagcctcaagcaagagttcatgaagaagaggaagaaaggaaagctccctaaagaagctcgtcaacaactgcttgattggtggagccgtcactacaaatggccttacccttcggagcaacaaaagctcgcccttgcggaatcaacggggctggaccagaaacagataaacaattggttcataaaccagaggaaacggcattggaagccgtcggaggacatgcagtttgtagtaatggacgcaacacatcctcaccattacttcatggataatgtcttggacaatcctttcccaatggatcacatctcctccaccatgctttga

SEQ ID NO: 2336 - protein, 382 aa, Arabidopsis thaliana
  G431
MESGSNSTSCPMAFAGDNSDGPMCPMMMMMPPIMTSHQHHGHDHQHQQQEHDGYAYQSHHQQSSSLFLQSLAPPQGTKNKVASSSSPSSCAPAYSLMEIHHNEIVAGGINPCSSFSSSASVKAKIMAHPHYHRLLAAYVNCQKVGAPPEVVARLEEACSSAAAAAASMGPTGCLGEDPGLDQFMEAYCEMLVKYEQELSKPFKEAMVFLQRVECQFKSLSLSSPSSFSGYGETAIDRNNNGSSEEEVDMNNEFVDPQAEDRELKGQLLRKYSGYLGSLKQEFMKKRKKGKLPKEARQQLLDWWSRHYKWPYPSEQQKLALAESTGLDQKQINNWFINQRKRHWKPSEDMQFVVMDATHPHHYFMDNVLDNPFPMDHISSTML

SEQ ID NO: 2337 - DNA, 2157 bp, Arabidopsis thaliana
  G436
atggattttactcgcgatgacaactcaagtgatgaacgggaaaatgatgtagacgccaacaccaacaaccgtcacgagaagaagggttaccatcgccacactaatgaacaaattcataggcttgaaacgtatttcaaggaatgtcctcatccagacgaatttcagcgacgtctgttgggtgaagaactgaatctgaaaccaaaacaaatcaaattttggtttcaaaacaaaagaactcaagctaagagtcacaatgaaaaagcagacaatgcagcgcttagggcagaaaatattaagattagacgtgagaacgaatcaatggaagatgcactgaataatgtggtttgccctccatgtggtggtcgtggtcctgggagagaagaccaacttcgacatctccaaaaactccgtgcacaaaacgcttatctcaaagatgagtatgaaagagtctcaaactacctaaaacagtacggaggtcactcaatgcataacgtcgaggccacaccctatctccatggtccatcaaaccatgcatcaacgtccaagaaccgtccagcattgtacggaacctcttctaaccgtctccccgagccttcaagcatatttagaggaccatacactcgtggaaacatgaacaccaccgcaccgcctcagccgcgaaagccgctggaaatgcagaatttccaaccactatctcaactggagaaaattgcaatgttggaagcagcggaaaaagcggtgtcagaggttttgagcctcattcaaatggatgatacaatgtggaaaaagtcgtctattgatgataggctcgtcattgatccagggctctatgagaaatattttactaagactaacacaaatggtcgtcctgagtcttctaaagatgtcgtggtggttcaaatggatgctggaaacttgatcgacatcttcttaactgcggagaaatgggcgaggctttttccaacaattgtgaacgaagctaaaacgattcacgtcttggattccgttgaccatcgaggaaaaactttctcaagagtgatttatgagcaactgcacatactgtcaccattggtgccaccgagggaatttatgatcctaaggacttgccaacaaattgaagacaatgtctggatgattgctgatgtgtcgtgtcatctcccaaacattgagtttgatctttcgtttcccatttgcaccaaacgtccctcaggtgtgctcattcaagccttgccccacggcttctctaaggtgacgtggatagagcatgtggtagtgaatgataatagagtgcggccacataagctttacagagacctcttatacggcggctttggctacggagctcgacgttggaccgttactcttgagaggacgtgtgagaggctgattttctccacctccgtccctgccttgcccaacaatgacaatcccggagttgtgcaaacaatacgaggcagaaatagcgtaatgcatttgggagaaagaatgttgaggaactttgcatggatgatgaaaatggttaacaaactcgacttctcgccacagtctgaaactaacaacagcggaattaggattggggtgcggataaacaatgaggcgggtcaaccgcccggtctcattgtctgtgctggttcatctttatccctccctctccctcctgtccaagtgtacgatttccttaagaatctggaggttcgtcaccagtgggacgttctgtgccatgggaatccagcgactgaggctgctcgtttcgtcaccggatcaaacccaaggaacactgtgtcttttctcgagccttcaattagggatattaatactaagctaatgatactccaagatagcttcaaagatgcattgggaggaatggtggcctacgctccaatggatctaaacaccgcctgcgctgccatttcaggcgatatcgatcctaccaccattccaatcctcccttccggttttatgatctcccgtgacggccgtccttccgagggcgaagccgagggtggcagctatacactcctcaccgtggctttccagatccttgtctccggtccgagttactctcctgataccaacctggaagtttctgccaccacagtcaataccttgattagctccaccgttcaaaggatcaaagccatgctcaagtgcgaatga

SEQ ID NO: 2338 - protein, 718 aa, Arabidopsis thaliana
  G436
MDFTRDDNSSDERENDVDANTNNRHEKKGYHRHTNEQIHRLETYFKECPHPDEFQRRLLGEELNLKPKQIKFWFQNKRTQAKSHNEKADNAALRAENIKIRRENESMEDALNNVVCPPCGGRGPGREDQLRHLQKLRAQNAYLKDEYERVSNYLKQYGGHSMHNVEATPYLHGPSNHASTSKNRPALYGTSSNRLPEPSSIFRGPYTRGNMNTTAPPQPRKPLEMQNFQPLSQLEKIAMLEAAEKAVSEVLSLIQMDDTMWKKSSIDDRLVIDPGLYEKYFTKTNTNGRPESSKDVVVVQMDAGNLIDIFLTAEKWARLFPTIVNEAKTIHVLDSVDHRGKTFSRVIYEQLHILSPLVPPREFMILRTCQQIEDNVWMIADVSCHLPNIEFDLSFPICTKRPSGVLIQALPHGFSKVTWIEHVVVNDNRVRPHKLYRDLLYGGFGYGARRWTVTLERTCERLIFSTSVPALPNNDNPGVVQTIRGRNSVMHLGERMLRNFAWMMKMVNKLDFSPQSETNNSGIRIGVRINNEAGQPPGLIVCAGSSLSLPLPPVQVYDFLKNLEVRHQWDVLCHGNPATEAARFVTGSNPRNTVSFLEPSIRDINTKLMILQDSFKDALGGMVAYAPMDLNTACAAISGDIDPTTIPILPSGFMISRDGRPSEGEAEGGSYTLLTVAFQILVSGPSYSPDTNLEVSATTVNTLISSTVQRIKAMLKCE

SEQ ID NO: 2339 - DNA, 1177 bp, Arabidopsis thaliana
  G439
tataaatcttcgtttctacttttttttcttccataatatagtcaattcgttttcttaattagggcttcttctctttgtttctccaatctttattagtttatttatttattttggttattgtatacaaatggcaatggctttaaacatgaatgcttacgtagacgagttcatggaagctcttgaaccattcatgaaggtaacttcatcttcttctacttcgaattcatcaaatccaaaaccattaactcctaatttcatccctaataatgaccaagtcttaccggtatctaaccaaaccggtccgattgggctaaaccagctcactccaacacaaatcctccaaattcagacagagttacatctccggcaaaaccaatctcgtcgtcgcgctggtagtcatcttctcaccgctaaaccaacctcaatgaagaaaatcgacgtagcaactaaaccggttaaactataccgaggcgtaagacagaggcaatggggtaaatgggtagctgagattcggctacctaaaaaccgaacccggttatggctcggtacgttcgaaacggctcaagaagctgcattagcttacgatcaagcagctcataagatcagaggagacaacgctcgtctcaatttcccagacattgttcgtcaaggacactataaacagatattgtctccgtctatcaacgcaaagatcgaatccatctgcaatagttctgatcttccactgcctcagatcgagaaacagaacaaaacagaggaggtgctctctggtttttccaaaccggagaaagaaccggaatttggggagatatacggatgcggatactcgggctcatctcctgagtcggatataacgttgttggatttctcaagcgactgtgtgaaagaagatgagagtttcttgatgggtttgcacaagtatccttctttggagattgattgggacgctatagagaaactcttctgaatccattttatctttttgattcatttgtctctaaattgtagaattttattttcagagctttgtaagggaagttcttgaatgagagttgcagaggactagtggaacctaactctgttttcttttgtaagtattgtttataatgggccgttgaatgggccttattgatttaaacagcccaagtttttaaaaaaaaaaaaaaaaaaaaaaaaa

SEQ ID NO: 2340 - protein, 279 aa, Arabidopsis thaliana
  G439
MAMALNMNAYVDEFMEALEPFMKVTSSSSTSNSSNPKPLTPNFIPNNDQVLPVSNQTGPIGLNQLTPTQILQIQTELHLRQNQSRRRAGSHLLTAKPTSMKKIDVATKPVKLYRGVRQRQWGKWVAEIRLPKNRTRLWLGTFETAQEAALAYDQAAHKIRGDNARLNFPDIVRQGHYKQILSPSINAKIESICNSSDLPLPQIEKQNKTEEVLSGFSKPEKEPEFGEIYGCGYSGSSPESDITLLDFSSDCVKEDESFLMGLHKYPSLEIDWDAIEKLF

SEQ ID NO: 2341 - DNA, 3829 bp, Arabidopsis thaliana
  G447
ctttttaagagcttaaaaatttgctttgaagcttcaaatattcttatgaactaaaaagaagaaaaaagcttttgtttctttttccttagcagcagaatgatttttgtttccaaaattattactatttagtttctctcgtgctcttctcttgagcaaatacagattcgttaattttgctgaagaagaagaactctgtttcttccctgcaccaaaccaattttttcgttctttctataaaccatgaaagctccatcaaatggatttcttccaagttccaacgaaggagagaagaagccaatcaattctcaactatggcacgcttgtgcagggcctttagtttcattacctcctgtgggaagtcttgtggtttacttccctcaaggacacagcgagcaagttgcagcatcgatgcagaagcaaacagattttataccaaattacccaaatcttccttctaagctgatttgcttgcttcacagtgttacattacatgctgataccgaaacagatgaagtctatgcacaaatgactcttcaacctgtgaataagtatgatagagaagcattgctagcttctgatatgggcttgaagctaaacagacaacctactgagtttttttgcaagactcttactgcaagtgacacaagcactcatggtggattctctgtaccgcgtcgtgcagctgagaaaatattccctcctcttgatttctcgatgcaaccgcctgcgcaagagattgtagctaaagatttacatgatactacatggactttcagacatatctatcgaggccaaccaaaaagacacttgcttaccacaggttggagcgtttttgttagcacaaagagactatttgcgggtgattcagttttgtttgtaagagatgagaaatcacagctgatgttgggtataagacgtgcaaatagacaaactccgactctttcctcatcggtcatatccagcgacagtatgcacattgggatacttgcagctgcagctcatgctaatgccaatagtagcccttttaccatcttcttcaatccaagggcaagtccttcagagtttgtagttcctttagccaaatacaacaaagccttatacgctcaagtatctctaggaatgagattccggatgatgtttgagactgaggattgtggggttcgtagatatatgggtacagtcacaggtattagtgatcttgaccctgtaagatggaaaggctcacaatggcgtaatcttcaggtaggatgggatgaatcaacagctggagataggccaagccgagtatccatatgggaaatcgaacccgtcataactcctttttacatatgtcctcctccatttttcagacctaagtacccgaggcaacccgggatgccagatgatgagttagacatggaaaatgctttcaaaagagcaatgccttggatgggagaagactttgggatgaaggacgcacagagttcgatgttccctggtttaagtctagttcaatggatgagtatgcagcaaaacaatccattgtcaggttctgctactcctcagctcccgtccgcgctctcatcttttaacctaccaaacaattttgcttccaacgacccttccaagctgttgaacttccaatccccaaacctctcttccgcaaattcccaattcaacaaaccgaacacggttaaccatatcagccaacagatgcaagcacaaccagccatggtgaaatctcaacaacaacaacaacaacaacaacaacaacaccaacaccaacaacaacaactgcaacaacaacaacaactacagatgtcacagcaacaggtgcagcaacaagggatttataacaatggtacgattgctgttgctaaccaagtctcttgtcaaagtccaaaccaacctactggattctctcagtctcagcttcagcagcagtcaatgctccctactggtgctaaaatgacacaccagaacataaattctatggggaataaaggcttgtctcaaatgacatcgtttgcgcaagaaatgcagtttcagcagcaactggaaatgcataacagtagccagttattaagaaaccagcaagaacagtcctctctccattcattacaacaaaatctgtcccaaaatcctcagcaactccaaatgcaacaacaatcatcaaaaccaagtccttcacaacagcttcagttgcagctactgcagaagctacagcagcagcaacagcagcagtcgattcctccagtaagctcatccttacagccacaattatcagcgttgcagcagacacaaagccatcaattgcaacaacttctgtcgtctcaaaatcaacagcccttggcacatggtaataacagcttcccagcttcaactttcatgcagcctccacagattcaggtgagtcctcagcagcaaggacagatgagtaacaaaaatcttgtagccgctggaagatcacattctggccacacagatggagaagctccttcttgttcaacctcaccttccgccaataacacgggacatgataatgtttcaccgacaaatttcctgagcagaaatcaacagcaaggacaagctgcatctgtatctgcatctgattcagtctttgagcgcgcaagcaatccggtccaagagctttatacaaaaactgagagccggatcagtcaaggcatgatgaatatgaagagtgctggtgaacatttcagatttaaaagcgcggtaacagatcaaatcgatgtatccacagcgggaacgacgtactgtcctgatgttgttggccctgtacagcagcaacaaactttcccactaccatcatttggttttgatggagactgccaatctcatcatccaagaaacaacttagctttccctggtaatctcgaagccgtaacttctgatccactctattctcaaaaggactttcaaaacttggttcccaactatggcaacacaccaagagacattgagacggagctgtccagtgctgcaatcagttctcagtcatttggtattcccagcattccctttaagcccggatgttcaaatgaggttggcggcatcaatgattcaggaatcatgaatggtggaggactgtggcccaatcagactcaacgaatgcgaacatatacaaaggttcaaaaacgagggtcagtaggtagatcaatagatgttacccgttatagcggctatgatgaacttaggcatgacttagcgagaatgtttggcatcgaaggacagctcgaagatccgctaacctctgattggaaactcgtctacaccgatcacgaaaacgatattttactagttggtgatgatccttgggaagagtttgtgaactgcgtgcagaacataaagatactatcatcagtagaagttcagcaaatgagcttagacggagatcttgcagctatcccaaccacaaaccaagcctgcagcgaaacagacagcggaaatgcttggaaagtacactatgaagacacttctgctgcagcttctttcaacagatagaaataaaaagatgcaaatataccaagtcaacttacattatcattcgaggccatcgcaaagtacatgtttttttttgtgtgtatgtactgcaaacaacaaactgagaagaagaagatactgcacggtatataaacatttttataggacagtgatttgatttttcattctaacttgatgttgttgtactttcttgtttccatatttgtataacaagtataatgcttgacaagtctatgaggagcatatcttatacagagatactaagatgtaatgttaatgtaactaaacaattaccttcattaatcatgaatcctttggtcgtttaaaa

SEQ ID NO: 2342 - protein, 1086 aa, Arabidopsis thaliana
  G447
MKAPSNGFLPSSNEGEKKPINSQLWHACAGPLVSLPPVGSLVVYFPQGHSEQVAASMQKQTDFIPNYPNLPSKLICLLHSVTLHADTETDEVYAQMTLQPVNKYDREALLASDMGLKLNRQPTEFFCKTLTASDTSTHGGFSVPRRAAEKIFPPLDFSMQPPAQEIVAKDLHDTTWTFRHIYRGQPKRHLLTTGWSVFVSTKRLFAGDSVLFVRDEKSQLMLGIRRANRQTPTLSSSVISSDSMHIGILAAAAHANANSSPFTIFFNPRASPSEFVVPLAKYNKALYAQVSLGMRFRMMFETEDCGVRRYMGTVTGISDLDPVRWKGSQWRNLQVGWDESTAGDRPSRVSIWEIEPVITPFYICPPPFFRPKYPRQPGMPDDELDMENAFKRAMPWMGEDFGMKDAQSSMFPGLSLVQWMSMQQNNPLSGSATPQLPSALSSFNLPNNFASNDPSKLLNFQSPNLSSANSQFNKPNTVNHISQQMQAQPAMVKSQQQQQQQQQQHQHQQQQLQQQQQLQMSQQQVQQQGIYNNGTIAVANQVSCQSPNQPTGFSQSQLQQQSMLPTGAKMTHQNINSMGNKGLSQMTSFAQEMQFQQQLEMHNSSQLLRNQQEQSSLHSLQQNLSQNPQQLQMQQQSSKPSPSQQLQLQLLQKLQQQQQQQSIPPVSSSLQPQLSALQQTQSHQLQQLLSSQNQQPLAHGNNSFPASTFMQPPQIQVSPQQQGQMSNKNLVAAGRSHSGHTDGEAPSCSTSPSANNTGHDNVSPTNFLSRNQQQGQAASVSASDSVFERASNPVQELYTKTESRISQGMMNMKSAGEHFRFKSAVTDQIDVSTAGTTYCPDVVGPVQQQQTFPLPSFGFDGDCQSHHPRNNLAFPGNLEAVTSDPLYSQKDFQNLVPNYGNTPRDIETELSSAAISSQSFGIPSIPFKPGCSNEVGGINDSGIMNGGGLWPNQTQRMRTYTKVQKRGSVGRSIDVTRYSGYDELRHDLARMFGIEGQLEDPLTSDWKLVYTDHENDILLVGDDPWEEFVNCVQNIKILSSVEVQQMSLDGDLAAIPTTNQACSETDSGNAWKVHYEDTSAAASFNR

SEQ ID NO: 2343 - DNA, 1128 bp, Arabidopsis thaliana
  G479
atggagatgggttccaactcgggtccgggtcatggtccgggtcaggcagagtcgggtggttcctccactgagtcatcctctttcagtggagggctcatgtttggccagaagatctacttcgaggacggtggtggtggatccgggtcttcttcctcaggtggtcgttcaaacagacgtgtccgtggaggcgggtcgggtcagtcgggtcagataccaaggtgccaagtggaaggttgtgggatggatctaaccaatgcaaaaggttattactcgagacaccgagtttgtggagtgcactctaaaacacctaaagtcactgtggctggtatcgaacagaggttttgtcaacagtgcagcaggtttcatcagcttccggaatttgacctagagaaaaggagttgccgcaggagactcgctggtcataatgagcgacgaaggaagccacagcctgcgtctctctctgtgttagcttctcgttacgggaggatcgcaccttcgctttacgaaaatggtgatgctggaatgaatggaagctttcttgggaaccaagagataggatggccaagttcaagaacattggatacaagagtgatgaggcggccagtgtcgtcaccgtcatggcagatcaatccaatgaatgtatttagtcaaggttcagttggtggaggagggacaagcttctcatctccagagattatggacactaaactagagagctacaagggaattggcgactcaaactgtgctctctctcttctgtcaaatccacatcaaccacatgacaacaacaacaacaacaacaacaacagcaacaacaacaacaatacatggcgagcttcttcaggttttggcccgatgacggttacaatggctcaaccaccacctgcacctagccagcatcagtatctgaacccgccttgggtattcaaggacaatgataatgatatgtctcctgttttgaatttaggtcgatacaccgagccagataattgtcagataagtagtggcacggcaatgggtgagttcgagttatctgatcaccatcatcaaagtaggagacagtacatggaagatgagaacacaagggcttatgactcttcttctcaccataccaactggtctctctga

SEQ ID NO: 2344 - protein, 375 aa, Arabidopsis thaliana
  G479
MEMGSNSGPGHGPGQAESGGSSTESSSFSGGLMFGQKIYFEDGGGGSGSSSSGGRSNRRVRGGGSGQSGQIPRCQVEGCGMDLTNAKGYYSRHRVCGVHSKTPKVTVAGIEQRFCQQCSRFHQLPEFDLEKRSCRRRLAGHNERRRKPQPASLSVLASRYGRIAPSLYENGDAGMNGSFLGNQEIGWPSSRTLDTRVMRRPVSSPSWQINPMNVFSQGSVGGGGTSFSSPEIMDTKLESYKGIGDSNCALSLLSNPHQPHDNNNNNNNNSNNNNNTWRASSGFGPMTVTMAQPPPAPSQHQYLNPPWVFKDNDNDMSPVLNLGRYTEPDNCQISSGTAMGEFELSDHHHQSRRQYMEDENTRAYDSSSHHTNWSL

SEQ ID NO: 2345 - DNA, 1179 bp, Arabidopsis thaliana
  G525
cttctctcttctcaaaaacccttccctcttcgtctccaaacaacaacaaacacaacaacaacaaaaatcttacaagaagatcatttttagaaaccctattaggataaaatggattacgaggcatcaagaatcgtcgaaatggtagaagatgaagaacatatagatctaccaccaggattcagatttcaccctactgatgaagaactcataactcactacctcaaaccaaaggttttcaacactttcttctctgctactgccattggtgaagttgatctcaacaagattgagccttgggacttaccatggaaggctaagatgggagaaaaagaatggtatttcttctgtgtgagagaccggaaatacccgaccggtttaaggacaaaccgggcgacagaagccggttattggaaagccacaggaaaagacaaagagatattcaagggaaaatcacttgtgggtatgaagaaaactttggttttctataaaggaagagctcctaaaggagttaaaaccaattgggttatgcatgaatatcgtttagaaggcaaatattgtattgaaaatcttccccaaacagctaagaacgaatgggttatatgtcgtgttttccaaaaacgtgccgatggtacaaaggttccaatgtcaatgcttgatccacacattaaccgaatggaaccagccggtttaccttcgttaatggattgttctcaacgagactccttcaccggttcgtcgtctcacgtgacctgcttctccgaccaagaaaccgaagacaaaagacttgtccacgagtccaaagacggttttggttctctgttttactcggatcctctgtttttacaagacaattattcgctaatgaagctgttgcttgacggtcaagaaactcaattctccggcaaacctttcgacggtcgtgattcgtccggtacagaagaattggattgcgtttggaatttctgagttgtataagttatgttgtagacttgtagtagtcatgtgttcgtgtgtgtgaatgaatattcttgttacatttttttgtaaaaaaggagaaaaaaatatgctagaaagtcaattgcttttgttatgtagcattagtgttttttatgtactcaatagacttcctaattaaataaaaatcttaatttatttgccaaaaaaaaaaaaaaaaaaaaa

SEQ ID NO: 2346 - protein, 285 aa, Arabidopsis thaliana
  G525
MDYEASRIVEMVEDEEHIDLPPGFRFHPTDEELITHYLKPKVFNTFFSATAIGEVDLNKIEPWDLPWKAKMGEKEWYFFCVRDRKYPTGLRTNRATEAGYWKATGKDKEIFKGKSLVGMKKTLVFYKGRAPKGVKTNWVMHEYRLEGKYCIENLPQTAKNEWVICRVFQKRADGTKVPMSMLDPHINRMEPAGLPSLMDCSQRDSFTGSSSHVTCFSDQETEDKRLVHESKDGFGSLFYSDPLFLQDNYSLMKLLLDGQETQFSGKPFDGRDSSGTEELDCVWNF

SEQ ID NO: 2347 - DNA, 1481 bp, Arabidopsis thaliana
  G526
cgacccacgcgtccgagattctctcccagctagctttctcaattcatttttctttcttcatcttcttcttgtgtgatctctctttccaaataagcttatcattcttacaaaaatatttctgggtttctgatattgttcttgttctcttgaatctttattacttgaaaaacatataaagtgatggcggttgtggttgaagaaggtgtggtgttgaatcatggaggtgaagagcttgtggatttgccacctggtttcaggtttcatccaacagacgaagagatcataacatgttaccttaaggagaaggttttaaacagccgattcacggctgtggccatgggagaagctgatctcaacaagtgtgagccttgggatttgccaaagagggcaaagatgggggagaaagagttctacttcttctgtcaaagggacaggaagtatccgactgggatgaggacgaaccgtgcgacggagtcaggatactggaaagccaccgggaaggataaggagatcttcaaaggcaaaggttgtctcgttgggatgaagaaaacacttgtgttttatagaggaagagctccaaaaggtgaaaagactaattgggtcatgcatgaatatcgtcttgaaggcaaatattcgtattacaatctcccaaaatctgcaagggacgaatgggtcgtgtgtagggtttttcacaagaacaatccttctaccacaacccaaccaatgacgagaatacccgttgaagatttcacaaggatggattctctagagaacattgatcatctcctagacttctcatctcttcctcctctcatagacccgagtttcatgagtcaaaccgaacaaccaaacttcaaacccatcaaccctccaacttacgatatctcatcaccaatccaaccccatcatttcaattcttaccaatcaatctttaaccaccaggtttttggttctgcttcgggctctacgtacaacaacaacaacgagatgatcaagatggagcaatcacttgttagtgtatctcaagaaacatgcctaagctcagatgtgaacgcgaacatgactacaaccacggaggtatcttcgggtcctgtaatgaaacaagaaatggggatgatgggaatggtgaatggtagcaagtcgtatgaagatctatgtgacttgaggggggacttgtgggacttctaattaatcatttgactgtggtgaaagagtatatttgttgggatttaaatcatgttagttaatacatatacatataggatttactagaggcttaatcctagttaactattttcacttcattgatattatttaattagttgattgtttaattagtttatactttatagtgtggttaaaaaagaaaagaaaggattgtgataatttgggattttagtgcataagttatatctcaatgtaaactgtatttgtatccaaaaaaaaaaaaaaaaaaaaaaaaaaaaaaaaaaaaaaaaaaa

SEQ ID NO: 2348 - protein, 335 aa, Arabidopsis thaliana
  G526
MAVVVEEGVVLNHGGEELVDLPPGFRFHPTDEEIITCYLKEKVLNSRFTAVAMGEADLNKCEPWDLPKRAKMGEKEFYFFCQRDRKYPTGMRTNRATESGYWKATGKDKEIFKGKGCLVGMKKTLVFYRGRAPKGEKTNWVMHEYRLEGKYSYYNLPKSARDEWVVCRVFHKNNPSTTTQPMTRIPVEDFTRMDSLENIDHLLDFSSLPPLIDPSFMSQTEQPNFKPINPPTYDISSPIQPHHFNSYQSIFNHQVFGSASGSTYNNNNEMIKMEQSLVSVSQETCLSSDVNANMTTTTEVSSGPVMKQEMGMMGMVNGSKSYEDLCDLRGDLWDF

SEQ ID NO: 2349 - DNA, 768 bp, Arabidopsis thaliana
  G536
atgtcgacaagggaagagaatgtttacatggcgaaattagccgaacaagctgaacgttacgaagaaatggttgaattcatggagaaagttgcgaaaactgttgatgttgaggaactttcagttgaagagaggaatcttctctctgttgcttacaagaacgtgattggagcgagaagagcttcgtggagaatcatttcttcgattgagcagaaagaagagagcaaagggaacgaagatcatgttgctattatcaaggattacagaggagagattgaatccgagcttagcaaaatctgtgatgggattttgaatgttcttgaagctcatcttattccttctgcttcaccagctgaatctaaagtgttttatcttaagatgaagggtgattatcataggtatcttgctgagtttaaggctggtgctgaaaggaaagaagctgctgaaagcactttggttgcttacaagtctgcttccgacattgccactgctgagttagctcctactcacccgataaggcttggtcttgcactcaacttctctgtgttttactatgaaatcctcaactcgcctgatcgtgcttgcagcctcgcaaagcaggcgtttgatgatgcaatcgctgagttagatacattgggtgaggaatcatacaaggacagtacactgattatgcagcttcttagagacaatctcactctctggacttcagatatgactgacgaagcaggagatgagattaaggaggcatcaaagcccgatggtgccgagtaa

SEQ ID NO: 2350 - protein, 255 aa, Arabidopsis thaliana
  G536
MSTREENVYMAKLAEQAERYEEMVEFMEKVAKTVDVEELSVEERNLLSVAYKNVIGARRASWRIISSIEQKEESKGNEDHVAIIKDYRGEIESELSKICDGILNVLEAHLIPSASPAESKVFYLKMKGDYHRYLAEFKAGAERKEAAESTLVAYKSASDIATAELAPTHPIRLGLALNFSVFYYEILNSPDRACSLAKQAFDDAIAELDTLGEESYKDSTLIMQLLRDNLTLWTSDMTDEAGDEIKEASKPDGAE

SEQ ID NO: 2351 - DNA, 1374 bp, Arabidopsis thaliana
  G550
atggctgatccggcgattaagctctttggaaagacgattcctttacctgagcttggtgttgttgattcttcttctagctataccggatttttaaccgaaactcagattcctgttcggttatcagattcgtgtaccggcgatgatgatgatgaagagatgggtgattccggtttaggacgagaagaaggtgatgatgttggtgatggtggaggagagagcgagactgataaaaaggaagaaaaagatagtgagtgtcaggaagagtcattgaggaatgaatctaatgatgttactactactacatcgggtataactgaaaaaacggaaacaacaaaagctgcaaagacgaatgaagagtcaggtggtactgcttgctctcaagaggggaagttaaagaaacctgataagattctaccgtgtccgcgatgtaacagcatggaaaccaagttctgttactacaacaactataatgttaaccaacctcgccatttctgcaagaaatgtcagagatattggacagctggtggaacgatgaggaatgttccggttggtgctgggagacgtaagaataagagtccagcttctcattataaccgtcatgtaagtataacatctgcggaagctatgcagaaggtggcgagaactgatcttcaacatcctaatggtgcaaatcttctcacttttggctctgattctgtgctttgtgaatctatggcttctggattgaatcttgttgagaagtcattgttgaagacacaaactgtattgcaagaacccaatgaaggcttgaagattacggttccgttaaaccagacaaacgaagaagctggaacagtcagcccgttaccaaaagttccatgctttccaggaccaccaccaacttggccttacgcttggaacggagtttcgtggacgattttaccgttttaccctccaccggcttactggagctgcccgggggtttcaccgggggcatggaacagcttcacatggatgccacaacccaattcaccatctggttccaatccaaattctcctacactaggtaaacattcacgtgacgagaacgctgctgaaccaggaaccgcttttgatgaaaccgagtcacttggtagggagaaaagcaaacccgagagatgcttgtgggttcccaagacgctgaggattgatgatccagaggaagctgctaaaagttccatctgggaaacattagggatcaaaaaagacgaaaatgcggatactttcggagctttcagatcatcaaccaaagaaaaaagcagtctttctgaaggaagacttccgggaagaagaccggagttgcaagcgaatcctgctgctctttctaggtcagcaaacttccatgagagctcatag

SEQ ID NO: 2352 - protein, 457 aa, Arabidopsis thaliana
  G550
MADPAIKLFGKTIPLPELGVVDSSSSYTGFLTETQIPVRLSDSCTGDDDDEEMGDSGLGREEGDDVGDGGGESETDKKEEKDSECQEESLRNESNDVTTTTSGITEKTETTKAAKTNEESGGTACSQEGKLKKPDKILPCPRCNSMETKFCYYNNYNVNQPRHFCKKCQRYWTAGGTMRNVPVGAGRRKNKSPASHYNRHVSITSAEAMQKVARTDLQHPNGANLLTFGSDSVLCESMASGLNLVEKSLLKTQTVLQEPNEGLKITVPLNQTNEEAGTVSPLPKVPCFPGPPPTWPYAWNGVSWTILPFYPPPAYWSCPGVSPGAWNSFTWMPQPNSPSGSNPNSPTLGKHSRDENAAEPGTAFDETESLGREKSKPERCLWVPKTLRIDDPEEAAKSSIWETLGIKKDENADTFGAFRSSTKEKSSLSEGRLPGRRPELQANPAALSRSANFHESS

SEQ ID NO: 2353 - DNA, 708 bp, Arabidopsis thaliana
  G551
atggagtggtcaacaacgagcaacgtagaaaacgtgagagtagctttcatgccaccgccatggccggagtctagttcctttaactcgctccacagcttcaactttgatccttacgcaggaaattcatatacgcctggcgatacacaaaccggaccggttatctctgtaccggaatcagaaaagatcatgaatgcgtaccgatttccgaacaacaacaatgagatgataaaaaagaagagactaacgagtggacaattagcttcacttgagcgaagttttcaagaagagatcaaattagattcagacaggaaggtgaagctgtcgagagagctcggtctgcagccacgtcagatagcagtttggttccaaaaccgccgtgcacggtggaaggcgaagcagcttgagcagttgtacgactcgcttagacaagagtacgacgtcgtttctagggagaaacaaatgttacacgatgaggtgaagaagctgagagctttactaagagaccagggtttgatcaagaagcaaatctctgccgggaccatcaaagtttccggtgaggaagacacggtggagatttcatcggtggtggtagctcatccaagaacggagaatatgaacgcaaatcaaatcaccggagggaatcaagtttacggtcaatacaacaatccgatgctggttgcttcctctggctggccgtcatacccctga

SEQ ID NO: 2354 - protein, 235 aa, Arabidopsis thaliana
  G551
MEWSTTSNVENVRVAFMPPPWPESSSFNSLHSFNFDPYAGNSYTPGDTQTGPVISVPESEKIMNAYRFPNNNNEMIKKKRLTSGQLASLERSFQEEIKLDSDRKVKLSRELGLQPRQIAVWFQNRRARWKAKQLEQLYDSLRQEYDVVSREKQMLHDEVKKLRALLRDQGLIKKQISAGTIKVSGEEDTVEISSVVVAHPRTENMNANQITGGNQVYGQYNNPMLVASSGWPSYP

SEQ ID NO: 2355 - DNA, 842 bp, Arabidopsis thaliana
  G557
cagagatctgacggcggtagcagagtaatctattccttcccaaaatgtctcgcaattagattctttccaagttcttctgtaaatcccaagtcccgctcttttcctctttatccttttcaccagcttcgctactaagacaacaaatctttccctctctctctcgcctgatcgatcttcaaagagtaagaaaaatgcaggaacaagcgactagctctttagctgcaagctctttaccatcaagcagcgagaggtcatcaagctctgctccacatttggagatcaaagaaggaattgaaagcgatgaggagatacggcgagtgccggagtttggaggagaagctgtcggaaaagaaacttccggtagagaatctggatcggcgaccggtcaggagcggacacaggcgactgtcggagaaagtcaaaggaagcgagggaggacaccggcggagaaagagaacaagcggctgaagaggttgttgaggaacagagtttcagctcagcaagcaagagagaggaaaaaggcttacttgagcgagttggaaaacagagtgaaagacttggagaacaaaaactctgaacttgaagagcgactctctactcttcagaacgagaaccagatgcttagacatattctgaagaacacaacaggaaacaagagaggaggtggtggtggttctaatgctgatgcaagcctttgatctccttcttcttcttgtgttatatttttgtggataaaatttacagagaattgtatcaataattatcatgttaaaattatatgggatgtgagagctaatattgcaattgtagaccaagttctcttaaaaaaaaaaaaaaaaaaa

SEQ ID NO: 2356 - protein, 168 aa, Arabidopsis thaliana
  G557
MQEQATSSLAASSLPSSSERSSSSAPHLEIKEGIESDEEIRRVPEFGGEAVGKETSGRESGSATGQERTQATVGESQRKRGRTPAEKENKRLKRLLRNRVSAQQARERKKAYLSELENRVKDLENKNSELEERLSTLQNENQMLRHILKNTTGNKRGGGGGSNADASL

SEQ ID NO: 2357 - DNA, 1407 bp, Arabidopsis thaliana
  G559
aaagttgctagctttaatttgccaacttactattcttatgtgtaataatcgtttgcagggtcgttgatttggtgataagtcagtagaaatggataaggagaaatctccagcacctccttgtggaggtcttcctcctccatctccatcaggtcgatgctctgcattctcagaagctggtcccattggtcatggttcagatgctaatcgaatgagtcatgatattagccgtatgcttgataacccacctaagaagattggacatcggcgagctcattctgaaatacttactctccctgatgatttgagctttgatagtgatcttggtgtggttggtaatgctgctgatggagcttctttctctgatgagactgaagaagatttgctctctatgtatcttgatatggataagtttaattcttctgctacatcttctgcccaagttggtgagccatcaggaactgcttggaaaaatgagacaatgatgcagacaggcacaggctcaacttccaatcctcagaatacggttaatagtcttggcgaaaggccaagaatcaggcatcaacatagccaatctatggatggttcaatgaatatcaatgagatgcttatgtcgggaaatgaagatgattctgctattgatgctaagaagtctatgtctgctactaaacttgctgagcttgctctcattgatcctaaacgtgctaagaggatatgggcaaacaggcagtccgcagcacgatcaaaagaaaggaagacgagatacatatttgagcttgagagaaaagtacagactttgcaaacagaggctacaactctctcagcccagttgaccctcttacagagagacacaaatggcttgactgttgaaaacaatgagctgaagctgcggttacaaacaatggagcagcaggttcacttgcaggatgaactaaacgaagcactaaaggaggaaatccagcatctgaaggtgttgactggccaagttgctccatcagcgttgaactatgggtcgtttggatcaaaccagcagcaattctattccaacaatcagtcaatgcaaacaatcttagctgcaaaacagttccagcaacttcagattcattcacagaagcagcaacaacaacaacaacaacaacaacagcaacaccaacagcagcagcagcaacagcaacagtatcagtttcaacagcaacagatgcaacagcttatgcagcagcggcttcaacagcaagaacaacaaaatggagtaagactcaagccttcacaagcccagaaagagaactgaggaatatgaatatgtcccacgtaagtgagaggttctccttctgaacaattcctttctcattcataaattgttgttcatccatcacttgcagtctcttggattttagggttttagctaacaca

SEQ ID NO: 2358 - protein, 398 aa, Arabidopsis thaliana
  G559
MDKEKSPAPPCGGLPPPSPSGRCSAFSEAGPIGHGSDANRMSHDISRMLDNPPKKIGHRRAHSEILTLPDDLSFDSDLGVVGNAADGASFSDETEEDLLSMYLDMDKFNSSATSSAQVGEPSGTAWKNETMMQTGTGSTSNPQNTVNSLGERPRIRHQHSQSMDGSMNINEMLMSGNEDDSAIDAKKSMSATKLAELALIDPKRAKRIWANRQSAARSKERKTRYIFELERKVQTLQTEATTLSAQLTLLQRDTNGLTVENNELKLRLQTMEQQVHLQDELNEALKEEIQHLKVLTGQVAPSALNYGSFGSNQQQFYSNNQSMQTILAAKQFQQLQIHSQKQQQQQQQQQQQHQQQQQQQQQYQFQQQQMQQLMQQRLQQQEQQNGVRLKPSQAQKEN

SEQ ID NO: 2359 - DNA, 1370 bp, Arabidopsis thaliana
  G569
gtcgacccacgcgtccgggtttttcttttatcctcttatcgctaatctggagctctatatagactataaagggtttttgattgattcgggagctcgagatttgacttcttttagctgattcggcaagtttgtatctagaaaggatcgattggtgaggtcaatagtggttggtgggttttagtaatggaagacggtgagcttgatttctccaatcaggaagtgttttcgagttcggagatgggtgaattaccacctagcaattgttcgatggatagtttctttgatgggcttttaatggatactaatgctgcttgtacccacactcacacctgtaaccccactggaccagagaacactcatactcacacgtgcttccatgtccacaccaagattctcccggatgagagcgatgaaaaagtttctactgatgatacagctgagtcttgtgggaagaagggtgaaaagagacctttgggaaaccgggaagcggttagaaagtatagagagaagaagaaggctaaagctgcttctttggaggatgaggttgcaaggcttagggcggtgaatcagcagctggtgaagaggttgcaaaatcaggctaccttggaagctgaggtttcgaggcttaagtgtttgcttgtggatttgagaggaagaatagatggagagattggatcttttccttatcagaaacctatggctgcaaatattccttctttctcgcacatgatgaatccttgtaatgtacaatgtgatgatgaagtttattgccctcagaatgtgtttggagtgaatagccaagaaggtgcctcgatcaatgaccaagggttaagtggttgtgattttgatcagctacaatgcatggctaatcagaacttaaatggaaatggaaacggatcattcagcaacgtcaatacatctgtctcgaataagagaaaaggtgggcatcgtgcatcaagagcagtttgaagcatcatcaagcttgtactatctatttccaccagcatagatattgtattccaaataagttgtagagttcagctgcaggatcagcttcgctcagctttgaggggttggtggtgtggtctttctttgtggcacgagtgagatctatggacagaacccagatttagtagtagtagaggcaggatttcgacttccactaaccatcatgttgcttggtgaagaacaaggtatgcccatgaagcacactgttttgtacattgagcttgaggggctgtctctgatctagccttactgtaacattgcaacgttctcacaattgtgatcccaagttgctttgttgacttaaatgtgataatatagcttaacttttacttgaaaaaaaaaaaaaaaaaaaaaaaaaaaaa

SEQ ID NO: 2360 - protein, 261 aa, Arabidopsis thaliana
  G569
MEDGELDFSNQEVFSSSEMGELPPSNCSMDSFFDGLLMDTNAACTHTHTCNPTGPENTHTHTCFHVHTKILPDESDEKVSTDDTAESCGKKGEKRPLGNREAVRKYREKKKAKAASLEDEVARLRAVNQQLVKRLQNQATLEAEVSRLKCLLVDLRGRIDGEIGSFPYQKPMAANIPSFSHMMNPCNVQCDDEVYCPQNVFGVNSQEGASINDQGLSGCDFDQLQCMANQNLNGNGNGSFSNVNTSVSNKRKGGHRASRAV

SEQ ID NO: 2361 - DNA, 1888 bp, Arabidopsis thaliana
  G571
tagccgacctctcttctctcttctgaaaaaaacaccaaaggagctttaaatgctccgttacataatctctatctctttccaagaatatagagaaaggaaaataatatacaagaattaaaagaaggtatatcatcatctctctagctagtgatcaaagcaccgtcatcatcatcatatatcatcagcttgcctcagaggagaagaccaacataagagagatcgaagatcaaaatctatctctcttcatcatcttctgctgttactatcatatcacacgctctctcaaacatcatcctatatatagacttctcttcatcatcatcaaatgcaaggtcatcaccagaatcatcatcaacacttatcatcatcctccgccacgtcttcccatggaaacttcatgaacaaagatgggtatgatattggagagatagacccatcactcttcctctatcttgatggacaaggacatcatgatcctccatcaactgctccttctcctttacatcatcatcacacaactcagaatttggcgatgagacctccaacatcgacgctcaacatctttccatctcagcctatgcacatagagccacctccttcttctacacacaataccgataatacaagattagttccggctgctcaacctagtggttccactcgaccagcttctgacccgtccatggacttgaccaatcattctcagtttcatcaacctcctcaaggttctaaatccatcaagaaggaagggaaccgcaagggtcttgcctcatcggaccatgacatacctaaatcgtcagaccctaaaacattgagaagactagcacaaaacagagaagcagcaagaaaaagcagattacgtaaaaaggcttatgttcagcaactcgagtcatgtaggatcaaactgacccaactagaacaagagattcaacgggccagatcccaaggcgtattctttggagggtctcttataggaggagatcaacagcaaggtggactacccattggccctggcaacatcagctctgaagcagcggtgttcgatatggaatatgcgaggtggctggaggagcagcagaggctattaaacgaactaagggtggcaacacaagaacacttgtccgagaacgagcttaggatgtttgtggacacatgtttagctcattatgaccatttgattaacctcaaggctatggtcgctaagaccgatgtcttccacctcatttctggagcatggaaaactccagctgaacgttgcttcttgtggatgggtggtttccgtccatcggagatcattaaggtgattgtgaaccagatagaaccattgacggagcaacagatagttgggatatgtgggctgcaacagtccacacaagaggccgaggaggctctctcgcaaggcctcgaggcgttgaatcaatcactttccgatagcattgtctctgactccctcccgcctgcctccgcaccacttcctcctcatctatccaatttcatgtcacacatgtccttagctctcaacaagctctctgctctcgagggcttcgttctccaggcggataatttgaggcaccaaacgatccataggctgaaccaattgttgacgacccgtcaagaagcacggtgtcttctagccgttgcggagtacttccaccgtcttcaagctctaagttctctctggctagcccgtcctcggcaagatggataatactaaaacaactgatgaaggaaaccaaaaacaaaaacaagagaataggttgattagttagccgccagcttgacctctttatcatatatatcgtctctctactcaaatacagtgcaattagggaaaattgtttggcttctttttggtatatgattcttactattatgtttttaatcaaga

SEQ ID NO: 2362 - protein, 460 aa, Arabidopsis thaliana
  G571
MQGHHQNHHQHLSSSSATSSHGNFMNKDGYDIGEIDPSLFLYLDGQGHHDPPSTAPSPLHHHHTTQNLAMRPPTSTLNIFPSQPMHIEPPPSSTHNTDNTRLVPAAQPSGSTRPASDPSMDLTNHSQFHQPPQGSKSIKKEGNRKGLASSDHDIPKSSDPKTLRRLAQNREAARKSRLRKKAYVQQLESCRIKLTQLEQEIQRARSQGVFFGGSLIGGDQQQGGLPIGPGNISSEAAVFDMEYARWLEEQQRLLNELRVATQEHLSENELRMFVDTCLAHYDHLINLKAMVAKTDVFHLISGAWKTPAERCFLWMGGFRPSEIIKVIVNQIEPLTEQQIVGICGLQQSTQEAEEALSQGLEALNQSLSDSIVSDSLPPASAPLPPHLSNFMSHMSLALNKLSALEGFVLQADNLRHQTIHRLNQLLTTRQEARCLLAVAEYFHRLQALSSLWLARPRQDG

SEQ ID NO: 2363 - DNA, 2290 bp, Arabidopsis thaliana
  G577
aaaaacagactgagagagagagagagagagtgtgttgttggccatgggatgcacggcctccaagctcgacagtgaggatgctgtccgtcgctgcaaggagcggcgccgtcttatgaaggacgccgtctacgctcgtcaccatctcgccgccgctcactctgactactgccgctcccttcgtctcactggctctgccctctcctccttcgccgccggcgagcccctctccgtctccgagaatactcccgctgtttttctccgcccttcctccagtcaggacgcgccacgtgtcccttcttcccattccccagaaccccctcctccgcccatccgcagcaagcctaagcctactaggcctaggaggcttccacacattctctccgactcctctccttcttcctctcctgccaccagtttctatcccactgctcaccagaactctacttactctcgctctccatctcaagcttcctctgtctggaactgggagaatttctaccctccctctccccccgactccgagtacttcgaacgcaaagctcgccagaaccacaagcaccgtcctccttccgactacgacgccgaaactgaaagatccgaccacgattactgccactcacggagagatgccgccgaggaagttcactgcagcgagtggggcgacgaccacgaccgtttcactgccacctcttcgtccgacggagatggggaggtcgaaactcacgtttccagatccggtattgaagaagagcctgtgaaacaaccacatcaagacccaaatggcaaagagcactctgaccatgttaccacttcttccgactgctacaagaccaaattggtggtaaggcacaagaatttgaaggagatccttgacgccgttcaagactacttcgacaaggctgcctccgctggggaccaggtctccgccatgcttgagatcggccgggctgagctcgaccgcagcttcagcaagctgaggaagacggtgtatcattcaagcagtgtgttcagcaacttgagcgcaagctggacctcaaaacccccattggcagtcaaatacaagctcgatgcatctaccctgaatgatgaacaaggcggcctcaagagcctctgctccactctagaccgactcctcgcttgggaaaagaagctttatgaggatgtcaaggcaagagaaggagttaagattgagcacgagaagaagctgtctgcgctgcagagtcaggagtataagggaggtgatgaatccaagctagacaagactaaaacttccataaccagactgcaatcactcatcattgtttcttcagaagctgttttaaccacgtctaatgccattctccgcctccgggacactgaccttgtccctcagcttgttgaactctgccacggattaatgtacatgtggaagtcaatgcacgagtatcacgaaatccagaacaacatcgtgcaacaagtccgtggcctgatcaaccaaacagagagaggtgagtcaacatcagaggtacaccggcaggtgacgcgggacctagagtcagctgtgtccttgtggcattcgagcttctgtcgcatcattaaattccagagggagttcatatgctctctccacgcatggttcaagctgagcctggttcccctgagcaacggagacccaaagaaacagcggccagactcatttgccttgtgcgaggagtggaagcagagcctggaacgggtgcctgacacagtggcgtcagaagccataaagagctttgtaaacgtggtacatgtgatatcaataaagcaggcggaagaggtgaagatgaagaaacgcacggagagtgcaggaaaggagctggagaagaaagcatcctcactgaggagcatagagaggaagtactaccaggcatactcgacggttgggataggccctggaccggaggtgttggactcacgggacccgctatctgagaagaaatgtgagctggcggcatgtcagaggcaggtggaggatgaggtaatgaggcacgtgaaggctgtggaggtgacacgagctatgactctcaacaatctacaaaccggcctgcccaatgtattccaggccttgaccagcttctcatctctcttcactgaatctctccagactgtctgttctcgttcctactccatcaactgattatgtccaagtttctcatttatttttaagctctcattacgttggtatcatgtaaatttgaggattgattaaattgagtcttgtggttttgtgaggactcacaatctttctcatttaaaaaaaaaaaaaaaaaaa

SEQ ID NO: 2364 - protein, 703 aa, Arabidopsis thaliana
  G577
MGCTASKLDSEDAVRRCKERRRLMKDAVYARHHLAAAHSDYCRSLRLTGSALSSFAAGEPLSVSENTPAVFLRPSSSQDAPRVPSSHSPEPPPPPIRSKPKPTRPRRLPHILSDSSPSSSPATSFYPTAHQNSTYSRSPSQASSVWNWENFYPPSPPDSEYFERKARQNHKHRPPSDYDAETERSDHDYCHSRRDAAEEVHCSEWGDDHDRFTATSSSDGDGEVETHVSRSGIEEEPVKQPHQDPNGKEHSDHVTTSSDCYKTKLVVRHKNLKEILDAVQDYFDKAASAGDQVSAMLEIGRAELDRSFSKLRKTVYHSSSVFSNLSASWTSKPPLAVKYKLDASTLNDEQGGLKSLCSTLDRLLAWEKKLYEDVKAREGVKIEHEKKLSALQSQEYKGGDESKLDKTKTSITRLQSLIIVSSEAVLTTSNAILRLRDTDLVPQLVELCHGLMYMWKSMHEYHEIQNNIVQQVRGLINQTERGESTSEVHRQVTRDLESAVSLWHSSFCRIIKFQREFICSLHAWFKLSLVPLSNGDPKKQRPDSFALCEEWKQSLERVPDTVASEAIKSFVNVVHVISIKQAEEVKMKKRTESAGKELEKKASSLRSIERKYYQAYSTVGIGPGPEVLDSRDPLSEKKCELAACQRQVEDEVMRHVKAVEVTRAMTLNNLQTGLPNVFQALTSFSSLFTESLQTVCSRSYSIN

SEQ ID NO: 2365 - DNA, 1757 bp, Arabidopsis thaliana
  G588
atctgaagtgaaccaagctcaggttttgtcttctctttgatcattcctttctcagcaatataaattagagttatatcctttataaaggattttgctttttcaccaacaaaccctaaattcggtgtctcagcaagaatcacgtgattctcgttcctcttcctcacgaaacccatcatcttctatctcatttgagaaatgggtcaaaagttttgggagaatcaagaagatcgagcgatggttgaatccaccataggctctgaagcttgcgactttttcatctcaacagcttcagcttccaacactgccttgtccaagcttgtctcaccaccaagtgattccaatctccaacaagggttacgtcacgttgttgaaggatctgattgggattatgctcttttctggctagcgtccaacgttaatagctctgatggttgtgtcttgatctggggagatggtcattgccgtgtcaaaaagggtgcttcaggtgaggattactctcagcaagatgagatcaaaagacgtgtgcttcgcaagcttcacttgtcgttcgttggttcagatgaagatcatcgtttggtgaaatcaggagctcttactgatctcgacatgttttatctggcttctttgtacttttcctttaggtgtgataccaataagtacggtcctgctggaacctatgtgtctgggaagcctctttgggctgcagatttgcctagctgcttgagttattatagggttaggtctttcttagctaggtcagctggttttcagactgtgttgtctgtaccagtgaattctggagttgtggagcttggttctttaagacatattccagaagataagagtgtgattgagatggtgaaatcagtgtttggtgggtctgactttgttcaggctaaagaagctcctaaaatctttggtcgacagctgagtcttggtggagcaaaacctcggtctatgagtattaatttctccccgaagaccgaggatgacacgggtttctcattggaatcgtatgaggtgcaagcgatcggaggctctaatcaagtgtatggttatgagcaagggaaagatgagacattgtatctaactgacgagcaaaagccgaggaagagagggagaaaaccagcaaatggaagagaagaggctctaaaccatgtggaagcggaacggcagaggagggagaagctgaaccagagattctacgctttgagagcggtggtgcctaacatctccaagatggacaaggcttcgctccttgcagacgcaatcacttacatcacggatatgcagaagaaaatcagggtgtatgaaacagagaagcagataatgaagaggagggagagtaatcagataactccagcagaggttgattatcaacagaggcatgatgatgcagttgtaaggctaagctgtccgttggaaactcatccagtttcaaaggtgatacaaacgttgagggagaatgaagttatgcctcatgattccaacgtggccatcacagaggagggtgtggttcacacattcactctccggcctcagggtggctgcaccgctgagcagttgaaggacaagctccttgcctctctatcacagtaactatcacagcagtaactgctatgtaataagtgtaaccgtgttggaggttgtatcaatgtactattgcaagccaaccaaaaaaaactccagcttagtaggatcgtgtaattttccttatatgtaatgttgagatttgtcttttacatataaagatttga

SEQ ID NO: 2366 - protein, 467 aa, Arabidopsis thaliana
  G588
MGQKFWENQEDRAMVESTIGSEACDFFISTASASNTALSKLVSPPSDSNLQQGLRHVVEGSDWDYALFWLASNVNSSDGCVLIWGDGHCRVKKGASGEDYSQQDEIKRRVLRKLHLSFVGSDEDHRLVKSGALTDLDMFYLASLYFSFRCDTNKYGPAGTYVSGKPLWAADLPSCLSYYRVRSFLARSAGFQTVLSVPVNSGVVELGSLRHIPEDKSVIEMVKSVFGGSDFVQAKEAPKIFGRQLSLGGAKPRSMSINFSPKTEDDTGFSLESYEVQAIGGSNQVYGYEQGKDETLYLTDEQKPRKRGRKPANGREEALNHVEAERQRREKLNQRFYALRAVVPNISKMDKASLLADAITYITDMQKKIRVYETEKQIMKRRESNQITPAEVDYQQRHDDAVVRLSCPLETHPVSKVIQTLRENEVMPHDSNVAITEEGVVHTFTLRPQGGCTAEQLKDKLLASLSQ

SEQ ID NO: 2367 - DNA, 1240 bp, Arabidopsis thaliana
  G591
gtaaatctctctttgaaggttcctaactcgttaatcgtaactcacagtgactcgttcgagtcaaagtctctgtctttagctcaaaccatggctagtaacaaccctcacgacaacctttctgaccaaactccttctgatgatttcttcgagcaaatcctcggccttcctaacttctcagcctcttctgccgccggtttatctggagttgacggaggattaggtggtggagcaccgcctatgatgctgcagttgggttccggagaagaaggaagtcacatgggtggcttaggaggaagtggaccaactgggtttcacaatcagatgtttcctttggggttaagtcttgatcaagggaaaggacctgggtttcttagacctgaaggaggacatggaagtgggaaaagattctcagatgatgttgttgataatcgatgttcttctatgaaacctgttttccacgggcagcctatgcaacagccacctccatcggccccacatcagcctacttcaatccgtcccagggttcgagctaggcgtggtcaggctactgatccacatagcatcgctgagcggctacgtagagaaagaatagcagaacggatcagggcgctgcaggaacttgtacctactgtgaacaagaccgatagagctgctatgatcgatgagattgtcgattatgtaaagtttctcaggctccaagtcaaggttttgagcatgaaccgacttggtggagccggtgcggttgctccacttgttactgatatgcctctttcatcatcagttgaggatgaaacgggtgagggtggaaggactccgcaaccagcgtgggagaaatggtctaacgatgggactgaacgtcaagtggctaaactgatggaagagaacgttggagccgcgatgcagcttcttcaatcaaaggctctttgtatgatgccaatctcattggcaatggcaatttaccattctcaacctccggatacatcttcagtggtcaagcctgagaacaatcctccacagtaggatttctgcaataaagagtttgtacagctaatccaactgtccaacatgggtttttcttctgctctaatgactctggtttcttctctcctctctcaccgacttgaaaggtaaaaaagtgaaaaaggctttgtagatggaatcaatgtaggatttgcagtagagggcaaaaaaatgtcatatagctcaattgatcaagtcttaaaaaaaaaaaaaaaaaaaa

SEQ ID NO: 2368 - protein, 310 aa, Arabidopsis thaliana
  G591
MASNNPHDNLSDQTPSDDFFEQILGLPNFSASSAAGLSGVDGGLGGGAPPMMLQLGSGEEGSHMGGLGGSGPTGFHNQMFPLGLSLDQGKGPGFLRPEGGHGSGKRFSDDVVDNRCSSMKPVFHGQPMQQPPPSAPHQPTSIRPRVRARRGQATDPHSIAERLRRERIAERIRALQELVPTVNKTDRAAMIDEIVDYVKFLRLQVKVLSMNRLGGAGAVAPLVTDMPLSSSVEDETGEGGRTPQPAWEKWSNDGTERQVAKLMEENVGAAMQLLQSKALCMMPISLAMAIYHSQPPDTSSVVKPENNPPQ

SEQ ID NO: 2369 - DNA, 1394 bp, Arabidopsis thaliana; identical to SEQ ID NO: 2037
  G596

SEQ ID NO: 2370 - protein, 317 aa, Arabidopsis thaliana; identical to SEQ ID NO: 2038
  G596

SEQ ID NO: 2371 - DNA, 1857 bp, Arabidopsis thaliana
  G599
tcgacagaacagcttcgttgtcacttgtcattctataaatcgcatccccattgacaacctttcacttccatcaaaactctctctctatatctctctctctatatatctctctctatatctctctctctcttcactctctctttctttcaaaatggaaaaactcatggttccgacatggagacccgacccggtttaccgtccaccggaaacaccactcgaaccgatggagtttttagctcgttcatggagcgtctctgctctcgaagtctccaaggctctaacaccacccaaccctcagattctcctctccaaaaccgaagaagaagaagaagaagaacccatctcctctgtcgtagacggcgacggcgacacggaagacaccggacttgtcaccggaaacccattctccttcgcttgttcagaaacttctcaaatggtcatggatcgtatcttgtctcactctcaagaagtatcaccaagaacatctggtcggctatctcacagtagtggtccacttaatggttctttgaccgacagtcctcctgtgtctcctcccgaatccgacgacattaagcaattttgcagagcgaacaaaaattcattgaacagtgtaaattctcagttccgttcaacggcggcaactccgggacctataaccgctacagctacacagtccaagacggtgggacggtggcttaaggaccggagagagaaaaagaaagaggagactcgggctcataacgctcagattcacgctgctgtctctgtcgccggcgttgctgcagctgttgctgctattgcagcagccaccgctgcgtcttctagctgtggtaaggatgagcagatggctaaaactgacatggccgttgcttctgctgcgacccttgtggctgctcagtgtgtggaagctgctgaagttatgggagctgagagagagtatttggcttctgttgttagctccgccgtcaatgttcgttctgccggagatattatgactctcaccgccggagcagctacagctttaagaggagtgcaaacattgaaggcaagggcaatgaaggaagtgtggaacatagcatcagtgataccaatggataaaggactcacttctacaggaggaagcagcaataatgttaatggtagcaatggaagctcaagcagtagtcacagtggtgaacttgtacaacaggagaatttcttgggaacttgtagtagagaatggctcgctagaggttgtgaactcctcaaacgcactcgcaaaggtgatctccactggaagatagtatctgtttacatcaacaaaatgaatcaggttatgttgaagatgaagagcaggcatgttggaggaaccttcaccaagaagaaaaagaacattgtgcttgatgtgatcaagaatgtcccggcctggcctggacgacatttgctagagggaggagatgatctaagatacttcggtttgaagacggttatgcgaggtgatgttgaattcgaggtcaagagccaaagggaatatgaaatgtggacacaaggtgtctcaaggcttcttgttcttgctgctgagaggaagtttaggatgtgaataaacgttcaatggctgcttggtttaagtgtgagtttttttttaacttatgtggtcaaatttcattagtaggggttcttttaaggtaatggttttttgggttgggtataggataaaatggacctaccagtcaaggtgaggaagcatttgggtaaacaaaacttagtgggggtgatctgtaatatctatgttcttagtttttttttggttgttggtggtctttttgtataaaaaaacaaagttgaagtaatagatatatagtatgttttaattttaaa

SEQ ID NO: 2372 - protein, 475 aa, Arabidopsis thaliana
  G599
MEKLMVPTWRPDPVYRPPETPLEPMEFLARSWSVSALEVSKALTPPNPQILLSKTEEEEEEEPISSVVDGDGDTEDTGLVTGNPFSFACSETSQMVMDRILSHSQEVSPRTSGRLSHSSGPLNGSLTDSPPVSPPESDDIKQFCRANKNSLNSVNSQFRSTAATPGPITATATQSKTVGRWLKDRREKKKEETRAHNAQIHAAVSVAGVAAAVAAIAAATAASSSCGKDEQMAKTDMAVASAATLVAAQCVEAAEVMGAEREYLASVVSSAVNVRSAGDIMTLTAGAATALRGVQTLKARAMKEVWNIASVIPMDKGLTSTGGSSNNVNGSNGSSSSSHSGELVQQENFLGTCSREWLARGCELLKRTRKGDLHWKIVSVYINKMNQVMLKMKSRHVGGTFTKKKKNIVLDVIKNVPAWPGRHLLEGGDDLRYFGLKTVMRGDVEFEVKSQREYEMWTQGVSRLLVLAAERKFRM

SEQ ID NO: 2373 - DNA, 1519 bp, Arabidopsis thaliana
  G615
ttttttcttttctttctttttttgctggtgtgagaaattgtacgcttactatctctctctctctctgccagattctctctttttgatgatgtgaaagttgtgcttttgtttcttaagaaaaaggcatatttttaatacttgattcttggttcttgattcttgattcttggttttttttagcttcttaagttcggtgatgtcgtcttccaccaatgactacaacgatggtaataacaatggagtgtaccctctctctctttacctttcttcactctctggccatcaagacatcattcataatccctacaaccatcagttaaaagcatctccgggccatatggtatcagcagttcctgaatctctgatcgattacatggcgtttaagtcaaataatgttgtgaatcaacaaggctttgagtttcctgaggtgtcaaaggaaatcaagaaggtggtgaagaaggaccgacatagcaagattcaaacggcacaagggattagagacaggagggttaggctttttattgggattgctcgccaattctttgatcttcaggatatgttggggtttgataaagctagtaaaacgttagactggctgctcaagaagtcaagaaaagccatcaaagaggtcgtacaagcaaaaaacctcaacaatgatgatgaagattttggaaacattggaggcgatgtagaacaagaagaggagaaggaggaggatgacaatggcgataagagcttcgtgtatggtttgagccccgggtacggtgaagaagaagtggtatgtgaggccacgaaggcagggataagaaagaagaagagtgagttgagaaacatctcatcaaaggggctaggagccaaagctagaggaaaagcaaaggagcgaacaaaagagatgatggcctatgataatccagagactgcctctgatattacacaatctgaaatcatggacccattcaagaggtctatagtcttcaatgaaggagaagatatgacacaccttttctacaaggaaccaatcgaggagtttgataatcaagaatctatcttaaccaatatgactctaccaacgaagatgggtcaaagttacaatcaaaataatgggatacttatgttggtagatcagagttctagcagcaactataatacatttctgcctcaaaatttggattatagttatgatcaaaacccttttcatgaccaaaccttatatgtagtcaccgacaaaaatttccccaaaggtttcctataaatctcgacagttttgaaggactatgcatgatcaagtttaaacatgtaagccaatatagtcccttattcctctgaatgtatacaaaatctatagttatgtatatctgttcctttttaacgtatctttattgatcttctgtgccttgatcaaaattgtcattttaagattcagtttgtgtaatattttagctacaacttttaagtggtattattgtaaccttttgaactatatattttgaagatgaataagaacatgtttatataaaaa

SEQ ID NO: 2374 - protein, 351 aa, Arabidopsis thaliana
  G615
MSSSTNDYNDGNNNGVYPLSLYLSSLSGHQDIIHNPYNHQLKASPGHMVSAVPESLIDYMAFKSNNVVNQQGFEFPEVSKEIKKVVKKDRHSKIQTAQGIRDRRVRLFIGIARQFFDLQDMLGFDKASKTLDWLLKKSRKAIKEVVQAKNLNNDDEDFGNIGGDVEQEEEKEEDDNGDKSFVYGLSPGYGEEEVVCEATKAGIRKKKSELRNISSKGLGAKARGKAKERTKEMMAYDNPETASDITQSEIMDPFKRSIVFNEGEDMTHLFYKEPIEEFDNQESILTNMTLPTKMGQSYNQNNGILMLVDQSSSSNYNTFLPQNLDYSYDQNPFHDQTLYVVTDKNFPKGFL

SEQ ID NO: 2375 - DNA, 1431 bp, Arabidopsis thaliana
  G616
ctttaaatcccaaaccaaccctaaagttttgatttttaattttgggggtaaccaaaaaaaaaacaaaaccctaattttttttctttagtgatgagattattggtgatgatgaaatgattggagatctaatgaagaataacaacaatggcgacgttgtggataacgaagtgaacaaccggttaagccggtggcatcacaattcttcccggataattagggtttcacgagcttccggtggtaaagatcgacacagcaaagtcttgacttctaaaggaccacgtgaccgtcgtgtccggttatcagtctccaccgctcttcaattctatgatcttcaagatcggttaggttatgatcaacctagcaaagctgttgaatggttaatcaaagctgctgaagattcaatctctgagcttccttcactcaacaacactcattttccgaccgatgacgagaatcaccagaatcagacattaacaacagttgctgctaattccttgtctaaatctgcttgtagtagcaattcagacacgagcaagaactcttctggtttgtctttatcaagatcggagcttagagataaagctagagagagggctagagagagaacagctaaagagaccaaggaaagagatcataaccacacttcgtttacggatttgttaaattccggttcagatccggttaactcaaaccggcaatggatggcttcagctccttcttcatctccaatggagtatttcagttcgggtttaattctcgggtcgggtcaacaaacccatttccctatttcaacaaattctcatcctttctcatcaatctccgatcatcatcatcatcatcctcatcatcagcatcaagagttttcattcgttcccgaccatttgatatcaccggcagaatccaacggcggagcattcaatcttgattttaatatgtcaacaccctccggcgccggagctgccgtctccgccgcatcaggtggtggcttcagtggtttcaacagggggacccttcagtccaattcaacaaatcagcatcagtcattcctcgctaatctacagaggtttccaacatcagaaagtggaggaggtccacagttcttattcggtgcactgcctgcagagaatcaccaccacaatcaccagtttcagctttactatgaaaatggatgcagaaactcatcagaacataagggtaaaggcaagaactgatgatattaattattgcatctttggttttgttcaaatgctcattttgtatgtttatctttggtttatttcaaaacaaatgttaatctctttcgttgtctgatgtgtgttagggttttgttttatgtattgagggtctttggaaatctttttgcattgtgcttgtaatgttgtatttgtgataatagcattttgtttgtgagttaaaaaaaaaaaaaaaaaa

SEQ ID NO: 2376 - protein, 360 aa, Arabidopsis thaliana
  G616
MKNNNNGDVVDNEVNNRLSRWHHNSSRIIRVSRASGGKDRHSKVLTSKGPRDRRVRLSVSTALQFYDLQDRLGYDQPSKAVEWLIKAAEDSISELPSLNNTHFPTDDENHQNQTLTTVAANSLSKSACSSNSDTSKNSSGLSLSRSELRDKARERARERTAKETKERDHNHTSFTDLLNSGSDPVNSNRQWMASAPSSSPMEYFSSGLILGSGQQTHFPISTNSHPFSSISDHHHHHPHHQHQEFSFVPDHLISPAESNGGAFNLDFNMSTPSGAGAAVSAASGGGFSGFNRGTLQSNSTNQHQSFLANLQRFPTSESGGGPQFLFGALPAENHHHNHQFQLYYENGCRNSSEHKGKGKN

SEQ ID NO: 2377 - DNA, 1242 bp, Arabidopsis thaliana
  G617
cagatctgttctttacaccaaattgagtactgaagatcttgttgagtgaattaaagagatgagatcaggagaatgtgatgaagaggagattcaagcaaagcaagaaagagatcaaaatcaaaatcatcaagtaaacttaaaccacatgttgcaacaacaacagccgagttcggtatcatcttcaaggcaatggacttcagcttttaggaatccaagaatcgttcgagtctcaagaacattcggtggcaaagacagacacagcaaagtatgtacagtccgtggtcttcgagaccggaggataaggttgtccgtacctacagctattcaactctacgaccttcaagatcgattagggctgagtcagccaagcaaagtcattgattggttactcgaagcagcaaaagatgacgtagacaagctacctcctctacaattcccacatggatttaaccagatgtatccaaatctcatcttcggaaactccgggtttggagaatctccatcttcaactacatcaacaacgtttccaggaaccaatctcgggttcttggaaaattgggatcttggtggttcttcaagaacaagagcaagattaaccgatacaactacgacccaaagagaaagttttgatcttgataaaggaaaatggatcaaaaacgacgagaatagtaatcaagatcatcaagggtttaacaccaatcatcaacaacaatttcctctgaccaatccgtacaacaacacttcagcttattacaaccttggacatcttcaacaatcgttagaccaatctggtaataacgttactgtcgcaatatctaatgttgctgctaataataacaataatctcaatttgcatcctccttcctcgtctgccggagatggatctcagctttttttcggtcctactcctccggcaatgagctctctattcccgacatacccttcgtttcttggagcttctcatcatcatcatgtcgtcgatggagccggtcatcttcagctctttagctcgaattcaaataccgcatcgcagcaacacatgatgccgggtaatacgagtttgattagaccatttcatcatttgatgagctcgaatcatgatacggatcatcatagtagcgataatgaatcagattcttgaatgattttatatatctacactatacattgaaaatgttatatgtatacgtattcttctatattttgatatatatgcgtattgttggattggtttatgtatct

SEQ ID NO: 2378 - protein, 360 aa, Arabidopsis thaliana
  G617
MRSGECDEEEIQAKQERDQNQNHQVNLNHMLQQQQPSSVSSSRQWTSAFRNPRIVRVSRTFGGKDRHSKVCTVRGLRDRRIRLSVPTAIQLYDLQDRLGLSQPSKVIDWLLEAAKDDVDKLPPLQFPHGFNQMYPNLIFGNSGFGESPSSTTSTTFPGTNLGFLENWDLGGSSRTRARLTDTTTTQRESFDLDKGKWIKNDENSNQDHQGFNTNHQQQFPLTNPYNNTSAYYNLGHLQQSLDQSGNNVTVAISNVAANNNNNLNLHPPSSSAGDGSQLFFGPTPPAMSSLFPTYPSFLGASHHHHVVDGAGHLQLFSSNSNTASQQHMMPGNTSLIRPFHHLMSSNHDTDHHSSDNESDS

SEQ ID NO: 2379 - DNA, 3001 bp, Arabidopsis thaliana
  G619
atttttttccaatctgcaaattttagtctatgtctgttccttgtgctccctcttctcagtacctgcaaatggaggaagaagaatccttctctgaaacccttgttctcatttgattcctccttcctctctcttcttctctctctgtctctgattcgttattccacacttatgactcatctttcccgtcaatagctaagtttgcctcttctttgtgaaatttagctgaaaaaggagaggaattccgaattctgtcacttcaaagctcgaattttgcaaactttcctttgatgggttttacttgttttgttgtaatctgattaaaaatagaaactttttgttttcttcttgtctccttttgctcttaaaagagaagctttttcaatggaatttgacttgaatactgagattgcggaggtggaagaggaggagaatgatgatgtaggagtaggagtaggaggaggaacaagaattgacaagggtaggcttggaatttcaccatcttcttcttcttcatgctcttccggatcatcatcgtcatcatcttctacaggctctgcatcttccatttactctgagctttggcatgcttgtgctggtcctctcacttgtcttcccaagaaaggcaatgtagttgtctatttccctcaaggtcatttggagcaagatgctatggtttcatattcgtctcctcttgaaatccccaaatttgaccttaatccccaaatcgtctgcagggtggttaatgtccagttgcttgctaataaggacaccgatgaggtctacactcaagtcactctgcttccacttcaagagttttcgatgctaaatggggaggggaaagaggtcaaggagttaggaggggaggaagagaggaacggaagctcatccgtcaagcggacacctcatatgttctgtaaaaccttaacagcgtctgacacaagcacacatggaggcttctctgtacctagaagagccgctgaagattgttttgctcctcttgactacaaacaacagaggccatctcaagagctcattgcaaaggacctccatggagtagagtggaagtttcgccatatctatagaggtcaaccaaggaggcatctactcaccactggttggagtatctttgtcagtcaaaagaatctcgtctctggtgatgcggttctctttctgagagacgaaggaggagagctgagattaggaatcagaagagcagcacggccaagaaatggacttcctgactcaatcattgagaagaattcatgttcaaacattctgtctcttgtggctaatgctgtatctacaaaaagcatgtttcatgtgttctacagtccacgagcgacgcatgcagagtttgtgattccttatgagaagtatatcacaagcatcaggagtcctgtttgcataggcacaagatttagaatgcgatttgaaatggacgattctcctgagagaagatgcgctggtgtagtgactggagtctgtgacttggacccgtataggtggccaaactctaaatggaggtgcttgttggtgcgatgggatgagtcttttgtgagtgatcatcaagaaagagtttcaccttgggagattgatccctcggtttctctcccacacttgagcattcagtcatctccaaggcctaaaaggccatgggcaggtttactggatactaccccacccggaaaccccataacaaaaaggggtggttttttggactttgaggagtcggttagaccctctaaggtcttgcaaggtcaagaaaatataggttctgcatcaccctcacaggggtttgatgttatgaaccgccggatactggattttgcgatgcagtctcatgcaaatccagtccttgtgtcgagtagagtcaaggatcgatttggtgagtttgtagatgctactggcgtgaacccagcttgttcaggtgttatggacctggataggtttccaagggtcttgcaaggtcaagaaatttgctcgcttaaatcattcccgcaatttgctggtttcagtccagctgctgctcctaatccctttgcttaccaagccaacaagtcaagttactatccgctagctttgcatgggattaggagcactcatgttccgtatcagaatccatacaatgcgggaaaccaatcctcgggtcccccttcacgtgcaataaactttggtgaagagactagaaagtttgatgcacaaaatgaaggtggcctaccaaataatgttacagctgatttgccattcaagattgatatgatgggaaaacagaaaggcagtgagttgaatatgaatgcttcatcaggatgtaaacttttcggattctccttaccagtggagacacctgcatctaagccgcaaagctcgagcaaaagaatctgtacaaaggttcacaagcaaggaagccaagtggggagagctattgatttgtcgcgacttaacgggtatgatgatctccttatggagcttgaacggctgttcaacatggaagggcttctcagggatcctgaaaaaggatggaggatcttatatactgatagtgagaacgatatgatggtcgttggcgatgatccatggcatgatttctgcaatgtggtgtggaagatacacttatacacgaaagaggaagtggagaatgcgaatgacgataacaagagttgtttagagcaagctgctctcatgatggaagcatcaaagtcatcttctgtgagccagcctgattcttctcctacaatcactagggtttgatacccataaagaagcttatttcctatgttttaaagtgtgttttgctcacaaaagaacttcaactttatctttgtctttgaatccatttatgtgtttgtttgtgtttcttctggtctccatggatgtctcatgtgtaccgttttactcgagagatatgtgagtttatgggatgtgtaaagcatgccattggattttaaggttttcaaaattacaatatatatattagttttgaagttaaaaaaaaaaaaaaaaa

SEQ ID NO: 2380 - protein, 788 aa, Arabidopsis thaliana
  G619
MEFDLNTEIAEVEEEENDDVGVGVGGGTRIDKGRLGISPSSSSSCSSGSSSSSSSTGSASSIYSELWHACAGPLTCLPKKGNVVVYFPQGHLEQDAMVSYSSPLEIPKFDLNPQIVCRVVNVQLLANKDTDEVYTQVTLLPLQEFSMLNGEGKEVKELGGEEERNGSSSVKRTPHMFCKTLTASDTSTHGGFSVPRRAAEDCFAPLDYKQQRPSQELIAKDLHGVEWKFRHIYRGQPRRHLLTTGWSIFVSQKNLVSGDAVLFLRDEGGELRLGIRRAARPRNGLPDSIIEKNSCSNILSLVANAVSTKSMFHVFYSPRATHAEFVIPYEKYITSIRSPVCIGTRFRMRFEMDDSPERRCAGVVTGVCDLDPYRWPNSKWRCLLVRWDESFVSDHQERVSPWEIDPSVSLPHLSIQSSPRPKRPWAGLLDTTPPGNPITKRGGFLDFEESVRPSKVLQGQENIGSASPSQGFDVMNRRILDFAMQSHANPVLVSSRVKDRFGEFVDATGVNPACSGVMDLDRFPRVLQGQEICSLKSFPQFAGFSPAAAPNPFAYQANKSSYYPLALHGIRSTHVPYQNPYNAGNQSSGPPSRAINFGEETRKFDAQNEGGLPNNVTADLPFKIDMMGKQKGSELNMNASSGCKLFGFSLPVETPASKPQSSSKRICTKVHKQGSQVGRAIDLSRLNGYDDLLMELERLFNMEGLLRDPEKGWRILYTDSENDMMVVGDDPWHDFCNVVWKIHLYTKEEVENANDDNKSCLEQAALMMEASKSSSVSQPDSSPTITRV

SEQ ID NO: 2381 - DNA, 826 bp, Arabidopsis thaliana
  G620
gaattgaacttggaccagcacagcaacaacccaaccccaatgaccagctcagtcatagtagccggcgccggtgacaagaacaatggtatcgtggtccagcagcaaccaccatgtgtggctcgtgagcaagaccaatacatgccaatcgcaaacgtcataagaatcatgcgtaaaaccttaccgtctcacgccaaaatctctgacgacgccaaagaaacgattcaagaatgtgtctccgagtacatcagcttcgtgaccggtgaagccaacgagcgttgccaacgtgagcaacgtaagaccataactgctgaagatatcctttgggctatgagcaagcttgggttcgataactacgtggaccccctcaccgtgttcattaaccggtaccgtgagatagagaccgatcgtggttctgcacttagaggtgagccaccgtcgttgagacaaacctatggaggaaatggtattgggtttcacggcccatctcatggcctacctcctccgggtccttatggttatggtatgttggaccaatccatggttatgggaggtggtcggtactaccaaaacgggtcgtcgggtcaagatgaatccagtgttggtggtggctcttcgtcttccattaacggaatgccggcttttgaccattatggtcagtataagtgaagaaggagttattcttcatttttatatctattcaaaacatgtgtttcgatagatattttatttttatgtcttatcaataacatttctatataatgttgcttctttaaggaaaagtgttgtatgtcaatactttatgagaaactgatttatatatgcaaat

SEQ ID NO: 2382 - protein, 208 aa, Arabidopsis thaliana
  G620
MTSSVIVAGAGDKNNGIVVQQQPPCVAREQDQYMPIANVIRIMRKTLPSHAKISDDAKETIQECVSEYISFVTGEANERCQREQRKTITAEDILWAMSKLGFDNYVDPLTVFINRYREIETDRGSALRGEPPSLRQTYGGNGIGFHGPSHGLPPPGPYGYGMLDQSMVMGGGRYYQNGSSGQDESSVGGGSSSSINGMPAFDHYGQYK

SEQ ID NO: 2383 - DNA, 2628 bp, Arabidopsis thaliana
  G622
tctttctttcttcaattcgccgtcaaaatcttctctttctcttcccccgccggtccttcaccaatcctctgatctctctacacacgaacctttgattttgaccaacgtcgatgcatgttcatgactagtctcttcctcaatccttcaatttcatcaattcacgtcgatttcgtatccgattcgttgttctagctctttgtgtggtgttagggttttaagattttggaattggggtttggagtttgtgatgtttgaagtcaaaatggggtcaaagatgtgcatgaacgcttcatgtggtacgacttctactgttgaatggaagaaaggttggcctcttcgatctggtcttctcgctgatctctgttatcgttgcggatctgcgtatgagagttctctattctgtgaacaatttcataaggaccaatctggttggagggaatgctatttgtgtagcaagagactacattgtggatgcattgcttctaaggtaacgattgagttaatggactatggtggtgttggttgtagtacatgtgcttgctgccatcaactcaatttgaacacaaggggtgagaatccaggtgtttttagcagattgccaatgaaaacgttagctgataggcaacatgtaaatggcgaaagcggaggaagaaacgaaggcgatctcttttctcagccactagtcatgggcggagataaaagggaagagttcatgcctcaccgtgggtttggtaagctaatgagtccagaaagtacaaccaccgggcataggctggatgctgctggggaaatgcatgaatcatcacctttacagccatctttaaatatgggtttggctgtgaatccgtttagcccatcttttgcaaccgaggctgtcgagggaatgaaacacatcagtccttctcagtccaacatggtccattgctctgcttctaatatactgcaaaagccatcaagacctgctatttcaactcctcctgtggctagtaaatccgctcaggcgcggattggaaggcctcctgtcgaagggcgagggagaggccacttgcttccgcggtattggccaaaatatacggataaagaggttcagcagatctctggaaatttgaatttgaacattgtacctctctttgagaaaactcttagtgccagtgatgctggtcgcattggtcgtctagttcttccaaaagcctgtgcagaggcatattttcctccgattagtcaatccgaaggcattcctttgaaaatccaagatgtgaggggtagggagtggacgttccagttcagatattggcccaataacaatagtagaatgtatgttttagaaggtgtcactccatgcatacagtccatgatgctacaggctggtgatacagtaactttcagtcgggttgatcctggcggaaaactaatcatgggttccaggaaggcagctaatgctggagacatgcagggttgtgggctcaccaacggaacatcaactgaggacacatcatcgtctggtgtaacagaaaacccaccctccataaatggttcctcgtgtatttcactaataccgaaagagttgaatggtatgcctgagaatttgaacagtgagactaacgggggcaggataggtgatgatcctacacgagttaaagagaagaagagaactcgaaccattggtgcaaaaaataagagacttcttttgcatagtgaagaatctatggagctgagactcacttgggaagaagctcaggacttgcttcgtccctctcctagtgtaaagcctaccatcgttgtcattgaggagcaagaaattgaagaatatgacgaacctcctgtctttggaaagaggactatagtcactacaaaaccttcaggtgaacaggaacgatgggcaacttgcgacgactgctctaaatggagaaggttacctgtagatgctcttctttcctttaaatggacatgtatagacaatgtttgggatgtgagtaggtgttcatgttctgcaccggaggagagtctgaaggaacttgagaatgttcttaaagtaggtagagagcacaagaagagaagaactggggaaagacaggcagcacaaagtcagcaagaaccgtgtggtttggacgcactggcgagtgcagcagtcttaggagacacaataggcgagccagaggtagcgaccacgaccagacatccaaggcacagggctggatgctcttgcatcgtgtgcattcagccaccaagtgggaaaggtaggcacaagcctacatgtggctgcactgtgtgtagcaccgtgaagagaaggttcaagacgcttatgatgaggaggaagaagaagcagttggagcgcgatgtaacagcagcagaagataagaagaagaaggacatggaactggctgagtctgataagagtaaggaggagaaggaagtgaacacagcgagaatagacctgaacagtgatccatacaataaagaagatgttgaagctgttgcggtggagaaagaagagagtcgaaaaagagcaataggacagtgttcgggcgtggtggctcaagacgccagtgatgttttaggagttacagagttagaaggagagggtaagaatgttcgtgaagagccgagagtttcaagctgatatggaaa

SEQ ID NO: 2384 - protein, 790 aa, Arabidopsis thaliana
  G622
MFEVKMGSKMCMNASCGTTSTVEWKKGWPLRSGLLADLCYRCGSAYESSLFCEQFHKDQSGWRECYLCSKRLHCGCIASKVTIELMDYGGVGCSTCACCHQLNLNTRGENPGVFSRLPMKTLADRQHVNGESGGRNEGDLFSQPLVMGGDKREEFMPHRGFGKLMSPESTTTGHRLDAAGEMHESSPLQPSLNMGLAVNPFSPSFATEAVEGMKHISPSQSNMVHCSASNILQKPSRPAISTPPVASKSAQARIGRPPVEGRGRGHLLPRYWPKYTDKEVQQISGNLNLNIVPLFEKTLSASDAGRIGRLVLPKACAEAYFPPISQSEGIPLKIQDVRGREWTFQFRYWPNNNSRMYVLEGVTPCIQSMMLQAGDTVTFSRVDPGGKLIMGSRKAANAGDMQGCGLTNGTSTEDTSSSGVTENPPSINGSSCISLIPKELNGMPENLNSETNGGRIGDDPTRVKEKKRTRTIGAKNKRLLLHSEESMELRLTWEEAQDLLRPSPSVKPTIVVIEEQEIEEYDEPPVFGKRTIVTTKPSGEQERWATCDDCSKWRRLPVDALLSFKWTCIDNVWDVSRCSCSAPEESLKELENVLKVGREHKKRRTGERQAAQSQQEPCGLDALASAAVLGDTIGEPEVATTTRHPRHRAGCSCIVCIQPPSGKGRHKPTCGCTVCSTVKRRFKTLMMRRKKKQLERDVTAAEDKKKKDMELAESDKSKEEKEVNTARIDLNSDPYNKEDVEAVAVEKEESRKRAIGQCSGVVAQDASDVLGVTELEGEGKNVREEPRVSS

SEQ ID NO: 2385 - DNA, 1500 bp, Arabidopsis thaliana
  G625
aatcgaccattcacaacgatgacattcaaacactcttcagtttcccttccttcttgattcgtcctctccactatttttctcaatttctttaatctctctctttctctctctacttcctcttcctcttcttcttcttcttcttcttcatctatggaccctttagcttcccaacatcaacacaaccatctggaagataataaccaaaccctaacccataataatcctcaatccgattccaccaccgactcatcaacttcctccgctcaacgcaaacgcaaaggcaaaggtggtccggacaactccaagttccgttaccgtggcgttcgacaaagaagctggggcaaatgggtcgccgagatccgagagccacgtaagcgcactcgcaagtggcttggtactttcgcaaccgccgaagacgccgcacgtgcctacgaccgggctgccgtttacctatacgggtcacgtgctcagctcaacttaaccccttcgtctccttcctccgtctcttcctcttcctcctccgtctccgccgcttcttctccttccacctcctcttcctccactcaaaccctaagacctctcctccctcgccccgccgccgccaccgtaggaggaggagccaactttggtccgtacggtatcccttttaacaacaacatcttccttaatggtgggacctctatgttatgccctagttatggttttttccctcaacaacaacaacaacaaaatcagatggtccagatgggacaattccaacaccaacagtatcagaatcttcattctaatactaacaataacaagatttctgacatcgagctcactgatgttccggtaactaattcgacttcgtttcatcatgaggtggcgttagggcaggaacaaggaggaagtgggtgtaataataatagttcgatggaggatttgaactctctagctggttcggtgggttcgagtctatcaataactcatccaccgccgttggttgatccggtatgttctatgggtctggatccgggttatatggttggagatggatcttcgaccatttggccttttggaggagaagaagaatatagtcataattgggggagtatttgggattttattgatcccatcttgggggaattctattaatttgtttttgtggaagatcatattatatacgatgagcatccctaaggtcggtcaagagcattggagattcattgttgagaggaatcaaagagattgcattctatgaggagctctgcatgcaaaattttggaggatttttttactacctatagagataaataagagggtatttttattatttttttgaagatttttattttcaaggaattcgtaaaagagattacggttccaataaagtatgtatatgtggaagagaatcggaggagatggtggaaagttgtatgggaattttattggttcaacacttccttcacagtgtgcctaccttaatatataattattgataggatatgataatttctg

SEQ ID NO: 2386 - protein, 328 aa, Arabidopsis thaliana
  G625
MDPLASQHQHNHLEDNNQTLTHNNPQSDSTTDSSTSSAQRKRKGKGGPDNSKFRYRGVRQRSWGKWVAEIREPRKRTRKWLGTFATAEDAARAYDRAAVYLYGSRAQLNLTPSSPSSVSSSSSSVSAASSPSTSSSSTQTLRPLLPRPAAATVGGGANFGPYGIPFNNNIFLNGGTSMLCPSYGFFPQQQQQQNQMVQMGQFQHQQYQNLHSNTNNNKISDIELTDVPVTNSTSFHHEVALGQEQGGSGCNNNSSMEDLNSLAGSVGSSLSITHPPPLVDPVCSMGLDPGYMVGDGSSTIWPFGGEEEYSHNWGSIWDFIDPILGEFY

SEQ ID NO: 2387 - DNA, 1661 bp, Arabidopsis thaliana
  G631
cttcttcttcttcttcttcttcttcttcctcctctctcgtcggatctctctgatttagtgatttttcaaatttcaagttttcttcacctttaattttgtgtctcgttgatctctctttggacattctgctttggattctggaggcttctcattagatctctattagtgggtttaggtcaagttcttgaaatggataaggagaaatctcctgcaccaccacctagtggaggtcttcctccaccatcgggtcgttactctgcgttttcacctaatggaagtagctttgcaatgaaagctgaatcatcttttcctcctttgactccaagtggaagcaatagctcagatgctaaccgattcagccatgatattagccgaatgccggataatccacctaagaacctaggccatcgccgagctcattcagagattcttactcttcctgatgacttaagctttgatagtgatcttggtgtggttggtgctgctgatggaccttctttctctgatgatactgacgaggacttactctatatgtatcttgatatggaaaaattcaattcttctgctacatcgacttctcaaatgggtgagccatcagaaccgacttggaggaatgaattagcctcgacttctaaccttcagagtacacccggtagctctagtgaaagaccgagaattagacaccaacacagccaatcgatggatggttcaacaactatcaagcctgagatgcttatgtcagggaatgaagatgtgtctggagttgactctaagaaagccatctctgctgctaaactttctgagcttgctctcattgatccaaaacgcgccaagaggatatgggcaaacaggcagtctgctgcgaggtcaaaagaaaggaagatgagatacattgcagagctcgagagaaaagtacagactttacaaacagaggccacatctctctcagcccagttgactctcttacagagagatacaaatggcctgggtgttgaaaacaatgagcttaaactgcgagtacaaactatggagcaacaggtccacctacaggatgctttaaatgatgcactaaaggaggaagtccagcatcttaaggtattgacggggcaaggtccatcaaatggtacatcaatgaactacggttcttttggatcaaaccagcaattctatcccaataatcagtcgatgcacactatcttagccgcacaacagttacagcagctccagatccagtcacagaaacagcaacaacaacaacagcaacaccagcaacaacaacagcagcagcagcagcaatttcactttcaacagcagcaactgtaccagcttcagcagcagcaacggcttcaacaacaggaacaacaaagcggggcttcagagctaagaagacccatgccttctcctggtcagaaagagagtgtgacatcgcctgatcgtgaaactcccttgacaaaagactgagtctagactgtgctaatgtccaatttagtaagttactcttggaaaatcttctttttcatcgcaggctcatggatttgggatttactgcattatagagttaaaaacaagacagcttagaagttgcggatttagaagttgttagtgaagcttttgttctcgtctgttggtagtttacaatcttctctttgtatgatcctaag

SEQ ID NO: 2388 - protein, 423 aa, Arabidopsis thaliana
  G631
MDKEKSPAPPPSGGLPPPSGRYSAFSPNGSSFAMKAESSFPPLTPSGSNSSDANRFSHDISRMPDNPPKNLGHRRAHSEILTLPDDLSFDSDLGVVGAADGPSFSDDTDEDLLYMYLDMEKFNSSATSTSQMGEPSEPTWRNELASTSNLQSTPGSSSERPRIRHQHSQSMDGSTTIKPEMLMSGNEDVSGVDSKKAISAAKLSELALIDPKRAKRIWANRQSAARSKERKMRYIAELERKVQTLQTEATSLSAQLTLLQRDTNGLGVENNELKLRVQTMEQQVHLQDALNDALKEEVQHLKVLTGQGPSNGTSMNYGSFGSNQQFYPNNQSMHTILAAQQLQQLQIQSQKQQQQQQQHQQQQQQQQQQFHFQQQQLYQLQQQQRLQQQEQQSGASELRRPMPSPGQKESVTSPDRETPLTKD

SEQ ID NO: 2389 - DNA, 948 bp, Arabidopsis thaliana
  G647
atgatgatcggcgaaaataaaaaccggccacatccaacgatccatatccctcaatgggatcaaatcaacgatccaacggccacaatctcttcaccattctcttccgtcaaccttaacagcgttaacgactacccacactctccgtcaccgtatctcgactccttcgcttctctcttccgttacctcccgtcaaacgagttaacaaacgattcagactcatcaagtggcgacgagtcatcaccactcaccgactcattctcctccgacgagtttcgcatctacgagttcaaaatccggcgatgcgctcgaggtcgatctcatgattggacggagtgtccgttcgcacatcccggagaaaaagctcgacgacgtgatccgagaaagtttcattactccggcaccgcttgtcctgagtttcgtaaaggaagttgtagaagaggtgattcgtgtgagttctctcatggagttttcgagtgttggctccatccttctcgttaccgtactcagccgtgtaaagacggaactagctgccggagaagaatctgtttcttcgctcatacgacggagcagttacgtgtattaccttgttcgttagatccagatcttggattcttctcaggattagctacttctccgacttcgattcttgtttctccttcgttttcaccaccgtcggaatctccgccgctttctccgagtaccggtgaacttattgcgtcgatgaggaaaatgcaattgaacggaggtggttgttcgtggagttctccgatgagatctgcagttaggttacctttttcgtcgtctctgcgtccgattcaggcggcaacgtggccgaggataagagagtttgagatcgaagaagctccggcgatggaatttgtggaatctgggaaagagctgagagcggagatgtatgcaagactcagtagagagaactcactcggttga

SEQ ID NO: 2390 - protein, 315 aa, Arabidopsis thaliana
  G647
MMIGENKNRPHPTIHIPQWDQINDPTATISSPFSSVNLNSVNDYPHSPSPYLDSFASLFRYLPSNELTNDSDSSSGDESSPLTDSFSSDEFRIYEFKIRRCARGRSHDWTECPFAHPGEKARRRDPRKFHYSGTACPEFRKGSCRRGDSCEFSHGVFECWLHPSRYRTQPCKDGTSCRRRICFFAHTTEQLRVLPCSLDPDLGFFSGLATSPTSILVSPSFSPPSESPPLSPSTGELIASMRKMQLNGGGCSWSSPMRSAVRLPFSSSLRPIQAATWPRIREFEIEEAPAMEFVESGKELRAEMYARLSRENSLG

SEQ ID NO: 2391 - DNA, 2331 bp, Arabidopsis thaliana
  G657
atgaagcgtgagatgaaagcacctactactccactagagagtctccaaggtgacctcaaaggaaaacaagggaggacatctggccctgctagacgatctaccaaaggacaatggacacctgaagaggacgaagtcttgtgtaaagctgttgagcgttttcaaggaaagaactggaagaagatagctgaatgttttaaggatcggactgatgttcagtgtcttcatagatggcaaaaggtcttgaacccagagcttgtgaaaggaccgtggtcaaaagaggaggataacacaataattgacctggttgaaaaatatgggccaaagaaatggtctactatatctcagcatttacctgggcgcataggaaagcaatgtagggaaaggtggcataaccatcttaaccctgggattaataaaaatgcatggactcaggaagaggaactgactcttattcgtgcgcatcaaatttatgggaataaatgggcagagcttatgaaatttttgccaggaaggtcagataattcgataaaaaatcattggaacagctcagttaagaagaagttggattcctactatgcatcaggtcttttagatcagtgtcaaagctcgccattaattgcccttcagaacaaatctatcgcttcatcttcctcgtggatgcacagcaatggagatgaaggtagttcaaggccaggggttgatgctgaggaatcagaatgcagccaagcttcaactgttttctcacaatcaaccaacgatttacaagatgaagttcaacgtggaaatgaggaatattacatgcctgaatttcattcaggaacggagcagcaaatctcaaacgctgcatctcatgcagaaccgtactacccttcctttaaagatgtcaaaattgttgtccccgaaatttcttgtgaaacagaatgttcgaagaagtttcagaatcttaattgttctcacgagctaagaactaccacagctacggaggatcaattgccgggtgtatctaatgatgctaaacaggaccgtggtctagagttattgacccataacatggacaacggtggaaaaaaccaagcacttcaacaagattttcaaagttcagtaagattaagtgatcaaccttttttgtcaaactcggacacagatccagaagctcaaactttgatcacggatgaggagtgttgtagggttctttttccagataacatgaaagatagcagtacatcttctggtgagcaaggtcggaatatggttgaccctcaaaacggcaaaggatctctttgttctcaggctgcagaaacccatgctcatgaaactggaaaagttccagctttaccgtggcatccttcaagttctgagggcctggcgggtcataattgtgtccctttgttggattcagacttgaaggactcacttttaccccgtaatgattccaacgctcctatacaaggttgtcgcctttttggagctaccgaattagaatgtaagactgatacaaatgacggtttcatcgatacttacggacatgtaacttcccatggcaatgatgataatggtggtttcccagaacaacaggggctgtcatatattcccaaggattctttgaagctagtacctttgaatagtttttcttctccttctagagtgaacaagatttattttcctattgacgataagccggctgaaaaagacaaaggagctctttgttatgaacctccacgttttccaagtgcagatattcctttcttcagctgtgatcttgtaccatcaaatagtgacttacggcaagagtacagtccctttggtatccgtcagttgatgatttcttcaatgaattgtacaactccgttaaggttatgggattcaccgtgtcacgataggagccctgatgtcatgcttaatgatactgccaaaagttttagtggtgcaccatccatcttaaagaagcggcatcgagacttgctttcacctgtgcttgatagaagaaaagacaaaaagcttaaaagggctgcgacttcctccttggctaatgatttttcgcgcttagatgtaatgcttgatgaaggagatgattgcatgacctctcgtccgtcagagtctcctgaagataaaaatatatgtgcctccccttccatagccagagataacagaaattgtgcatcagctcggttatatcaagaaatgattccgatagatgaggaaccaaaggaaaccttagaatcaggtggagtgacttctatgcaaaatgaaaatggatgtaatgacggtggtgcttcagctaaaaatgtaagtccgtctttgtccttgcatattatctggtatcagttataa

SEQ ID NO: 2392 - protein, 776 aa, Arabidopsis thaliana
  G657
MKREMKAPTTPLESLQGDLKGKQGRTSGPARRSTKGQWTPEEDEVLCKAVERFQGKNWKKIAECFKDRTDVQCLHRWQKVLNPELVKGPWSKEEDNTIIDLVEKYGPKKWSTISQHLPGRIGKQCRERWHNHLNPGINKNAWTQEEELTLIRAHQIYGNKWAELMKFLPGRSDNSIKNHWNSSVKKKLDSYYASGLLDQCQSSPLIALQNKSIASSSSWMHSNGDEGSSRPGVDAEESECSQASTVFSQSTNDLQDEVQRGNEEYYMPEFHSGTEQQISNAASHAEPYYPSFKDVKIVVPEISCETECSKKFQNLNCSHELRTTTATEDQLPGVSNDAKQDRGLELLTHNMDNGGKNQALQQDFQSSVRLSDQPFLSNSDTDPEAQTLITDEECCRVLFPDNMKDSSTSSGEQGRNMVDPQNGKGSLCSQAAETHAHETGKVPALPWHPSSSEGLAGHNCVPLLDSDLKDSLLPRNDSNAPIQGCRLFGATELECKTDTNDGFIDTYGHVTSHGNDDNGGFPEQQGLSYIPKDSLKLVPLNSFSSPSRVNKIYFPIDDKPAEKDKGALCYEPPRFPSADIPFFSCDLVPSNSDLRQEYSPFGIRQLMISSMNCTTPLRLWDSPCHDRSPDVMLNDTAKSFSGAPSILKKRHRDLLSPVLDRRKDKKLKRAATSSLANDFSRLDVMLDEGDDCMTSRPSESPEDKNICASPSIARDNRNCASARLYQEMIPIDEEPKETLESGGVTSMQNENGCNDGGASAKNVSPSLSLHIIWYQL

SEQ ID NO: 2393 - DNA, 897 bp, Arabidopsis thaliana
  G658
ccacgcgtccgctcacatgaacaaaggagcttggactaaagaagaagatcagcttcttgttgattacatccgtaaacacggtgaaggttgctggcgatctctccctcgcgccgctggattacaaagatgtggtaagagttgtagattgagatggatgaattatctaagaccagatctcaaaagaggcaattttactgaagaagaagatgaactcatcatcaagctccatagcttgctcggtaacaaatggtctttaatagctgggagattaccaggaagaacagataacgagatcaagaactattggaacactcatatcaagaggaagcttctcagccgtgggattgatccaaactctcaccgtctgatcaacgaatccgtcgtgtctccgtcgtctcttcaaaacgatgtcgttgagactatacatcttgatttctctggaccggttaaaccggaaccggtgcgtgaagagattggtatggttaataattgtgagagtagtggaacgacgtcggagaaggattatgggaacgaggaagattgggtgttgaatttggaactctctgttggaccgagttatcggtacgagtcgactcggaaagtgagtgttgttgactcggctgagtcgactcgacggtggggttccgagttgtttggagctcatgagagtgatgcggtgtgtttgtgttgtcggattgggttgtttcgtaatgagtcgtgtcggaattgtcgggtttctgatgttagaactcattagagagtcaatcgagaattctttaggaatctttttatatatttagatcgtcaattgtgttttttttttgttcacatttgttatgtaacatcaagtaagaaactagcataattatttgatggcaaagccaaaagattgtgctc

SEQ ID NO: 2394 - protein, 246 aa, Arabidopsis thaliana
  G658
MNKGAWTKEEDQLLVDYIRKHGEGCWRSLPRAAGLQRCGKSCRLRWMNYLRPDLKRGNFTEEEDELIIKLHSLLGNKWSLIAGRLPGRTDNEIKNYWNTHIKRKLLSRGIDPNSHRLINESVVSPSSLQNDVVETIHLDFSGPVKPEPVREEIGMVNNCESSGTTSEKDYGNEEDWVLNLELSVGPSYRYESTRKVSVVDSAESTRRWGSELFGAHESDAVCLCCRIGLFRNESCRNCRVSDVRTH

SEQ ID NO: 2395 - DNA, 1307 bp, Arabidopsis thaliana
  G670
cacagcattgcagctgtgaataactaaatggggagacattcttgctgttacaaacaaaagctgaggaaagggctttggtctcctgaagaagacgagaagcttcttactcacatcaccaatcacggccatggctgctggagctctgtccctaaactcgctggtttgcagagatgtgggaagagttgtcgactcgagcagatctggtaccgccgactaagatggatcaattacttgagacctgatttaaagagaggagctttttctcctgaagaagagaatctcatcgtcgaacttcatgccgtccttggaaacagatggtcacagattgcgtcaaggcttccgggtagaaccgacaacgagatcaagaatctatggaactcaagcatcaagaagaaactgaaacaaagaggcattgacccaaacacacacaagcccatctctgaagtggagagttttagcgacaaagacaaaccaacaacaagcaacaacaaaagaagcggtaacgatcacaagtctcctagttcctcttctgcgactaaccaagacttcttcctcgaaaggccatctgatttatccgactacttcggatttcagaagcttaacttcaactccaatctaggactctctgttacaactgattcttcactctgctcgatgattccgccgcagtttagccccgggaacatggttggttctgtccttcagacaccagtatgcgtaaagccctcgattagtcttcctcccgacaacaacagttcgagtcctatctccggaggagatcatgtgaaattggctgcaccaaactgggaatttcagacaaacaacaataatacctcaaatttcttcgacaatggcggattctcatggtctatcccaaattcttctacttcttcttcacaagtcaaaccaaatcataacttcgaagaaataaaatggtcagagtatttgaacacaccgttcttcatagggagtactgtacagagtcaaacctctcaaccaatctacatcaaatcagaaacagattacttagccaatgtttcaaacatgacagatccttggagccaaaacgagaacttgggcacaactgaaactagtgacgtgttctccaaggatcttcagagaatggccgtctcttttggtcagtccctttagcttttttctttctttctttcttatttctaacagatgtagagaacataaagatatacaaatacatacaatgtcaatacgtacagtggatttaagtgttctgtatatttcatgggcgagctgtctttatttttatgtttaaaaaaaaaaaaaaaaaa

SEQ ID NO: 2396 - protein, 374 aa, Arabidopsis thaliana
  G670
MGRHSCCYKQKLRKGLWSPEEDEKLLTHITNHGHGCWSSVPKLAGLQRCGKSCRLEQIWYRRLRWINYLRPDLKRGAFSPEEENLIVELHAVLGNRWSQIASRLPGRTDNEIKNLWNSSIKKKLKQRGIDPNTHKPISEVESFSDKDKPTTSNNKRSGNDHKSPSSSSATNQDFFLERPSDLSDYFGFQKLNFNSNLGLSVTTDSSLCSMIPPQFSPGNMVGSVLQTPVCVKPSISLPPDNNSSSPISGGDHVKLAAPNWEFQTNNNNTSNFFDNGGFSWSIPNSSTSSSQVKPNHNFEEIKWSEYLNTPFFIGSTVQSQTSQPIYIKSETDYLANVSNMTDPWSQNENLGTTETSDVFSKDLQRMAVSFGQSL

SEQ ID NO: 2397 - DNA, 840 bp, Arabidopsis thaliana
  G681
atggggaggacgacatggttcgacgtcgacgggatgaagaaaggagagtggacggcagaggaagaccagaagctcggcgcttacatcaacgagcatggcgtttgtgattggcgttccctccccaaaagagctggtttgcagagatgtggaaagagctgcagattaaggtggcttaactatctaaagcctgggattagaagaggcaaattcactcctcaagaagaagaagaaatcatccaacttcatgctgttctcggaaacaggtgggcagccatggcgaagaagatgcagaatcgaacagacaatgatatcaagaaccattggaactcttgtctcaagaaaagactttcgagaaagggaatcgaccctatgacccacgagcccatcatcaaacacctcaccgtcaataccactaacgcagattgtggtaactcttccaccacgacgtccccgtcgacgacggaaagctctccttcctccggctcgtctcgtcttcttaacaaactcgccgcaggtatctcatctagacaacatagtctcgataggatcaagtacatcttgtcgaattcaataatcgaaagcagtgatcaagcaaaagaggaagaagaaaaagaagaagaagaagaagaaagagattcaatgatgggtcagaagattgacggtagtgaaggagaagatattcagatttggggcgaggaggaagttaggcgtttaatggagattgatgcaatggatatgtacgagatgacttcgtacgacgctgtcatgtacgagagtagtcacatacttgatcatctcttttgacttaatatagtgtgactgtgtgagtgcatgcatgtt

SEQ ID NO: 2398 - protein, 267 aa, Arabidopsis thaliana
  G681
MGRTTWFDVDGMKKGEWTAEEDQKLGAYINEHGVCDWRSLPKRAGLQRCGKSCRLRWLNYLKPGIRRGKFTPQEEEEIIQLHAVLGNRWAAMAKKMQNRTDNDIKNHWNSCLKKRLSRKGIDPMTHEPIIKHLTVNTTNADCGNSSTTTSPSTTESSPSSGSSRLLNKLAAGISSRQHSLDRIKYILSNSIIESSDQAKEEEEKEEEEEERDSMMGQKIDGSEGEDIQIWGEEEVRRLMEIDAMDMYEMTSYDAVMYESSHILDHLF

SEQ ID NO: 2399 - DNA, 2299 bp, Arabidopsis thaliana
  G716
  misc_feature (32)..(33): n is a, c, g, or t
  misc_feature (37)..(37): n is a, c, g, or t
  misc_feature (45)..(45): n is a, c, g, or t
  misc_feature (62)..(62): n is a, c, g, or t
  misc_feature (76)..(76): n is a, c, g, or t
  misc_feature (122)..(122): n is a, c, g, or t
  misc_feature (151)..(151): n is a, c, g, or t
aaaaaaaaaggggagagatttagttttatccnncagngcctgaantacgttctgcaatcaanacggacataaccgnccgttgtgtcctgtttataaagttttgctttttttattttctccantgatgggtcttttctttcttctctctctngtgtttctttcatggggttaagactagtgtttaccgcgtgaaggtttttttttctttctattttctttcatttcctctccttctacttcttcttctccagttctcatctgggttcttcaatggcgagtgttgaaggtgatgatgatttcggaagttcttcgtcaaggtcttatcaagatcaactatacacagagctatggaaagtttgtgcaggtccattagtggaagttcctcgtgctcaagagagagttttctacttccctcagggtcacatggaacaacttgtggcgtcaactaatcaaggaatcaattcagaagaaatacctgtttttgatcttcctccaaagatactttgtcgagttcttgatgtcactttaaaggcggagcatgaaacagatgaggtttacgctcagatcacattacaaccagaggaagatcaaagtgaaccaacaagtcttgatccacctattgttggaccaactaagcaagagtttcattcgtttgttaagattttaacggcttcagatacaagcactcatggtggattctctgttcttcgtaaacacgccactgaatgcttgccttctttggatatgacacaagctactcctactcaagaacttgtgactagagatcttcatggctttgaatggaggtttaagcatatattcagaggacaaccacggaggcatttgcttactacgggttggagtacatttgtatcctcgaaaagacttgtagctggagatgcttttgtgttcttgaggggtgagaatggggatttacgggttggagtgagacgattagctcggcatcaaagcacaatgcctacttcggttatttcaagtcagagcatgcatttgggagttcttgctacagcttctcatgctgtgcgtacaacaacaatctttgttgtcttttacaagcctaggataagccaattcatagttggggtgaacaagtatatggaagctataaagcatggattttctctcggtacccgattcagaatgaggtttgaaggagaagagtctcctgagagaatatttactggtacgattgtgggaagtggagatctatcttcacaatggccagcttctaaatggaggtcattgcaggtacaatgggatgagccaacaacagttcagagaccagataaagtctcaccatgggagatagagcctttcttggcaacttccccaatttcaactcctgctcaacaaccacaatcgaaatgcaagcggtcaagacccatcgagccatcagttaaaacaccagccccacctagtttcttgtacagcctccctcagagccaagattccattaatgcatcccttaaactgtttcaagatccatcacttgagagaatttcaggtggatactcctcaaacaacagcttcaaacccgagactcctcctcctccaacgaattgtagctataggttgtttggatttgatctcacaagcaattctcctgctccaatccctcaagacaagcaaccgatggatacttgtggagctgccaagtgtcaagaacccatcactccaacctcaatgagtgagcagaagaagcaacaaacatcaagaagtcgaactaaagtgcaaatgcaaggcattgcggttggtcgtgcggttgatttaacactgttgaaatcttacgatgaactgattgatgagcttgaggagatgtttgagattcaaggacagcttcttgcccgagacaaatggatcgttgtcttcactgatgatgaaggagatatgatgcttgctggtgatgatccgtggaatgagttttgcaagatggcaaagaagatatttatatattcgagcgatgaggttaagaaaatgacaacgaaactgaagatttcttcgtcgttagagaatgaggaatatggtaatgaatcattcgaaaatcgtagtagggggtgagagttttagctgttaattaaggttaattcggcgacgtcgttttagtgcgtaagtgtctaaagactttttttttagtctgtgtatataaagtcttgtcctctttttcatgtcaatttttcaagttggcgatttaatatttcggttttgggacagtggttgatggggcggttttacattttttatgtgtatgtacttgttccaaaaccattcaattttcaaa

SEQ ID NO: 2400 - protein, 602 aa, Arabidopsis thaliana
  G716
MASVEGDDDFGSSSSRSYQDQLYTELWKVCAGPLVEVPRAQERVFYFPQGHMEQLVASTNQGINSEEIPVFDLPPKILCRVLDVTLKAEHETDEVYAQITLQPEEDQSEPTSLDPPIVGPTKQEFHSFVKILTASDTSTHGGFSVLRKHATECLPSLDMTQATPTQELVTRDLHGFEWRFKHIFRGQPRRHLLTTGWSTFVSSKRLVAGDAFVFLRGENGDLRVGVRRLARHQSTMPTSVISSQSMHLGVLATASHAVRTTTIFVVFYKPRISQFIVGVNKYMEAIKHGFSLGTRFRMRFEGEESPERIFTGTIVGSGDLSSQWPASKWRSLQVQWDEPTTVQRPDKVSPWEIEPFLATSPISTPAQQPQSKCKRSRPIEPSVKTPAPPSFLYSLPQSQDSINASLKLFQDPSLERISGGYSSNNSFKPETPPPPTNCSYRLFGFDLTSNSPAPIPQDKQPMDTCGAAKCQEPITPTSMSEQKKQQTSRSRTKVQMQGIAVGRAVDLTLLKSYDELIDELEEMFEIQGQLLARDKWIVVFTDDEGDMMLAGDDPWNEFCKMAKKIFIYSSDEVKKMTTKLKISSSLENEEYGNESFENRSRG

SEQ ID NO: 2401 - DNA, 1221 bp, Arabidopsis thaliana
  G725
cctctttcagagagagaaagagagtcagagagagagagagagagaatgttccatgctaagaaaccttcaagtatgaatggttcatatgagaacagagctatgtgcgttcaaggcgattcaggccttgtcctcaccaccgaccctaaaccgcgtttgcgttggaccgtcgaactccacgagcgttttgtggacgccgtcgctcagctcggcggccccgacaaagcgaccccaaagacgattatgagagttatgggtgtgaagggtcttactctttaccacctaaagagccatcttcagaaattcaggcttggaaagcagccgcacaaggagtacggagatcactccacaaaggaaggttcaagagcttctgccatggatattcagcgcaacgtagcttcttcttctggcatgatgagtcgcaacatgaatgagatgcaaatggaagtgcagagaaggttgcatgaacagctagaggtgcaaagacatctgcaactgaggattgaagcacaaggaaagtacatgcaatctatcttggagagagcttgccaaaccctagccggtgagaacatggcagccgccaccgcagcagccgccgtcggaggaggatacaagggtaatctgggaagttcgagtctttcagcagcggtgggcccacctcctcatcctcttagtttcccgccgtttcaagacctaaacatctatggaaacacaaccgaccaagtcctcgaccatcacaacttccatcatcaaaacatagagaaccatttcacgggtaacaatgctgcagacaccaacatttacttggggaagaagcgacctaatcctaattttggtaacgatgtaaggaaaggactattgatgtggtctgatcaagatcacgatctttccgcaaaccaatcgatcgatgatgagcatagaattcagatacagatggctacacatgtctccacggatttggattctttgtcggagatctacgaaaggaaatcaggtttatcaggtgatgaagggaataatggtgggaaattactggaaaggccatcgcctaggagatcaccattgagtcctatgatgaaccctaatggtggattaatacaaggaagaaactcgccatttgggtgatacaatttattaatttttatctatgagtgatgcatgggaatgtaagaacgagatatatatgttttgtcattgtgagtttgacgtagggtttagagaaaa

SEQ ID NO: 2402 - protein, 358 aa, Arabidopsis thaliana
  G725
MFHAKKPSSMNGSYENRAMCVQGDSGLVLTTDPKPRLRWTVELHERFVDAVAQLGGPDKATPKTIMRVMGVKGLTLYHLKSHLQKFRLGKQPHKEYGDHSTKEGSRASAMDIQRNVASSSGMMSRNMNEMQMEVQRRLHEQLEVQRHLQLRIEAQGKYMQSILERACQTLAGENMAAATAAAAVGGGYKGNLGSSSLSAAVGPPPHPLSFPPFQDLNIYGNTTDQVLDHHNFHHQNIENHFTGNNAADTNIYLGKKRPNPNFGNDVRKGLLMWSDQDHDLSANQSIDDEHRIQIQMATHVSTDLDSLSEIYERKSGLSGDEGNNGGKLLERPSPRRSPLSPMMNPNGGLIQGRNSPFG

SEQ ID NO: 2403 - DNA, 2007 bp, Arabidopsis thaliana
  G727
cttcttctccttctctgatcgttcgttttctggacgagagagatggtaaatccgggtcacggaagaggacccgattcgggtactgctgctggtgggtcaaactccgacccgtttcctgcgaatcttcgagttcttgtcgttgatgatgatccaacttgtctcatgatcttagagaggatgcttatgacttgtctctacagagagcagagagcgcattgtctctgcttcggaagaacaaagaatggttttgatattgtcattagtgatgttcatatgcctgacatggatggtttcaagctccttgaacacgttggtttagagatggatttacctgttatcaatctgaatgttttgaaacctttggttatagtgatgtctgcggatgattcgaagagcgttgtgttgaaaggagtgactcacggtgcagttgattacctcatcaaaccggtacgtattgaggctttgaagaatatatggcaacatgtggtgcggaagaagcgtaacgagtggaatgtttctgaacattctggaggaagtattgaagatactggcggtgacagggacaggcagcagcagcatagggaggatgctgataacaactcgtcttcagttaatgaagggaacgggaggagctcgaggaagcggaaggaagaggaagtagatgatcaaggggatgataaggaagactcatcgagtttaaagaaaccacgcgtggtttggtctgttgaattgcatcagcagtttgttgctgctgtgaatcagctaggcgttgacagtgagttaaaaacttgcttgcttatgcatttgtgtgtgtcgattggtaacattgtggaattccagaagtatcggatatatctgagacggcttggaggagtatcgcaacaccaaggaaatatgaaccattcgtttatgactggtcaagatcagagttttggacctctttcttcgttgaatggatttgatcttcaatctttagctgttactggtcagctccctcctcagagccttgcacagcttcaagcagctggtcttggccggcctacactcgctaaaccagggatgtcggtttctccccttgtagatcagagaagcatcttcaactttgaaaacccaaaaataagatttggagacggacatggtcagacgatgaacaatggaaatttgcttcatggtgtcccaacgggtagtcacatgcgtctgcgtcctggacagaatgttcagagcagcggaatgatgttgccagtagcagaccagctacctcgaggaggaccatcgatgctaccatccctcgggcaacagccgatattgtcaagcagcgtttcaagaagaagcgatctcactggtgcgctggcggttagaaacagtatccccgagaccaacagcagagtgttaccaactactcactcggtcttcaataacttccccgcggatctacctcgcagcagcttcccgttggcaagtgccccagggatttcagttccagtatcagtttcttaccaagaagaggtcaacagctcggatgcaaaaggaggttcatcagctgctactgctggatttggtaacccaagctacgacatatttaacgattttccgcagcaccaacagcacaacaagaacatcagcaataaactaaacgattgggatctgcggaatatgggattggtcttcagttccaatcaggacgcagcaactgcaaccgcaaccgcagcattttccacttcggaagcatactcttcgtcttctacgcagagaaaaagacgggaaacggacgcaacagttgtgggtgagcatgggcagaacctgcagtcaccgagccggaatctgtatcatctgaaccacgtttttatggacggtggttcagtcagagtgaagtcagaaagagtggcggagacagtgacttgtcctccagcaaatacattgtttcacgagcagtataatcaagaagatctgatgagcgcatttctcaaacaggtttgattattactcgaatacagtgcactctaaaac

(The sequence listing continues in the following parts.)

What is claimed is:

1. A method for producing a transgenic plant having greater yield, wherein the method comprises:
   (a) providing a nucleic acid construct comprising a recombinant polynucleotide encoding a polypeptide that has a conserved domain that is at least 70% identical to amino acids 34-70 of SEQ ID NO: 38, wherein the polypeptide is at least 58% identical to the full length sequence of SEQ ID NO: 38;
   (b) introducing the nucleic acid construct into a plant to produce a transgenic plant overexpressing said polypeptide;
   (c) exposing the transgenic plant to a cold stress, a hyperosmotic stress, or a nitrogen-limited condition; and
   (d) selecting a transgenic plant that has greater yield relative to a control plant not comprising said recombinant polynucleotide.

2. The method of claim 1, wherein the polypeptide has a conserved domain that is at least 86% identical to amino acids 34-70 of SEQ ID NO: 38; and wherein the polypeptide is at least 78% identical to the full length sequence of SEQ ID NO: 38.

3. The method of claim 1, the method steps further comprising:
   (d) crossing the transgenic plant with itself or another plant; and
   (e) selecting a transgenic seed that develops as a result of said crossing; and
   (f) growing a progeny plant from the transgenic seed, thus producing a transgenic progeny plant having greater yield relative to the control plant, and wherein the progeny plant comprises said recombinant polynucleotide.

4. The method of claim 1, wherein the polypeptide that has a conserved domain that is at least 83% identical to amino acids 34-70 of SEQ ID NO: 38; and wherein the polypeptide is at least 80% identical to the full length sequence of SEQ ID NO: 38.

5. A method for producing a transgenic plant having greater yield, wherein the method comprises the steps of:
(a) providing a nucleic acid construct comprising a recombinant polynucleotide encoding a polypeptide that is at least 90% identical to the full length sequence of SEQ ID NO: 38;
(b) introducing the nucleic acid construct into a plant to produce a transgenic plant overexpressing said polypeptide;
(c) exposing the transgenic plant to a cold stress, a hyperosmotic stress, or a nitrogen-limited condition; and
(d) selecting a transgenic plant that has greater yield relative to a control plant not comprising said recombinant polynucleotide.

6. A method for producing a transgenic plant having greater yield, wherein the method comprises the steps of:
(a) providing a nucleic acid construct comprising a recombinant polynucleotide encoding a polypeptide that has a conserved domain that is at least 70% identical to amino acids 34-70 of SEQ ID NO: 38, wherein the polypeptide is at least 58% identical to the full length sequence of SEQ ID NO: 38;
(b) introducing the nucleic acid construct into a plant to produce a transgenic plant overexpressing said polypeptide; and
(c) selecting a transgenic plant that has glabrous leaves, reduced trichome density, or increased number of root hairs relative to a control plant not comprising said recombinant polynucleotide, wherein the transgenic plant has greater yield relative to the control plant.

7. The method of claim 6, wherein the polypeptide that has a conserved domain that is at least 83% identical to amino acids 34-70 of SEQ ID NO: 38; wherein the polypeptide is at least 80% identical to the full length sequence of SEQ ID NO: 38.

8. The method of claim 6, wherein the polypeptide that has a conserved domain that is at least 86% identical to amino acids 34-70 of SEQ ID NO: 38, and wherein the polypeptide is at least 78% identical to the full length sequence of SEQ ID NO: 38.

9. The method of claim 8, wherein the recombinant polynucleotide encodes a polypeptide that is at least 90% identical to the full length sequence of SEQ ID NO: 38.

* * * * *